(12) United States Patent
Guccione et al.

(10) Patent No.: US 12,188,016 B2
(45) Date of Patent: Jan. 7, 2025

(54) ANTISENSE OLIGONUCLEOTIDES FOR MODULATING THE FUNCTION OF A T CELL

(71) Applicants: AGENCY FOR SCIENCE, TECHNOLOGY AND RESEARCH, Singapore (SG); LION TCR PTE. LTD., Singapore (SG)

(72) Inventors: Ernest Guccione, Singapore (SG); Dave Keng Boon Wee, Singapore (SG); Antonio Bertoletti, Singapore (SG)

(73) Assignees: AGENCY FOR SCIENCE, TECHNOLOGY AND RESEARCH, Singapore (SG); LION TCR PTE. LTD., Singapore (SG)

( * ) Notice: Subject to any disclaimer, the term of this patent is extended or adjusted under 35 U.S.C. 154(b) by 643 days.

(21) Appl. No.: 16/626,395

(22) PCT Filed: Jun. 27, 2018

(86) PCT No.: PCT/SG2018/050313
§ 371 (c)(1),
(2) Date: Dec. 24, 2019

(87) PCT Pub. No.: WO2019/004939
PCT Pub. Date: Jan. 3, 2019

(65) Prior Publication Data
US 2020/0377883 A1 Dec. 3, 2020

(30) Foreign Application Priority Data
Jun. 27, 2017 (SG) .............................. 10201705285S

(51) Int. Cl.
*C12N 15/11* (2006.01)
*A61K 31/7088* (2006.01)
*A61K 35/17* (2015.01)
*A61P 35/00* (2006.01)
*C12N 15/113* (2010.01)

(52) U.S. Cl.
CPC ........ *C12N 15/113* (2013.01); *A61K 31/7088* (2013.01); *A61K 35/17* (2013.01); *A61P 35/00* (2018.01); *C12N 15/1136* (2013.01); *C12N 15/1138* (2013.01); *C12N 2310/11* (2013.01); *C12N 2310/351* (2013.01); *C12N 2320/33* (2013.01)

(58) Field of Classification Search
CPC .............. C12N 15/113; C12N 2310/11; C12N 2320/33
See application file for complete search history.

(56) References Cited

FOREIGN PATENT DOCUMENTS

| | | | |
|---|---|---|---|
| CN | 103820454 | 5/2014 | |
| EP | 2735568 | 5/2014 | |
| WO | 02/088162 A1 | 11/2002 | |
| WO | 2007056466 | 5/2007 | |
| WO | 2010054267 | 5/2010 | |
| WO | WO-2011029914 A1 * | 3/2011 | ......... C12N 15/1137 |
| WO | 2011120101 | 10/2011 | |
| WO | 2013135830 | 9/2013 | |
| WO | 2014078749 | 5/2014 | |
| WO | 2014/090985 A1 | 6/2014 | |
| WO | 2014184741 | 11/2014 | |
| WO | 2015161276 | 10/2015 | |
| WO | WO-2015161276 A2 * | 10/2015 | ............. A61K 48/00 |
| WO | 2016/138278 A2 | 9/2016 | |
| WO | 2016160721 | 10/2016 | |
| WO | 2016/196388 A1 | 12/2016 | |
| WO | 2017093969 | 6/2017 | |

OTHER PUBLICATIONS

NCBI Reference Sequence NM_005018.3, GenBank, 1997, pp. 1-5 (Year: 1997).*
Sequence listing from WO 2015161276, pp. 1-839 (Year: 2015).*
International Preliminary Report on Patentability issued in PCT/SG2018/050313, dated Sep. 3, 2019, 25 pages.
Bochan, Markian R., W. Scott Goebel, and Zacharie Brahmi. "Stably transfected antisense granzyme B and perforin constructs inhibit human granule-mediated lytic ability." Cellular immunology 164.2 (1995): 234-239.
Acha-Orbea, Hans, et al. "Inhibition of lymphocyte mediated cytotoxicity by perforin antisense oligonucleotides." The EMBO journal 9.12 (1990): 3815-3819.
Spaner, David, et al. "A role for perforin in activation-induced cell death." The Journal of Immunology 160.6 (1998): 2655-2664.
Bertoletti, Antonio, et al. "T cell receptor-therapy in HBV-related hepatocellularcarcinoma." Oncoimmunology 4.6 (2015): e1008354, 1-3. Mar. 19, 2015.
Roth, Evelyn, and Hanspeter Pircher. "IFN-γ promotes Fas ligand- and perforin-mediated liver cell destruction by cytotoxic CD8 T cells." The Journal of Immunology 172.3 (2004): 1588-1594.
Sharpe, Michaela, and Natalie Mount. "Genetically modified T cells in cancer therapy: opportunities and challenges." Disease models & mechanisms 8.4 (2015): 337-350.
Pardee, Angela D., and Lisa H. Butterfield. "Immunotherapy of hepatocellular carcinoma: unique challenges and clinical opportunities." Oncoimmunology 1.1 (2012): 48-55.

(Continued)

*Primary Examiner* — Ekaterina Poliakova-Georgantas
(74) *Attorney, Agent, or Firm* — Meunier Carlin & Curfman LLC

(57) ABSTRACT

The present invention relates to antisense oligonucleotides for modulating the function of a T cell, including antisense oligonucleotides that hybridise to IFN-γ, granzyme, perforin 1, PD-1, PRDM1, PD-L1, CD40LG, NDFIP1, PDCD1 LG2, REL, BTLA, CD80, CD160, CD244, LAG3, TIGIT, ADORA2A & TIM-3 RNAs. In particular, the present invention relates to antisense oligonucleotides capable of inducing exon skipping of RNA. Also claimed is a method for further modifying the specificity of said T-cell by providing for a T cell receptor gene.

Figure 1:
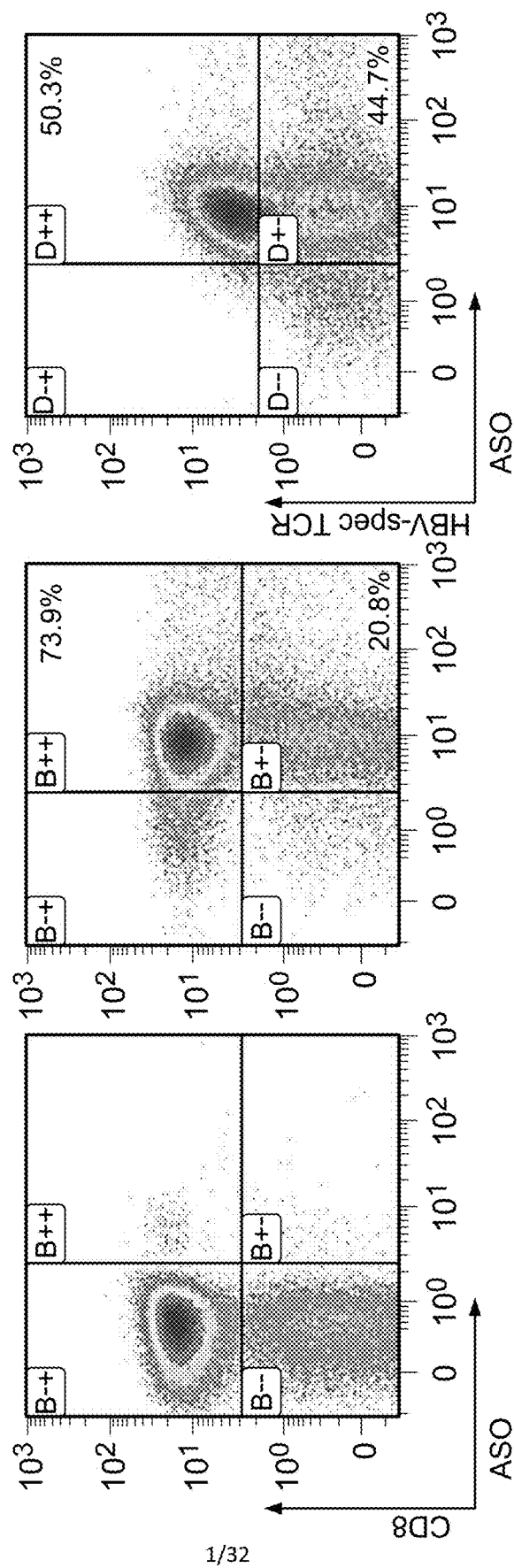

24 Claims, 32 Drawing Sheets
Specification includes a Sequence Listing.

(56) References Cited

OTHER PUBLICATIONS

Kudo, Masatoshi. "Immune checkpoint inhibition in hepatocellular carcinoma: basics and ongoing clinical trials." Oncology 92.Suppl. 1 (2017): 50-62.
International Search Report and Written Opinion issued by the International Searching Authority (ISA/SG) in PCT Application No. PCT/SG2018/050313 on Sep. 14, 2018. 19 pages.
Australian Examination Report issued for Application No. 2018291556, dated Nov. 17, 2020.
Australian Examination Report issued for Application No. 2018291556, dated Nov. 8, 2021.
European Extended Search Report issued for Application No. 18823314.2, dated Jun. 21, 2021.
Śledzińska, Anna, et al. "Negative immune checkpoints on T lymphocytes and their relevance to cancer immunotherapy." Molecular oncology 9.10 (2015): 1936-1965.
Cao, Yang, et al. "Tim-3 expression in cervical cancer promotes tumor metastasis." PloS one 8.1 (2013): e53834.
Beavis, Paul A., et al. "Targeting the adenosine 2A receptor enhances chimeric antigen receptor T cell efficacy." The Journal of clinical investigation 127.3 (2017): 929-941.
Andrews, Lawrence P., et al. "LAG 3 (CD 223) as a cancer immunotherapy target." Immunological reviews 276.1 (2017): 80-96.
Jennifer Couzin-Frankel, "Cancer Immunotherapy," Science vol. 342, No. 6165, December, p. 1432-3, 2013.
K. C. M. Straathof, C. M. Bollard, U. Popat, M. H. Huls, T. Lopez, M. C. Morriss, M. V Gresik, A. P. Gee, H. V Russell, M. K. Brenner, C. M. Rooney, and H. E. Heslop, "Treatment of nasopharyngeal carcinoma with Epstein-Barr virus-specific T lymphocytes," Therapy, vol. 105, No. 5, pp. 1898-1904, 2005.
M. H. Geukes Foppen, M. Donia, I. M. Svane, and J. B. a G. Haanen, "Tumor-infiltrating lymphocytes for the treatment of metastatic cancer," Mol. Oncol., vol. 9, No. 10, pp. 1918-1935, 2015.
W. Qasim and A. J. Thrasher, "Progress and prospects for engineered T cell therapies," Br. J. Haematol., vol. 166, No. 6, pp. 818-829, 2014.
B. Savoldo, C. A. Ramos, E. Liu, M. P. Mims, M. J. Keating, G. Carrum, R. T. Kamble, C. M. Bollard, A. P. Gee, Z. Mei, H. Liu, B. Grilley, C. M. Rooney, H. E. Heslop, M. K. Brenner, and G. Dotti, "CD28 costimulation improves expansion and persistence of chimeric antigen receptor-modified T cells in lymphoma patients," . Clin. Invest., vol. 121, No. 5, pp. 1822-1826, 2011.
L. A. Johnson, R. a Morgan, M. E. Dudley, L. Cassard, J. C. Yang, M. S, U. S. Kammula, R. E. Royal, R. M. Sherry, J. R. Wunderlich, and C. R. Lee, "regression and targets normal tissues expressing cognate antigen Gene therapy with human and mouse T cell receptors mediates cancer regression and targets normal tissues expressing cognate antigen," Hematology, vol. 114, No. 3, pp. 535-547, 2009.
A. J. Gehring, S. A. Xue, Z. Z. Ho, D. Teoh, C. Ruedl, A. Chia, S. Koh, S. G. Lim, M. K. Maini, H. Stauss, and A. Bertoletti, "Engineering virus-specific T cells that target HBV infected hepatocytes and hepatocellular carcinoma cell lines," Hepatol., vol. 55, No. 1, pp. 103-110, 2011.
W. Qasim, M. Brunetto, A. J. Gehring, S.-A. Xue, A. Schurich, A. Khakpoor, H. Zhan, P. Ciccorossi, K. Gilmour, D. Cavallone, F. Moriconi, F. Farzhenah, A. Mazzoni, L. Chan, E. Morris, A. Thrasher, M. K. Maini, F. Bonino, H. Stauss, and A. Bertoletti, "Immunotherapy of HCC metastases with autologous T cell receptor redirected T cells, targeting HBsAg in a liver transplant patient.," J. Hepatol., vol. 62, No. 2, pp. 486-491, 2015.
S. Koh, N. Shimasaki, R. Suwanarusk, Z. Z. Ho, A. Chia, N. Banu, S. W. Howland, A. S. M. Ong, A. J. Gehring, H. Stauss, L. Renia, M. Sallberg, D. Campana, and A. Bertoletti, "A practical approach to immunotherapy of hepatocellular carcinoma using T cells redirected against hepatitis B virus.," Mol. Ther. Nucleic Acids, vol. 2, No. August, p. el 14, 2013.
E. J. Wherry, S. J. Ha, S. M. Kaech, W. N. Haining, S. Sarkar, V. Kalia, S. Subramaniam, J. N. Blattman, D. L. Barber, and R. Ahmed, "Molecular Signature of CD8+ T Cell Exhaustion during Chronic Viral Infection," Immunity, vol. 27, No. 4, pp. 670-684, 2007.
P. A. Morcos, "Achieving targeted and quantifiable alteration of mRNA splicing with Morpholino oligos," Biochem. Biophys. Res. Commun., vol. 358, No. 2, pp. 521-527, 2007.
G. Schmajuk, H. Sierakowska, and R. Kole, "Antisense Oligonucleotides with Different Backbones," J. Biol. Chem., vol. 274, No. 31, pp. 21783-21789, 1999.
E. M. McNally and E. J. Wyatt, "Welcome to the splice age: Antisense oligonucleotide-mediated exon skipping gains wider applicability," . Clin. Invest., vol. 126, No. 4, pp. 1236-1238, 2016.
A Phase I/IIa Clinical Trial in Duchenne Muscular Dystrophy Using Systemically Delivered Morpholino Antisense Oligomer to Skip Exon 53 (SKIP-NMD). (2015). Human Gene Therapy Clinical Development, 26(2), 92-95. doi:10.1089/humc.2015.2528.
Goemans, N. M., Tulinius, M., van den Akker, J. T., Burm, B. E., Ekhart, P. F., Heuvelmans, N., . . . van Deutekom, J. C. (2011). Systemic Administration of PRO051 in Duchenne's Muscular Dystrophy. New England Journal of Medicine, 364(16), 1513-1522. doi:10.1056/nejmoa1011367.
N. J. Gogtay and K. Sridharan, "Therapeutic Nucleic Acids: Current clinical status.," Br. J. Clin. Pharmacol., pp. 1-14, 2016.
J. Jo, U. Aichele, N. Kersting, R. Klein, P. Aichele, E. Bisse, A. K. Sewell, H. E. Blum, R. Bartenschlager, V. Lohmann, and R. Thimme, "Analysis of CD8+ T-Cell-Mediated Inhibition of Hepatitis C Virus Replication Using a Novel Immunological Model," Gastroenterology, vol. 136, No. 4, pp. 1391-1401, 2009.
A. J. Davenport, M. R. Jenkins, R. S. Cross, C. S. Yong, H. M. Prince, D. S. Ritchie, J. a Trapani, M. H. Kershaw, P.K. Darcy, and P.J. Neeson, "CAR-T Cells Inflict Sequential Killing of Multiple Tumor Target Cells.," Cancer Immunol. Res., vol. 3, No. 5, pp. 483-494, 2015.

* cited by examiner

A

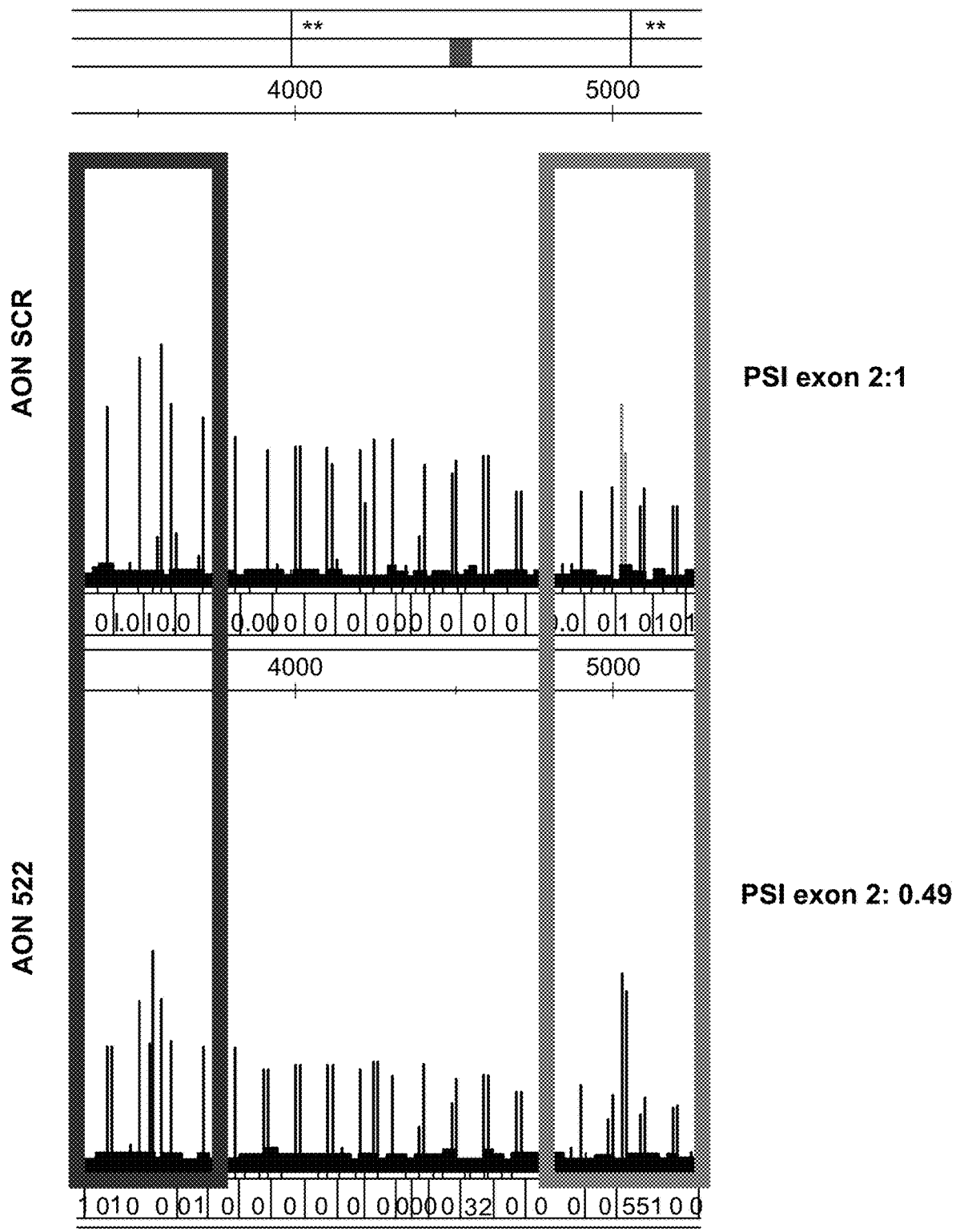

| | | |
|---|---|---|
| 0218_1173_2OM_E3 | CTLA4 | 5' - mG*mG*mA*mA*mG*mU*mC*mA*mA*mG*mA*mU*mG*mG*mG*mC*mA*mC*mA*mG*mG*mG*mU - 3' |
| 0218_1174_2OM_E3 | CTLA4 | 5' - mU*mA*mA*mC*mC*mU*mG*mC*mG*mU*mG*mC*mC*mC*mA*mU*mG*mG*mA*mG*mA*mG*mG - 3' |
| 1117_930_2OM_E2 | ADORA2A | 5' - mG*mG*mC*mG*mC*mG*mU*mC*mU*mG*mG*mC*mC*mU*mU*mU*mU*mC - 3' |
| 1117_931_2OM_E2 | ADORA2A | 5' - mG*mC*mA*mU*mC*mA*mC*mC*mA*mG*mG*mC*mA*mG*mG*mG*mC*mA*mG*mG*mG*mU - 3' |
| 0817_887_2OM_E3 | PD-1 | 5' - mG*mA*mC*mA*mC*mC*mA*mC*mC*mA*mG*mG*mU*mU*mU*mG*mG - 3' |
| 0817_888_2OM_E3 | PD-1 | 5' - mC*mG*mG*mC*mC*mG*mG*mA*mG*mU*mG*mG*mG*mG - 3' |
| 0817_889_2OM_E4 | PD-1 | 5' - mA*mU*mG*mG*mU*mC*mU*mC*mA*mA*mA*mC*mA*mC*mA*mC*mC*mA*mU*mU*mG*mG - 3' |
| 0817_890_2OM_E4 | PD-1 | 5' - mA*mC*mU*mG*mA*mC*mU*mC*mA*mG*mG*mG*mG*mG*mC*mU*mG - 3' |

Figure 24

ANTISENSE OLIGONUCLEOTIDES FOR MODULATING THE FUNCTION OF A T CELL

REFERENCE TO SEQUENCE LISTING

The Sequence Listing submitted Aug. 5, 2020, as a text file named "007593981_final_ST25.txt" created on Aug. 5, 2020, and having a size of 15.9 MB is hereby incorporated by reference pursuant to 37 C.F.R. § 1.52 (e) (5).

The present invention relates to antisense oligonucleotides. In particular, the present invention relates to antisense oligonucleotides capable of inducing exon skipping. More particularly, the present invention relates to the use of such antisense oligonucleotides in the field of immunotherapy, specifically to that of immunotherapy directed against tumours and/or viral infections (such as Hepatitis B induced Hepatocellular Carcinoma, EBV induced NKT cell Lymphmas and other chronic infections such as chronic HBV infection and human cytomegalovirus infection etc.).

It is here shown that direct and selective downregulation of immune-related or immunomodulatory genes expressed by T cells (e.g. by Antisense OligoNucleotide (ASO)-mediated exon skipping or intron retention), leads to modulation of T cell functions (such as increased expansion, ability to kill or production of antiviral cytokines).

Cancer immunotherapy has been declared "Breakthrough of the year 2013" by the journal Science [1]. The statement made by the editors is justified by several promising clinical trials that are currently ongoing and by the wish to acknowledge a new paradigm shift: the therapy is now directed towards the immune system, rather than against the tumor [2]. The change of strategy is supported by failures from various other approaches and by new findings that lead to define 'immune evasion" as a novel hallmark of cancer. In fact, new progresses in the field have demonstrated that the immune system is actively playing a role in surveillance and tumor eradication, as cancer cells often have modified molecules on their surface that can be potentially detected (tumor-associated antigens), leading to their elimination. Nonetheless, cancer often is able to evade the inspection or silence the immune response. Thus, the restoration of a functional and prompt immune anti-tumoral activity could serve as an improvement in the long-unresolved battle against cancer.

One of the first approaches of immunotherapy consisted in the administration of cytokines (e.g. IL-2) able to stimulate the immune system, while nowadays both adoptive T-cell transfer and immune checkpoint blockade are widely used [3]. Adoptive T-cell transfer is the administration of engineered lymphocytes into a patient and the engineering process aims at T-cell activation and/or redirection against the tumor-associated antigens. Various proof-of-concept studies have already revealed the potential of engineered T-cells in adoptive transfer therapy and the key idea is the redirection of T-cell specificity through the transfer of antigen receptor genes. Few strategies have been developed in the past couple of decades and they involve recombinant variants of conventional T-cell receptors (TCRs), or composites of antibody-like receptor chains linked to transmembrane and activation domains (CARs) [4].

Chimeric antigen receptors (CARs) are made of three functional units: an extracellular domain for the antigen recognition, a transmembrane anchor and an intracellular signalling domain [5]. The first is an antibody-like single chain, whose main advantages are the strength in the antigen binding (many fold higher than conventional T-cell receptors) and the fact that the recognition is not HLA-restricted or dependent on antigen presentation pathways on antigen presenting cells (APCs). The signalling domain is instead derived from elements of CD3f in combination with a costimulatory domain. CARs have evolved significantly over the past few decades and many studies are ongoing and giving encouraging results; however at present only few specific targets have been identified and, moreover, these receptors might be immunogenic, due to their non-physiological nature.

The T-cell receptors (TCR) used for adoptive immune therapy are constituted by physiological αβ heterodimers engineered to avoid the dimerization with the endogenous TCR chains and they are expressed with signalling elements of the CD3 complex [6]. TCRs bind to antigens presented on their surface in combination with a MHC-I (Major Histocompatibility Complex-I) molecule. This approach is limited to settings where TCR against a MHC-I/peptide complex have already been isolated and characterized from antigen-specific T-cells, and it relies on the presentation pathways of cancer cells. However, in contrast to CARs, TCRs possess physiological structures that are non-immunogenic and their activity in vivo is already known in physiological conditions.

In the context of chronic Hepatitis B or Hepatitis B virus (HBV)-related hepatocellular carcinoma (HCC), adoptive T-cell therapy has shown positive results. In particular, T-cells transduced with a viral vector expressing a HLA-restricted HBV-specific TCR are able to recognize peptides derived from the core and the envelope proteins of the virus presented in association with a MHC-I molecule [7]. The recognition induces an activation of the HBV-specific T-cells that results in the lysis of HBV infected cells. Moreover, the same cells were successfully used in a patient with HBsAg positive HCC relapses [8]. The HBV-specific TCR-redirected T-cells infused in the patient were able to proliferate in vivo, and in vitro tests confirmed their specificity and their activation status. The immunotherapy induced a drop of HBsAg levels after 4 weeks of treatment together with an increase in T-cell chemokines and ALT (alanine transaminase, a marker of hepatocyte lysis).

However, the use in therapy of stably retro or lentiviral-transduced cells may raise concerns from two different points of view: first of all, the risk of insertional mutagenesis can never be totally excluded; second, the presence of high quantities of HBV-targeting T-cells can lead to hepatotoxicity, as up to 90% of the liver of chronic patients could be infected by the virus. Various strategies are being investigated, and one of them is the transfection of the mRNA coding for the HBV-specific TCR via electroporation; this method eliminates the use of the lentiviral system and, moreover, it leads to a transient expression of the TCR. T-cells electroporated with a mRNA coding the α/β chains of a HBV-specific TCR can express the T-cell receptor at higher frequency compared to those transfected with a retro- or lentiviral system [9]. These electroporated cells were able to lyse the antigen-expressing targets in vitro, and to block tumor growth in a mouse PDX model. The advantages of this method are the high transfection rate and transient expression of the TCR. The last point might be seen as a disadvantage, requiring multiple infusions of the transfected T-cells to the patient, but safety-wise the improvement is significant, since the HBV specificity will be lost after a few days, limiting liver damage.

Given the possibility to modify the specificity of T-cell, we asked whether it would be possible to additionally modify their function. For example, it could be beneficial to enhance the ability of T-cells to fight cancer cells by blocking the immune checkpoint molecules that lead T-cells to be deleted or exhausted in the tumor microenvironment, such as PD-1 and CTLA-4 [10]. Alternatively it could be important to have T cells that have a reduced killing capacity, limiting their potential toxic side effects (e.g. by downregulating the levels of Perforin or Granzyme). Among the different strategies commonly used to modify cellular expression (CRISPR/Cas9-mediated, TALEN-mediated, RNA-interference), we chose to use the antisense technology via the AntiSense Oligonucleotides (ASOs) [11]. The ASOs are short oligomers (about 25/30 bases long) of chemically modified RNA that are able to anneal to the pre-mRNA of the target genes and interfere with their physiological splicings [12]. ASOs need to be chemically modified to improve their resistance to nucleases and provide favourable pharmacokinetic and pharmacodynamic properties for in vivo use. ASOs are designed to anneal to the pre-mRNA at specific sites in order to mask the cis-elements required for a correct splicing, therefore altering the interaction between the target pre-mRNA and the splicing machinery. As a consequence, this will lead to substantial defects in the processed mRNA that will eventually affect its stability and translation. This mechanism can be exploited to obtain knockdown of the function of an undesired gene, by inducing the exclusion from the mature mRNA of an exon that is fundamental for the function or the stability of the protein. The elimination could in fact lead to the creation of mRNA isoforms that encode non-functional proteins or trigger nonsense-mediated decay (NMD) of the mRNA [13].

In the past few years, antisense-mediated splicing modulation has advanced steadily and has been developed from preclinical models into the clinical trial phase for Duchenne muscular dystrophy and spinal muscular atrophy, showing remarkable results, preparing the ground for more exciting advances in genetic therapy [14] [15]. Other methods, such as RNA interference or translation inhibition, could be used if simple knockdown is desired, but it has been demonstrated that ASOs have less off-target effects and higher in vivo stability, making them more suitable and appealing for clinical development [16].

Antisense oligonucleotides (ASOs) that interfere with the splicing of granzyme B and perforin pre-mRNAs were designed and introduced in human lymphocytes in combination with mRNA coding for the V alpha/beta chains of HBV-specific T-cells. The efficiency of ASOs to modify the cytotoxic T-cell function of TCR-redirected T-cells was analysed. We demonstrated that 24 hours after the electroporation 50% of the lymphocytes express the HBV-specific TCR and show significant alteration of the ASO-targeted mRNAs. At the protein level, HBV-specific TCR-redirected T-cells showed a reduction of 40% in perforin expression. Consequently, the knock down of perforin lead to a decrease of 35% in the T-cell ability to lyse HBV-infected targets. However, no impairment of the antiviral activity was detected together with the decrease in cytotoxicity.

In conclusion, we demonstrated that we are able to transiently redirect the antigen specificity of T-cells for recognition of specific viral antigens and simultaneously modulate their function. After having proven the efficiency of the method with few proof-of-concept experiments, we aim to modify TCR-redirected T-cells in order to increase their efficacy in tumor microenvironments. In summary, our results look promising for the design of more efficient effectors that could be more safely applied in targeted and personalized treatments of tumors and chronic viral infections.

The present invention provides direct and selective modulators of T cell functions. With direct, it is meant that we will directly modulate the expression or splicing of key genes involved in T cell functionality. With selective, it is meant that the modulation is sequence specific and does not modulate the expression or splicing of other mRNAs. This is important to prevent unwanted side effects (i.e. iatrogenic effects caused by the therapy), given that aberrant modulation of splicing might be associated with pathologies (e.g. cancer). This is equivalent as saying that methods of treating cancer in a subject are provided, comprising a step of administering TCR-redirected T cells modified ex vivo in their functions (e.g. ability to kill target cells, or to inhibit viral replication). Such modification of functions may be achieved by administering ex vivo Antisense Oligonucleotides to T cells.

According to particular embodiments, the cancer expresses a specific antigen, which can be targeted by TCR-redirected T cells (e.g. a viral HBV protein). According to particular embodiments expression of a specific antigen means it can be detected by sequencing methods. According to particular embodiments, the cancer is selected from the group of virally induced or expressing cancers (e.g. HBV induced HCC, EBV induced NKT Lymphoma). Although any direct and selective modulator of T cell functions can be suitable for the methods taught herein (e.g. small molecules, lentiviral- or retroviral based shRNA or CRISPR vectors) it is particularly envisaged that the T cell modulator acts at the RNA level. More specifically, the inhibitor is an antisense oligonucleotide (ASO). The antisense oligonucleotides should affect the expression or splicing of genes important for T cell functions (e.g. IFNgamma, Perforin, Granzyme, PD-1). Even more particularly envisaged is an antisense oligonucleotide that induces exon skipping. Most particularly, the exon that is skipped is either exon 2 or 3 for IFNgamma, exon 2b for Perforin, exon 3 for Granzyme, exon 2 for PD-1 Accordingly, also provided herein are antisense oligonucleotides that induce exon skipping in the afore mentioned transcripts. Such antisense oligonucleotides are also provided for use as a medicament. Particularly, they are provided for cancer immunotherapy. The ASOs may be used as a single agents, or simultaneously electroporated into T-cells to modify their functions.

The listing or discussion of an apparently prior-published document in this specification should not necessarily be taken as an acknowledgement that the document is part of the state of the art or is common general knowledge.

Any document referred to herein is hereby incorporated by reference in its entirety.

The disclosure is directed to one or more antisense polynucleotides and their use in pharmaceutical compositions in a strategy against tumors and/or viral infections (such as Hepatitis B induced Hepatocellular Carcinoma, EBV induced NKT cell Lymphmas etc.). It is here shown that direct and selective downregulation of immune-related or immunomodulatory genes expressed by T cells (e.g. by Antisense OligoNucleotide (ASO)-mediated exon skipping or intron retention), leads to modulation of T cell functions (such as direct inhibition of viral replication or selective killing of cells expressing a targeted antigen).

In a first aspect of the present invention, there is provided an antisense oligonucleotide that modulates the function of a T-cell.

By the term "modulating the function", it is meant to include any inhibition or an increase of the activity of . . . includes inhibition, decrease, regulation or enhancing of a function of a T cell, e.g. a T cell's response in a human, a T cell's interaction with a target etc. In various embodiments, the antisense oligonucleotide modulates one or more of T-cell expansion, T-cell ability to kill or produce an anti-viral cytokines.

The activity of a T cell may be measured using any suitable in vitro, cellular or in vivo assay, by at least 1%, preferably at least 5%, such as at least 10% or at least 25%, for example by at least 50%, at least 60%, at least 70%, at least 80%, or 90% or more, compared to activity of T cell that is not transfection by an ASO of the present invention, in the same assay under the same conditions but without the presence of the an ASO sequence. As will be clear to the skilled person, "modulating" may also involve effecting a change (which may either be an increase or a decrease) in affinity, avidity, specificity and/or selectivity of the T-cell receptor, for one or more of its targets, ligands, receptors or substrates. As will be clear to the skilled person, this may again be determined in any suitable manner and/or using any suitable assay known per se, such as the assays described herein or in the prior art cited herein.

"Modulating" may also mean effecting a change (i.e. an activity as an agonist or as an antagonist, respectively) with respect to one or more biological or physiological mechanisms, effects, responses, functions, pathways or activities in which the T-cell receptor and their targets are involved, such as its signaling pathway or metabolic pathway and their associated biological or physiological effects. Again, as will be clear to the skilled person, such an action as an agonist or an antagonist may be determined in any suitable manner and/or using any suitable (in vitro and usually cellular or in assay) assay known per se. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of an ASO of the invention.

In some embodiments, the antisense oligonucleotide modulates one or more of activity, or level of expression of an immune-related or immunomodulatory genes expressed by the T-cell, with the proviso that the gene is not a CTLA4 gene. The level of expression includes modulation of splicing to alter isoform expression of the immune-related or immunomodulatory gene.

In other embodiments, the antisense oligonucleotide modulates the function of the T cell by blocking an immune checkpoint molecule. The immune checkpoint molecule may be PD-1.

In other embodiments, the level of expression is one of directly or selectively downregulating the immune-related or immunomodulatory gene. The oligonucleotide specifically hybridises to a target region of the immune-related or immunomodulatory gene's pre-mRNA or mature mRNA, the gene may be any one selected from the group comprising: IFN-γ, Granzyme, Perforin1, PD-1, PRDM1, PD-L1, CD40LG, NDFIP1, PDCD1LG2, REL, BTLA, CD80, CD160, CD244, LAG3, TIGIT and TIM-3.

By "hybridisation" means an interaction between two or three strands of nucleic acids by hydrogen bonds in accordance with the rules of Watson-Crick DNA complementarity, Hoogstein binding, or other sequence specific binding known in the art. Hybridisation can be performed under different stringency conditions known in the art. "Specifically hybridises," as used herein, is hybridization that allows for a stabilized duplex between polynucleotide strands that are complementary or substantially complementary. For example, a polynucleotide strand having 21 nucleotide units can base pair with another polynucleotide of 21 nucleotide units, yet only 19 bases on each strand are complementary or substantially complementary, such that the "duplex" has 19 base pairs. The remaining bases may, for example, exist as 5' and/or 3' overhangs. Further, within the duplex, 100% complementarity is not required; substantial complementarity is allowable within a duplex. Substantial complementarity refers to 75% or greater complementarity. For example, a mismatch in a duplex consisting of 19 base pairs results in 94.7% complementarity, rendering the duplex substantially complementary.

In an embodiment, the oligonucleotide specifically hybridises to an exon, intron or exon-intron boundary target region of an IFN-γ RNA, the target region is any one selected from the group comprising: exon 1 and exon 2.

In other embodiments, the oligonucleotide specifically hybridises to an exon, intron or exon-intron boundary target region of a Perforin, the target region is exon 2b.

In other embodiments, the oligonucleotide specifically hybridises to an exon, intron or exon-intron boundary target region of a Granzyme RNA, the target region is exon 3.

In other embodiments, the oligonucleotide specifically hybridises to an exon, intron or exon-intron boundary target region of a PD-1 RNA, the target region is exon 2.

The antisense oligonucleotide of the present invention may comprise a sequence selected from any one of SEQ ID NOs: 1 to 69575.

As will be discussed later, the sequences of the oligonucleotides (AONs) of the present invention may be modified. An example of the modified sequences is shown in FIG. 24.

In an embodiment, the 35 sequences used in the present invention are sent out in the Table 1 below.

TABLE 1

| | | |
|---|---|---|
| 0615_263_2OM_E2 | IFNG | 5'-GUU CCA UUA UCC GCU ACA UCU GAA UGA CCU GC-3' |
| 0615_264_2OM_E3 | IFNG | 5'-UUU GAA GUA AAA GGA GACAAU UUG GCU CUG CAU U-3' |
| 0615_265_2OM_E3 | IFNG | 5'-UUU UGG AUG CUC UGG UCA UCU UUA AAG UUU UUA-3' |
| 0615_266_2OM_E3 | GZMB | 5'-UAU UGU GGG CCC CCA AGG UGA CAU UUA UG-3' |
| 0615_267_2OM_E3 | GZMB | 5'-UAA ACU GCU GGG UCG GCU CCU GUU CUU UGA-3' |
| 0615_268_2OM_E2b | PFF1 | 5'-UGU AGG GCA UUU UCA CAG AGG GUG CAG GU-3' |
| 0615_269_2OM_E2b | PFF1 | 5'-AUG CCC AGG AGG AGC AGA CGG GCU GCC AUG-3' |
| 0915_315_2OM_E2 | PD-1 | 5'-GUU CCA GGG CCU GUC UGG GG-3' |

TABLE 1-continued

| | | |
|---|---|---|
| 0915_316_2OM_E2 | PD-1 | 5'-AGG GCU GGG GAG AAG GUG GGG-3' |
| 0915_317_2OM_E2 | PD-1 | 5'-AGU UUA GCA CGA AGC UCU CCG AUG UGU-3' |
| 0915_318_2OM_E3 | PD-L1 | 5'-CAC AUA UAG GUC CUU GGG AAC CGU GA-3' |
| 0915_319_2OM_E4 | PD-L1 | 5'-CAG UUC AUG UUC AGA GGU GAC UGG AUCC-3' |
| 0316_442_2OM_E4 | PFDM1 | 5'-AGG UUU UGC UCC CGG GGA GAG U-3' |
| 0316_443_2OM_E4 | PFDM1 | 5'-GGU GAA GCU CCC CUC UGG AAU AGA U-3' |
| 0316_444_2OM_E4 | PFDM1 | 5'-AUG GUG UAG AAG UAG AUG UUC AUC UGC UU-3' |
| 0316_447_2OM_E3 | CD40LG | 5'-UGU UUU CUU UCU UCG UCU CCU CUU UGU UU-3' |
| 0316_448_2OM_E2 | CTLA4 | 5'-AAG GUC AAC UCA UUC CCC AUC AUG UAG GUU G-3' |
| 0316_449_2OM_E2 | CTLA4 | 5'-GUG GCU UUG CCU GGA GAU GCA UA-3' |
| 0316_450_2OM_E2 | CTLA4 | 5'-UUG CCG CAC AGA CUU CAG UCA C-3' |
| 0316_451_2OM_E2 | CTLA4 | 5'-AUG CAU ACU CAC ACA CAA AGC UGG-3' |
| 0316_452_2OM_E3 | NDRP1 | 5'-AUA ACU GGG CAG UGU UGU AGC UAC AUU G-3' |
| 0316_453_2OM_E3 | NDRP1 | 5'-UGG AAA CCC AGA CUC AUC CUU GUA GU-3' |
| 0316_457_2OM_E3 | PDOD1LG2 | 5'-UCC AGU GUC AAA GUU GCA UUC CAG GGU-3' |
| 0316_458_2OM_E4 | PDOD1LG2 | 5'-UCA UCU GUU UCU GGA ACC UUU AGG AUG UGA GU-3' |
| 0316_462_2OM_E2 | FEL | 5'-GGG UUG UUC AAU UAU CUC UAU AUA AGG GU-3' |
| 0316_463_2OM_E3 | FEL | 5'-GGU UUA UAU GGG UCA UUC UUU GUU ACU AA-3' |
| 0316_464_2OM_E3 | FEL | 5'-UAG UAG CCG UCU CUG GAG UCU UUU C-3' |
| 0616_520_2OM_E2 | BTLA | 5'-UGC UAA GAU GGA GUG UUC AGA UUG UCU CUU UAU A-3' |
| 0616_521_2OM_E4 | BTLA | 5'-AAU UUC CCU UCC UGC UGU GUC AGA GAG-3' |
| 0616_522_2OM_E2 | CD80 | 5'-UGG GUC UCC AAA GGU UGU GGA UUU AGU UU-3' |
| 0616_523_2OM_E3 | CD160 | 5'-AAC UUG AAG CAA AUG UUG GCU CUG CUG GUA-3' |
| 0616_524_2OM_E5 | CD244 | 5'UCG UAA AUU GUC AAA AUC CUU GGA CUG GUC U-3' |
| 0616_525_2OM_E2 | LAG3 | 5'-GAG AUC CUG GAG GGG GAU UGU GG-3' |
| 0616_526_2OM_E3 | TIGIT | 5'-AAU GGA AUC UGG AAC CUG GCA CCG U-3' |
| 0616_527_2OM_E4 | TIM-3 | 5'-AUU UAU AUC AGG GAG GCU CCC CAG UG-3' |

Table 2 sets out the corresponding SEQ ID Nos set out in the sequence listing that corresponds to the sequences of Table 1.

TABLE 2

| Sequence Listing | SEQ ID Nos. in Table 1 | SEQ ID Nos. set out in sequence listing |
|---|---|---|
| guuccauuauccgcuacaucugaaugaccugc | 1 | 7274 |
| uuugaaguaaaaggagacaauuuggcucugcauu | 2 | 7970 |
| uuuuggaugcucuggucaucuuuaaaguuuuua | 3 | 8521 |
| uauugugggccccccaaggugacauuuaug | 4 | 11414 |
| uaaacugcugggucggcuccuguucuuuga | 5 | 11514 |

TABLE 2-continued

| Sequence Listing | SEQ ID Nos. in Table 1 | SEQ ID Nos. set out in sequence listing |
|---|---|---|
| uguagggcauuuucacagagggugcaggu | 6 | 15372 |
| augcccaggaggagcagacgggcugccaug | 7 | 15458 |
| guuccagggccugucugggg | 8 | 3680 |
| agggcuggggagaagguggggg | 9 | 3817 |
| aguuuagcacgaagcucuccgaugugu | 10 | 3877 |
| cacauauagguccuugggaaccguga | 11 | 19411 |

TABLE 2-continued

| Sequence Listing | SEQ ID Nos. in Table 1 | SEQ ID Nos. set out in sequence listing |
|---|---|---|
| caguucauguucagaggugacuggaucc | 12 | 20993 |
| agguuuugcucccggggagagu | 13 | 25333 |
| ggugaagcuccccucuggaauagau | 14 | 25599 |
| augguguagaaguagauguucaucccguu | 15 | 25676 |
| uguuucuuucuucgucuccucuuuguuu | 16 | 32803 |
| aaggucaacucauucccaucauguagguug | 17 | 400 |
| guggcuuugccuggagaugcaua | 18 | 1073 |
| uugccgcacagacuucagucac | 19 | 1097 |
| augcauacucacacacaaagcugg | 20 | 1684 |
| auaacugggcaguguuguagcuacauug | 21 | 35585 |
| uggaaacccagacucauccuuguagu | 22 | 35761 |
| uccagugucaaaguugcauuccagggu | 23 | 40204 |
| ucaucuguuucuggaaccuuuaggaugugagu | 24 | 42491 |
| gggguguucaauuaucucuauauacgggu | 25 | 43942 |
| gguuuauaugggucauucuuuguuacuaa | 26 | 45170 |
| uaguagccgucucugcagucuuuuc | 27 | 45445 |
| ugcuaagauggagguucagauugucucuuuaua | 28 | 46162 |
| aauuucccuuccugcuguguucagagag | 29 | 53243 |
| ugggucuccaaagguuguggauuuaguuu | 30 | 53882 |
| aacuugaagcaaauguuggcucugcuggua | 31 | #N/A |
| ucguaaauugucaaaaauuccuugggacuggucu | 32 | 63352 |
| gagauccuggaggggggauugugg | 33 | 63703 |
| aauggaaucuggaaccuggcaccgu | 34 | 66260 |
| auuuauaucagggaggcuccccagug | 35 | 67190 |

In an embodiment, the present invention provides for an oligonucleotide having any one of the following sequences: SEQ ID NOs: 6508, 69648, 2565, 7274, 15372, 63352, 67190, 66260, 25333, 25599, 25676, 43942, 45170, 45445, 61632 and 53882.

By "oligonucleotide", it is meant to refer to any polynucleotide. A "polynucleotide" is an oligomer comprised of nucleotides. A polynucleotide may be comprised of DNA, RNA modified forms thereof, or a combination thereof. The term "nucleotide" or its plural as used herein is interchangeable with modified forms as discussed herein and otherwise known in the art. In certain instances, the art uses the term "nucleobase" which embraces naturally occurring nucleotides as well as modifications of nucleotides that can be polymerized. Thus, nucleotide or nucleobase means the naturally occurring nucleobases adenine (A), guanine (G), cytosine (C), thymine (T) and uracil (U) as well as non-naturally occurring nucleobases such as xanthine, diaminopurine, 8-oxo-N6- methyladenine, 7-deazaxanthine, 7-deazaguanine, N4,N4-ethanocytosin, N',N'-ethano-2,6-diaminopurine, 5-methylcytosine (mC), 5-(C[3]- C6)-alky- nyl-cytosine, 5-fluorouracil, 5- bromouracil, pseudoisocytosine, 2-hydroxy-5-methyl-4-triazolopyridin, isocytosine, isoguanine, inosine and the "non-naturally occurring" nucleobases described in Benner et ah, U. S. Pat. No. 5,432,272 and Susan M. Freier and Karl-Heinz Altmann, 1997, Nucleic Acids Research, vol. 25: pp 4429-4443. The term "nucleobase" also includes not only the known purine and pyrimidine heterocycles, but also heterocyclic analogues and tautomers thereof. Further naturally and non-naturally occurring nucleobases include those disclosed in U.S. Pat. No. 3,687,808 (Merigan, et ah), in Chapter 15 by Sanghvi, in Antisense Research and Application, Ed. S. T. Crooke and B. Lebleu, CRC Press, 1993, in Englisch et ah, 1991, Angewandte Chemie, International Edition, 30: 613-722 (see especially pages 622 and 623, and in the Concise Encyclopedia of Polymer Science and Engineering, J. I. Kroschwitz Ed., John Wiley & Sons, 1990, pages 858-859, Cook, Anti-Cancer Drug Design 1991, 6, 585-607, each of which is hereby incorporated by reference in its entirety). In various aspects, polynucleotides also include one or more "nucleosidic bases" or "base units" which include compounds such as heterocyclic compounds that can serve like nucleobases, including certain "universal bases" that are not nucleosidic bases in the most classical sense but serve as nucleosidic bases. Universal bases include 3-nitropyrrole, optionally substituted indoles {e.g., 5-nitroindole), and optionally substituted hypoxanthine. Other desirable universal bases include pyrrole, and diazole or triazole derivatives, including those universal bases known in the art.

Polynucleotides may also include modified nucleobases. A "modified base" is understood in the art to be one that can pair with a natural base {e.g., adenine, guanine, cytosine, uracil, and/or thymine) and/or can pair with a non-naturally occurring base. Exemplary modified bases are described in EP 1 072 679 and WO 97/12896, the disclosures of which are incorporated herein by reference. Modified nucleobases include, without limitation, 5- methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8- thioalkyl, 8-hydroxyl and other 8-substituted adenines and guanines, 5-halo particularly 5- bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Further modified bases include tricyclic pyrimidines such as phenoxazine cytidine (1H-pyrimido[5,4-b] [1,4]benzoxazin-2(3H)- one), phenothiazine cytidine (1H-pyrimido[5,4-b] [1,4]benzothiazin-2(3H)-one), G-clamps such as a substituted phenoxazine cytidine (e.g. 9-(2-aminoethoxy)-H-pyrimido[5,4-b] [1,4] benzox-azin-2(3H)-one), carbazole cytidine (2H-pyrimido [4,5-b]indol-2-one), pyridoindole cytidine (H- pyrido[3',2': 4,5]pyrrolo[2,3-d]pyrimidin-2-one). Modified bases may also include those in which the purine or pyrimidine base is replaced with other heterocycles, for example 7-deazaadenine, 7-deazaguanosine, 2-aminopyridine and 2-pyridone. Additional nucleobases include those disclosed in U. S. Pat. No. 3,687,808, those disclosed in The Concise Encyclopedia Of Polymer Science And Engineering, pages 858-859, Kroschwitz, J. I., ed. John Wiley & Sons, 1990, those disclosed by Englisch et ah, 1991, Angewandte Chemie, International Edition, 30: 613, and those disclosed by Sanghvi, Y. S., Chapter 15, Antisense Research and Applications, pages 289- 302, Crooke, S. T. and Lebleu, B., ed., CRC Press, 1993. Certain of these bases are useful for increasing the binding affinity of the polynucleotide and include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2.deg.C. and are, in certain aspects, combined with 2'- O-methoxyethyl sugar modifications. See, U.S. Pat. Nos. 3,687,808, 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,645,985; 5,830,653; 5,763,588; 6,005,096; 5,750,692 and 5,681,941, the disclosures of which are incorporated herein by reference.

Those of skill in the art can readily design antisense polynucleotides according to the present disclosure. For example, general teachings in the art include, but are not limited to, Aartsma-Rus et al, Methods Mol Biol. 867: 117-29 (2012); Aartsma-Rus et al, Methods Mol Biol. 867: 97-116 (2012); van Roon-Mom et al., Methods Mol Biol. 867: 79-96 (2012), each of which is incorporated herein by reference. General guidelines also include attempting to avoid 3 consecutive G or C nucleotides, choosing lengths and sequences that favour self structure (hairpinning will be avoided), and avoiding those sequences likely to form primer dimers. In some embodiments, an antisense polynucleotide of the disclosure is one that is designed to specifically hybridize to an exon or an intron or an intron-exon boundary, such that the antisense polynucleotide specifically hybridises to a sequence that is completely within an exon of an immune-related or immunomodulatory genes/ nucleic acid expressed by the T-cell, or about one nucleotide of the antisense polynucleotide spans said intron-exon boundary when the antisense polynucleotide is specifically hybridised to such a nucleic acid. In some embodiments wherein the antisense polynucleotide specifically hybridizes to a sequence that is completely within an exon, it is contemplated that a terminus of the antisense polynucleotide is about 1, 2, 3, 4, 5, 6, 7, 8, 9, 10 or more nucleotides from a terminus of the exon.

Modified polynucleotides are contemplated for use wherein both one or more sugar and/or one or more internucleotide linkage of the nucleotide units in the polynucleotide is replaced with "non-naturally occurring" sugars (i.e., sugars other than ribose or deoxyribose) or internucleotide linkages, respectively. In one aspect, this embodiment contemplates a peptide nucleic acid (PNA). In PNA compounds, the sugar-backbone of a polynucleotide is replaced with an amide-containing (e.g., peptide bonds between N-(2-aminoethyl)-glycine units) backbone. See, for example U. S. Pat. Nos. 5,539,082; 5,714,331; and 5,719,262, and Nielsen et ah, Science, 1991, 254, 1497- 1500, the disclosures of which are herein incorporated by reference. Modified polynucleotides may also contain one or more substituted sugar groups. In one aspect, a modification of the sugar includes Locked Nucleic Acids (LNAs) in which the 2'- hydroxyl group is linked to the 3' or 4' carbon atom of the sugar ring, thereby forming a bicyclic sugar group. The linkage is in certain aspects a methylene (—$CH_{[2]}$—)$_{[n]}$ group bridging the 2' oxygen atom and the 4' carbon atom wherein n is 1 or 2. LNAs and preparation thereof are described in WO 98/39352 and WO 99/14226, the disclosures of which are incorporated herein by reference. In the present invention, preferably, the antisense oligonucleotide comprises a modified polynucleotide backbone. The modified polynucleotide backbone may comprise a modified moiety substituted for the sugar of at least one of the polynucleotides.

In various embodiments, the antisense oligonucleotide comprising a modified polynucleotide backbone. The modified polynucleotide backbone may comprises a modified moiety substituted for the sugar of at least one of the polynucleotides. The modified moiety may be selected from the group consisting of phosphorodiamidate morpholino oligomer (PMO), peptide-conjugated phosphorodiamidate morpholino oligomer (PPMO), and non-peptide dendrimeric octaguanidine moiety-tagged morpholino oligomer.

In various embodiments, the modified polynucleotide backbone may comprise at least one modified internucleotide linkage. The modified internucleotide linkage may comprise a modified phosphate. The modified phosphate is selected from the group comprising of a non-bridging oxygen atom substituting a sulfur atom, a phosphonate, a phosphorothioate, a phosphodiester, a phosphoromorpholidate, a phosphoropiperazidate and a phosphoroamidate.

In various embodiments, the antisense oligonucleotide comprises a backbone which is selected from the group comprising of ribonucleic acid, deoxyribonucleic acid, DNA phosphorothioate, RNA phosphorothioate, 2'-O-methyl-oligoribonucleotide and 2'-O-methyl-oligodeoxyribonucleotide, 2'-O-hydrocarbyl ribonucleic acid, 2'-O-hydrocarbyl DNA, 2'-O-hydrocarbyl RNA phosphorothioate, 2'-O-hydrocarbyl DNA phosphorothioate, 2'-F-phosphorothioate, 2'-F-phosphodiester, 2'-methoxyethyl phosphorothioate, 2-methoxyethyl phosphodiester, deoxy methylene(methylimino) (deoxy MMI), 2'-O-hydrocarby MMI, deoxy-methylphos-phonate, 2'-O-hydrocarbyl methylphosphonate, morpholino, 4'-thio DNA, 4'-thio RNA, peptide nucleic acid, 3'-amidate, deoxy 3'-amidate, 2'-O-hydrocarbyl 3'-amidate, locked nucleic acid, cyclohexane nucleic acid, tricycle-DNA, 2'fluoro-arabino nucleic acid, N3'-P5' phosphoroamidate, carbamate linked, phosphotriester linked, a nylon backbone modification and mixtures of the aforementioned backbones.

In various embodiments, the oligonucleotide is chemically linked to one or more conjugates that enhance the activity, cellular distribution, or cellular uptake of the antisense oligonucleotide.

The oligonucleotide may be chemically linked to one or more conjugates that enhance the activity, cellular distribution, or cellular uptake of the antisense oligonucleotide.

The compounds of the disclosure also can be used as a prophylactic or therapeutic, which may be utilized for the purpose of treatment of a genetic disease. Hence, advantageously, the antisense oligonucleotide according to the present invention may be used in treating cancer, or an autoimmune disease in a patient. In addition to the antisense oligonucleotide, the patient may be administered a further anti-cancer agent or treatment. The cancer may be any one selected from the group comprising: HBV induced HCC, EBV induced Non Hodgkin Lymphomas.

As such, the antisense oligonucleotide of the present invention may be used to prepare novel chemical formulas for highly efficacious (IC50<2.5 nM) drug candidates against immunomodulatory molecules (e.g. IFN-gamma, Granzyme, Perforin1 etc). In another aspect of the present invention, there is provided a pharmaceutical composition comprising the antisense oligonucleotide according to the present invention and a pharmaceutically acceptable carrier.

A pharmaceutically acceptable carrier refers, generally, to materials that are suitable for administration to a subject wherein the carrier is not biologically harmful, or otherwise, causes undesirable effects. Such carriers are typically inert ingredients of a medicament. Typically a carrier is administered to a subject along with an active ingredient without causing any undesirable biological effects or interacting in a deleterious manner with any of the other components of a pharmaceutical composition in which it is contained. Suitable pharmaceutical carriers are described in Martin, Remington's Pharmaceutical Sciences, 18th Ed., Mack Publishing Co., Easton, Pa., (1990), incorporated by reference herein in its entirety.

In a more specific form of the disclosure there are provided pharmaceutical compositions comprising therapeutically effective amounts of an antisense polynucleotide together with pharmaceutically acceptable diluents, preservatives, solubilizers, emulsifiers, adjuvants and/or carriers. Such compositions include diluents of various buffer content (e.g., phosphate, Tris-HCl, acetate), pH and ionic strength and additives such as detergents and solubilizing agents (e.g., Tween 80, Polysorbate 80), anti-oxidants (e.g., ascorbic acid, sodium metabisulfite), preservatives (e.g., Thimersol, benzyl alcohol) and bulking substances (e.g., lactose, mannitol). The material may be incorporated into particulate preparations of polymeric compounds such as, for example and without limitation, polylactic acid or polyglycolic acid, or into liposomes. Hylauronic acid may also be used. Such compositions may influence the physical state, stability, rate of in vivo release, and rate of in vivo clearance of the disclosed compositions. The compositions may be prepared in liquid form, or may be in dried powder, such as lyophilized form.

It will be appreciated that pharmaceutical compositions provided according to the disclosure may be administered by any means known in the art. Preferably, the pharmaceutical compositions for administration are administered by injection, orally, or by the pulmonary, or nasal route. The antisense polynucleotides are, in various embodiments, delivered by intravenous, intra-arterial, intraperitoneal, intramuscular, or subcutaneous routes of administration. In various embodiments, the composition is suitable for parenteral administration either naked or complexed with a delivery agent to a patient. The carrier may be selected from the group comprising of a nanoparticle, such as a polymeric nanoparticle; a liposome, such as pH-sensitive liposome, an antibody conjugated liposome; a viral vector, a cationic lipid, a polymer, a UsnRNA, such as U7 snRNA and a cell penetrating peptide.

The antisense oligonucleotide may be administered orally, or rectal, or transmucosal, or intestinal, or intramuscular, or subcutaneous, or intramedullary, or intrathecal, or direct intraventricular, or intravenous, or intravitreal, or intraperitoneal, or intranasal, or intraocular.

The antisense molecules of the invention encompass any pharmaceutically acceptable salts, esters, or salts of such esters, or any other compound which, upon administration to an animal including a human, is capable of providing (directly or indirectly) the biologically active metabolite or residue thereof. Accordingly, for example, the disclosure is also drawn to prodrugs and pharmaceutically acceptable salts of the compounds of the invention, pharmaceutically acceptable salts of such pro-drugs, and other bioequivalents.

The term "pharmaceutically acceptable salts" refers to physiologically and pharmaceutically acceptable salts of the compounds of the invention: i.e., salts that retain the desired biological activity of the parent compound and do not impart undesired toxicological effects thereto.

For polynucleotides, preferred examples of pharmaceutically acceptable salts include, but are not limited to, (a) salts formed with cations such as sodium, potassium, ammonium, magnesium, calcium, polyamines such as spermine and spermidine; (b) acid addition salts formed with inorganic acids, for example hydrochloric acid, hydrobromic acid, sulfuric acid, phosphoric acid, nitric acid; (c) salts formed with organic acids such as, for example, acetic acid, oxalic acid, tartaric acid, succinic acid, maleic acid, fumaric acid, gluconic acid, citric acid, malic acid, ascorbic acid, benzoic acid, tannic acid, palmitic acid, alginic acid, polyglutamic acid, naphthalenesulfonic acid, methanesulfonic acid, p-toluenesulfonic acid, naphthalenedisulfonic acid, polygalacturonic acid; and (d) salts formed from elemental anions such as chlorine, bromine, and iodine. The pharmaceutical compositions of the disclosure may be administered in a number of ways depending upon whether local or systemic treatment is desired and upon the area to be treated. Administration may be topical (including ophthalmic and to mucous membranes including rectal delivery), pulmonary, e.g., by inhalation of powders or aerosols, (including by nebulizer, intratracheal, intranasal, epidermal and transdermal), oral or parenteral. Parenteral administration includes intravenous, intra-arterial, subcutaneous, intraperitoneal or intramuscular injection or infusion; or intracranial, e.g., intrathecal or intraventricular, administration. Polynucleotides with at least one 2'-O-methoxyethyl modification are believed to be particularly useful for oral administration.

The pharmaceutical formulations of the disclosure, which may conveniently be presented in unit dosage form, may be prepared according to conventional techniques well known in the pharmaceutical industry. Such techniques include the step of bringing into association the active ingredients with the pharmaceutical carrier(s) or excipient(s). In general the formulations are prepared by uniformly bringing into association the active ingredients with liquid carriers or finely divided solid carriers or both, and then, if necessary, shaping the product.

Combination therapy with an additional therapeutic agent is also contemplated by the disclosure. Examples of therapeutic agents that may be delivered concomitantly with a composition of the disclosure include, without limitation, a glucocorticoid steroid (for example and without limitation, prednisone and deflazacort), an angiotensin converting enzyme inhibitor, a beta adrenergic receptor blocker, an anti-fibrotic agent and a combination thereof.

In some embodiments, the present invention may be used in gene therapy such, e.g. using a vector (e.g., an expression vector) comprising a polynucleotide of the invention to direct expression of the polynucleotide in a suitable host cell. Such vectors are useful, e.g., for amplifying the polynucleotides in host cells to create useful quantities thereof, and for expressing proteins using recombinant techniques. In some embodiments, the vector is an expression vector wherein a polynucleotide of the invention is operatively linked to a polynucleotide comprising an expression control sequence.

In various embodiments, the composition comprising an oligonucleotide of the present invention may further comprise a nucleic acid molecule that encodes a T-cell receptor gene. In an embodiment, the nucleic acid molecule may be an mRNA molecule.

Methods for introducing a nucleic into the T-cell, which are well known and routinely practiced in the art, include transformation, transfection, electroporation, nuclear injection, or fusion with carriers such as liposomes, micelles, ghost cells, and protoplasts. The host T-cell may be isolated and/or purified. The T-cell also may be a cell transformed in vivo to cause transient or permanent expression of the polypeptide in vivo. The T-cell may also be an isolated cell transformed ex vivo and introduced post-transformation, e.g., to produce the polypeptide in vivo for therapeutic purposes.

The ASOs of the present invention may be introduced into a T cell by methods of transfection well known in the art. These methods include sonophoresis, electric pulsing, electroporation, osmotic shock, calcium phosphate precipitation, and DEAE dextran transfection, lipid mediated delivery, passive delivery etc. The language "transfecting T cells" is intended to include any means by which a nucleic acid molecule can be introduced into a T cell. The term "transfection" encompasses a variety of techniques useful for introduction of nucleic acids into mammalian cells including electroporation, calcium-phosphate precipitation, DEAE-dextran treatment, lipofection, microinjection, and viral infection. Suitable methods for transfecting mammalian cells can be found in Sambrook et al. (*Molecular Cloning: A Laboratory Manual, 2nd Edition*, Cold Spring Harbor Laboratory press (1989)) and other laboratory textbooks.

The ASO may also be introduced into a I cell using a viral vector. Such viral vectors include, for example, recombinant retroviruses, adenovirus, adeno-associated virus, and herpes simplex virus-1. Retrovirus vectors and adeno-associated virus vectors are generally understood to be the recombinant gene delivery system of choice for the transfer of exogenous genes in vivo, particularly into humans. Alternatively they can be used for introducing exogenous genes ex vivo into T cells. These vectors provide efficient delivery of genes into T cells, and the transferred nucleic acids are stably integrated into the chromosomal DNA of the host cell.

Another viral gene delivery system useful in the present invention utilizes adenovirus-derived vectors. The genome of an adenovirus can be manipulated such that it encodes and expresses a gene product of interest but is inactivated in terms of its ability to replicate in a normal lytic viral life cycle. Yet another viral vector system useful for delivery of a nucleic acid molecule comprising a gene of interest is the adeno-associated virus.

The ASOs may be carried by and delivered into a T cell by a cell-delivery vehicle. Such vehicles include, for example, cationic liposomes (Lipofectin™) or derivatized (e.g. antibody conjugated) polylysine conjugates, gramicidin S, artificial viral envelopes. These vehicles can deliver a nucleic acid that is incorporated into a plasmid, vector, or viral DNA. In a specific embodiment, efficient introduction of the nucleic acid molecule in primary T lymphocytes is obtained by transfecting the primary T lymphocytes with adeno-associated virus plasmid DNA complexed to cationic liposomes, as described in Philip, R. et al. (1994) *Mol. Cell. Biol.* 14, 2411.

In another embodiment of the invention, the ASOs may be delivered in the form of a soluble molecular complex. The complex contains the nucleic acid releasably bound to a carrier comprised of a nucleic acid binding agent and a cell-specific binding agent which binds to a surface molecule of the specific T cell and is of a size that can be subsequently internalized by the cell.

In another embodiment of the invention the nucleic acid is introduced into T cells by particle bombardment.

In various embodiments, the ASOs may be passively delivered (i.e., deliver without additional transfection reagents) to the T cells, particularly during T cell expansion. Expansion as used herein includes the production of progeny cells by a transfected neural stem cell in containers and under conditions well know in the art. Expansion may occur in the presence of suitable media and cellular growth factors. The ASOs may be passively delivered to the T cells in culture (e.g., in culture plates, culture dishes, multiwell plates etc without limitation) under reduced serum conditions, including under 0% serum conditions. Such conditions include cells cultured in standard, art-tested reduced-serum media that are commercially available from numerous companies including Invitrogen, and HyClone. In one example, cells are first plated in serum medium, then the serum medium is replaced with reduced serum medium comprising a tripartite oligonucleotide complex of the disclosure for 24 hours, then the reduced serum medium is replaced with serum medium.

In various embodiments, the transfection reagent may be selected from the group consisting of polymers, lipids, lipid-polymers and/or their combinations and/or their derivatives containing a cell-targeting or an intracellular targeting moiety and/or a membrane-destabilizing component and one or more delivery enhancers.

In another aspect of the present invention, there is provided a method of treating a disease in a patient, the method comprising administering an antisense oligonucleotide according to the present invention or a pharmaceutically effective amount of a composition according to the present invention.

The term "effective amount" or "therapeutically effective amount" means a dosage sufficient to treat, inhibit, or alleviate one or more symptoms of a disease state being treated or to otherwise provide a desired pharmacologic and/or physiologic effect, especially enhancing T cell response to a selected antigen. The precise dosage will vary according to a variety of factors such as subject-dependent variables (e.g., age, immune system health, etc.), the disease, and the treatment being administered.

As used herein "pharmaceutically acceptable carrier" includes any and all solvents, dispersion media, coatings, antibacterial and antifungal agents, isotonic and absorption delaying agents, and the like. The use of such media and agents for pharmaceutically active substances is well known in the art. Except insofar as any conventional media or agent is incompatible with the active compound, use thereof in the therapeutic compositions is contemplated. Supplementary active compounds can also be incorporated into the compositions.

The antisense oligonucleotide or composition may be administered orally, or rectal, or transmucosal, or intestinal, or intramuscular, or subcutaneous, or intramedullary, or intrathecal, or direct intraventricular, or intravenous, or intravitreal, or intraperitoneal, or intranasal, or intraocular. Having said that, proven systemic administration options include intravenous, intraperitoneal, intranasal and intrathecal. Complexing of ASOs with delivery carriers such as nanoparticles, polymer- or liposome-based vehicles can further augment the delivery efficiency of ASOs to specific tissues.

In various embodiments, the antisense oligonucleotide has been transfected in a T cell, and the method comprising administering the transfected T cell to the patient. The antisense oligonucleotide may be transfected or introduced to the T cell by an electroporation process.

Alternatively, the introduction of the oligonucleotides of the present invention into the T-cell can be effected by calcium phosphate transfection, DEAF-dextran mediated transfection, cationic lipid-mediated transfection, transduction, infection, microinjection, recombinant viral and retroviral infection or other methods. Such methods are described in many standard laboratory manuals, such as Davis et al., Basic Methods 1n Molecular Biology (1986). It is specifically contemplated that the polypeptides of the present invention may in fact be expressed by a host cell lacking a recombinant vector.

In various embodiments, the carrier is selected from the group consisting of a nanoparticle, such as a polymeric nanoparticle; a liposome, such as pH-sensitive liposome, an antibody conjugated liposome; a viral vector, a cationic lipid, a polymer, a UsnRNA, such as U7 snRNA and a cell penetrating peptide.

In various embodiments, the antisense oligonucleotide or composition is administered orally, or rectal, or transmucosal, or intestinal, or intramuscular, or subcutaneous, or intramedullary, or intrathecal, or direct intraventricular, or intravenous, or intravitreal, or intraperitoneal, or intranasal, or intraocular.

The disease may be a cancer selected from the group comprising: HBV induced HCC, EBV induced Non Hodgkin Lymphomas.

As such, it is the antisense oligonucleotide according to the present invention is useful in medicine.

In another aspect of the present invention, there is provided a method of inducing exon-skipping of an immune-related or immunomodulatory genes pre-mRNA expressed by the T-cell, the method comprising delivering to a cell an antisense oligonucleotide or a composition according to any one of the above aspects of the present invention.

In various embodiments, the cell is a human cell.

In another aspect of the present invention, there is provided a method for modulating the function of a T-cell, the method comprising administering to the T-cell an antisense oligonucleotide according to the present invention.

The method further comprising modifying the specificity of the T-cell by administering to the T-cell a nucleic acid molecule that encodes a T-cell receptor gene. The nucleic acid molecule that encodes a T-cell receptor gene is transfected or introduced to the T cell by electroporation.

In yet another aspect of the present invention, there is provided a T-cell transformed or transfected with an antisense oligonucleotide according to the present invention. In various embodiments, the antisense oligonucleotide is transfected or introduced to the T cell by an electroporation process.

The T-cell may further comprise a nucleic acid molecule that encodes a T-cell receptor gene, wherein the nucleic acid molecule is an mRNA.

In yet another aspect of the present invention, there is provided a kit comprising the antisense oligonucleotide according to the present invention, optionally in a container, and a package insert, package label, instructions or other labelling.

In order that the present invention may be fully understood and readily put into practical effect, there shall now be described by way of non-limitative examples only preferred embodiments of the present invention, the description being with reference to the accompanying illustrative figures.

In the Figures:

FIG. 1. Flow cytometry plots showing non transfected T-cells (left), T-cells transfected with an ASO tagged with FAM (centre) and T-cells transfected with an HBV-specific TCR together with the FAM-tagged ASO (right). The TCR is stained using a PE (phycoerythrin)-conjugated pentamer while the ASO is tagged with FAM (6-carboxyfluorescein).

Figure 2:
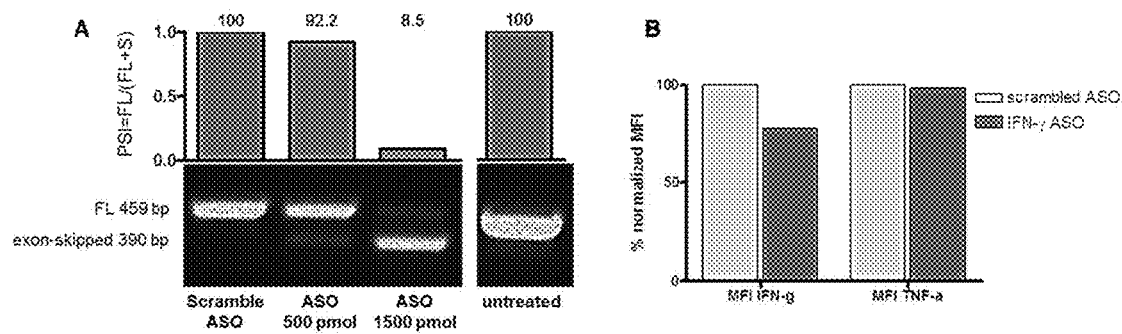

FIG. 2. A. Lower part: PCR reaction amplifying IFN-γ mRNA in T-cells treated with a scrambled ASO (left), 500 picomoles of a IFN-γ specific ASO (centre) or 1500 picomoles of the same ASO (right). The separated lane shows the amplification of IFN-γ mRNA in not electroporated T-cells. Upper part: histogram bars representing the PSI (Percentage Spliced Index) of the full-length transcript. The PSI provides the inclusion level of the analysed exon. B. Histogram bars showing MFI of IFN-γ and TNF-α fluorescent staining (median fluorescence intensity) normalized to the MFI of scrambled ASO-treated T-cells from intracellular cytokine staining.

Figure 3:
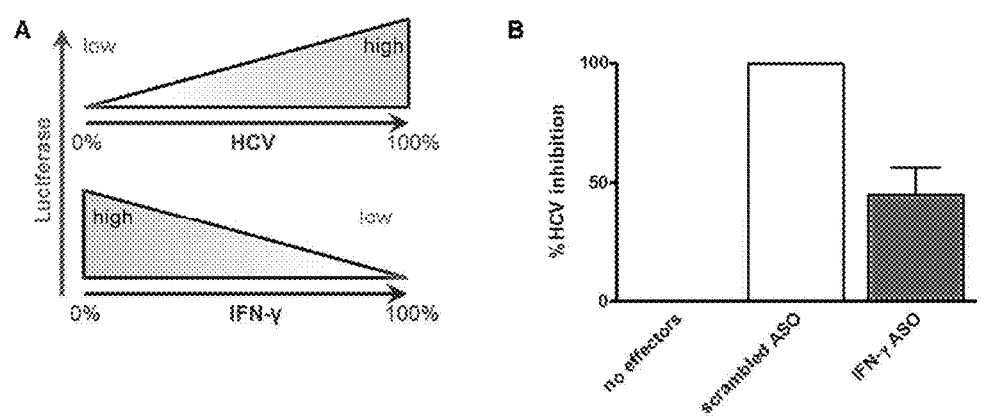

FIG. 3. A. Luciferase expression in the HuH7 HCV-replicon cell line in relation to HCV replication or IFN-γ concentration in the culture medium. B. Histogram bars representing the percentage of HCV inhibition in HuH7 HCV-replicon cell line by IFN-γ-ASO treated T-cells normalized to the inhibition by scrambled ASO-treated T-cells.

Figure 4:
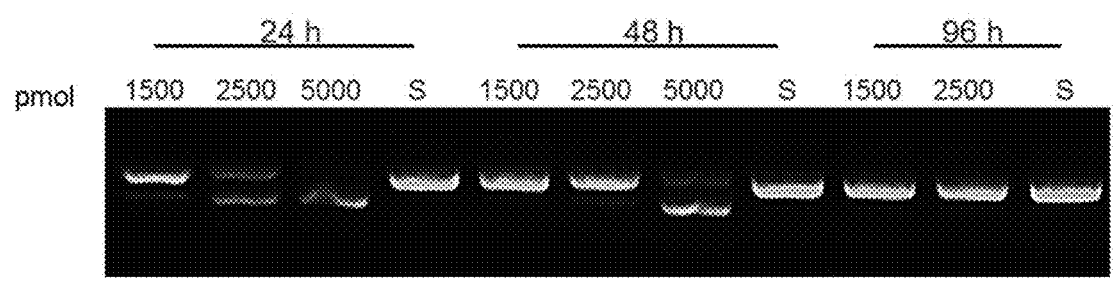

FIG. 4. PCR amplification of IFN-γ mRNA 24-48-96 hours after electroporation of different amounts (1500-2500-5000 picomoles) of IFN-γ specific ASO or a scrambled ASO (2500 picomoles).

Figure 5:
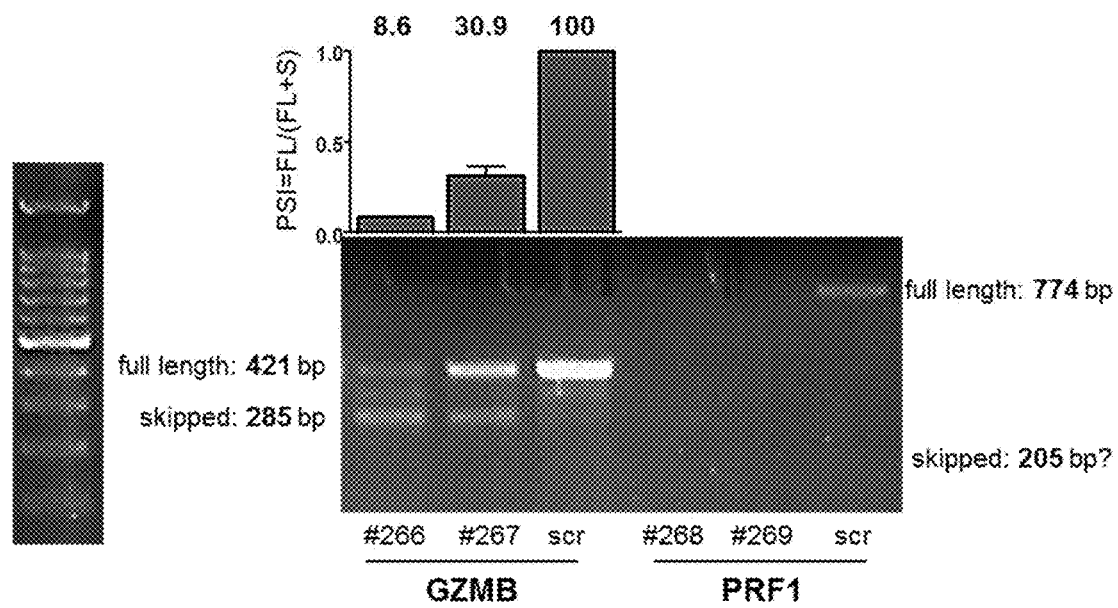

FIG. 5. PCR amplification of granzyme B (GZMB) and perforin (PRF1) mRNA 24 hours after electroporation of 2500 picomoles of granzyme B specific ASOs (#266 or #267), perforin specific ASOs (#268 or #269) or a scrambled ASO. The full length PCR product and the expected exon-skipped product lengths are annotated for both GZMB (left) and PRF1 (right). Upper part: histogram bars representing the PSI of granzyme exon-skip reaction. The same measurement cannot be conducted for perforin, as the specific bands are not detected in the gel.

Figure 6:
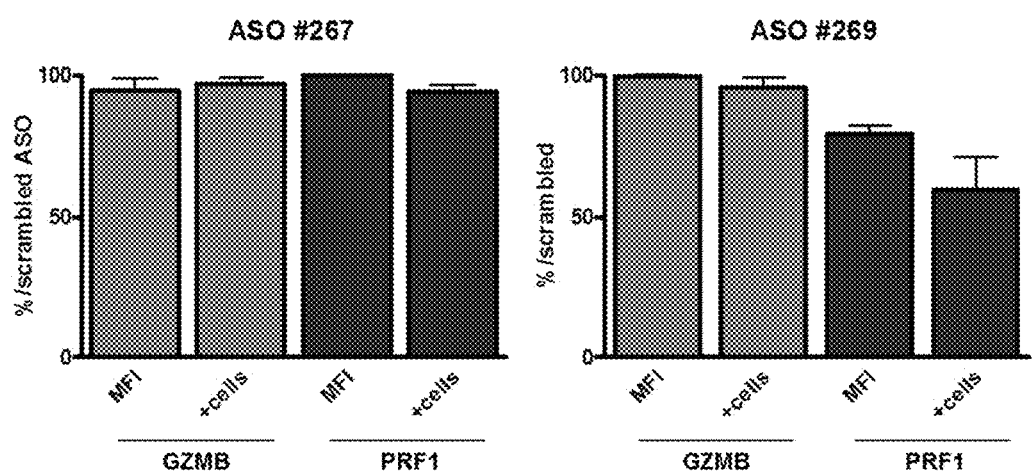

FIG. 6. Histogram bars representing the MFI or the percentage of positive cells in an intracellular cytokine staining experiment in T-cells electroporated with an ASO targeting granzyme B pre-mRNA (left) or perforin pre-mRNA (right). The values are normalized to the values obtained from T-cells electroporated with a scrambled ASO.

Figure 7:
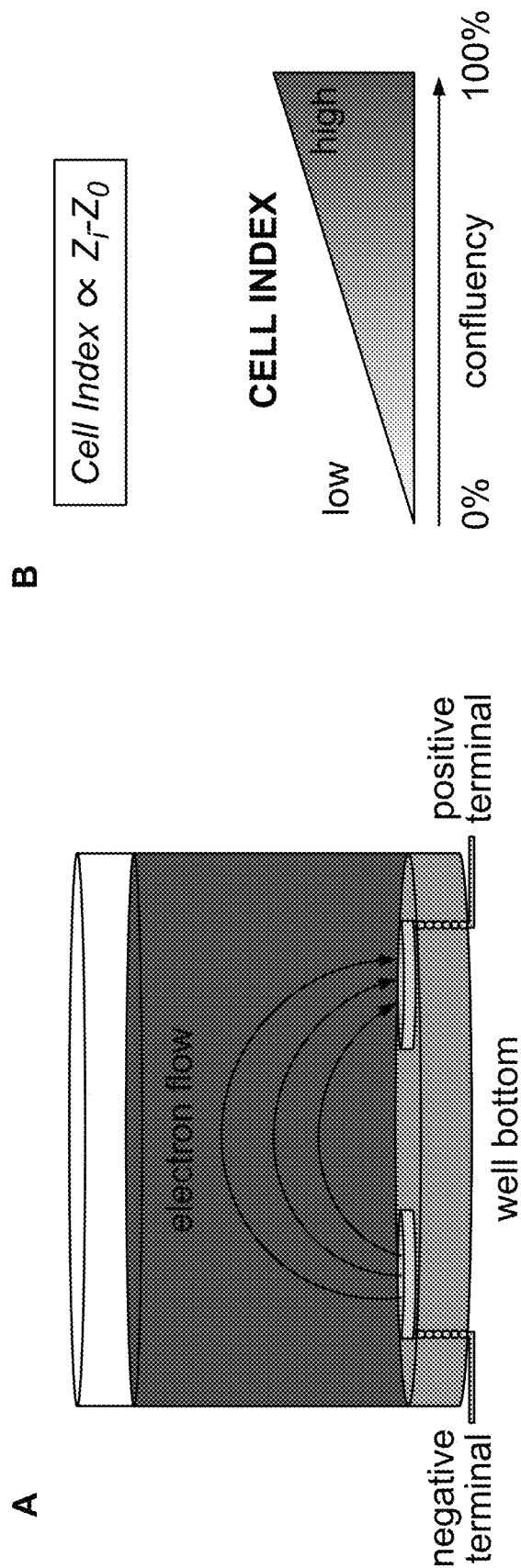

FIG. 7. A. Representation of a well of xCELLigence® RTCA DP. B. Cell Index is a measure-less unit proportional to the impedance measured in the well, which in turn is proportional to the cell confluency.

Figure 8:
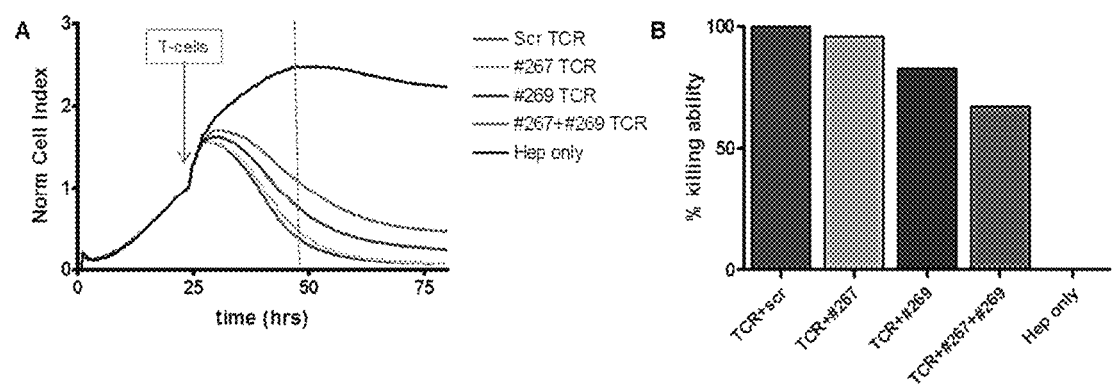

FIG. 8. A. Cell Index plotted over time obtained with xCELLigence®RTCA DP. A HBV-producing hepatoma cell line was seeded on the sensing wells and the cell growth was monitored over 24 hours. HBV-specific TCR-redirected T-cells treated were added in culture (1:2 effector:target ratio) and their cytotoxic ability was measured. T-cells were pre-treated with a scrambled ASO (red), an ASO targeting perforin (green), two ASOs targeting granzyme and perforin (blue and yellow line). The black line represents the Cell Index recorded in wells with no T-cells added. All the Cell Indexes are normalized to the moment in which the T-cells are added in culture. B. Histogram bars representing the cytotoxic ability of HBV-specific TCR-redirected T-cells after 24 hours in culture with HBV-producing hepatoma cell line.

Figure 9:
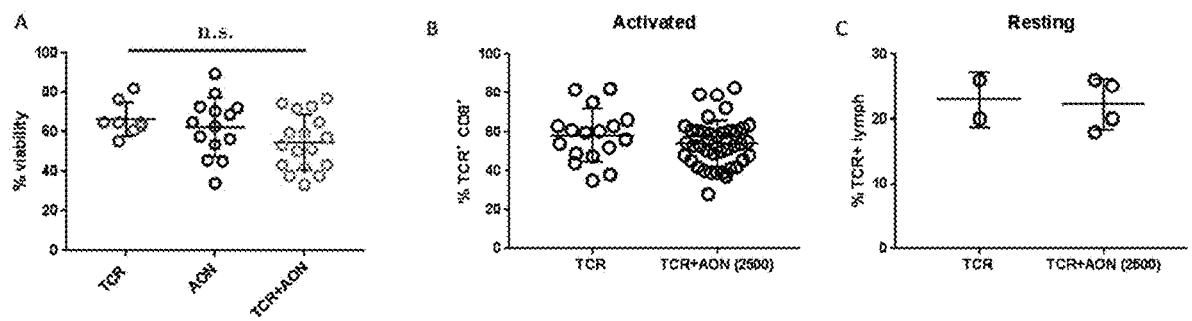
Figure 10:
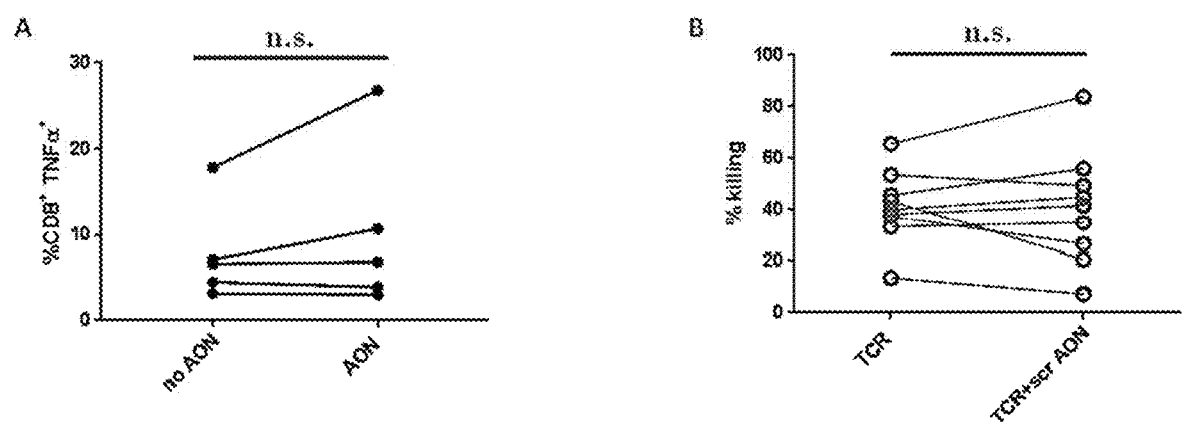

FIGS. 9 and 10. Data from control experiments.

FIGS. 11 to 15. Data obtained from experiments using AONs #887 (SEQ ID NO. 6508), 888 (SEQ ID NO. 69648) and 1173 (SEQ ID NO. 2565) (for targets PD-1 and CTLA-4).

Figure 16:
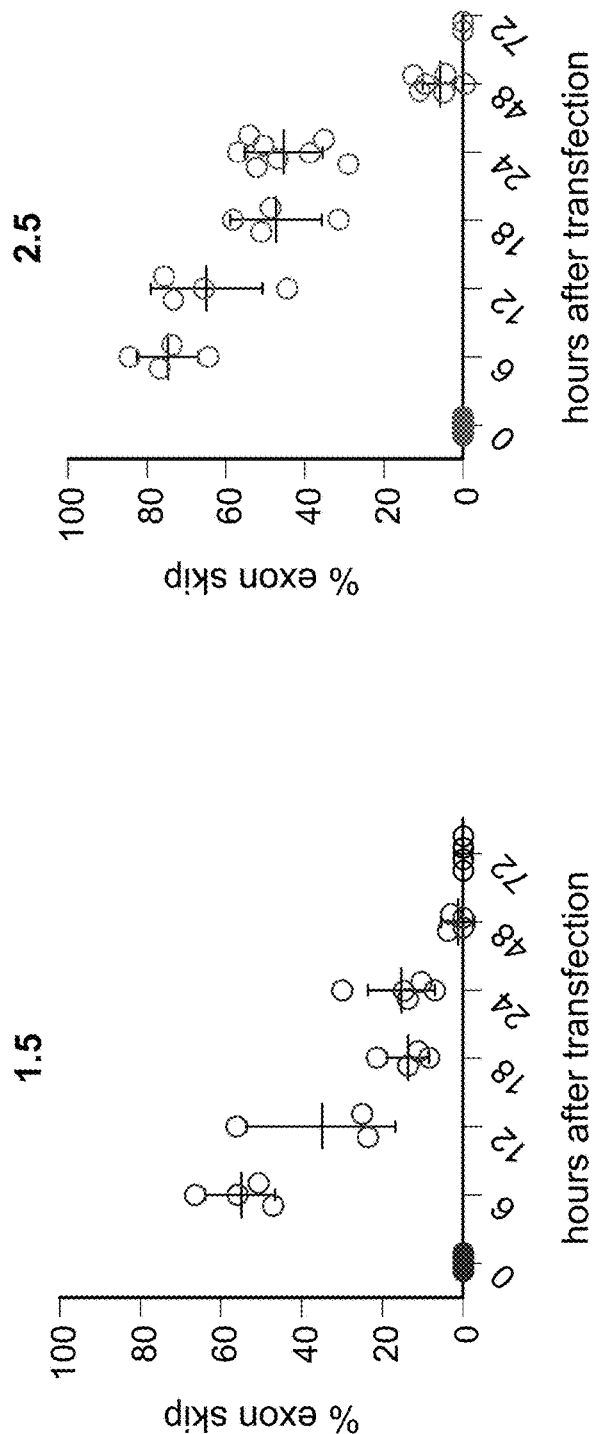
Figure 16:
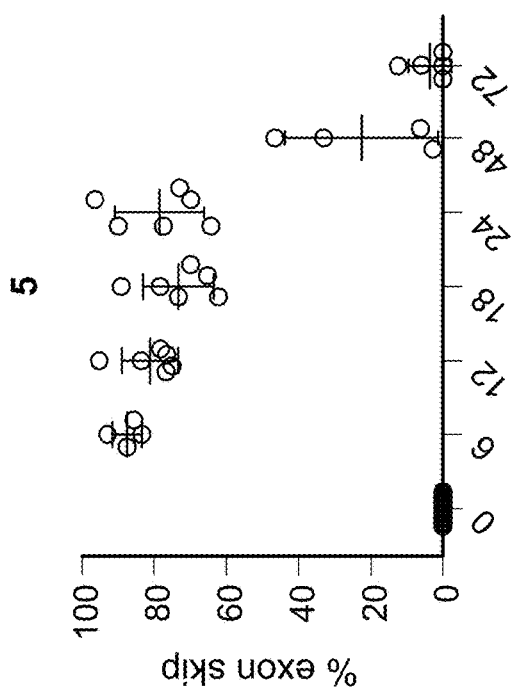

FIGS. 16 and 17. Data obtained from experiments using AON #263 (SEQ ID NO. 7274) (for target IFN-γ).

FIGS. 18 and 19. Data obtained from experiments using AON #268 (SEQ ID NO. 15372) (for target Perforin).

Figure 20:
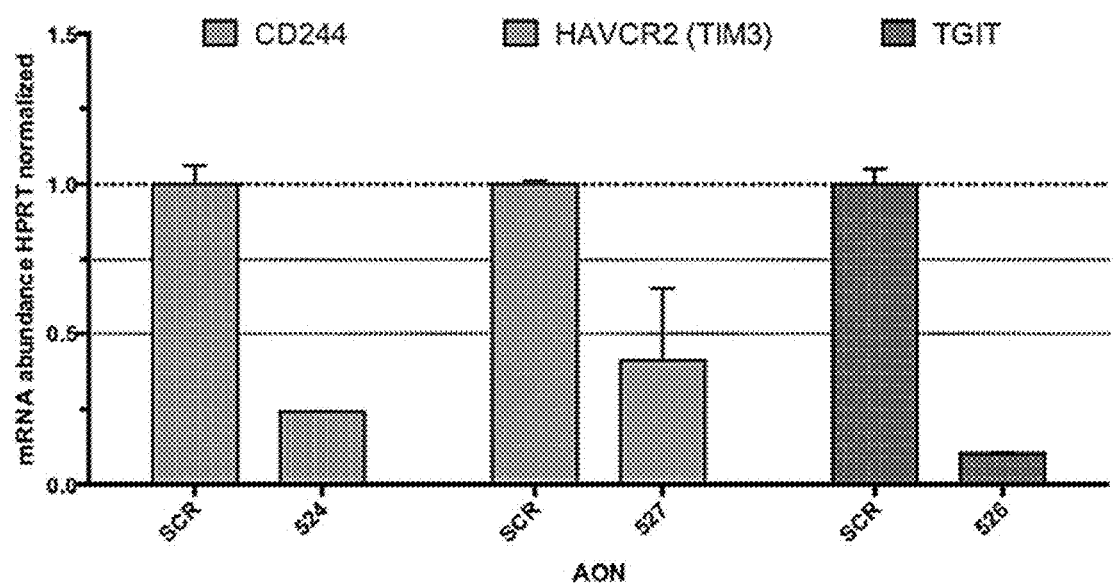

FIG. 20. Data obtained from experiments using AONs #524 (SEQ ID NO. 63352), 527 (SEQ ID NO. 67190) and 526 (SEQ ID NO. 66260) (for targets CD244, TIM3 (HAVCR2) and TGIT).

Figure 21:
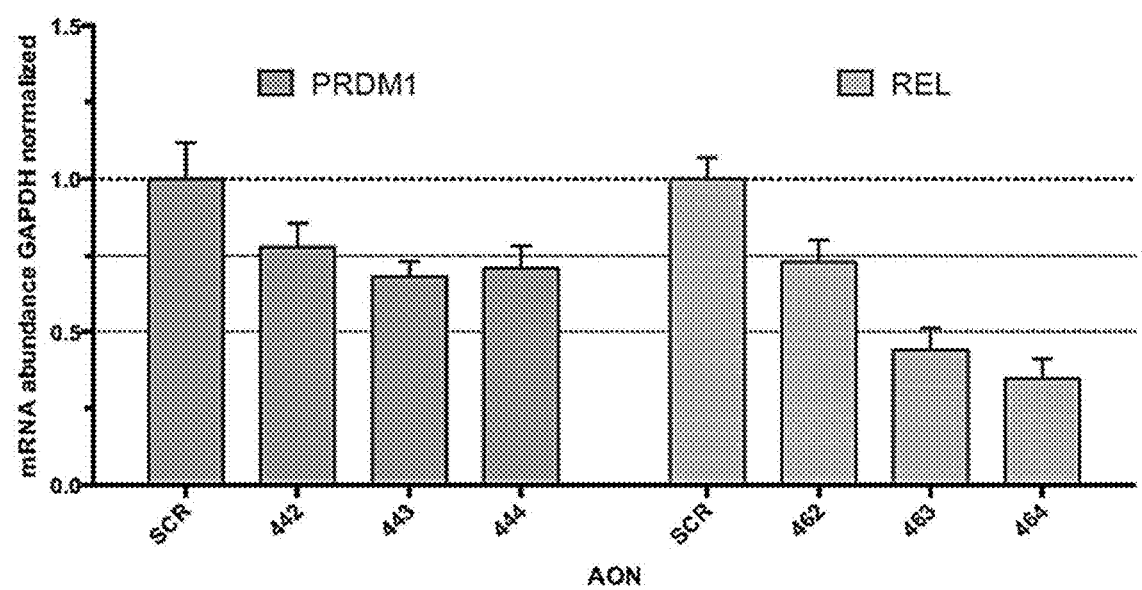

FIG. 21. Data obtained from experiments using AONs #442 (SEQ ID NO. 25333), 443 (SEQ ID NO. 25599), 444 (SEQ ID NO. 25676), 462 (SEQ ID NO. 43942), 463 (SEQ ID NO. 45170) and 464 (SEQ ID NO. 45445) (for targets PRDM1 and REL).

FIG. 22. Data obtained from experiments using AONs #523 (SEQ ID NO. 61632) (for target CD160).

FIG. 23. Data obtained from experiments using AON 522 (SEQ ID NO. 53882) (for target CD80).

FIG. 24 shows an example of a modified sequence according to an embodiment of the present invention.

The present application relates to the field of immunotherapy, specifically to that of immunotherapy directed against tumors and/or viral infections (such as Hepatitis B induced Hepatocellular Carcinoma, EBV induced NKT cell Lymphmas etc.). It is here shown that direct and selective downregulation of immune-related or immunomodulatory genes expressed by T cells [e.g. by Antisense OligoNucleotide (ASO)-mediated exon skipping or intron retention], leads to modulation of T cell functions (such as direct inhibition of viral replication or selective killing of cells expressing a targeted antigen).

Definitions

The present invention will be described with respect to particular embodiments and with reference to certain drawings, but the invention is not limited thereto but only by the claims. Any reference signs in the claims shall not be construed as limiting the scope. The drawings described are only schematic and are non-limiting. In the drawings, the size of some of the elements may be exaggerated and not drawn on scale for illustrative purposes. Where the term "comprising" is used in the present description and claims, it does not exclude other elements or steps. Where an indefinite or definite article is used when referring to a singular noun e.g. "a" or "an", "the", this includes a plural of that noun unless something else is specifically stated. Furthermore, the terms first, second, third and the like in the description and in the claims, are used for distinguishing between similar elements and not necessarily for describing a sequential or chronological order. It is to be understood that the terms so used are interchangeable under appropriate circumstances and that the embodiments of the invention described herein are capable of operation in other sequences than described or illustrated herein.

The following terms or definitions are provided solely to aid in the understanding of the invention. Unless specifically defined herein, all terms used herein have the same meaning as they would to one skilled in the art of the present invention. Practitioners are particularly directed to Sambrook et al., Molecular Cloning: A Laboratory Manual, 2nd ed., Cold Spring Harbor Press, Plainsview, New York (1989); and Ausubel et al., Current Protocols in Molecular Biology (Supplement 47), John Wiley & Sons, New York (1999), for definitions and terms of the art. The definitions provided herein should not be construed to have a scope less than understood by a person of ordinary skill in the art.

EXAMPLE 1

ASOs Can Be Efficiently Introduced Into HBV-specific, TCR-Redirected Primary T Cells.

In order to modify the specificity of primary T-cells, we transfected them, using electroporation method, with mRNA coding for the V alpha/beta chain of a TCR recognizing a peptide (S183-191) in the envelope protein of HBV, as in [9]. This peptide is commonly presented via MHC-I on the surface of antigen presenting cells (APCs) or on HBV infected hepatocytes. Therefore, the expression of a S183-191 specific TCR on the surface of the T-cells, make them capable of recognizing the presence of HBV and to undergo, eventually, TCR activation. The expression of the HBV-specific TCR on the surface of T-cells can be assessed using simple surface staining with MHC multimers and flow cytometry analysis. MHC multimers are labelled oligomeric forms of MHC molecules, designed to identify antigen-specific T-cells; MHC multimers can bind directly to T-cell receptors of a particular specificity, and this specificity is determined by the combination of the MHC molecule and peptide presented on it. Similarly, we used RNA electroporation to modify the function of T-cells, introducing antisense oligonucleotides (ASOs) targeting various exons of undesired genes.

To assess the possibility to deliver ASOs in activated primary T-cells, we used a scrambled-ASO tagged with FAM and we introduced it in the T-cells alone or in combination with the mRNA coding for a TCR and looked for their presence using flow cytometry. As shown in the central panel of FIG. 1, 94% of the T-cells electroporated with the FAM-tagged ASO alone are positive for the fluorophore, indicating that the electroporation is an effective way to deliver the oligomers. Similarly, the panel on the right shows that T-cells that are electroporated with the TCR together with the FAM-ASO are positive for both the transfectants. Most importantly, again 94% of the T-cells show positivity for the ASO, meaning that the introduction of two different molecules does not reduce the efficiency in the delivery. The right plot of FIG. 1 shows also that the double-electroporated T-cell are double-stained with the two fluorophores used in the assay, that means that we are able to deliver both the transfectants in a single reaction and consequently we could be able to modify the T-cell specificity (with the introduction of a TCR) and the T-cell function (with the introduction of an ASO).

Moreover, in a different experiment, we electroporated the TCR and the ASO in the same T-cells, in two separate reactions 16 hours apart from each other. We were interested in this different schedule because the peak of the expression of the TCR and the peak of activity of the ASOs could not coincide and the simultaneous delivery of them could lead to a not coordinated effect on the T-cells. Also with this particular experimental schedule, we managed to get both the expression of the TCR and the delivery of the ASO (data not shown). Thus, we can prove that we are able to introduce the two molecules at different time points to let us tune their effect at their best timing.

EXAMPLE 2

Gene Expression Can Be Modulated by ASOs in Primary T Cells.

After having demonstrated the feasibility of the transfection of ASOs in primary activated T-cells (with or without HBV-specific TCR), we moved forward to test the ability of the oligonucleotides to interfere with the splicing of a target gene. For the proof of concept, we chose to design an ASO targeting the exon 2 of the interferon-γ (IFN-γ) pre-mRNA, since in the lab we can exploit various tools to assess the presence and the activity of such cytokine. We designed primers surrounding the exon 2 of (IFN-γ) in order to obtain a PCR product that amplifies both the full length and the short (exon-skipped) isoform performing a simple PCR on the cDNA of the transfected cells [11]. The control to assess the specificity of the technique is performed transfecting primary cells with a non-targeting/scrambled sequence. FIG. 2.A shows the results of the PCR: it is evident that the ASO interferes with the splicing of the pre-mRNA in a dose-dependent manner, leading to the exclusion of exon 2 from the final mRNA. When only 8% of the T-cells transfected with 500 picomoles of the IFN-γ-targeting ASO show an effect at the mRNA level, the T-cells transfected with triple amount of the same oligomer show a 92% reduction of the full-length transcript. T-cells treated with a scrambled ASO do not show any modification of the IFN-γ transcript. However, as clear in FIG. 2.A, we could not achieve the elimination of the exon-skipped mRNA via nonsense-mediated RNA decay, as we expected. After a bioinformatics search on immune-related proteins, we realized that many splice variants are normally present in physiological conditions, although often they are not functionally characterized.

We then tried to measure the abundancy of IFN-γ at the protein level, to verify that the modification of the splicing was reflected in the knock-down of the protein. FIG. 2.B shows that, despite an almost complete elimination of the full-length mRNA from the transfected cells, IFN-γ could still be detected by intracellular cytokine staining. The staining reveals only a 25% reduction of fluorescence of the IFN-γ-specific ASO treated T-cells to the T-cells transfected with the scrambled ASO.

This discrepancy between the results at mRNA and at the protein level may be explained by the presence of the exon-skipped form detected by PCR and not eliminated via NMD: this mRNA could be translated anyway into a shorter isoform of IFN-γ that is not-specifically detected by the antibody in the intracellular cytokine staining. To test for the presence of this exon-skipped isoform in the T-cells at the protein level we could perform a Western blot, but the feasibility of the assay and the quality of the results still depend on the ability of an antibody to detect not specifically the shorter protein, so we concurred that it was irrelevant to the objective of our study.

We therefore proceeded to test the function of the IFN-γ produced by the ASO-transfected cells, as a measure of the effect of the treatment. For this purpose we used a well-established functional assay that involves the use of a HuH7 cell line transfected with a plasmid that contains a HCV-replicon very sensitive to IFN-γ antiviral effect [17] (FIG. 3.A). The plasmid used for the transfection contains also luciferase as a reporter-gene, therefore the luciferase activity detected in the cells is proportional to the "replication" of HCV (FIG. 3.A).

We cultured overnight the HCV-replicon cell line in the presence of the supernatant derived from the stimulation of the ASO-treated T-cells and we performed a luciferase assay to verify whether the IFN-γ produced was able to stop the production of replicons. FIG. 3.B shows that stimulated T-cells that have been transfected with the ASO targeting IFN-γ are less competent in the control of the viral replication (50% less compared to T-cells electroporated with a scrambled ASO). This demonstrates that the cytokine derived from the exon-skipped isoform is not functional.

Lastly, since one of the main goals of the method of transfection used is the transiency of the effect, we checked for how long the exon skipping was maintained at the mRNA level. In FIG. 4 we see that the effect of the treatment is diluted with time and is totally disappeared 96 hours after the electroporation.

EXAMPLE 3

Cytotoxicity Can Be Modulated by ASOs in Primary T Cells.

As mentioned in the introduction, one possible drawback of the use of adoptive T-cell transfer for the therapy of malignancies like HCC, is the hepatic cytotoxicity, as virtually all the liver could be target of the effector T-cells, leading to serious consequences. One measure adopted to limit this risk and improve the safety of the therapy is the transiency of expression of the T-cell receptor induced by the electroporation, but we asked if we could also be able to modify the cytotoxic function of the TCR-redirected T-cells using the antisense technology. Using the same set up, we introduced ASOs targeting exon 3 and exon 2 of the pre-mRNA of granzyme B (ASOs #266 and #267) and perforin (ASOs #268 and #269), respectively. Perforin and granzyme are the two main effectors playing in cell-cell cytotoxicity.

In FIG. 5 we show that we can detect a modification of the splicing of the two proteins 24 hours after the electroporation at the mRNA level (and already 6 hours after the treatment, data not shown). Granzyme-specific ASOs can produce 91% of exon skip (#266) and 70% of exon skip (#267), compared to the scrambled ASO. Interestingly, we can notice that granzyme B is naturally presenting three different splicing isoforms, and the ASOs are only modifying the proportions between full length and short length transcripts. Unfortunately in the literature there's no report of the presence at the protein level and of the physiological function (if any) of these different isoforms. Consequently, we do not know whether these isoforms are translated into proteins and whether they are also detected by the antibodies we use for detection in the intracellular cytokine staining.

In addition, from the same figure we notice that the full-length band of the mRNA of perforin is not detectable after the transfection of the perforin-specific ASO, but at the same we are unable to detect also the shorter isoform that we are supposed to obtain after the treatment. The absence of the full-length transcript could be explained by the effect of the ASOs targeting the pre-mRNA of perforin. On the other hand, the exon-skipped transcript produced by the splicing alteration could be subjected to nonsense mediated RNA decay and this may explain the absence of the band from the gel. However, to verify this hypothesis more experiments need to be carried on.

Next, we moved on to check whether the modification at the RNA level was reflected into some modification of the protein expression, so we performed an intracellular cytokine staining to measure the levels of the two target proteins. FIG. 6 shows the percentage of granzyme and/or perforin positive cells and the median fluorescence intensity (MFI), as a measure of the abundance of the proteins in the cells 24 hours after the electroporation. From FIG. 6 we do not detect much modification in the levels of granzyme B. This could be explained by the existence of the multiple isoforms above described. Those transcripts could in fact be translated into shorter proteins and be bound by the antibody used in the assay. To verify this hypothesis, as for the intracellular cytokine staining for IFN-γ in the previous paragraph, a Western blot is needed to assess the presence of these shorter proteins in the T-cells, but the same limitations are met.

On the other hand, the perforin-positive T-cells treated with the specific ASO show a lower MFI compared to the T-cells electroporated with the scrambled ASO (even if the reduction is not dramatic, only 80%). Interestingly, we see a consistent and substantial drop in the count of perforin positive cells (60% compared to T-cells treated with a scrambled ASO). A possible explanation for this phenomenon is the fact that the ASO targeting the perforin pre-mRNA is very efficacious and, once entered in the cell, it is able to fully stop the production of the protein. For this reason the count of positive cells dropped, while the MFI did not change dramatically.

The assay shows also that the effect of the ASO is specific, as T-cells treated with an ASO targeting perforin do not show any modification in the levels of granzyme B.

We then moved forward to verify whether the cytotoxic ability of ASO-treated T-cells was modified due to the exon skip induced by the antisense oligonucleotides. Therefore we set up a cytotoxicity assay using xCELLigence® RTCA DP (Acea Biosciences). xCELLigence® RTCA DP is an instrument that uses non-invasive electrical impedance to monitor cell proliferation and attachment in a label-free, real-time manner [18]. The functional unit of the assay is a set of electrodes on the bottom of a plate well. When in a conductive solution, the application of an electric potential across the electrodes causes electrons to exit the negative terminal and deposit onto the positive terminal, passing through the conductive medium (FIG. 7A). This phenomenon is dependent upon the direct interaction between the electrodes and the solution, so the presence of adherent cells at the electrode-solution interface impedes electron flow. The magnitude of the impedance is dependent on the number, the size and shape of the cells, and it is possible to obtain a measure of these variables (Cell Index) exploiting the impedance measured in the bottom of the wells (FIG. 7B). Using this experimental method, we were able to set up a co-culture of HBV-specific TCR-redirected T-cells and HBV producing cells to study the killing ability of our modified effectors.

FIG. 8.A shows the ability of HBV-specific T-cells to kill HBV-producing cells. It is evident that the impaired production of perforin and/or granzyme B in the ASO knocked-down T-cells prevents them from killing their targets as the scrambled ASO-transfected TCR-redirected T-cells. More in detail, we see that, 24 hours after the addition of effectors in the culture, scrambled-ASO treated TCR-redirected T-cells killed almost all the adherent cells, causing a drop in the Cell Index, as the targets detached from the bottom of the well (red). The same phenomenon is observed in the wells were HBV producing cells were cultured together with granzyme knocked-down T-cells (yellow). Conversely, HBV-specific T-cells treated with a perforin-specific ASO show 20% of reduction in their killing ability 24 hours after the beginning of the co-culture (blue). Interestingly, when TCR-redirected T-cells are transfected with ASOs targeting perforin and granzyme B transcripts together, their cytotoxic ability decreases even more (up to 35%). The result shows that the effect of the two transfectants was additive (green), even if we saw no change when the T-cells were granzyme B knocked-down. This discrepancy could be simply explained considering the biology of the system we were trying to disrupt. In physiological conditions in fact perforin is used by cytotoxic lymphocytes (CTLs) as a pore forming cytolytic protein. The pores formed in the membrane of the target cells allow for the passive diffusion of granzyme B, which is pro-apoptotic protease that cleaves caspases involved in the process of programmed cell death. As a consequence, the knock-down of granzyme B alone will not modify dramatically the cytotoxic ability of the CTLs, as the action of perforin alone is sufficient to induce lysis of the target cells. On the other hand, when both the proteins are knocked-down, the pro-apoptotic pathway and the cytolytic pathway are both disrupted and the killing ability of the CTL is substantially modified.

FURTHER EXAMPLES AND DATA

FIG. 9 shows that, typically, AONs do not affect the viability of transfected T cells and do not interfere with TCR expression. FIG. 9(*a*) shows the viability of T cells EP with HBV-specific TCR, with AONs or both, compared to non electroporated cells. FIG. 9(*b*) shows TCR expression in activated or resting T cells EP with TCR or TCR+AON (measured with MHC-multimer staining in flow cytometry).

FIG. 10 also shows that, typically, AONs do not affect antiviral activity and cytotoxicity of transfected TCR-redirected T cells. FIG. 10(*a*) shows a flow cytometry with intracellular cytokine staining; and FIG. 10(*b*) shows results obtained from an impedance cytotoxicity assay. It can be seen from the figures that HBV specific TCR-redirected T cells transfected with a scrambled AON show comparable inflammatory cytokines production (A) and cytotoxicity (compared to the not treated TCR-redirected T cells) when in culture with HBV-expressing targets.

Figure 11A:
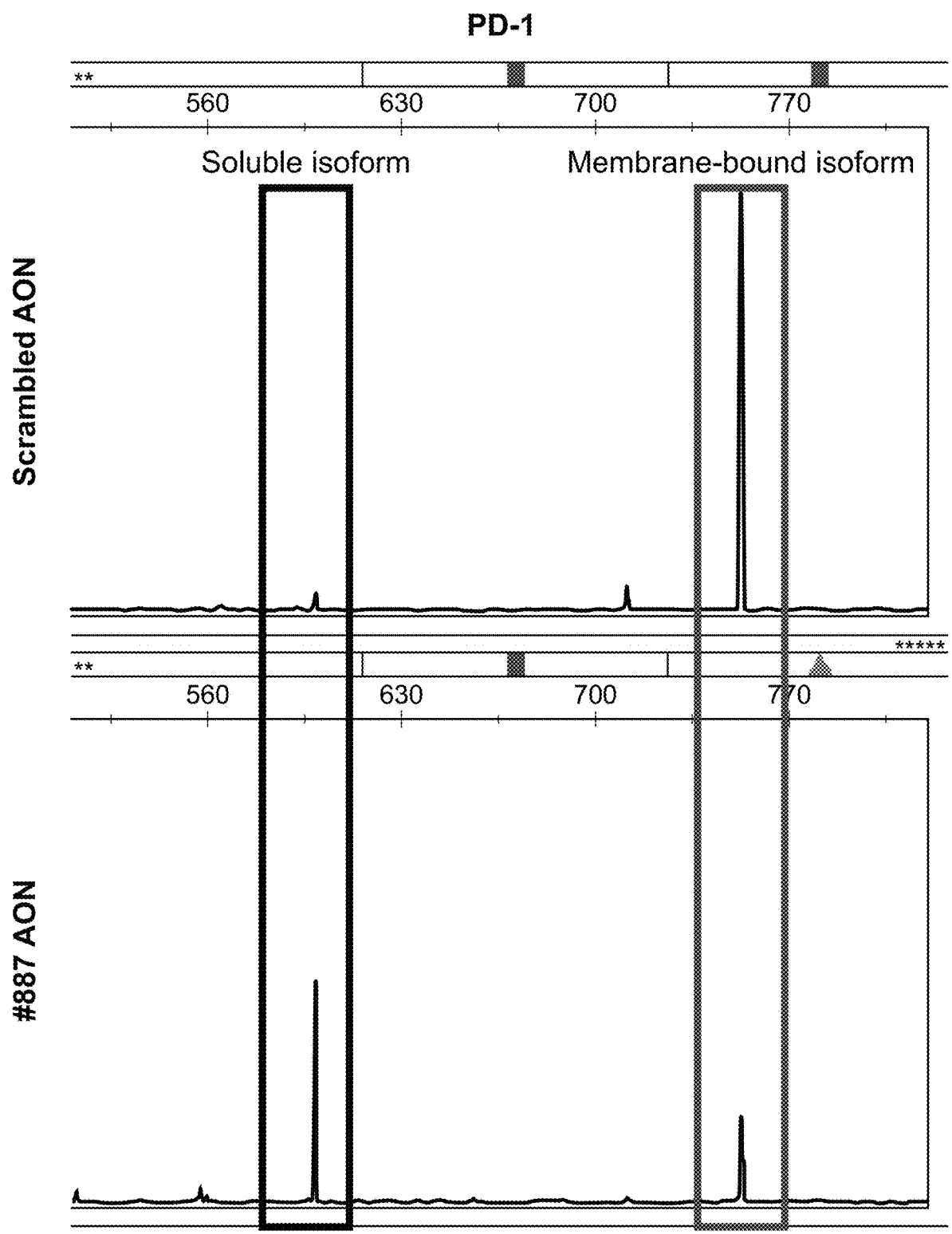
Figure 11B:
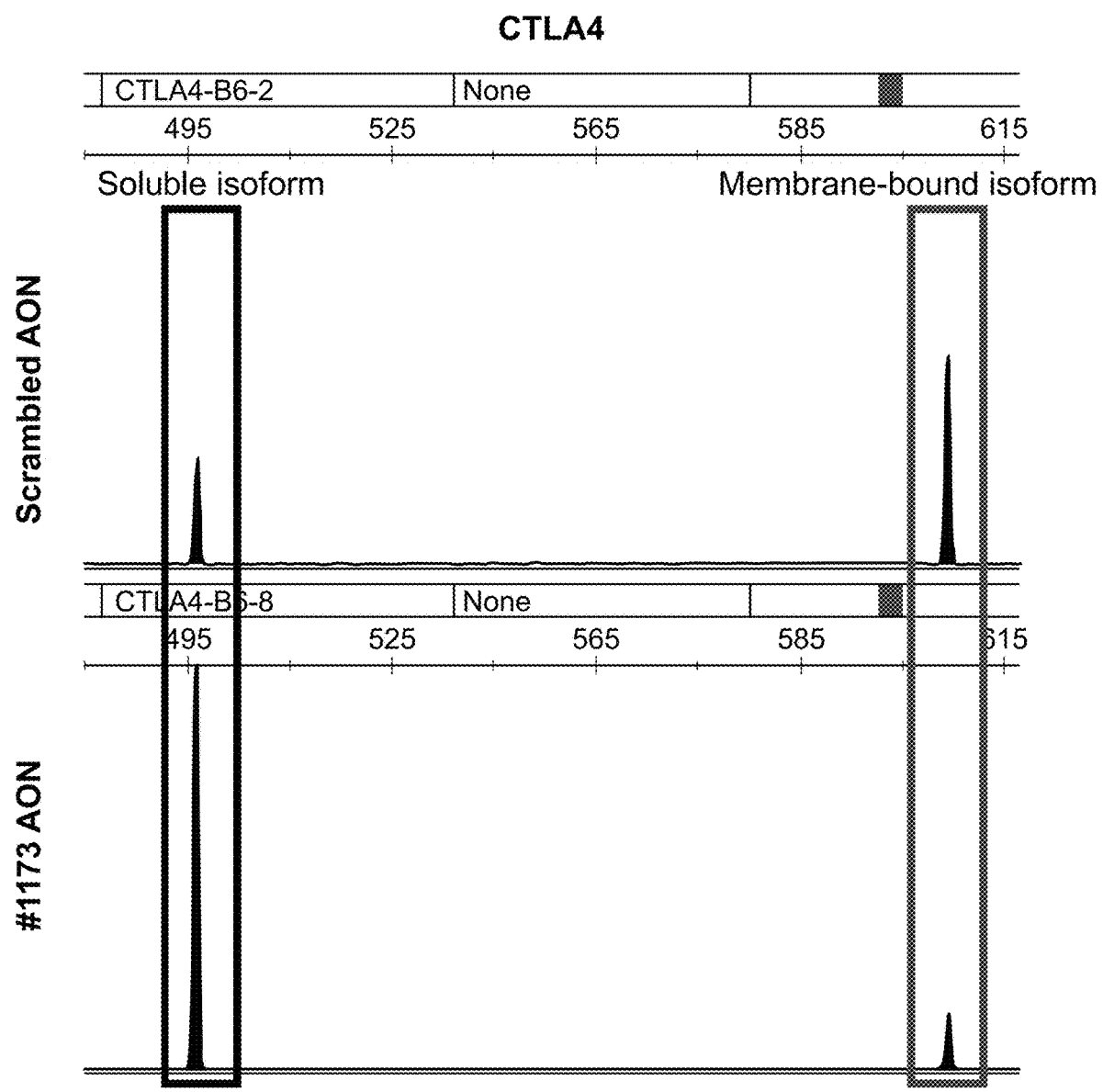
Figure 12A:
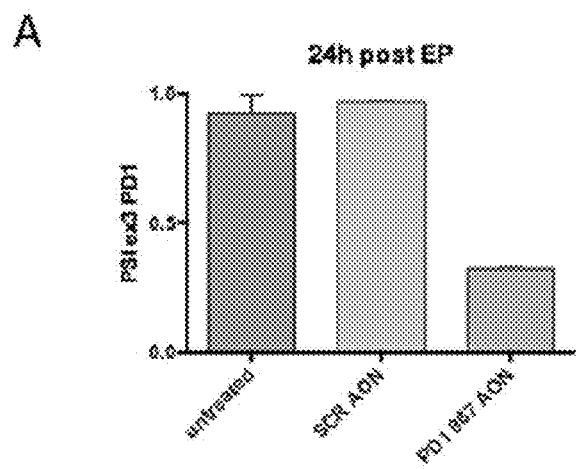
Figure 12B:
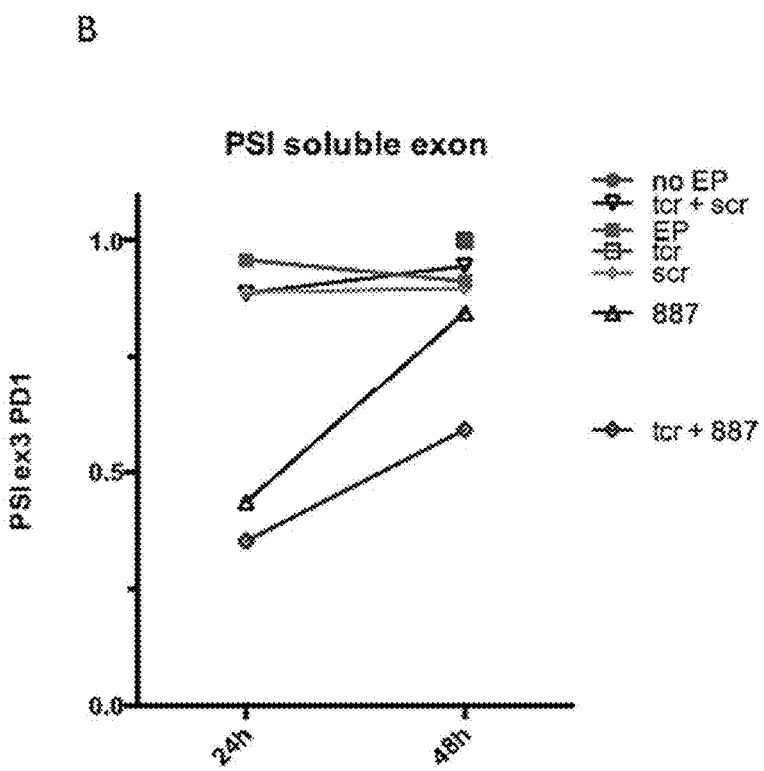
Figure 12C:
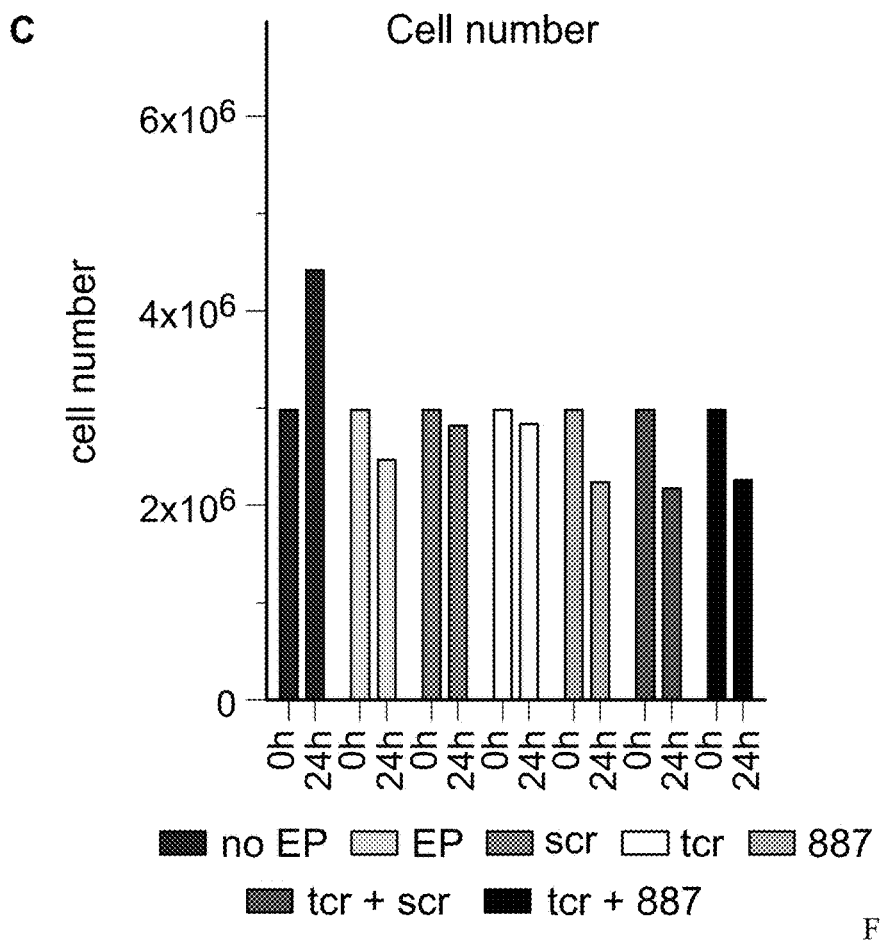
Figure 12D:
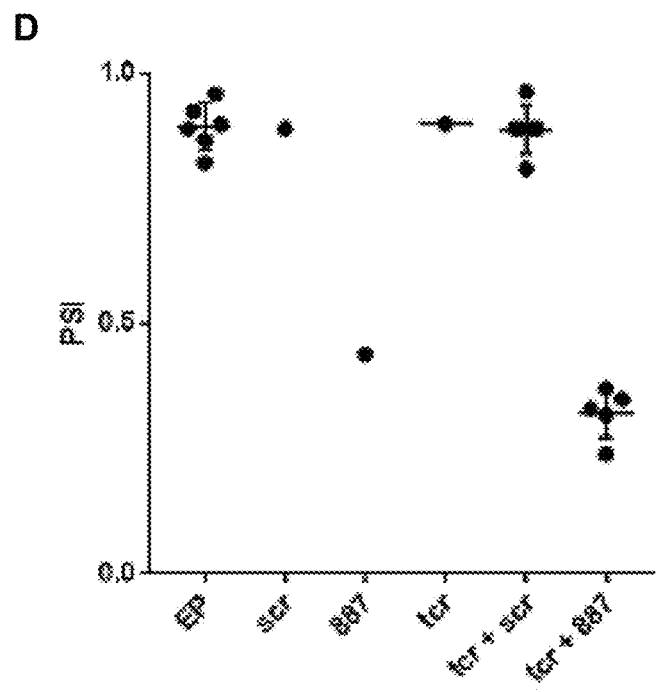

In the present invention, however, the inventors have found that AONs of the present invention can alter the function of a T cell, in particular, those sequences identified in the present application. For example, AONs of the present invention can be efficiently electroporated in primary human T cells and they are able to alter splicing selectively. With reference to FIG. 11, AON #887 (SEQ ID NO. 6508) and #1173 (SEQ ID NO. 2565), at 24h post-electroporation, show a switch from membrane-bound to soluble PD-1 and CTLA4 respectively. Images show the Fragment Length Analysis PCR on T cells cDNA. The height of each peak is proportional to the transcript abundance.

AONs of the present invention are also able to specifically switch exon inclusion without altering cell viability and their effect is compatible with simultaneous TCR electroporation. With reference of FIG. 12, AON #887 (SEQ ID NO. 6508) shows a switch from membrane-bound isoform to soluble isoform of PD-1 for 24/48h post-electroporation at mRNA level (A and B). Cell viability at 24 h post-electroporation is not affected significantly, also in concomitant electroporation of the TCR mRNA (C). Multiple electroporation of AON alone or AON+TCR show a consistent decrease in PSI of PD-1 exon 3 (D).

Figure 13A:
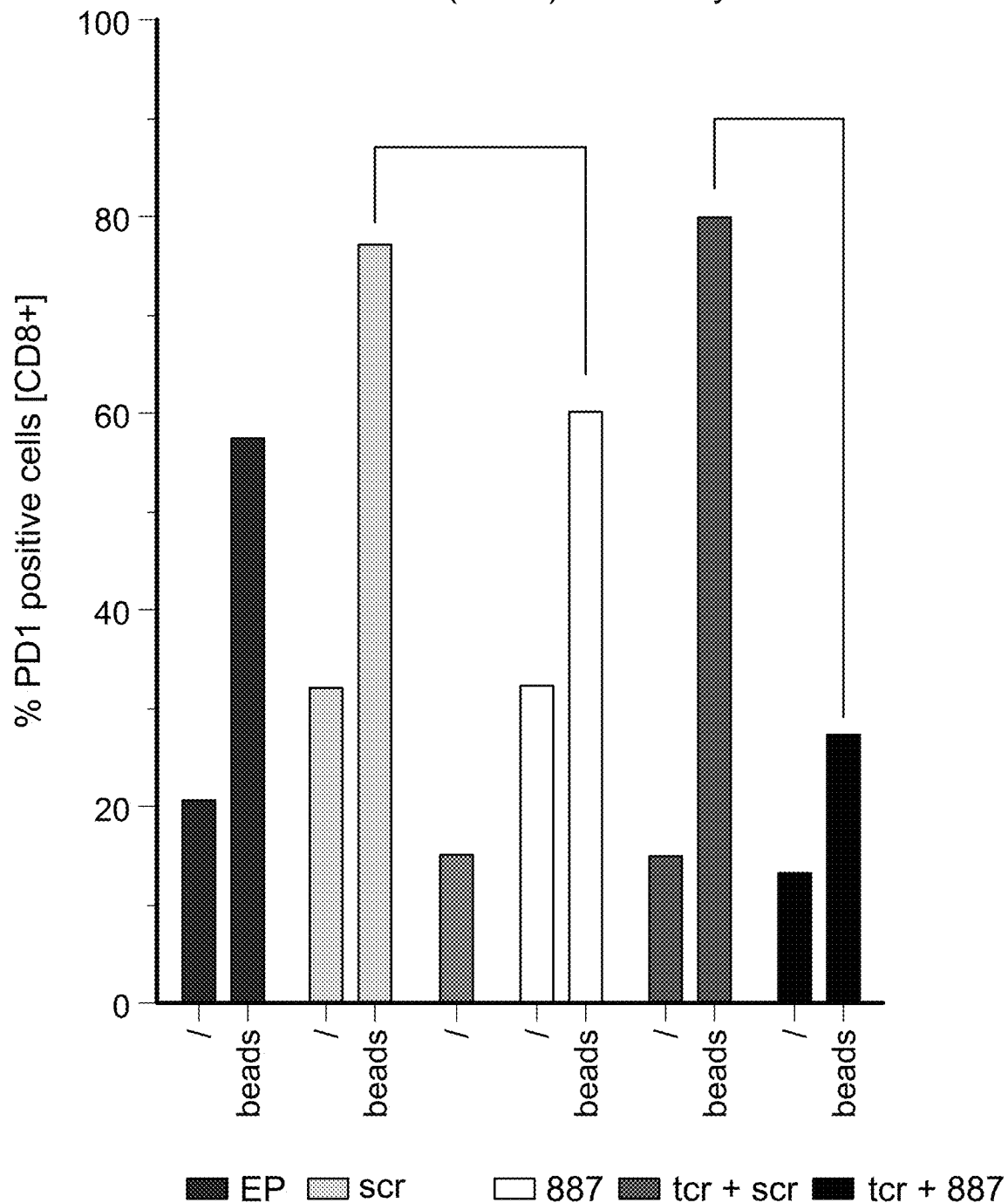
Figure 13B:
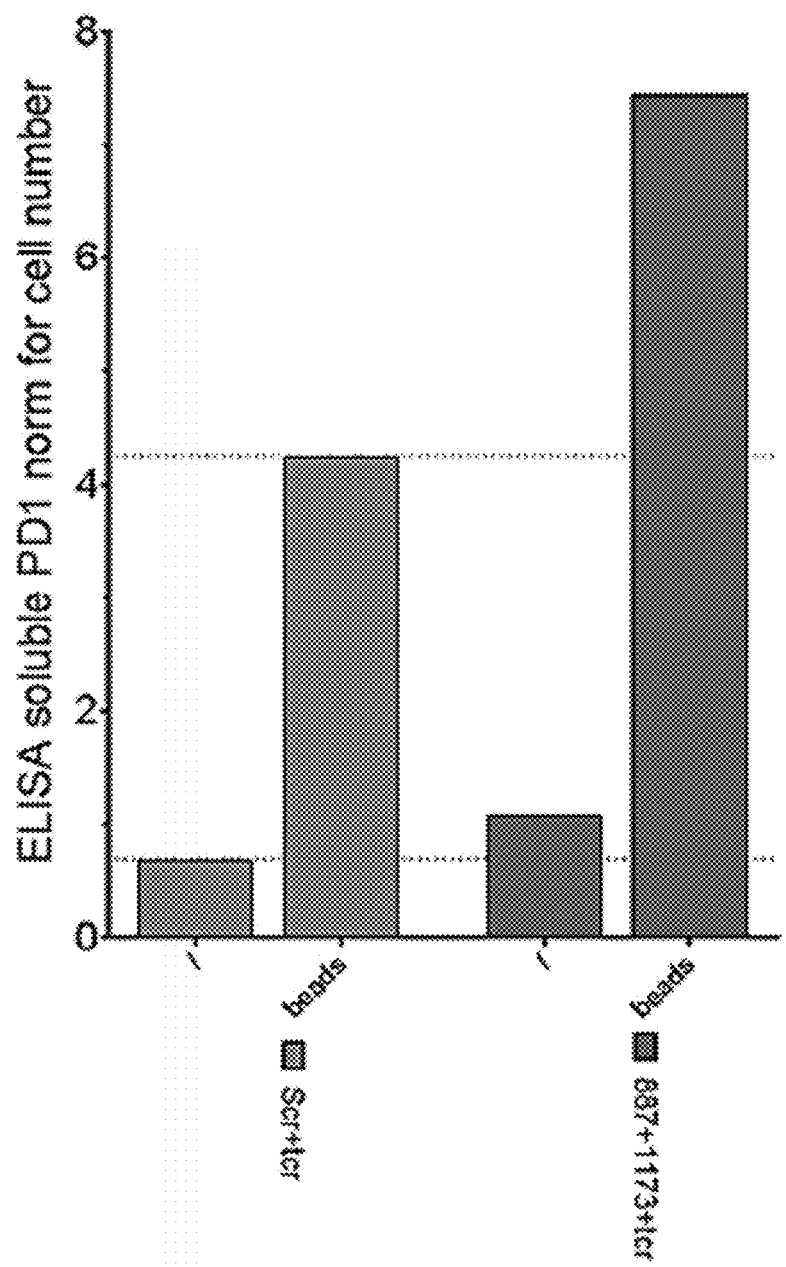
Figure 13C:
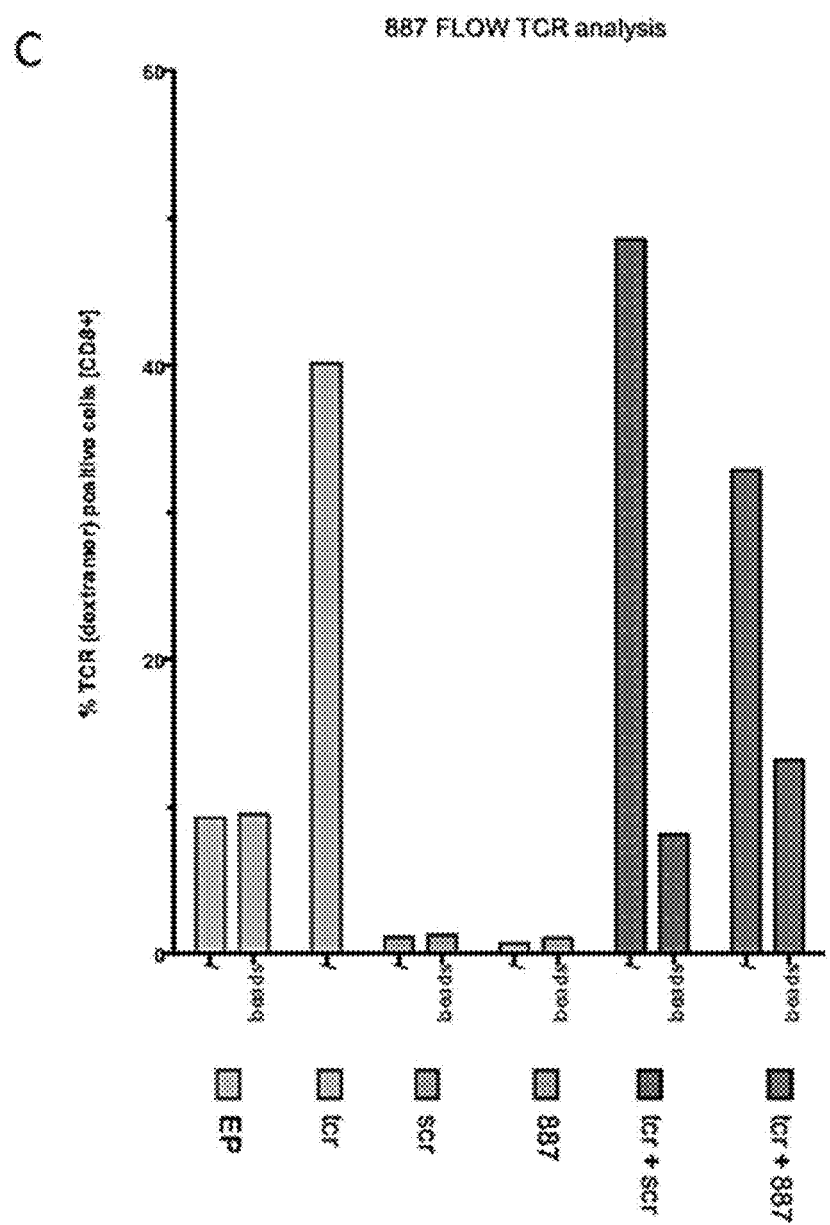

In addition, AONs are able to specifically reduce the membrane-bound proteins without affecting TCR expression. With reference to FIG. 13, AON #887-electroporated T cells show a switch from membrane-bound isoform (A, flow cytometry) to soluble isoform of PD-1 (B, ELISA) at the protein level. Flow cytometry data of the electroporated TCR are not altered significantly by the AON (C).

Figure 14A:
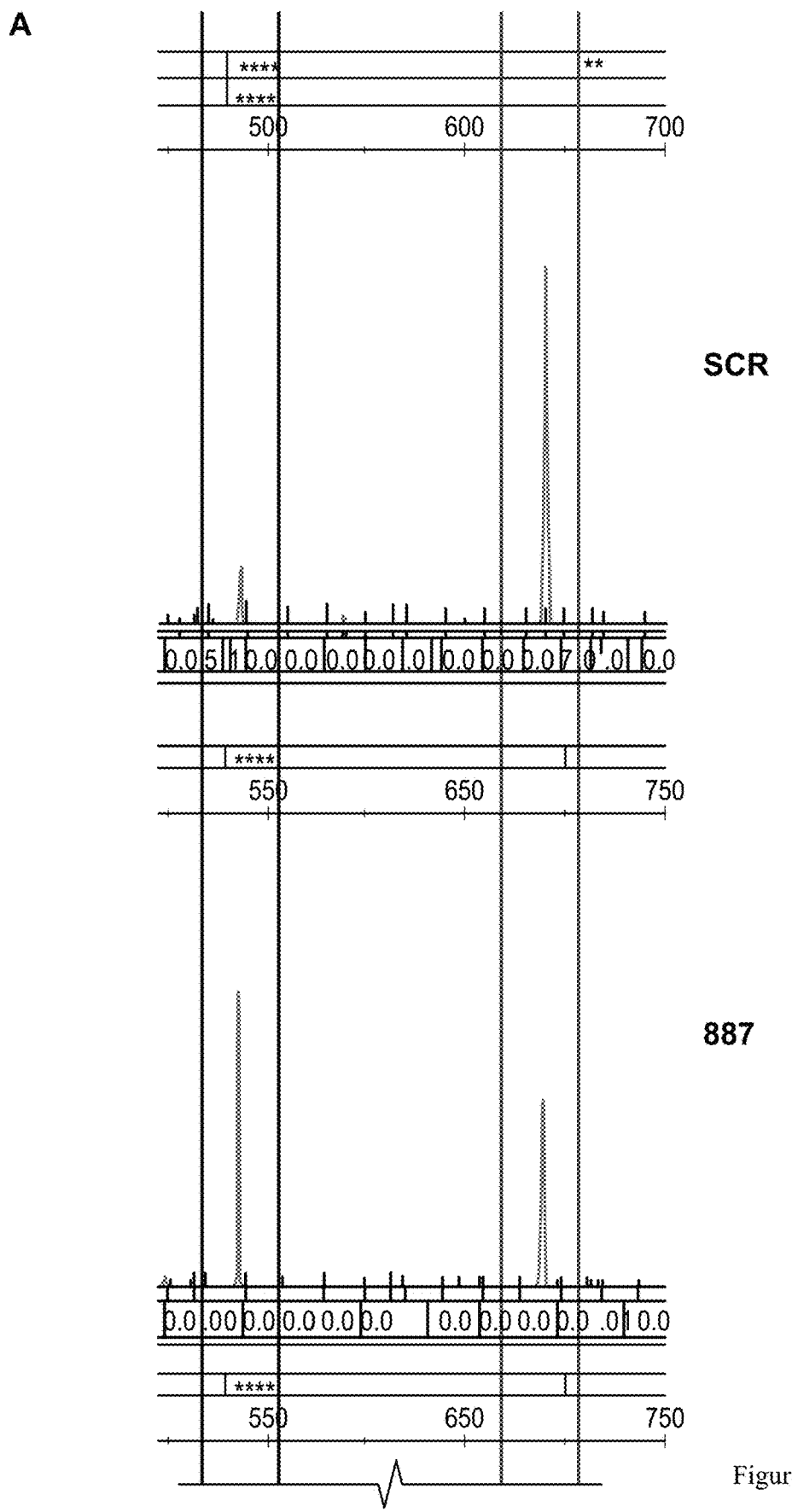
Figure 14A:
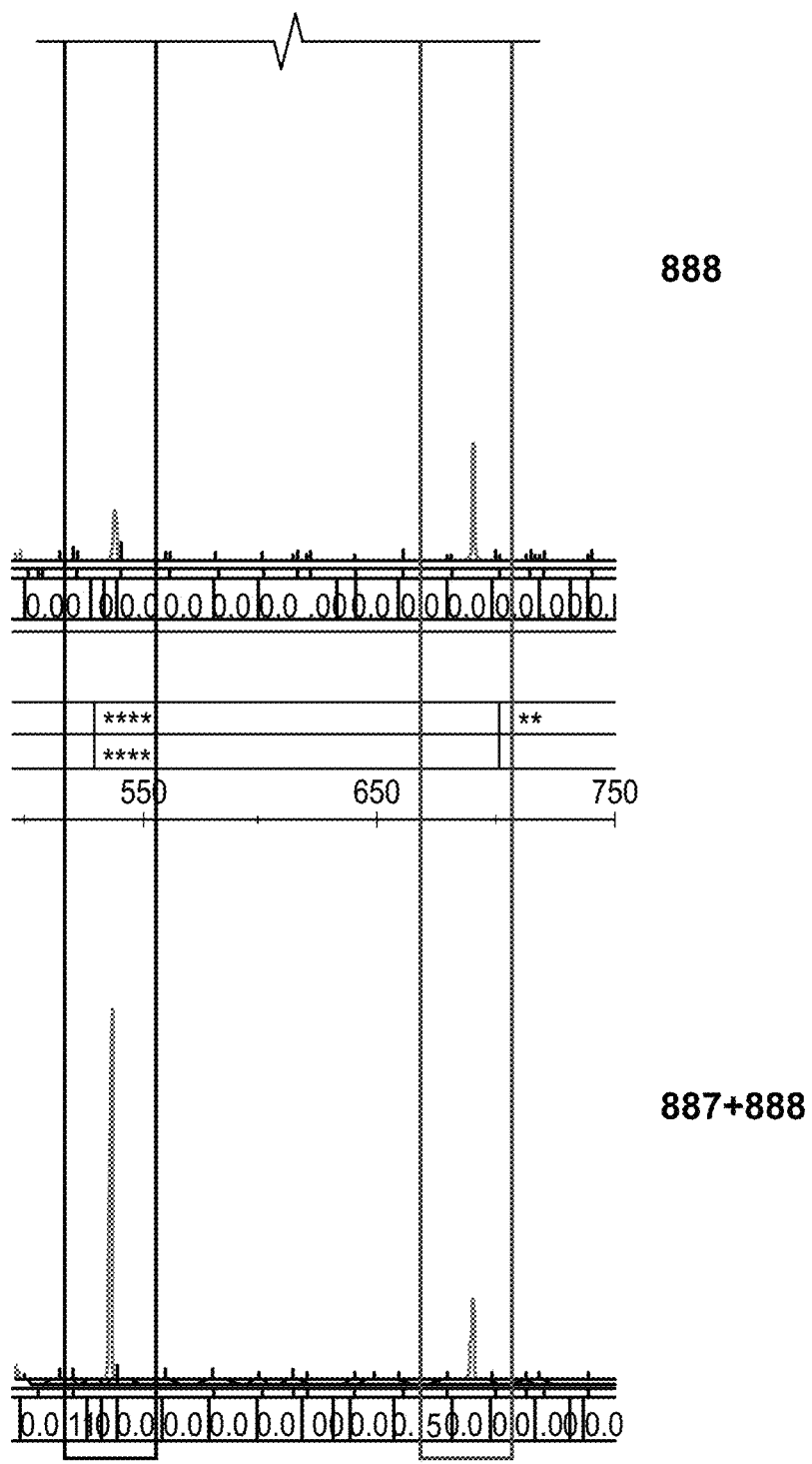
Figures 14B, 14C:
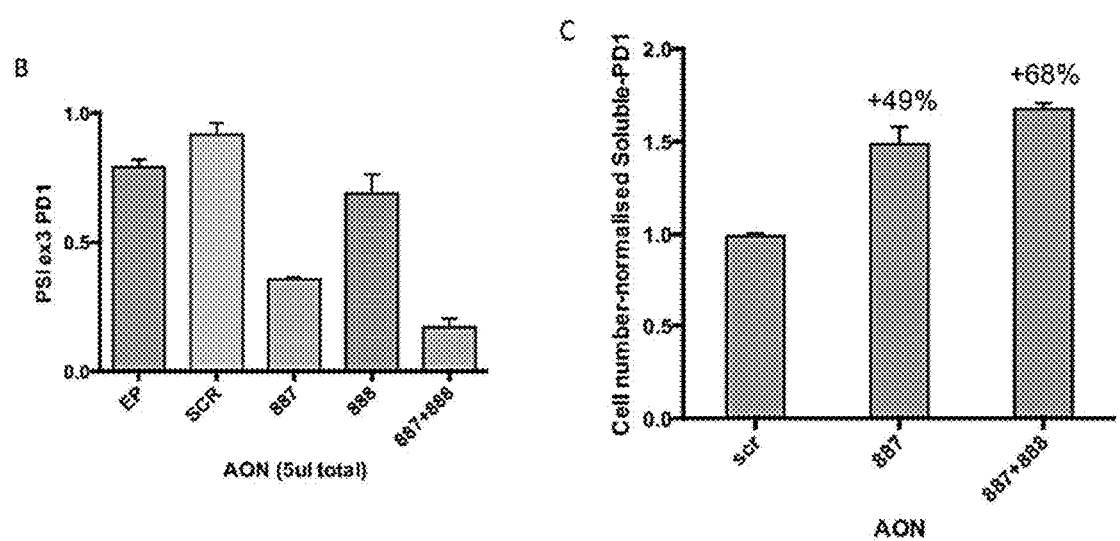

A combination of AONs May also be able to specifically reduce the membrane-bound PD-1 more than AONs in single-use. With reference to FIG. 14, AON #887+#888-electroporated T cells show a switch from membrane-bound isoform (highlighted in the box on the right (A)) to soluble isoform of PD-1 (highlighted in the box on the left, (A)) at the mRNA level. The quantification of the exon 3 PSI of PD-1 is shown in (B). The increase in soluble PD-1 is reflected at the protein level with an increased ELISA score (C).

Figure 15:
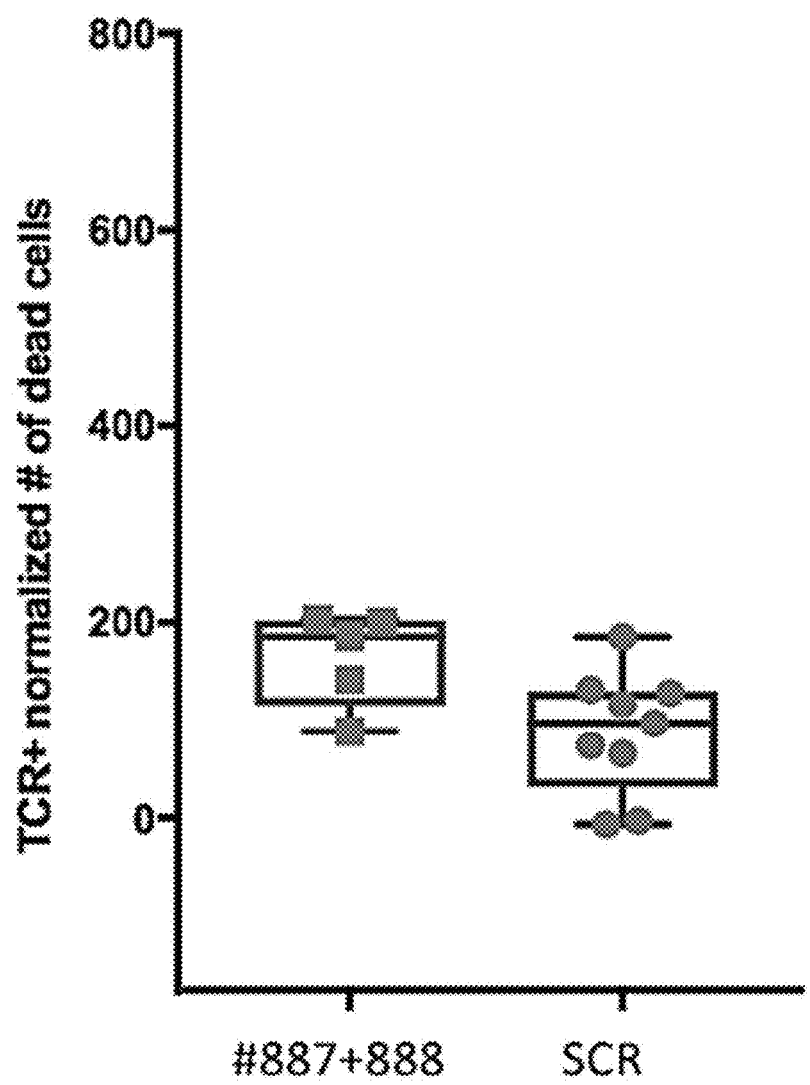

Specifically, AON #887+#888 (SEQ ID NO. 69648) are able to enhance T-cell mediated killing of target cells. FIG. 15 illustrations how AON #887/888+TCR-electroporated T cells show an overall killing increase of HBV hepatocellular carcinoma's in a 3D model compared to AON SCR+TCR-electroporated cells.

FIGS. 16 and 17 illustrates the effect of the present AONs on the target IFN-γ. The exon skipping induced by an IFN-γ-specific AON is dose dependent and transient. FIG. 16 shows 1.5/2.5/5 femtomoles of AON per cell with PCR done on RNA extracted at 0-6 12 18 24 48 72 hours after transfection with different amounts of an AON targeting IFN-γ.

Figure 17A:
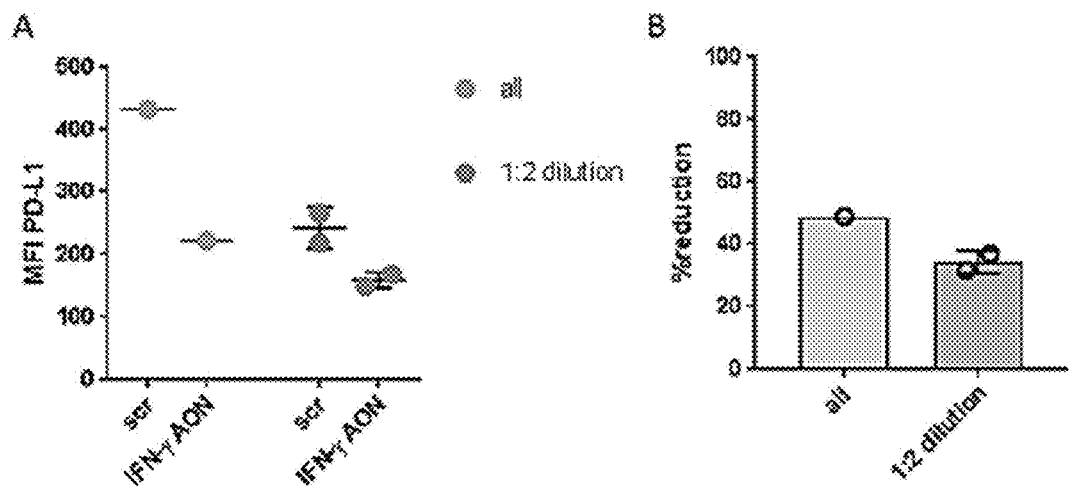
Figure 17B:
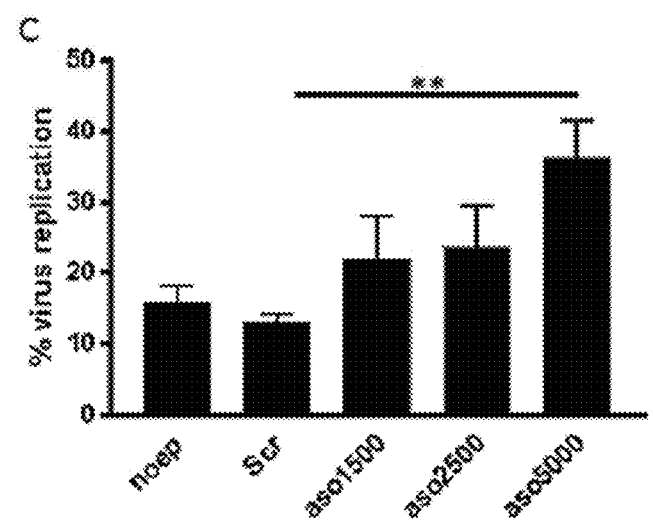

FIG. 17 illustrates the functional change of T cells treated with an AON targeting IFN-γ. It was assumed that T cells that produce less IFN-γ will induce less PD-L1 expression in the TME. FIG. 17(a) illustrates how HBV-specific TCR-redirected T cell (with and without an AON targeting IFN-γ) are cultured with HBV-expressing targets and the supernatant is collected after 5 hours. Subsequently, the supernatant is added on THP-1 cells (alone or diluted) and the expression of PD-L1 on THP-1 is measured by flow cytometry. FIG. 17(a): PD-L1 MFI on THP-1. FIG. 17(b): percentage reduction of PD-L1 in the THP-1 cultured with supernatants from AON-treated TCR-redirected T cells (compared to scrambled control). FIG. 17(c): viral replication (measured with luciferase assay) in JFH cells after culture with supernatants of activated T cells transfected with IFN-γ AON. Here, JFH-luciferase HCV replicons are a cell line that express HCV linked to luciferase. This cell line is very sensitive to IFN-γ antiviral activity. The supernatants from T cells treated with that AON are less able to control viral replication in JFH cells, hence they produce less IFN-γ.

Figures 18A, 18B:
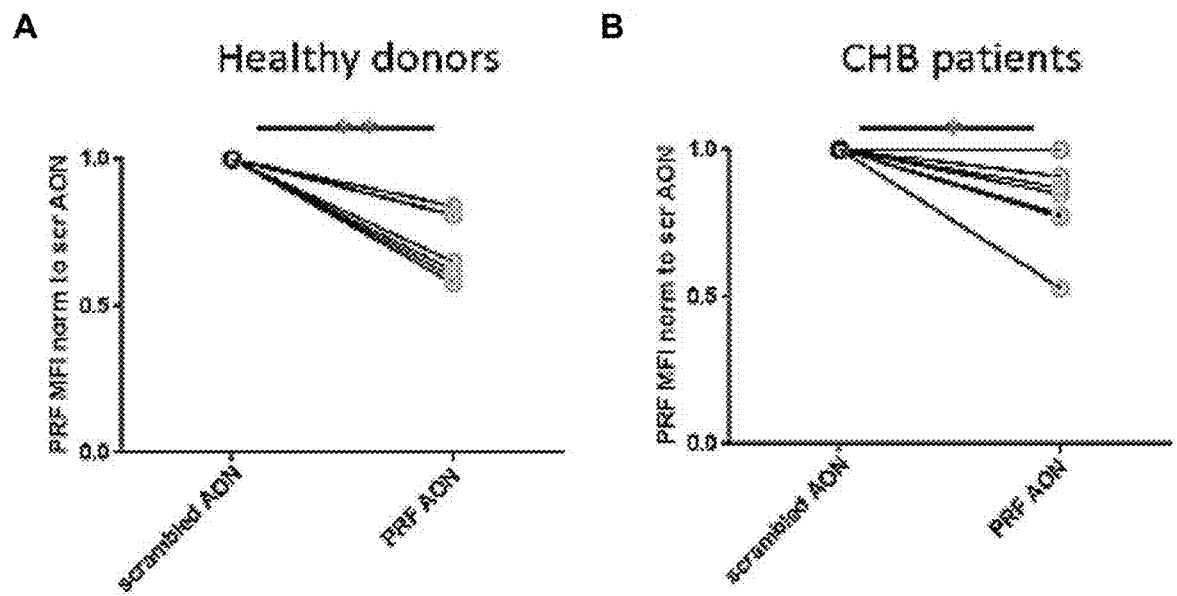
Figures 18C, 18D:
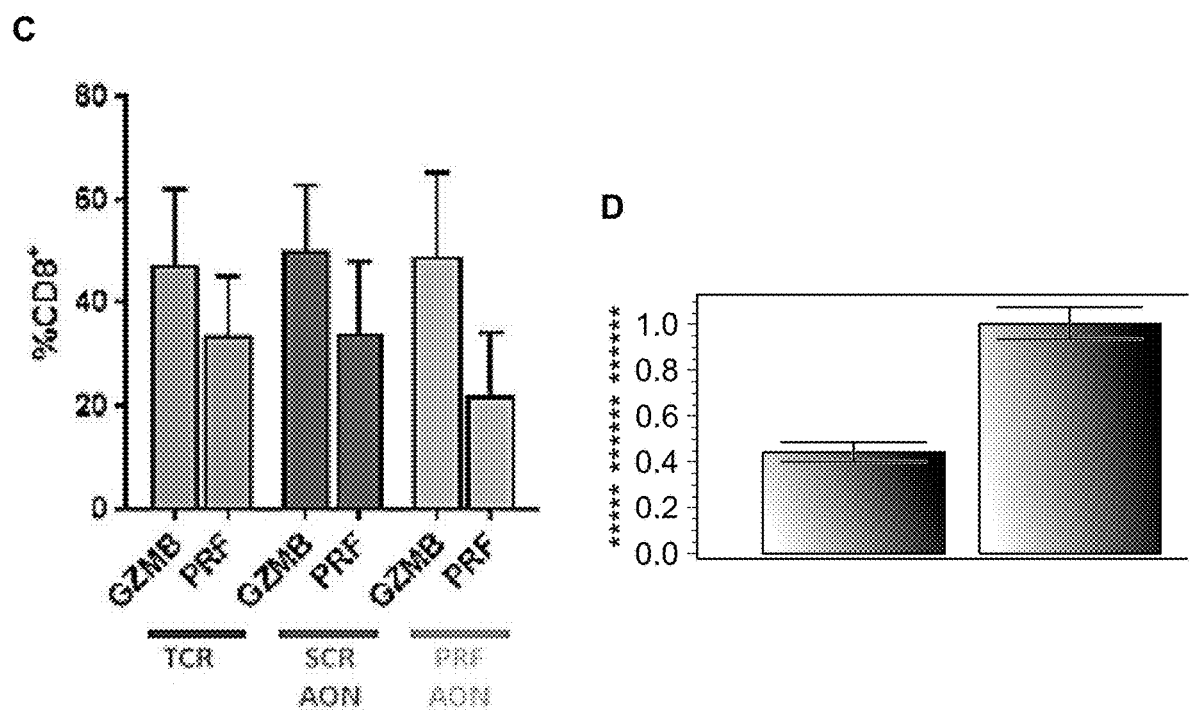

FIG. 18 illustrates an AON targeting PRF specifically reduces the protein levels and can be used in T cells from healthy donors or CHB patients. In FIGS. 18(a) and (b), intracellular cytokine staining (PRF) of T cells treated with an AON targeting PRF expanded from healthy donors or Chronic Hepatitis B patients. The experiment shows that the phenotype is achieved also in the T cells of interest. FIG. 18(c) shows the ICS of PRF and GZMB of TCR-redirected T cells (grey), T cells treated with an scrambled AON (middle 2 bars) and T cells treated with an AON targeting PRF (right most 2 bars). The levels of GZMB are not modified by the AONs, while the levels of PRF are modified only in T cells treated with the PRF AON. FIG. 18(d) shows qPCR on PRF mRNA. The levels of PRF mRNA are reduced after transfection of the specific AON of the present invention.

Figures 19A, 19B:
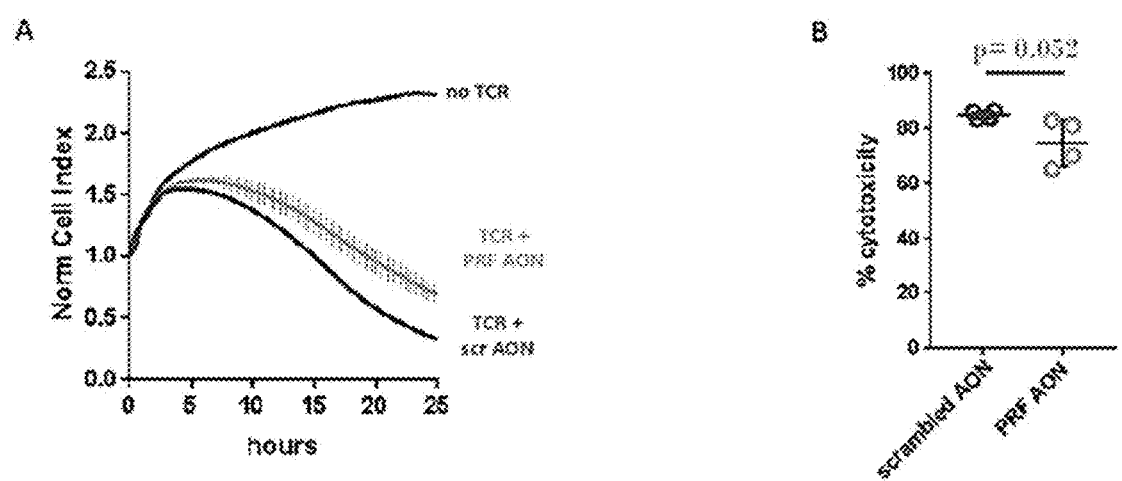

FIG. 19 illustrates TCR-redirected T cells treated with an AON targeting PRF are less cytotoxic. FIG. 19(a) is a representative graph obtained in a cytotoxicity assay in which HBV-specific TCR-redirected T cells (with and without a PRF-specific AON) are cultured with HBV-expressing targets. T cells treated with the PRF AON are less cytotoxic compared to the control. FIG. 19(b) are results obtained based on an average of experiments performed using cells from 4 different donors.

FIG. 20 illustrates the present AONs that induce the skipping of specific exons are triggering a NMD-mediated decrease of the target mRNA, particularly for targets CD244 (leftmost 2 bars), TIM3 (middle 2 bars) and TGIT (rightmost 2 bars). RT-qPCR data obtained on T cells electroporated with AON #524 (directed against CD244), #527 (vs TIM3) and #526 (vs TGIT) show that the relative abundance of mRNA of these genes is strongly decreased in presence of the respective AON.

FIG. 21 illustrates the present AONs that induce the skipping of specific exons are triggering a NMD-mediated decrease of the target mRNA, particularly for targets PRDM1 (leftmost 4 bars) and REL (rightmost 4 bars). With reference to the figure, RT-qPCR data obtained on T cells electroporated with AON #442, #443 and #444 (directed against PRDM1), #462, #463, #464 (vs REL) show that the relative abundance of mRNA of these genes is decreased in presence of the respective AON.

Figure 22A:
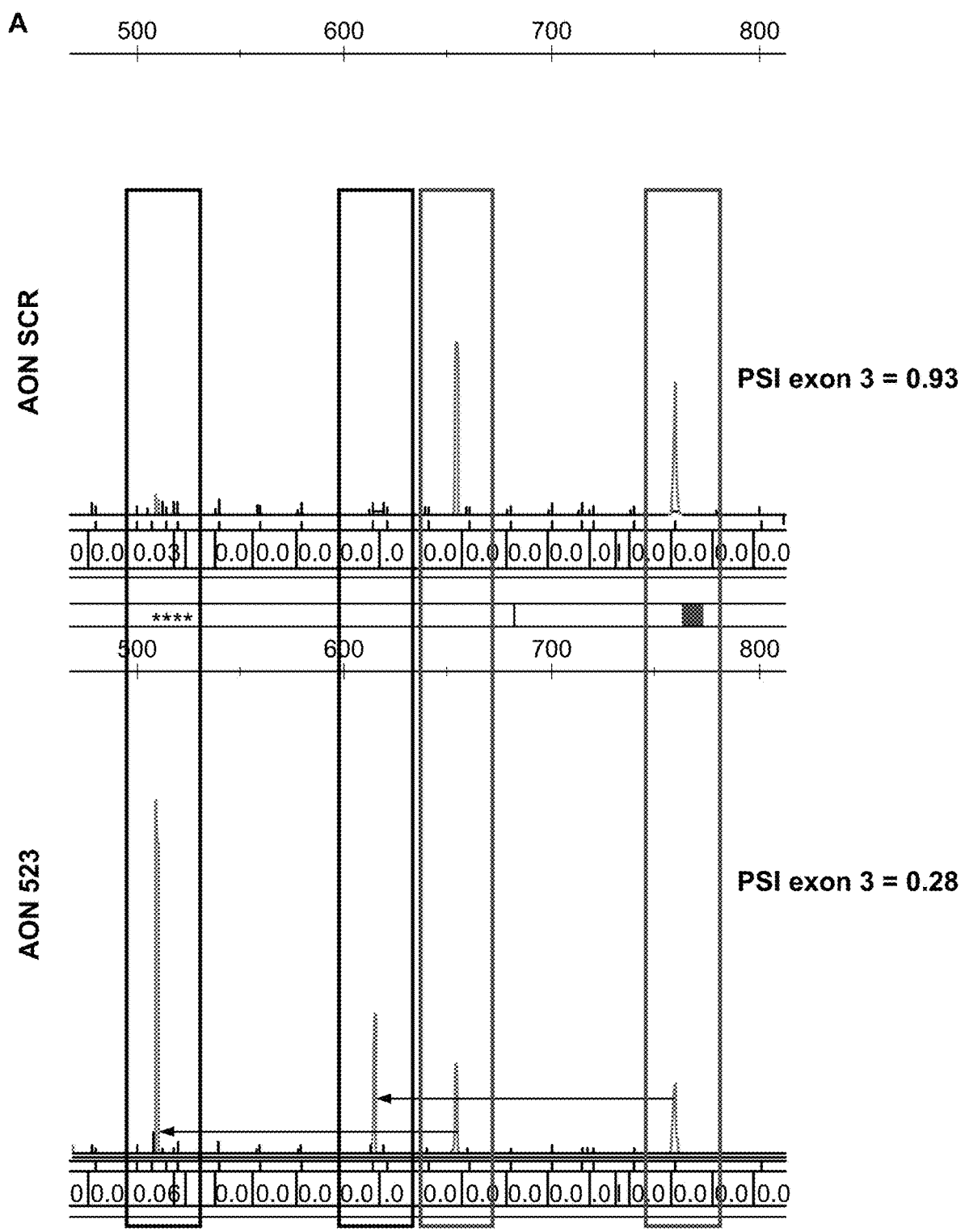
Figure 22B:
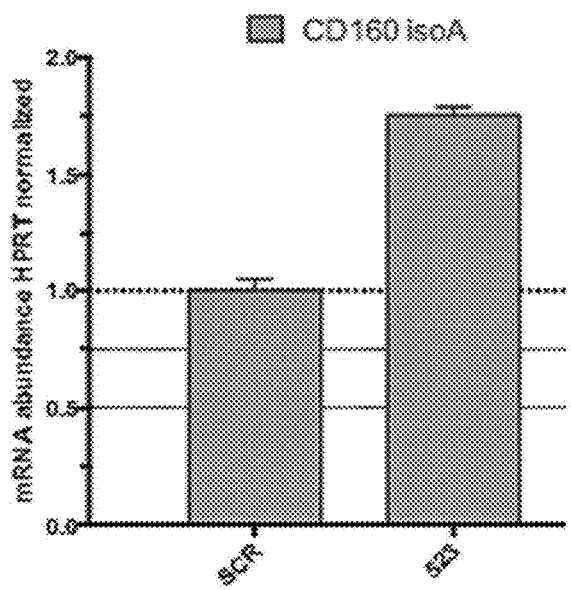

FIG. 22 illustrates how AON #523 is efficiently inducing the skipping of CD160 exon 3, causing an isoform switch. FIG. 22(a) shows FLA-PCR of T cells electroporated with AON Scramble or AON #523 show a switch from the two wild type isoforms (in green rectangles) to the isoforms excluding exon 3 (in the leftmost 2 boxes). FIG. 22(b) shows RT-qPCR data obtained on T cells electroporated with AON 523 show that the relative abundance of CD160 transcript increases.

Figure 23B:
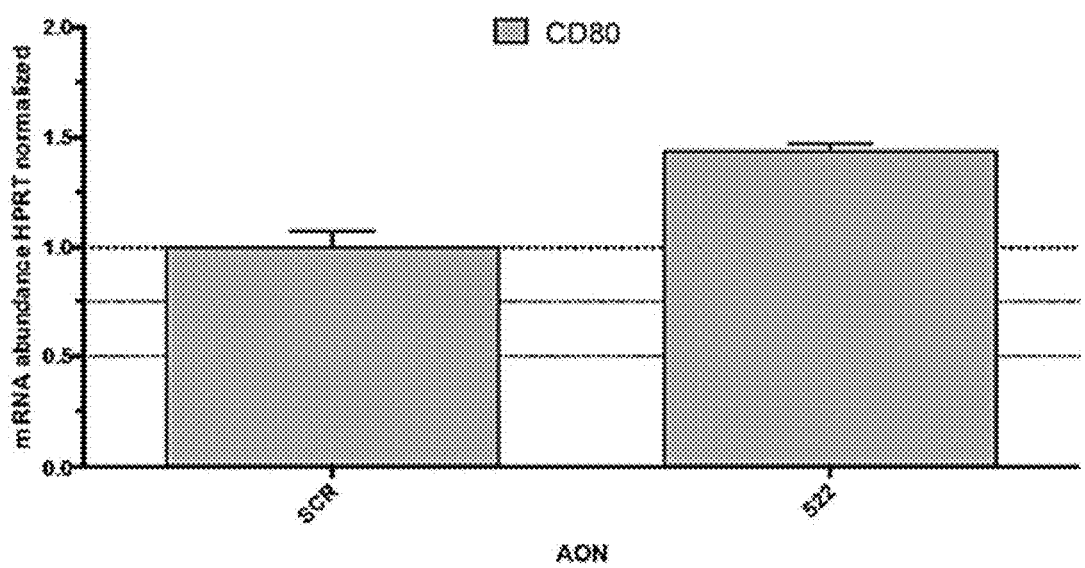

FIG. 23 illustrates how AON #522 is efficiently inducing the skipping of CD80 exon 2, causing an isoform switch. FIG. 23(a) shows FLA-PCR of T cells electroporated with AON Scramble or AON 522 show a switch from the wild type isoform (in leftmost box) to the isoform excluding exon 2 (in rightmost box), peaks. The other peaks are shown as ladder. FIG. 23(b) shows RT-qPCR data obtained on T cells electroporated with AON 522 show that the relative abundance of CD80 transcript increases.

Whilst there has been described in the foregoing description preferred embodiments of the present invention, it will be understood by those skilled in the technology concerned that many variations or modifications in details of design or construction may be made without departing from the present invention.

REFERENCES

[1] Jennifer Couzin-Frankel, "Cancer Immunotherapy," *Science* (80-.)., vol. 342, no. December, p. 1432, 2013.

[2] K. C. M. Straathof, C. M. Bollard, U. Popat, M. H. Huls, T. Lopez, M. C. Morriss, M. V Gresik, A. P. Gee, H. V Russell, M. K. Brenner, C. M. Rooney, and H. E. Heslop, "Treatment of nasopharyngeal carcinoma with Epstein-Barr virus - specific T lymphocytes," *Therapy*, vol. 105, no. 5, pp. 1898-1904, 2005.

[3] M. H. Geukes Foppen, M. Donia, I. M. Svane, and J. B. a G. Haanen, "Tumor-infiltrating lymphocytes for the treatment of metastatic cancer," *Mol. Oncol.*, vol. 9, no. 10, pp. 1918-1935, 2015.

[4] W. Qasim and A. J. Thrasher, "Progress and prospects for engineered T cell therapies," *Br. J. Haematol.*, vol. 166, no. 6, pp. 818-829, 2014.

[5] B. Savoldo, C. A. Ramos, E. Liu, M. P. Mims, M. J. Keating, G. Carrum, R. T. Kamble, C. M. Bollard, A. P. Gee, Z. Mei, H. Liu, B. Grilley, C. M. Rooney, H. E. Heslop, M. K. Brenner, and G. Dotti, "CD28 costimulation improves expansion and persistence of chimeric antigen receptor-modified T cells in lymphoma patients," *J. Clin. Invest.*, vol. 121, no. 5, pp. 1822-1826, 2011.

[6] L. a Johnson, R. a Morgan, M. E. Dudley, L. Cassard, J. C. Yang, M. S, U. S. Kammula, R. E. Royal, R. M. Sherry, J. R. Wunderlich, and C. R. Lee, "regression and targets normal tissues expressing cognate antigen Gene therapy with human and mouse T cell receptors mediates cancer regression and targets normal tissues expressing cognate antigen," *Hematology*, vol. 114, no. 3, pp. 535-547, 2009.

[7] A. J. Gehring, S. A. Xue, Z. Z. Ho, D. Teoh, C. Ruedl, A. Chia, S. Koh, S. G. Lim, M. K. Maini, H. Stauss, and A. Bertoletti, "Engineering virus-specific T cells that target HBV infected hepatocytes and hepatocellular carcinoma cell lines," *J. Hepatol.*, vol. 55, no. 1, pp. 103-110, 2011.

[8] W. Qasim, M. Brunetto, A. J. Gehring, S.-A. Xue, A. Schurich, A. Khakpoor, H. Zhan, P. Ciccorossi, K. Gilmour, D. Cavallone, F. Moriconi, F. Farzhenah, A. Mazzoni, L. Chan, E. Morris, A. Thrasher, M. K. Maini, F. Bonino, H. Stauss, and A. Bertoletti, "Immunotherapy of HCC metastases with autologous T cell receptor redirected T cells, targeting HBsAg in a liver transplant patient.," *J. Hepatol.*, vol. 62, no. 2, pp. 486-491, 2015.

[9] S. Koh, N. Shimasaki, R. Suwanarusk, Z. Z. Ho, A. Chia, N. Banu, S. W. Howland, A. S. M. Ong, A. J. Gehring, H. Stauss, L. Renia, M. Sallberg, D. Campana, and A. Bertoletti, "A practical approach to immunotherapy of hepatocellular carcinoma using T cells redirected against hepatitis B virus.," *Mol. Ther. Nucleic Acids*, vol. 2, no. August, p. e114, 2013.

[10] E. J. Wherry, S. J. Ha, S. M. Kaech, W. N. Haining, S. Sarkar, V. Kalia, S. Subramaniam, J. N. Blattman, D. L. Barber, and R. Ahmed, "Molecular Signature of CD8+ T Cell Exhaustion during Chronic Viral Infection," *Immunity*, vol. 27, no. 4, pp. 670-684, 2007.

[11] P. a. Morcos, "Achieving targeted and quantifiable alteration of mRNA splicing with Morpholino oligos," *Biochem. Biophys. Res. Commun.*, vol. 358, no. 2, pp. 521-527, 2007.

[12] G. Schmajuk, H. Sierakowska, and R. Kole, "Antisense Oligonucleotides with Different Backbones," *J. Biol. Chem.*, vol. 274, no. 31, pp. 21783-21789, 1999.

[13] E. M. McNally and E. J. Wyatt, "Welcome to the splice age: Antisense oligonucleotide-mediated exon skipping gains wider applicability," *J. Clin. Invest.*, vol. 126, no. 4, pp. 1236-1238, 2016.

[14] V. Straub, O. Veldhuizen, M. Bertoli, M. Eagle, J. Walton, G. Campion, I. Ferreira, T. Braakman, A. Labourkas, S. Giannakopoulos, T. Voit, P. Carlier, A. Moraux, L. Servais, I. De Myologie, E. Niks, J. Verschuuren, P. Spitali, and L. U. M. Cen-, "A Phase I/IIa Clinical Trial in Duchenne Muscular Dystrophy Using Systemically Delivered Morpholino Antisense Oligomer to Skip Exon 53 (SKIP-NMD)," *Hum. Gene Ther. Clin. Dev.*, vol. 26, pp. 92-95, 2015.

[15] J. T. Van Den Akker, D. Ph, B. E. Burm, D. Ph, P. F. Ekhart, M. Sc, N. Heuvelmans, T. Holling, D. Ph, A. a Janson, G. J. Platenburg, M. Sc, J. a Sipkens, M. Sc, J. M. A. Sitsen, D. Ph, A. Aartsma-rus, D. Ph, G. B. Van Ommen, D. Ph, S. J. De Kimpe, D. Ph, J. C. Van Deutekom, and D. Ph, "Systemic Administration of PRO051 in Duchenne's Muscular Dystrophy," pp. 1513-1522, 2011.

[16] N. J. Gogtay and K. Sridharan, "Therapeutic Nucleic Acids: Current clinical status.," *Br. J. Clin. Pharmacol., pp.* 1-14, 2016.

[17] J. Jo, U. Aichele, N. Kersting, R. Klein, P. Aichele, E. Bisse, A. K. Sewell, H. E. Blum, R. Bartenschlager, V. Lohmann, and R. Thimme, "Analysis of CD8+ T-Cell-Mediated Inhibition of Hepatitis C Virus Replication Using a Novel Immunological Model," *Gastroenterology*, vol. 136, no. 4, pp. 1391-1401, 2009.

[18] A. J. Davenport, M. R. Jenkins, R. S. Cross, C. S. Yong, H. M. Prince, D. S. Ritchie, J. a Trapani, M. H. Kershaw, P. K. Darcy, and P. J. Neeson, "CAR-T Cells Inflict Sequential Killing of Multiple Tumor Target Cells.," *Cancer Immunol. Res.*, vol. 3, no. 5, pp. 483-94, 2015.

SEQUENCE LISTING (70817 sequences)

SEQ ID NO: 1 - RNA, 15 nt, Artificial Sequence
  Synthetic Oligonucleotide; CTLA4 exon 2; Set C
augcccagguaguau

SEQ ID NO: 2 - RNA, 16 nt, Artificial Sequence
  Synthetic Oligonucleotide; CTLA4 exon 2; Set C
uaugcccagguaguau

SEQ ID NO: 3 - RNA, 15 nt, Artificial Sequence
  Synthetic Oligonucleotide; CTLA4 exon 2; Set C
uaugcccagguagua

SEQ ID NO: 4 - RNA, 17 nt, Artificial Sequence
  Synthetic Oligonucleotide; CTLA4 exon 2; Set C
cuaugcccagguaguau

SEQ ID NO: 5 - RNA, 16 nt, Artificial Sequence
  Synthetic Oligonucleotide; CTLA4 exon 2; Set C
cuaugcccagguagua

SEQ ID NO: 6 - RNA, 15 nt, Artificial Sequence
  Synthetic Oligonucleotide; CTLA4 exon 2; Set C
cuaugcccagguagu

SEQ ID NO: 7 - RNA, 22 nt, Artificial Sequence
  Synthetic Oligonucleotide; CTLA4 exon 2; Set B
guugccuaugcccagguaguau

SEQ ID NO: 8 - RNA, 21 nt, Artificial Sequence
  Synthetic Oligonucleotide; CTLA4 exon 2; Set B
guugccuaugcccagguagua

SEQ ID NO: 9 - RNA, 20 nt, Artificial Sequence
  Synthetic Oligonucleotide; CTLA4 exon 2; Set B
guugccuaugcccagguagu

SEQ ID NO: 10 - RNA, 19 nt, Artificial Sequence
  Synthetic Oligonucleotide; CTLA4 exon 2; Set B
guugccuaugcccagguag

SEQ ID NO: 11 - RNA, 18 nt, Artificial Sequence
  Synthetic Oligonucleotide; CTLA4 exon 2; Set B
guugccuaugcccaggua

SEQ ID NO: 12 - RNA, 27 nt, Artificial Sequence
  Synthetic Oligonucleotide; CTLA4 exon 2; Set C
guuccguugccuaugcccagguaguau

SEQ ID NO: 13 - RNA, 26 nt, Artificial Sequence
  Synthetic Oligonucleotide; CTLA4 exon 2; Set C
guuccguugccuaugcccagguagua

SEQ ID NO: 14 - RNA, 28 nt, Artificial Sequence
  Synthetic Oligonucleotide; CTLA4 exon 2; Set C
gguuccguugccuaugcccagguaguau

SEQ ID NO: 15 - RNA, 25 nt, Artificial Sequence
  Synthetic Oligonucleotide; CTLA4 exon 2; Set C
guuccguugccuaugcccagguagu

SEQ ID NO: 16 - RNA, 27 nt, Artificial Sequence
  Synthetic Oligonucleotide; CTLA4 exon 2; Set C
gguuccguugccuaugcccagguagua

SEQ ID NO: 17 - RNA, 29 nt, Artificial Sequence
  Synthetic Oligonucleotide; CTLA4 exon 2; Set C
ggguuccguugccuaugcccagguaguau

SEQ ID NO: 18 - RNA, 24 nt, Artificial Sequence
  Synthetic Oligonucleotide; CTLA4 exon 2; Set C
guuccguugccuaugcccagguag

SEQ ID NO: 19 - RNA, 28 nt, Artificial Sequence
  Synthetic Oligonucleotide; CTLA4 exon 2; Set C
ggguuccguugccuaugcccagguagua

SEQ ID NO: 20 - RNA, 26 nt, Artificial Sequence
  Synthetic Oligonucleotide; CTLA4 exon 2; Set C
gguuccguugccuaugcccagguagu

SEQ ID NO: 21 - RNA, 30 nt, Artificial Sequence
  Synthetic Oligonucleotide; CTLA4 exon 2; Set C
uggguuccguugccuaugcccagguaguau

SEQ ID NO: 22 - RNA, 29 nt, Artificial Sequence
  Synthetic Oligonucleotide; CTLA4 exon 2; Set C
uggguuccguugccuaugcccagguagua

SEQ ID NO: 23 - RNA, 27 nt, Artificial Sequence
  Synthetic Oligonucleotide; CTLA4 exon 2; Set C
ggguuccguugccuaugcccagguagu

SEQ ID NO: 24 - RNA, 25 nt, Artificial Sequence
  Synthetic Oligonucleotide; CTLA4 exon 2; Set C
gguuccguugccuaugcccagguag

SEQ ID NO: 25 - RNA, 31 nt, Artificial Sequence
  Synthetic Oligonucleotide; CTLA4 exon 2; Set C
cuggguuccguugccuaugcccagguaguau

SEQ ID NO: 26 - RNA, 23 nt, Artificial Sequence
  Synthetic Oligonucleotide; CTLA4 exon 2; Set C
guuccguugccuaugcccaggua

SEQ ID NO: 27 - RNA, 28 nt, Artificial Sequence
  Synthetic Oligonucleotide; CTLA4 exon 2; Set C
uggguuccguugccuaugcccagguagu

SEQ ID NO: 28 - RNA, 26 nt, Artificial Sequence
  Synthetic Oligonucleotide; CTLA4 exon 2; Set C
ggguuccguugccuaugcccagguag

SEQ ID NO: 29 - RNA, 30 nt, Artificial Sequence
  Synthetic Oligonucleotide; CTLA4 exon 2; Set C
cuggguuccguugccuaugcccagguagua

SEQ ID NO: 30 - RNA, 32 nt, Artificial Sequence
  Synthetic Oligonucleotide; CTLA4 exon 2; Set C
ucuggguuccguugccuaugcccagguaguau

SEQ ID NO: 31 - RNA, 24 nt, Artificial Sequence
  Synthetic Oligonucleotide; CTLA4 exon 2; Set C
gguuccguugccuaugcccaggua

SEQ ID NO: 32 - RNA, 27 nt, Artificial Sequence
  Synthetic Oligonucleotide; CTLA4 exon 2; Set C
uggguuccguugccuaugcccagguag

SEQ ID NO: 33 - RNA, 31 nt, Artificial Sequence
  Synthetic Oligonucleotide; CTLA4 exon 2; Set C
ucuggguuccguugccuaugcccagguagua

SEQ ID NO: 34 - RNA, 29 nt, Artificial Sequence
  Synthetic Oligonucleotide; CTLA4 exon 2; Set C
cuggguuccguugccuaugcccagguagu

SEQ ID NO: 35 - RNA, 33 nt, Artificial Sequence
  Synthetic Oligonucleotide; CTLA4 exon 2; Set C
aucuggguuccguugccuaugcccagguaguau

SEQ ID NO: 36 - RNA, 25 nt, Artificial Sequence
  Synthetic Oligonucleotide; CTLA4 exon 2; Set C
ggguuccguugccuaugcccaggua

SEQ ID NO: 37 - RNA, 32 nt, Artificial Sequence
  Synthetic Oligonucleotide; CTLA4 exon 2; Set C
aucuggguuccguugccuaugcccagguagua

SEQ ID NO: 38 - RNA, 30 nt, Artificial Sequence
  Synthetic Oligonucleotide; CTLA4 exon 2; Set C
ucuggguuccguugccuaugcccagguagu

SEQ ID NO: 39 - RNA, 28 nt, Artificial Sequence
  Synthetic Oligonucleotide; CTLA4 exon 2; Set C
cuggguuccguugccuaugcccagguag

SEQ ID NO: 40 - RNA, 34 nt, Artificial Sequence
  Synthetic Oligonucleotide; CTLA4 exon 2; Set C
aaucuggguuccguugccuaugcccagguaguau

SEQ ID NO: 41 - RNA, 26 nt, Artificial Sequence
  Synthetic Oligonucleotide; CTLA4 exon 2; Set C
uggguuccguugccuaugcccaggua

SEQ ID NO: 42 - RNA, 33 nt, Artificial Sequence
  Synthetic Oligonucleotide; CTLA4 exon 2; Set C
aaucuggguuccguugccuaugcccagguagua

SEQ ID NO: 43 - RNA, 31 nt, Artificial Sequence
  Synthetic Oligonucleotide; CTLA4 exon 2; Set C
aucuggguuccguugccuaugcccagguagu

SEQ ID NO: 44 - RNA, 29 nt, Artificial Sequence
  Synthetic Oligonucleotide; CTLA4 exon 2; Set C
ucuggguuccguugccuaugcccagguag

SEQ ID NO: 45 - RNA, 35 nt, Artificial Sequence
  Synthetic Oligonucleotide; CTLA4 exon 2; Set C
aaaucuggguuccguugccuaugcccagguaguau

SEQ ID NO: 46 - RNA, 27 nt, Artificial Sequence
  Synthetic Oligonucleotide; CTLA4 exon 2; Set C
cuggguuccguugccuaugcccaggua

SEQ ID NO: 47 - RNA, 34 nt, Artificial Sequence
  Synthetic Oligonucleotide; CTLA4 exon 2; Set C
aaaucuggguuccguugccuaugcccagguagua

SEQ ID NO: 48 - RNA, 32 nt, Artificial Sequence
  Synthetic Oligonucleotide; CTLA4 exon 2; Set C
aaucuggguuccguugccuaugcccagguagu

SEQ ID NO: 49 - RNA, 30 nt, Artificial Sequence
  Synthetic Oligonucleotide; CTLA4 exon 2; Set C
aucuggguuccguugccuaugcccagguag

SEQ ID NO: 50 - RNA, 36 nt, Artificial Sequence
  Synthetic Oligonucleotide; CTLA4 exon 2; Set C
uaaaucuggguuccguugccuaugcccagguaguau

SEQ ID NO: 51 - RNA, 28 nt, Artificial Sequence
  Synthetic Oligonucleotide; CTLA4 exon 2; Set C
ucuggguuccguugccuaugcccaggua

SEQ ID NO: 52 - RNA, 35 nt, Artificial Sequence
  Synthetic Oligonucleotide; CTLA4 exon 2; Set C
uaaaucuggguuccguugccuaugcccagguagua

SEQ ID NO: 53 - RNA, 33 nt, Artificial Sequence
  Synthetic Oligonucleotide; CTLA4 exon 2; Set C
aaaucuggguuccguugccuaugcccagguagu

SEQ ID NO: 54 - RNA, 31 nt, Artificial Sequence
  Synthetic Oligonucleotide; CTLA4 exon 2; Set C
aaucuggguuccguugccuaugcccagguag

SEQ ID NO: 55 - RNA, 37 nt, Artificial Sequence
  Synthetic Oligonucleotide; CTLA4 exon 2; Set C
auaaaucuggguuccguugccuaugcccagguaguau

SEQ ID NO: 56 - RNA, 29 nt, Artificial Sequence
  Synthetic Oligonucleotide; CTLA4 exon 2; Set C
aucuggguuccguugccuaugcccaggua

SEQ ID NO: 57 - RNA, 34 nt, Artificial Sequence
  Synthetic Oligonucleotide; CTLA4 exon 2; Set C
uaaaucuggguuccguugccuaugcccagguagu

SEQ ID NO: 58 - RNA, 32 nt, Artificial Sequence
  Synthetic Oligonucleotide; CTLA4 exon 2; Set C
aaaucuggguuccguugccuaugcccagguag

SEQ ID NO: 59 - RNA, 36 nt, Artificial Sequence
  Synthetic Oligonucleotide; CTLA4 exon 2; Set C
auaaaucuggguuccguugccuaugcccagguagua

SEQ ID NO: 60 - RNA, 38 nt, Artificial Sequence
  Synthetic Oligonucleotide; CTLA4 exon 2; Set C
cauaaaucuggguuccguugccuaugcccagguaguau

SEQ ID NO: 61 - RNA, 30 nt, Artificial Sequence
  Synthetic Oligonucleotide; CTLA4 exon 2; Set C
aaucuggguuccguugccuaugcccaggua

SEQ ID NO: 62 - RNA, 33 nt, Artificial Sequence
  Synthetic Oligonucleotide; CTLA4 exon 2; Set C
uaaaucuggguuccguugccuaugcccagguag

SEQ ID NO: 63 - RNA, 35 nt, Artificial Sequence
  Synthetic Oligonucleotide; CTLA4 exon 2; Set C
auaaaucuggguuccguugccuaugcccagguagu

SEQ ID NO: 64 - RNA, 37 nt, Artificial Sequence
  Synthetic Oligonucleotide; CTLA4 exon 2; Set C
cauaaaucuggguuccguugccuaugcccagguagua

SEQ ID NO: 65 - RNA, 39 nt, Artificial Sequence
  Synthetic Oligonucleotide; CTLA4 exon 2; Set C
acauaaaucuggguuccguugccuaugcccagguaguau

SEQ ID NO: 66 - RNA, 31 nt, Artificial Sequence
  Synthetic Oligonucleotide; CTLA4 exon 2; Set C
aaaucuggguuccguugccuaugcccaggua

SEQ ID NO: 67 - RNA, 15 nt, Artificial Sequence
  Synthetic Oligonucleotide; CTLA4 exon 2; Set C
guuccguugccuaug

SEQ ID NO: 68 - RNA, 34 nt, Artificial Sequence
  Synthetic Oligonucleotide; CTLA4 exon 2; Set C
auaaaucuggguuccguugccuaugcccagguag

SEQ ID NO: 69 - RNA, 36 nt, Artificial Sequence
  Synthetic Oligonucleotide; CTLA4 exon 2; Set C
cauaaaucuggguuccguugccuaugcccagguagu

SEQ ID NO: 70 - RNA, 38 nt, Artificial Sequence
  Synthetic Oligonucleotide; CTLA4 exon 2; Set C
acauaaaucuggguuccguugccuaugcccagguagua

SEQ ID NO: 71 - RNA, 40 nt, Artificial Sequence
  Synthetic Oligonucleotide; CTLA4 exon 2; Set C
uacauaaaucuggguuccguugccuaugcccagguaguau

SEQ ID NO: 72 - RNA, 32 nt, Artificial Sequence
  Synthetic Oligonucleotide; CTLA4 exon 2; Set C
uaaaucuggguuccguugccuaugcccaggua

SEQ ID NO: 73 - RNA, 35 nt, Artificial Sequence
  Synthetic Oligonucleotide; CTLA4 exon 2; Set C
cauaaaucuggguuccguugccuaugcccagguag

SEQ ID NO: 74 - RNA, 37 nt, Artificial Sequence
  Synthetic Oligonucleotide; CTLA4 exon 2; Set C
acauaaaucuggguuccguugccuaugcccagguagu

SEQ ID NO: 75 - RNA, 39 nt, Artificial Sequence
  Synthetic Oligonucleotide; CTLA4 exon 2; Set C
uacauaaaucuggguuccguugccuaugcccagguagua

SEQ ID NO: 76 - RNA, 15 nt, Artificial Sequence
  Synthetic Oligonucleotide; CTLA4 exon 2; Set C
gguuccguugccuau

SEQ ID NO: 77 - RNA, 33 nt, Artificial Sequence
  Synthetic Oligonucleotide; CTLA4 exon 2; Set C
auaaaucuggguuccguugccuaugcccaggua

SEQ ID NO: 78 - RNA, 36 nt, Artificial Sequence
  Synthetic Oligonucleotide; CTLA4 exon 2; Set C
acauaaaucuggguuccguugccuaugcccagguag

SEQ ID NO: 79 - RNA, 38 nt, Artificial Sequence
  Synthetic Oligonucleotide; CTLA4 exon 2; Set C
uacauaaaucuggguuccguugccuaugcccagguagu

SEQ ID NO: 80 - RNA, 40 nt, Artificial Sequence
  Synthetic Oligonucleotide; CTLA4 exon 2; Set C
uuacauaaaucuggguuccguugccuaugcccagguagua

SEQ ID NO: 81 - RNA, 16 nt, Artificial Sequence
  Synthetic Oligonucleotide; CTLA4 exon 2; Set C
ggguuccguugccuau

SEQ ID NO: 82 - RNA, 34 nt, Artificial Sequence
  Synthetic Oligonucleotide; CTLA4 exon 2; Set C
cauaaaucuggguuccguugccuaugcccaggua

SEQ ID NO: 83 - RNA, 37 nt, Artificial Sequence
  Synthetic Oligonucleotide; CTLA4 exon 2; Set C
uacauaaaucuggguuccguugccuaugcccagguag

SEQ ID NO: 84 - RNA, 39 nt, Artificial Sequence
  Synthetic Oligonucleotide; CTLA4 exon 2; Set C
uuacauaaaucuggguuccguugccuaugcccagguagu

SEQ ID NO: 85 - RNA, 15 nt, Artificial Sequence
  Synthetic Oligonucleotide; CTLA4 exon 2; Set C
ggguuccguugccua

SEQ ID NO: 86 - RNA, 17 nt, Artificial Sequence
  Synthetic Oligonucleotide; CTLA4 exon 2; Set C
uggguuccguugccuau

SEQ ID NO: 87 - RNA, 35 nt, Artificial Sequence
  Synthetic Oligonucleotide; CTLA4 exon 2; Set C
acauaaaucuggguuccguugccuaugcccaggua

SEQ ID NO: 88 - RNA, 40 nt, Artificial Sequence
  Synthetic Oligonucleotide; CTLA4 exon 2; Set C
auuacauaaaucuggguuccguugccuaugcccagguagu

SEQ ID NO: 89 - RNA, 38 nt, Artificial Sequence
  Synthetic Oligonucleotide; CTLA4 exon 2; Set C
uuacauaaaucuggguuccguugccuaugcccagguag

SEQ ID NO: 90 - RNA, 16 nt, Artificial Sequence
  Synthetic Oligonucleotide; CTLA4 exon 2; Set C
uggguuccguugccua

SEQ ID NO: 91 - RNA, 18 nt, Artificial Sequence
  Synthetic Oligonucleotide; CTLA4 exon 2; Set B
cuggguuccguugccuau

SEQ ID NO: 92 - RNA, 36 nt, Artificial Sequence
  Synthetic Oligonucleotide; CTLA4 exon 2; Set C
uacauaaaucuggguuccguugccuaugcccaggua

SEQ ID NO: 93 - RNA, 39 nt, Artificial Sequence
  Synthetic Oligonucleotide; CTLA4 exon 2; Set C
auuacauaaaucuggguuccguugccuaugcccagguag

SEQ ID NO: 94 - RNA, 17 nt, Artificial Sequence
  Synthetic Oligonucleotide; CTLA4 exon 2; Set B
cuggguuccguugccua

SEQ ID NO: 95 - RNA, 19 nt, Artificial Sequence
  Synthetic Oligonucleotide; CTLA4 exon 2; Set B
ucuggguuccguugccuau

SEQ ID NO: 96 - RNA, 37 nt, Artificial Sequence
  Synthetic Oligonucleotide; CTLA4 exon 2; Set C
uuacauaaaucuggguuccguugccuaugcccaggua

SEQ ID NO: 97 - RNA, 21 nt, Artificial Sequence
  Synthetic Oligonucleotide; CTLA4 exon 2; Set B
aucuggguuccguugccuaug

SEQ ID NO: 98 - RNA, 40 nt, Artificial Sequence
  Synthetic Oligonucleotide; CTLA4 exon 2; Set C
aauuacauaaaucuggguuccguugccuaugcccagguag

SEQ ID NO: 99 - RNA, 18 nt, Artificial Sequence
  Synthetic Oligonucleotide; CTLA4 exon 2; Set B
ucuggguuccguugccua

SEQ ID NO: 100 - RNA, 20 nt, Artificial Sequence
  Synthetic Oligonucleotide; CTLA4 exon 2; Set B
aucuggguuccguugccuau

SEQ ID NO: 101 - RNA, 38 nt, Artificial Sequence
  Synthetic Oligonucleotide; CTLA4 exon 2; Set C
auuacauaaaucuggguuccguugccuaugcccaggua

SEQ ID NO: 102 - RNA, 22 nt, Artificial Sequence
  Synthetic Oligonucleotide; CTLA4 exon 2; Set B
aaucuggguuccguugccuaug

SEQ ID NO: 103 - RNA, 19 nt, Artificial Sequence
  Synthetic Oligonucleotide; CTLA4 exon 2; Set B
aucuggguuccguugccua

SEQ ID NO: 104 - RNA, 21 nt, Artificial Sequence
  Synthetic Oligonucleotide; CTLA4 exon 2; Set B
aaucuggguuccguugccuau

SEQ ID NO: 105 - RNA, 39 nt, Artificial Sequence
  Synthetic Oligonucleotide; CTLA4 exon 2; Set C
aauuacauaaaucuggguuccguugccuaugcccaggua

SEQ ID NO: 106 - RNA, 23 nt, Artificial Sequence
  Synthetic Oligonucleotide; CTLA4 exon 2; Set B
aaaucuggguuccguugccuaug

SEQ ID NO: 107 - RNA, 20 nt, Artificial Sequence
  Synthetic Oligonucleotide; CTLA4 exon 2; Set B
aaucuggguuccguugccua

SEQ ID NO: 108 - RNA, 22 nt, Artificial Sequence
  Synthetic Oligonucleotide; CTLA4 exon 2; Set B
aaaucuggguuccguugccuau

SEQ ID NO: 109 - RNA, 24 nt, Artificial Sequence
  Synthetic Oligonucleotide; CTLA4 exon 2; Set B
uaaaucuggguuccguugccuaug

SEQ ID NO: 110 - RNA, 21 nt, Artificial Sequence
  Synthetic Oligonucleotide; CTLA4 exon 2; Set B
aaaucuggguuccguugccua

SEQ ID NO: 111 - RNA, 23 nt, Artificial Sequence
  Synthetic Oligonucleotide; CTLA4 exon 2; Set B
uaaaucuggguuccguugccuau

SEQ ID NO: 112 - RNA, 25 nt, Artificial Sequence
  Synthetic Oligonucleotide; CTLA4 exon 2; Set B
auaaaucuggguuccguugccuaug

SEQ ID NO: 113 - RNA, 22 nt, Artificial Sequence
  Synthetic Oligonucleotide; CTLA4 exon 2; Set B
uaaaucuggguuccguugccua

SEQ ID NO: 114 - RNA, 24 nt, Artificial Sequence
  Synthetic Oligonucleotide; CTLA4 exon 2; Set B
auaaaucuggguuccguugccuau

SEQ ID NO: 115 - RNA, 26 nt, Artificial Sequence
  Synthetic Oligonucleotide; CTLA4 exon 2; Set B
cauaaaucuggguuccguugccuaug

SEQ ID NO: 116 - RNA, 23 nt, Artificial Sequence
  Synthetic Oligonucleotide; CTLA4 exon 2; Set B
auaaaucuggguuccguugccua

SEQ ID NO: 117 - RNA, 25 nt, Artificial Sequence
  Synthetic Oligonucleotide; CTLA4 exon 2; Set B
cauaaaucuggguuccguugccuau

SEQ ID NO: 118 - RNA, 27 nt, Artificial Sequence
  Synthetic Oligonucleotide; CTLA4 exon 2; Set B
acauaaaucuggguuccguugccuaug

SEQ ID NO: 119 - RNA, 24 nt, Artificial Sequence
  Synthetic Oligonucleotide; CTLA4 exon 2; Set B
cauaaaucuggguuccguugccua

SEQ ID NO: 120 - RNA, 26 nt, Artificial Sequence
  Synthetic Oligonucleotide; CTLA4 exon 2; Set B
acauaaaucuggguuccguugccuau

SEQ ID NO: 121 - RNA, 28 nt, Artificial Sequence
  Synthetic Oligonucleotide; CTLA4 exon 2; Set B
uacauaaaucuggguuccguugccuaug

SEQ ID NO: 122 - RNA, 25 nt, Artificial Sequence
  Synthetic Oligonucleotide; CTLA4 exon 2; Set B
acauaaaucuggguuccguugccua

SEQ ID NO: 123 - RNA, 27 nt, Artificial Sequence
  Synthetic Oligonucleotide; CTLA4 exon 2; Set B
uacauaaaucuggguuccguugccuau

SEQ ID NO: 124 - RNA, 15 nt, Artificial Sequence
  Synthetic Oligonucleotide; CTLA4 exon 2; Set C
aaucuggguuccguu

SEQ ID NO: 125 - RNA, 26 nt, Artificial Sequence
  Synthetic Oligonucleotide; CTLA4 exon 2; Set B
uacauaaaucuggguuccguugccua

SEQ ID NO: 126 - RNA, 28 nt, Artificial Sequence
  Synthetic Oligonucleotide; CTLA4 exon 2; Set B
uuacauaaaucuggguuccguugccuau

SEQ ID NO: 127 - RNA, 16 nt, Artificial Sequence
  Synthetic Oligonucleotide; CTLA4 exon 2; Set C
aaaucuggguuccguu

SEQ ID NO: 128 - RNA, 30 nt, Artificial Sequence
  Synthetic Oligonucleotide; CTLA4 exon 2; Set B
auuacauaaaucuggguuccguugccuaug

SEQ ID NO: 129 - RNA, 27 nt, Artificial Sequence
  Synthetic Oligonucleotide; CTLA4 exon 2; Set B
uuacauaaaucuggguuccguugccua

SEQ ID NO: 130 - RNA, 29 nt, Artificial Sequence
  Synthetic Oligonucleotide; CTLA4 exon 2; Set B
auuacauaaaucuggguuccguugccuau

SEQ ID NO: 131 - RNA, 17 nt, Artificial Sequence
  Synthetic Oligonucleotide; CTLA4 exon 2; Set C
uaaaucuggguuccguu

SEQ ID NO: 132 - RNA, 28 nt, Artificial Sequence
  Synthetic Oligonucleotide; CTLA4 exon 2; Set B
auuacauaaaucuggguuccguugccua

SEQ ID NO: 133 - RNA, 30 nt, Artificial Sequence
  Synthetic Oligonucleotide; CTLA4 exon 2; Set B
aauuacauaaaucuggguuccguugccuau

SEQ ID NO: 134 - RNA, 18 nt, Artificial Sequence
  Synthetic Oligonucleotide; CTLA4 exon 2; Set C
auaaaucuggguuccguu

SEQ ID NO: 135 - RNA, 29 nt, Artificial Sequence
  Synthetic Oligonucleotide; CTLA4 exon 2; Set B
aauuacauaaaucuggguuccguugccua

SEQ ID NO: 136 - RNA, 19 nt, Artificial Sequence
  Synthetic Oligonucleotide; CTLA4 exon 2; Set C
cauaaaucuggguuccguu

SEQ ID NO: 137 - RNA, 20 nt, Artificial Sequence
  Synthetic Oligonucleotide; CTLA4 exon 2; Set C
acauaaaucuggguuccguu

SEQ ID NO: 138 - RNA, 21 nt, Artificial Sequence
  Synthetic Oligonucleotide; CTLA4 exon 2; Set C
uacauaaaucuggguuccguu

SEQ ID NO: 139 - RNA, 22 nt, Artificial Sequence
  Synthetic Oligonucleotide; CTLA4 exon 2; Set C
uuacauaaaucuggguuccguu

SEQ ID NO: 140 - RNA, 23 nt, Artificial Sequence
  Synthetic Oligonucleotide; CTLA4 exon 2; Set C
auuacauaaaucuggguuccguu

SEQ ID NO: 141 - RNA, 36 nt, Artificial Sequence
  Synthetic Oligonucleotide; CTLA4 exon 2; Set C
cucaccaauuacauaaaucuggguuccguugccuau

SEQ ID NO: 142 - RNA, 35 nt, Artificial Sequence
  Synthetic Oligonucleotide; CTLA4 exon 2; Set C
cucaccaauuacauaaaucuggguuccguugccua

SEQ ID NO: 143 - RNA, 37 nt, Artificial Sequence
  Synthetic Oligonucleotide; CTLA4 exon 2; Set C
gcucaccaauuacauaaaucuggguuccguugccuau

SEQ ID NO: 144 - RNA, 15 nt, Artificial Sequence
  Synthetic Oligonucleotide; CTLA4 exon 2; Set C
acauaaaucuggguu

SEQ ID NO: 145 - RNA, 36 nt, Artificial Sequence
  Synthetic Oligonucleotide; CTLA4 exon 2; Set C
gcucaccaauuacauaaaucuggguuccguugccua

SEQ ID NO: 146 - RNA, 38 nt, Artificial Sequence
  Synthetic Oligonucleotide; CTLA4 exon 2; Set C
ugcucaccaauuacauaaaucuggguuccguugccuau

SEQ ID NO: 147 - RNA, 16 nt, Artificial Sequence
  Synthetic Oligonucleotide; CTLA4 exon 2; Set C
uacauaaaucuggguu

SEQ ID NO: 148 - RNA, 37 nt, Artificial Sequence
  Synthetic Oligonucleotide; CTLA4 exon 2; Set C
ugcucaccaauuacauaaaucuggguuccguugccua

SEQ ID NO: 149 - RNA, 39 nt, Artificial Sequence
  Synthetic Oligonucleotide; CTLA4 exon 2; Set C
uugcucaccaauuacauaaaucuggguuccguugccuau

SEQ ID NO: 150 - RNA, 17 nt, Artificial Sequence
  Synthetic Oligonucleotide; CTLA4 exon 2; Set C
uuacauaaaucuggguu

SEQ ID NO: 151 - RNA, 15 nt, Artificial Sequence
  Synthetic Oligonucleotide; CTLA4 exon 2; Set C
uacauaaaucugggu

SEQ ID NO: 152 - RNA, 38 nt, Artificial Sequence
  Synthetic Oligonucleotide; CTLA4 exon 2; Set C
uugcucaccaauuacauaaaucuggguuccguugccua

SEQ ID NO: 153 - RNA, 40 nt, Artificial Sequence
  Synthetic Oligonucleotide; CTLA4 exon 2; Set C
uuugcucaccaauuacauaaaucuggguuccguugccuau

SEQ ID NO: 154 - RNA, 18 nt, Artificial Sequence
  Synthetic Oligonucleotide; CTLA4 exon 2; Set C
auuacauaaaucuggguu

SEQ ID NO: 155 - RNA, 16 nt, Artificial Sequence
  Synthetic Oligonucleotide; CTLA4 exon 2; Set C
uuacauaaaucugggu

SEQ ID NO: 156 - RNA, 39 nt, Artificial Sequence
  Synthetic Oligonucleotide; CTLA4 exon 2; Set C
uuugcucaccaauuacauaaaucuggguuccguugccua

SEQ ID NO: 157 - RNA, 19 nt, Artificial Sequence
  Synthetic Oligonucleotide; CTLA4 exon 2; Set C
aauuacauaaaucuggguu

SEQ ID NO: 158 - RNA, 15 nt, Artificial Sequence
  Synthetic Oligonucleotide; CTLA4 exon 2; Set C
uuacauaaaucuggg

SEQ ID NO: 159 - RNA, 17 nt, Artificial Sequence
  Synthetic Oligonucleotide; CTLA4 exon 2; Set C
auuacauaaaucugggu

SEQ ID NO: 160 - RNA, 40 nt, Artificial Sequence
  Synthetic Oligonucleotide; CTLA4 exon 2; Set C
cuuugcucaccaauuacauaaaucuggguuccguugccua

SEQ ID NO: 161 - RNA, 16 nt, Artificial Sequence
  Synthetic Oligonucleotide; CTLA4 exon 2; Set C
auuacauaaaucuggg

SEQ ID NO: 162 - RNA, 18 nt, Artificial Sequence
  Synthetic Oligonucleotide; CTLA4 exon 2; Set C
aauuacauaaaucugggu

SEQ ID NO: 163 - RNA, 15 nt, Artificial Sequence
  Synthetic Oligonucleotide; CTLA4 exon 2; Set C
auuacauaaaucugg

SEQ ID NO: 164 - RNA, 17 nt, Artificial Sequence
  Synthetic Oligonucleotide; CTLA4 exon 2; Set C
aauuacauaaaucuggg

SEQ ID NO: 165 - RNA, 16 nt, Artificial Sequence
  Synthetic Oligonucleotide; CTLA4 exon 2; Set C
aauuacauaaaucugg

SEQ ID NO: 166 - RNA, 15 nt, Artificial Sequence
  Synthetic Oligonucleotide; CTLA4 exon 2; Set C
aauuacauaaaucug

SEQ ID NO: 167 - RNA, 25 nt, Artificial Sequence
  Synthetic Oligonucleotide; CTLA4 exon 2; Set C
cucaccaauuacauaaaucuggguu

SEQ ID NO: 168 - RNA, 26 nt, Artificial Sequence
  Synthetic Oligonucleotide; CTLA4 exon 2; Set B
gcucaccaauuacauaaaucuggguu

SEQ ID NO: 169 - RNA, 27 nt, Artificial Sequence
  Synthetic Oligonucleotide; CTLA4 exon 2; Set B
ugcucaccaauuacauaaaucuggguu

SEQ ID NO: 170 - RNA, 28 nt, Artificial Sequence
  Synthetic Oligonucleotide; CTLA4 exon 2; Set B
uugcucaccaauuacauaaaucuggguu

SEQ ID NO: 171 - RNA, 29 nt, Artificial Sequence
  Synthetic Oligonucleotide; CTLA4 exon 2; Set B
uuugcucaccaauuacauaaaucuggguu

SEQ ID NO: 172 - RNA, 30 nt, Artificial Sequence
  Synthetic Oligonucleotide; CTLA4 exon 2; Set B
cuuugcucaccaauuacauaaaucuggguu

SEQ ID NO: 173 - RNA, 31 nt, Artificial Sequence
  Synthetic Oligonucleotide; CTLA4 exon 2; Set B
gcuuugcucaccaauuacauaaaucuggguu

SEQ ID NO: 174 - RNA, 19 nt, Artificial Sequence
  Synthetic Oligonucleotide; CTLA4 exon 2; Set C
gcucaccaauuacauaaau

SEQ ID NO: 175 - RNA, 27 nt, Artificial Sequence
  Synthetic Oligonucleotide; CTLA4 exon 2; Set C
cuuugcucaccaauuacauaaaucugg

SEQ ID NO: 176 - RNA, 20 nt, Artificial Sequence
  Synthetic Oligonucleotide; CTLA4 exon 2; Set C
ugcucaccaauuacauaaau

SEQ ID NO: 177 - RNA, 19 nt, Artificial Sequence
  Synthetic Oligonucleotide; CTLA4 exon 2; Set C
ugcucaccaauuacauaaa

SEQ ID NO: 178 - RNA, 21 nt, Artificial Sequence
  Synthetic Oligonucleotide; CTLA4 exon 2; Set C
uugcucaccaauuacauaaau

SEQ ID NO: 179 - RNA, 35 nt, Artificial Sequence
  Synthetic Oligonucleotide; CTLA4 exon 2; Set B
aauggcuuugcucaccaauuacauaaaucuggguu

SEQ ID NO: 180 - RNA, 22 nt, Artificial Sequence
  Synthetic Oligonucleotide; CTLA4 exon 2; Set C
uuugcucaccaauuacauaaau

SEQ ID NO: 181 - RNA, 20 nt, Artificial Sequence
  Synthetic Oligonucleotide; CTLA4 exon 2; Set C
uugcucaccaauuacauaaa

SEQ ID NO: 182 - RNA, 36 nt, Artificial Sequence
  Synthetic Oligonucleotide; CTLA4 exon 2; Set B
aaauggcuuugcucaccaauuacauaaaucuggguu

SEQ ID NO: 183 - RNA, 24 nt, Artificial Sequence
  Synthetic Oligonucleotide; CTLA4 exon 2; Set C
cuuugcucaccaauuacauaaauc

SEQ ID NO: 184 - RNA, 23 nt, Artificial Sequence
  Synthetic Oligonucleotide; CTLA4 exon 2; Set C
cuuugcucaccaauuacauaaau

SEQ ID NO: 185 - RNA, 21 nt, Artificial Sequence
  Synthetic Oligonucleotide; CTLA4 exon 2; Set C
uuugcucaccaauuacauaaa

SEQ ID NO: 186 - RNA, 37 nt, Artificial Sequence
  Synthetic Oligonucleotide; CTLA4 exon 2; Set B
gaaauggcuuugcucaccaauuacauaaaucuggguu

SEQ ID NO: 187 - RNA, 22 nt, Artificial Sequence
  Synthetic Oligonucleotide; CTLA4 exon 2; Set C
cuuugcucaccaauuacauaaa

SEQ ID NO: 188 - RNA, 20 nt, Artificial Sequence
  Synthetic Oligonucleotide; CTLA4 exon 2; Set C
uuugcucaccaauuacauaa

SEQ ID NO: 189 - RNA, 24 nt, Artificial Sequence
  Synthetic Oligonucleotide; CTLA4 exon 2; Set C
gcuuugcucaccaauuacauaaau

SEQ ID NO: 190 - RNA, 38 nt, Artificial Sequence
  Synthetic Oligonucleotide; CTLA4 exon 2; Set C
ugaaauggcuuugcucaccaauuacauaaaucuggguu

SEQ ID NO: 191 - RNA, 34 nt, Artificial Sequence
  Synthetic Oligonucleotide; CTLA4 exon 2; Set B
aaauggcuuugcucaccaauuacauaaaucuggg

SEQ ID NO: 192 - RNA, 21 nt, Artificial Sequence
  Synthetic Oligonucleotide; CTLA4 exon 2; Set C
cuuugcucaccaauuacauaa

SEQ ID NO: 193 - RNA, 23 nt, Artificial Sequence
  Synthetic Oligonucleotide; CTLA4 exon 2; Set C
gcuuugcucaccaauuacauaaa

SEQ ID NO: 194 - RNA, 39 nt, Artificial Sequence
  Synthetic Oligonucleotide; CTLA4 exon 2; Set C
gugaaauggcuuugcucaccaauuacauaaaucuggguu

SEQ ID NO: 195 - RNA, 33 nt, Artificial Sequence
  Synthetic Oligonucleotide; CTLA4 exon 2; Set B
aaauggcuuugcucaccaauuacauaaaucugg

SEQ ID NO: 196 - RNA, 22 nt, Artificial Sequence
  Synthetic Oligonucleotide; CTLA4 exon 2; Set C
gcuuugcucaccaauuacauaa

SEQ ID NO: 197 - RNA, 20 nt, Artificial Sequence
  Synthetic Oligonucleotide; CTLA4 exon 2; Set C
cuuugcucaccaauuacaua

SEQ ID NO: 198 - RNA, 21 nt, Artificial Sequence
  Synthetic Oligonucleotide; CTLA4 exon 2; Set C
gcuuugcucaccaauuacaua

SEQ ID NO: 199 - RNA, 28 nt, Artificial Sequence
  Synthetic Oligonucleotide; CTLA4 exon 2; Set C
aauggcuuugcucaccaauuacauaaau

SEQ ID NO: 200 - RNA, 30 nt, Artificial Sequence
  Synthetic Oligonucleotide; CTLA4 exon 2; Set C
aaauggcuuugcucaccaauuacauaaauc

SEQ ID NO: 201 - RNA, 29 nt, Artificial Sequence
  Synthetic Oligonucleotide; CTLA4 exon 2; Set C
aaauggcuuugcucaccaauuacauaaau

SEQ ID NO: 202 - RNA, 28 nt, Artificial Sequence
  Synthetic Oligonucleotide; CTLA4 exon 2; Set C
aaauggcuuugcucaccaauuacauaaa

SEQ ID NO: 203 - RNA, 30 nt, Artificial Sequence
  Synthetic Oligonucleotide; CTLA4 exon 2; Set B
gaaauggcuuugcucaccaauuacauaaau

SEQ ID NO: 204 - RNA, 27 nt, Artificial Sequence
  Synthetic Oligonucleotide; CTLA4 exon 2; Set C
aaauggcuuugcucaccaauuacauaa

SEQ ID NO: 205 - RNA, 31 nt, Artificial Sequence
  Synthetic Oligonucleotide; CTLA4 exon 2; Set B
ugaaauggcuuugcucaccaauuacauaaau

SEQ ID NO: 206 - RNA, 29 nt, Artificial Sequence
  Synthetic Oligonucleotide; CTLA4 exon 2; Set B
gaaauggcuuugcucaccaauuacauaaa

SEQ ID NO: 207 - RNA, 32 nt, Artificial Sequence
  Synthetic Oligonucleotide; CTLA4 exon 2; Set B
gugaaauggcuuugcucaccaauuacauaaau

SEQ ID NO: 208 - RNA, 30 nt, Artificial Sequence
  Synthetic Oligonucleotide; CTLA4 exon 2; Set B
ugaaauggcuuugcucaccaauuacauaaa

SEQ ID NO: 209 - RNA, 28 nt, Artificial Sequence
  Synthetic Oligonucleotide; CTLA4 exon 2; Set B
gaaauggcuuugcucaccaauuacauaa

SEQ ID NO: 210 - RNA, 26 nt, Artificial Sequence
  Synthetic Oligonucleotide; CTLA4 exon 2; Set C
aaauggcuuugcucaccaauuacaua

SEQ ID NO: 211 - RNA, 31 nt, Artificial Sequence
  Synthetic Oligonucleotide; CTLA4 exon 2; Set B
gugaaauggcuuugcucaccaauuacauaaa

SEQ ID NO: 212 - RNA, 29 nt, Artificial Sequence
  Synthetic Oligonucleotide; CTLA4 exon 2; Set B
ugaaauggcuuugcucaccaauuacauaa

SEQ ID NO: 213 - RNA, 25 nt, Artificial Sequence
  Synthetic Oligonucleotide; CTLA4 exon 2; Set C
aaauggcuuugcucaccaauuacau

SEQ ID NO: 214 - RNA, 30 nt, Artificial Sequence
  Synthetic Oligonucleotide; CTLA4 exon 2; Set B
gugaaauggcuuugcucaccaauuacauaa

SEQ ID NO: 215 - RNA, 28 nt, Artificial Sequence
  Synthetic Oligonucleotide; CTLA4 exon 2; Set B
ugaaauggcuuugcucaccaauuacaua

SEQ ID NO: 216 - RNA, 24 nt, Artificial Sequence
  Synthetic Oligonucleotide; CTLA4 exon 2; Set C
aaauggcuuugcucaccaauuaca

SEQ ID NO: 217 - RNA, 29 nt, Artificial Sequence
  Synthetic Oligonucleotide; CTLA4 exon 2; Set B
gugaaauggcuuugcucaccaauuacaua

SEQ ID NO: 218 - RNA, 28 nt, Artificial Sequence
  Synthetic Oligonucleotide; CTLA4 exon 2; Set B
gugaaauggcuuugcucaccaauuacau

SEQ ID NO: 219 - RNA, 39 nt, Artificial Sequence
  Synthetic Oligonucleotide; CTLA4 exon 2; Set B
caacucagugaaauggcuuugcucaccaauuacauaaau

SEQ ID NO: 220 - RNA, 40 nt, Artificial Sequence
  Synthetic Oligonucleotide; CTLA4 exon 2; Set B
ucaacucagugaaauggcuuugcucaccaauuacauaaau

SEQ ID NO: 221 - RNA, 38 nt, Artificial Sequence
  Synthetic Oligonucleotide; CTLA4 exon 2; Set B
caacucagugaaauggcuuugcucaccaauuacauaaa

SEQ ID NO: 222 - RNA, 39 nt, Artificial Sequence
  Synthetic Oligonucleotide; CTLA4 exon 2; Set B
ucaacucagugaaauggcuuugcucaccaauuacauaaa

SEQ ID NO: 223 - RNA, 37 nt, Artificial Sequence
  Synthetic Oligonucleotide; CTLA4 exon 2; Set B
caacucagugaaauggcuuugcucaccaauuacauaa

SEQ ID NO: 224 - RNA, 40 nt, Artificial Sequence
  Synthetic Oligonucleotide; CTLA4 exon 2; Set C
gucaacucagugaaauggcuuugcucaccaauuacauaaa

SEQ ID NO: 225 - RNA, 38 nt, Artificial Sequence
  Synthetic Oligonucleotide; CTLA4 exon 2; Set C
ucaacucagugaaauggcuuugcucaccaauuacauaa

SEQ ID NO: 226 - RNA, 39 nt, Artificial Sequence
  Synthetic Oligonucleotide; CTLA4 exon 2; Set C
gucaacucagugaaauggcuuugcucaccaauuacauaa

SEQ ID NO: 227 - RNA, 37 nt, Artificial Sequence
  Synthetic Oligonucleotide; CTLA4 exon 2; Set C
ucaacucagugaaauggcuuugcucaccaauuacaua

SEQ ID NO: 228 - RNA, 40 nt, Artificial Sequence
  Synthetic Oligonucleotide; CTLA4 exon 2; Set C
ugucaacucagugaaauggcuuugcucaccaauuacauaa

SEQ ID NO: 229 - RNA, 38 nt, Artificial Sequence
  Synthetic Oligonucleotide; CTLA4 exon 2; Set C
gucaacucagugaaauggcuuugcucaccaauuacaua

SEQ ID NO: 230 - RNA, 36 nt, Artificial Sequence
  Synthetic Oligonucleotide; CTLA4 exon 2; Set C
ucaacucagugaaauggcuuugcucaccaauuacau

SEQ ID NO: 231 - RNA, 39 nt, Artificial Sequence
  Synthetic Oligonucleotide; CTLA4 exon 2; Set C
ugucaacucagugaaauggcuuugcucaccaauuacaua

SEQ ID NO: 232 - RNA, 37 nt, Artificial Sequence
  Synthetic Oligonucleotide; CTLA4 exon 2; Set C
gucaacucagugaaauggcuuugcucaccaauuacau

SEQ ID NO: 233 - RNA, 15 nt, Artificial Sequence
  Synthetic Oligonucleotide; CTLA4 exon 2; Set C
gaaauggcuuugcuc

SEQ ID NO: 234 - RNA, 40 nt, Artificial Sequence
  Synthetic Oligonucleotide; CTLA4 exon 2; Set C
gugucaacucagugaaauggcuuugcucaccaauuacaua

SEQ ID NO: 235 - RNA, 38 nt, Artificial Sequence
  Synthetic Oligonucleotide; CTLA4 exon 2; Set C
ugucaacucagugaaauggcuuugcucaccaauuacau

SEQ ID NO: 236 - RNA, 36 nt, Artificial Sequence
  Synthetic Oligonucleotide; CTLA4 exon 2; Set C
gucaacucagugaaauggcuuugcucaccaauuaca

SEQ ID NO: 237 - RNA, 16 nt, Artificial Sequence
  Synthetic Oligonucleotide; CTLA4 exon 2; Set C
ugaaauggcuuugcuc

SEQ ID NO: 238 - RNA, 39 nt, Artificial Sequence
  Synthetic Oligonucleotide; CTLA4 exon 2; Set C
gugucaacucagugaaauggcuuugcucaccaauuacau

SEQ ID NO: 239 - RNA, 37 nt, Artificial Sequence
  Synthetic Oligonucleotide; CTLA4 exon 2; Set C
ugucaacucagugaaauggcuuugcucaccaauuaca

SEQ ID NO: 240 - RNA, 35 nt, Artificial Sequence
  Synthetic Oligonucleotide; CTLA4 exon 2; Set C
gucaacucagugaaauggcuuugcucaccaauuac

SEQ ID NO: 241 - RNA, 15 nt, Artificial Sequence
  Synthetic Oligonucleotide; CTLA4 exon 2; Set C
ugaaauggcuuugcu

SEQ ID NO: 242 - RNA, 17 nt, Artificial Sequence
  Synthetic Oligonucleotide; CTLA4 exon 2; Set C
gugaaauggcuuugcuc

SEQ ID NO: 243 - RNA, 38 nt, Artificial Sequence
  Synthetic Oligonucleotide; CTLA4 exon 2; Set C
gugucaacucagugaaauggcuuugcucaccaauuaca

SEQ ID NO: 244 - RNA, 36 nt, Artificial Sequence
  Synthetic Oligonucleotide; CTLA4 exon 2; Set C
ugucaacucagugaaauggcuuugcucaccaauuac

SEQ ID NO: 245 - RNA, 16 nt, Artificial Sequence
  Synthetic Oligonucleotide; CTLA4 exon 2; Set C
gugaaauggcuuugcu

SEQ ID NO: 246 - RNA, 18 nt, Artificial Sequence
  Synthetic Oligonucleotide; CTLA4 exon 2; Set C
agugaaauggcuuugcuc

SEQ ID NO: 247 - RNA, 37 nt, Artificial Sequence
  Synthetic Oligonucleotide; CTLA4 exon 2; Set C
gugucaacucagugaaauggcuuugcucaccaauuac

SEQ ID NO: 248 - RNA, 15 nt, Artificial Sequence
  Synthetic Oligonucleotide; CTLA4 exon 2; Set C
gugaaauggcuuugc

SEQ ID NO: 249 - RNA, 17 nt, Artificial Sequence
  Synthetic Oligonucleotide; CTLA4 exon 2; Set C
agugaaauggcuuugcu

SEQ ID NO: 250 - RNA, 16 nt, Artificial Sequence
  Synthetic Oligonucleotide; CTLA4 exon 2; Set C
agugaaauggcuuugc

SEQ ID NO: 251 - RNA, 34 nt, Artificial Sequence
  Synthetic Oligonucleotide; CTLA4 exon 2; Set C
ugucaacucagugaaauggcuuugcucaccaauu

SEQ ID NO: 252 - RNA, 36 nt, Artificial Sequence
  Synthetic Oligonucleotide; CTLA4 exon 2; Set C
gugucaacucagugaaauggcuuugcucaccaauua

SEQ ID NO: 253 - RNA, 15 nt, Artificial Sequence
  Synthetic Oligonucleotide; CTLA4 exon 2; Set C
agugaaauggcuuug

SEQ ID NO: 254 - RNA, 35 nt, Artificial Sequence
  Synthetic Oligonucleotide; CTLA4 exon 2; Set C
gugucaacucagugaaauggcuuugcucaccaauu

SEQ ID NO: 255 - RNA, 23 nt, Artificial Sequence
  Synthetic Oligonucleotide; CTLA4 exon 2; Set C
aacucagugaaauggcuuugcuc

SEQ ID NO: 256 - RNA, 22 nt, Artificial Sequence
  Synthetic Oligonucleotide; CTLA4 exon 2; Set C
aacucagugaaauggcuuugcu

SEQ ID NO: 257 - RNA, 24 nt, Artificial Sequence
  Synthetic Oligonucleotide; CTLA4 exon 2; Set B
caacucagugaaauggcuuugcuc

SEQ ID NO: 258 - RNA, 23 nt, Artificial Sequence
  Synthetic Oligonucleotide; CTLA4 exon 2; Set C
caacucagugaaauggcuuugcu

SEQ ID NO: 259 - RNA, 21 nt, Artificial Sequence
  Synthetic Oligonucleotide; CTLA4 exon 2; Set C
aacucagugaaauggcuuugc

SEQ ID NO: 260 - RNA, 25 nt, Artificial Sequence
  Synthetic Oligonucleotide; CTLA4 exon 2; Set B
ucaacucagugaaauggcuuugcuc

SEQ ID NO: 261 - RNA, 24 nt, Artificial Sequence
  Synthetic Oligonucleotide; CTLA4 exon 2; Set B
ucaacucagugaaauggcuuugcu

SEQ ID NO: 262 - RNA, 22 nt, Artificial Sequence
  Synthetic Oligonucleotide; CTLA4 exon 2; Set C
caacucagugaaauggcuuugc

SEQ ID NO: 263 - RNA, 26 nt, Artificial Sequence
  Synthetic Oligonucleotide; CTLA4 exon 2; Set B
gucaacucagugaaauggcuuugcuc

SEQ ID NO: 264 - RNA, 20 nt, Artificial Sequence
  Synthetic Oligonucleotide; CTLA4 exon 2; Set C
aacucagugaaauggcuuug

SEQ ID NO: 265 - RNA, 25 nt, Artificial Sequence
  Synthetic Oligonucleotide; CTLA4 exon 2; Set B
gucaacucagugaaauggcuuugcu

SEQ ID NO: 266 - RNA, 23 nt, Artificial Sequence
  Synthetic Oligonucleotide; CTLA4 exon 2; Set C
ucaacucagugaaauggcuuugc

SEQ ID NO: 267 - RNA, 27 nt, Artificial Sequence
  Synthetic Oligonucleotide; CTLA4 exon 2; Set B
ugucaacucagugaaauggcuuugcuc

SEQ ID NO: 268 - RNA, 19 nt, Artificial Sequence
  Synthetic Oligonucleotide; CTLA4 exon 2; Set C
aacucagugaaauggcuuu

SEQ ID NO: 269 - RNA, 21 nt, Artificial Sequence
  Synthetic Oligonucleotide; CTLA4 exon 2; Set C
caacucagugaaauggcuuug

SEQ ID NO: 270 - RNA, 26 nt, Artificial Sequence
  Synthetic Oligonucleotide; CTLA4 exon 2; Set B
ugucaacucagugaaauggcuuugcu

SEQ ID NO: 271 - RNA, 24 nt, Artificial Sequence
  Synthetic Oligonucleotide; CTLA4 exon 2; Set B
gucaacucagugaaauggcuuugc

SEQ ID NO: 272 - RNA, 18 nt, Artificial Sequence
  Synthetic Oligonucleotide; CTLA4 exon 2; Set C
aacucagugaaauggcuu

SEQ ID NO: 273 - RNA, 28 nt, Artificial Sequence
  Synthetic Oligonucleotide; CTLA4 exon 2; Set B
gugucaacucagugaaauggcuuugcuc

SEQ ID NO: 274 - RNA, 20 nt, Artificial Sequence
  Synthetic Oligonucleotide; CTLA4 exon 2; Set C
caacucagugaaauggcuuu

SEQ ID NO: 275 - RNA, 22 nt, Artificial Sequence
  Synthetic Oligonucleotide; CTLA4 exon 2; Set C
ucaacucagugaaauggcuuug

SEQ ID NO: 276 - RNA, 25 nt, Artificial Sequence
  Synthetic Oligonucleotide; CTLA4 exon 2; Set B
ugucaacucagugaaauggcuuugc

SEQ ID NO: 277 - RNA, 27 nt, Artificial Sequence
  Synthetic Oligonucleotide; CTLA4 exon 2; Set B
gugucaacucagugaaauggcuuugcu

SEQ ID NO: 278 - RNA, 19 nt, Artificial Sequence
  Synthetic Oligonucleotide; CTLA4 exon 2; Set C
caacucagugaaauggcuu

SEQ ID NO: 279 - RNA, 21 nt, Artificial Sequence
  Synthetic Oligonucleotide; CTLA4 exon 2; Set C
ucaacucagugaaauggcuuu

SEQ ID NO: 280 - RNA, 23 nt, Artificial Sequence
  Synthetic Oligonucleotide; CTLA4 exon 2; Set C
gucaacucagugaaauggcuuug

SEQ ID NO: 281 - RNA, 17 nt, Artificial Sequence
  Synthetic Oligonucleotide; CTLA4 exon 2; Set C
aacucagugaaauggcu

SEQ ID NO: 282 - RNA, 26 nt, Artificial Sequence
  Synthetic Oligonucleotide; CTLA4 exon 2; Set B
gugucaacucagugaaauggcuuugc

SEQ ID NO: 283 - RNA, 20 nt, Artificial Sequence
  Synthetic Oligonucleotide; CTLA4 exon 2; Set C
ucaacucagugaaauggcuu

SEQ ID NO: 284 - RNA, 22 nt, Artificial Sequence
  Synthetic Oligonucleotide; CTLA4 exon 2; Set C
gucaacucagugaaauggcuuu

SEQ ID NO: 285 - RNA, 24 nt, Artificial Sequence
  Synthetic Oligonucleotide; CTLA4 exon 2; Set C
ugucaacucagugaaauggcuuug

SEQ ID NO: 286 - RNA, 18 nt, Artificial Sequence
  Synthetic Oligonucleotide; CTLA4 exon 2; Set C
caacucagugaaauggcu

SEQ ID NO: 287 - RNA, 21 nt, Artificial Sequence
  Synthetic Oligonucleotide; CTLA4 exon 2; Set C
gucaacucagugaaauggcuu

SEQ ID NO: 288 - RNA, 23 nt, Artificial Sequence
  Synthetic Oligonucleotide; CTLA4 exon 2; Set C
ugucaacucagugaaauggcuuu

SEQ ID NO: 289 - RNA, 25 nt, Artificial Sequence
  Synthetic Oligonucleotide; CTLA4 exon 2; Set C
gugucaacucagugaaauggcuuug

SEQ ID NO: 290 - RNA, 19 nt, Artificial Sequence
  Synthetic Oligonucleotide; CTLA4 exon 2; Set C
ucaacucagugaaauggcu

SEQ ID NO: 291 - RNA, 22 nt, Artificial Sequence
  Synthetic Oligonucleotide; CTLA4 exon 2; Set C
ugucaacucagugaaauggcuu

SEQ ID NO: 292 - RNA, 24 nt, Artificial Sequence
  Synthetic Oligonucleotide; CTLA4 exon 2; Set C
gugucaacucagugaaauggcuuu

SEQ ID NO: 293 - RNA, 20 nt, Artificial Sequence
  Synthetic Oligonucleotide; CTLA4 exon 2; Set C
gucaacucagugaaauggcu

SEQ ID NO: 294 - RNA, 23 nt, Artificial Sequence
  Synthetic Oligonucleotide; CTLA4 exon 2; Set C
gugucaacucagugaaauggcuu

SEQ ID NO: 295 - RNA, 21 nt, Artificial Sequence
  Synthetic Oligonucleotide; CTLA4 exon 2; Set C
ugucaacucagugaaauggcu

SEQ ID NO: 296 - RNA, 22 nt, Artificial Sequence
  Synthetic Oligonucleotide; CTLA4 exon 2; Set C
gugucaacucagugaaauggcu

SEQ ID NO: 297 - RNA, 15 nt, Artificial Sequence
  Synthetic Oligonucleotide; CTLA4 exon 2; Set C
ucaacucagugaaau

SEQ ID NO: 298 - RNA, 16 nt, Artificial Sequence
  Synthetic Oligonucleotide; CTLA4 exon 2; Set C
gucaacucagugaaau

SEQ ID NO: 299 - RNA, 15 nt, Artificial Sequence
  Synthetic Oligonucleotide; CTLA4 exon 2; Set C
gucaacucagugaaa

SEQ ID NO: 300 - RNA, 17 nt, Artificial Sequence
  Synthetic Oligonucleotide; CTLA4 exon 2; Set C
ugucaacucagugaaau

SEQ ID NO: 301 - RNA, 38 nt, Artificial Sequence
  Synthetic Oligonucleotide; CTLA4 exon 2; Set C
aaugcaacaggugucaacucagugaaauggcuuugcuc

SEQ ID NO: 302 - RNA, 16 nt, Artificial Sequence
  Synthetic Oligonucleotide; CTLA4 exon 2; Set C
ugucaacucagugaaa

SEQ ID NO: 303 - RNA, 18 nt, Artificial Sequence
  Synthetic Oligonucleotide; CTLA4 exon 2; Set C
gugucaacucagugaaau

SEQ ID NO: 304 - RNA, 37 nt, Artificial Sequence
  Synthetic Oligonucleotide; CTLA4 exon 2; Set C
aaugcaacaggugucaacucagugaaauggcuuugcu

SEQ ID NO: 305 - RNA, 17 nt, Artificial Sequence
  Synthetic Oligonucleotide; CTLA4 exon 2; Set C
gugucaacucagugaaa

SEQ ID NO: 306 - RNA, 15 nt, Artificial Sequence
  Synthetic Oligonucleotide; CTLA4 exon 2; Set C
ugucaacucagugaa

SEQ ID NO: 307 - RNA, 36 nt, Artificial Sequence
  Synthetic Oligonucleotide; CTLA4 exon 2; Set C
aaugcaacaggugucaacucagugaaauggcuuugc

SEQ ID NO: 308 - RNA, 16 nt, Artificial Sequence
  Synthetic Oligonucleotide; CTLA4 exon 2; Set C
gugucaacucagugaa

SEQ ID NO: 309 - RNA, 35 nt, Artificial Sequence
  Synthetic Oligonucleotide; CTLA4 exon 2; Set B
aaugcaacaggugucaacucagugaaauggcuuug

SEQ ID NO: 310 - RNA, 15 nt, Artificial Sequence
  Synthetic Oligonucleotide; CTLA4 exon 2; Set C
gugucaacucaguga

SEQ ID NO: 311 - RNA, 34 nt, Artificial Sequence
  Synthetic Oligonucleotide; CTLA4 exon 2; Set B
aaugcaacaggugucaacucagugaaauggcuuu

SEQ ID NO: 312 - RNA, 33 nt, Artificial Sequence
  Synthetic Oligonucleotide; CTLA4 exon 2; Set B
aaugcaacaggugucaacucagugaaauggcuu

SEQ ID NO: 313 - RNA, 40 nt, Artificial Sequence
  Synthetic Oligonucleotide; CTLA4 exon 2; Set C
agacugcaaugcaacaggugucaacucagugaaauggcuu

SEQ ID NO: 314 - RNA, 36 nt, Artificial Sequence
  Synthetic Oligonucleotide; CTLA4 exon 2; Set C
gaagacugcaaugcaacaggugucaacucagugaaa

SEQ ID NO: 315 - RNA, 37 nt, Artificial Sequence
  Synthetic Oligonucleotide; CTLA4 exon 2; Set C
agaagacugcaaugcaacaggugucaacucagugaaa

SEQ ID NO: 316 - RNA, 19 nt, Artificial Sequence
  Synthetic Oligonucleotide; CTLA4 exon 2; Set C
gaacucaugcuccuucaug

SEQ ID NO: 317 - RNA, 18 nt, Artificial Sequence
  Synthetic Oligonucleotide; CTLA4 exon 2; Set C
gaacucaugcuccuucau

SEQ ID NO: 318 - RNA, 20 nt, Artificial Sequence
  Synthetic Oligonucleotide; CTLA4 exon 2; Set C
ugaacucaugcuccuucaug

SEQ ID NO: 319 - RNA, 17 nt, Artificial Sequence
  Synthetic Oligonucleotide; CTLA4 exon 2; Set C
gaacucaugcuccuuca

SEQ ID NO: 320 - RNA, 19 nt, Artificial Sequence
  Synthetic Oligonucleotide; CTLA4 exon 2; Set C
ugaacucaugcuccuucau

SEQ ID NO: 321 - RNA, 18 nt, Artificial Sequence
  Synthetic Oligonucleotide; CTLA4 exon 2; Set C
ugaacucaugcuccuuca

SEQ ID NO: 322 - RNA, 16 nt, Artificial Sequence
  Synthetic Oligonucleotide; CTLA4 exon 2; Set C
gaacucaugcuccuuc

SEQ ID NO: 323 - RNA, 17 nt, Artificial Sequence
  Synthetic Oligonucleotide; CTLA4 exon 2; Set C
ugaacucaugcuccuuc

SEQ ID NO: 324 - RNA, 31 nt, Artificial Sequence
  Synthetic Oligonucleotide; CTLA4 exon 2; Set A
aagggaacucagugaacucaugcuccuucau

SEQ ID NO: 325 - RNA, 30 nt, Artificial Sequence
  Synthetic Oligonucleotide; CTLA4 exon 2; Set A
aagggaacucagugaacucaugcuccuuca

SEQ ID NO: 326 - RNA, 29 nt, Artificial Sequence
  Synthetic Oligonucleotide; CTLA4 exon 2; Set A
aagggaacucagugaacucaugcuccuuc

SEQ ID NO: 327 - RNA, 39 nt, Artificial Sequence
  Synthetic Oligonucleotide; CTLA4 exon 2; Set C
aaaagccaaagggaacucagugaacucaugcuccuucau

SEQ ID NO: 328 - RNA, 38 nt, Artificial Sequence
  Synthetic Oligonucleotide; CTLA4 exon 2; Set C
aaaagccaaagggaacucagugaacucaugcuccuuca

SEQ ID NO: 329 - RNA, 24 nt, Artificial Sequence
  Synthetic Oligonucleotide; CTLA4 exon 2; Set C
auugcuagcauggaaaagccaaag

SEQ ID NO: 330 - RNA, 25 nt, Artificial Sequence
  Synthetic Oligonucleotide; CTLA4 exon 2; Set C
cauugcuagcauggaaaagccaaag

SEQ ID NO: 331 - RNA, 16 nt, Artificial Sequence
  Synthetic Oligonucleotide; CTLA4 exon 2; Set C
uugcuagcauggaaaa

SEQ ID NO: 332 - RNA, 15 nt, Artificial Sequence
  Synthetic Oligonucleotide; CTLA4 exon 2; Set C
uugcuagcauggaaa

SEQ ID NO: 333 - RNA, 17 nt, Artificial Sequence
  Synthetic Oligonucleotide; CTLA4 exon 2; Set C
auugcuagcauggaaaa

SEQ ID NO: 334 - RNA, 16 nt, Artificial Sequence
  Synthetic Oligonucleotide; CTLA4 exon 2; Set C
auugcuagcauggaaa

SEQ ID NO: 335 - RNA, 18 nt, Artificial Sequence
  Synthetic Oligonucleotide; CTLA4 exon 2; Set C
cauugcuagcauggaaaa

SEQ ID NO: 336 - RNA, 17 nt, Artificial Sequence
  Synthetic Oligonucleotide; CTLA4 exon 2; Set C
cauugcuagcauggaaa

SEQ ID NO: 337 - RNA, 19 nt, Artificial Sequence
  Synthetic Oligonucleotide; CTLA4 exon 2; Set C
gcauugcuagcauggaaaa

SEQ ID NO: 338 - RNA, 15 nt, Artificial Sequence
  Synthetic Oligonucleotide; CTLA4 exon 2; Set C
auugcuagcauggaa

SEQ ID NO: 339 - RNA, 18 nt, Artificial Sequence
  Synthetic Oligonucleotide; CTLA4 exon 2; Set C
gcauugcuagcauggaaa

SEQ ID NO: 340 - RNA, 20 nt, Artificial Sequence
  Synthetic Oligonucleotide; CTLA4 exon 2; Set C
ugcauugcuagcauggaaaa

SEQ ID NO: 341 - RNA, 16 nt, Artificial Sequence
  Synthetic Oligonucleotide; CTLA4 exon 2; Set C
cauugcuagcauggaa

SEQ ID NO: 342 - RNA, 19 nt, Artificial Sequence
  Synthetic Oligonucleotide; CTLA4 exon 2; Set C
ugcauugcuagcauggaaa

SEQ ID NO: 343 - RNA, 17 nt, Artificial Sequence
  Synthetic Oligonucleotide; CTLA4 exon 2; Set C
gcauugcuagcauggaa

SEQ ID NO: 344 - RNA, 15 nt, Artificial Sequence
  Synthetic Oligonucleotide; CTLA4 exon 2; Set C
cauugcuagcaugga

SEQ ID NO: 345 - RNA, 18 nt, Artificial Sequence
  Synthetic Oligonucleotide; CTLA4 exon 2; Set C
ugcauugcuagcauggaa

SEQ ID NO: 346 - RNA, 16 nt, Artificial Sequence
  Synthetic Oligonucleotide; CTLA4 exon 2; Set C
gcauugcuagcaugga

SEQ ID NO: 347 - RNA, 17 nt, Artificial Sequence
  Synthetic Oligonucleotide; CTLA4 exon 2; Set C
ugcauugcuagcaugga

SEQ ID NO: 348 - RNA, 15 nt, Artificial Sequence
  Synthetic Oligonucleotide; CTLA4 exon 2; Set C
gcauugcuagcaugg

SEQ ID NO: 349 - RNA, 16 nt, Artificial Sequence
  Synthetic Oligonucleotide; CTLA4 exon 2; Set C
ugcauugcuagcaugg

SEQ ID NO: 350 - RNA, 17 nt, Artificial Sequence
  Synthetic Oligonucleotide; CTLA4 exon 2; Set C
uucagucaccuggcugu

SEQ ID NO: 351 - RNA, 20 nt, Artificial Sequence
  Synthetic Oligonucleotide; CTLA4 exon 2; Set C
auuccccaucauguagguug

SEQ ID NO: 352 - RNA, 19 nt, Artificial Sequence
  Synthetic Oligonucleotide; CTLA4 exon 2; Set C
auuccccaucauguagguu

SEQ ID NO: 353 - RNA, 21 nt, Artificial Sequence
  Synthetic Oligonucleotide; CTLA4 exon 2; Set C
cauuccccaucauguagguug

SEQ ID NO: 354 - RNA, 20 nt, Artificial Sequence
  Synthetic Oligonucleotide; CTLA4 exon 2; Set C
cauuccccaucauguagguu

SEQ ID NO: 355 - RNA, 18 nt, Artificial Sequence
  Synthetic Oligonucleotide; CTLA4 exon 2; Set C
auuccccaucauguaggu

SEQ ID NO: 356 - RNA, 22 nt, Artificial Sequence
  Synthetic Oligonucleotide; CTLA4 exon 2; Set C
ucauuccccaucauguagguug

SEQ ID NO: 357 - RNA, 21 nt, Artificial Sequence
  Synthetic Oligonucleotide; CTLA4 exon 2; Set C
ucauuccccaucauguagguu

SEQ ID NO: 358 - RNA, 17 nt, Artificial Sequence
  Synthetic Oligonucleotide; CTLA4 exon 2; Set C
auuccccaucauguagg

SEQ ID NO: 359 - RNA, 19 nt, Artificial Sequence
  Synthetic Oligonucleotide; CTLA4 exon 2; Set C
cauuccccaucauguaggu

SEQ ID NO: 360 - RNA, 23 nt, Artificial Sequence
  Synthetic Oligonucleotide; CTLA4 exon 2; Set A
cucauuccccaucauguagguug

SEQ ID NO: 361 - RNA, 16 nt, Artificial Sequence
  Synthetic Oligonucleotide; CTLA4 exon 2; Set C
auuccccaucauguag

SEQ ID NO: 362 - RNA, 22 nt, Artificial Sequence
  Synthetic Oligonucleotide; CTLA4 exon 2; Set A
cucauuccccaucauguagguu

SEQ ID NO: 363 - RNA, 18 nt, Artificial Sequence
  Synthetic Oligonucleotide; CTLA4 exon 2; Set C
cauuccccaucauguagg

SEQ ID NO: 364 - RNA, 20 nt, Artificial Sequence
  Synthetic Oligonucleotide; CTLA4 exon 2; Set C
ucauuccccaucauguaggu

SEQ ID NO: 365 - RNA, 24 nt, Artificial Sequence
  Synthetic Oligonucleotide; CTLA4 exon 2; Set A
acucauuccccaucauguagguug

SEQ ID NO: 366 - RNA, 17 nt, Artificial Sequence
  Synthetic Oligonucleotide; CTLA4 exon 2; Set C
cauuccccaucauguag

SEQ ID NO: 367 - RNA, 23 nt, Artificial Sequence
  Synthetic Oligonucleotide; CTLA4 exon 2; Set A
acucauuccccaucauguagguu

SEQ ID NO: 368 - RNA, 19 nt, Artificial Sequence
  Synthetic Oligonucleotide; CTLA4 exon 2; Set C
ucauuccccaucauguagg

SEQ ID NO: 369 - RNA, 21 nt, Artificial Sequence
  Synthetic Oligonucleotide; CTLA4 exon 2; Set A
cucauuccccaucauguaggu

SEQ ID NO: 370 - RNA, 25 nt, Artificial Sequence
  Synthetic Oligonucleotide; CTLA4 exon 2; Set A
aacucauuccccaucauguagguug

SEQ ID NO: 371 - RNA, 18 nt, Artificial Sequence
  Synthetic Oligonucleotide; CTLA4 exon 2; Set C
ucauuccccaucauguag

SEQ ID NO: 372 - RNA, 24 nt, Artificial Sequence
  Synthetic Oligonucleotide; CTLA4 exon 2; Set A
aacucauuccccaucauguagguu

SEQ ID NO: 373 - RNA, 22 nt, Artificial Sequence
  Synthetic Oligonucleotide; CTLA4 exon 2; Set A
acucauuccccaucauguaggu

SEQ ID NO: 374 - RNA, 20 nt, Artificial Sequence
  Synthetic Oligonucleotide; CTLA4 exon 2; Set C
cucauuccccaucauguagg

SEQ ID NO: 375 - RNA, 26 nt, Artificial Sequence
  Synthetic Oligonucleotide; CTLA4 exon 2; Set A
caacucauuccccaucauguagguug

SEQ ID NO: 376 - RNA, 19 nt, Artificial Sequence
  Synthetic Oligonucleotide; CTLA4 exon 2; Set C
cucauuccccaucauguag

SEQ ID NO: 377 - RNA, 25 nt, Artificial Sequence
  Synthetic Oligonucleotide; CTLA4 exon 2; Set A
caacucauuccccaucauguagguu

SEQ ID NO: 378 - RNA, 21 nt, Artificial Sequence
  Synthetic Oligonucleotide; CTLA4 exon 2; Set C
acucauuccccaucauguagg

SEQ ID NO: 379 - RNA, 23 nt, Artificial Sequence
  Synthetic Oligonucleotide; CTLA4 exon 2; Set A
aacucauuccccaucauguaggu

SEQ ID NO: 380 - RNA, 27 nt, Artificial Sequence
  Synthetic Oligonucleotide; CTLA4 exon 2; Set A
ucaacucauuccccaucauguagguug

SEQ ID NO: 381 - RNA, 20 nt, Artificial Sequence
  Synthetic Oligonucleotide; CTLA4 exon 2; Set C
acucauuccccaucauguag

SEQ ID NO: 382 - RNA, 26 nt, Artificial Sequence
  Synthetic Oligonucleotide; CTLA4 exon 2; Set A
ucaacucauuccccaucauguagguu

SEQ ID NO: 383 - RNA, 24 nt, Artificial Sequence
  Synthetic Oligonucleotide; CTLA4 exon 2; Set A
caacucauuccccaucauguaggu

SEQ ID NO: 384 - RNA, 22 nt, Artificial Sequence
  Synthetic Oligonucleotide; CTLA4 exon 2; Set C
aacucauuccccaucauguagg

SEQ ID NO: 385 - RNA, 28 nt, Artificial Sequence
  Synthetic Oligonucleotide; CTLA4 exon 2; Set A
gucaacucauuccccaucauguagguug

SEQ ID NO: 386 - RNA, 21 nt, Artificial Sequence
  Synthetic Oligonucleotide; CTLA4 exon 2; Set C
aacucauuccccaucauguag

SEQ ID NO: 387 - RNA, 27 nt, Artificial Sequence
  Synthetic Oligonucleotide; CTLA4 exon 2; Set A
gucaacucauuccccaucauguagguu

SEQ ID NO: 388 - RNA, 25 nt, Artificial Sequence
  Synthetic Oligonucleotide; CTLA4 exon 2; Set A
ucaacucauuccccaucauguaggu

SEQ ID NO: 389 - RNA, 23 nt, Artificial Sequence
  Synthetic Oligonucleotide; CTLA4 exon 2; Set A
caacucauuccccaucauguagg

SEQ ID NO: 390 - RNA, 29 nt, Artificial Sequence
  Synthetic Oligonucleotide; CTLA4 exon 2; Set C
ggucaacucauuccccaucauguagguug

SEQ ID NO: 391 - RNA, 22 nt, Artificial Sequence
  Synthetic Oligonucleotide; CTLA4 exon 2; Set C
caacucauuccccaucauguag

SEQ ID NO: 392 - RNA, 28 nt, Artificial Sequence
  Synthetic Oligonucleotide; CTLA4 exon 2; Set C
ggucaacucauuccccaucauguagguu

SEQ ID NO: 393 - RNA, 24 nt, Artificial Sequence
  Synthetic Oligonucleotide; CTLA4 exon 2; Set A
ucaacucauuccccaucauguagg

SEQ ID NO: 394 - RNA, 26 nt, Artificial Sequence
  Synthetic Oligonucleotide; CTLA4 exon 2; Set A
gucaacucauuccccaucauguaggu

SEQ ID NO: 395 - RNA, 30 nt, Artificial Sequence
  Synthetic Oligonucleotide; CTLA4 exon 2; Set C
aggucaacucauuccccaucauguagguug

SEQ ID NO: 396 - RNA, 23 nt, Artificial Sequence
  Synthetic Oligonucleotide; CTLA4 exon 2; Set C
ucaacucauuccccaucauguag

SEQ ID NO: 397 - RNA, 29 nt, Artificial Sequence
  Synthetic Oligonucleotide; CTLA4 exon 2; Set C
aggucaacucauuccccaucauguagguu

SEQ ID NO: 398 - RNA, 27 nt, Artificial Sequence
  Synthetic Oligonucleotide; CTLA4 exon 2; Set C
ggucaacucauuccccaucauguaggu

SEQ ID NO: 399 - RNA, 25 nt, Artificial Sequence
  Synthetic Oligonucleotide; CTLA4 exon 2; Set A
gucaacucauuccccaucauguagg

SEQ ID NO: 400 - RNA, 31 nt, Artificial Sequence
  Synthetic Oligonucleotide; CTLA4 exon 2; Set A
aaggucaacucauuccccaucauguagguug

SEQ ID NO: 401 - RNA, 24 nt, Artificial Sequence
  Synthetic Oligonucleotide; CTLA4 exon 2; Set A
gucaacucauuccccaucauguag

SEQ ID NO: 402 - RNA, 30 nt, Artificial Sequence
  Synthetic Oligonucleotide; CTLA4 exon 2; Set A
aaggucaacucauuccccaucauguagguu

SEQ ID NO: 403 - RNA, 28 nt, Artificial Sequence
  Synthetic Oligonucleotide; CTLA4 exon 2; Set A
aggucaacucauuccccaucauguaggu

SEQ ID NO: 404 - RNA, 26 nt, Artificial Sequence
  Synthetic Oligonucleotide; CTLA4 exon 2; Set A
ggucaacucauuccccaucauguagg

SEQ ID NO: 405 - RNA, 25 nt, Artificial Sequence
  Synthetic Oligonucleotide; CTLA4 exon 2; Set A
ggucaacucauuccccaucauguag

SEQ ID NO: 406 - RNA, 27 nt, Artificial Sequence
  Synthetic Oligonucleotide; CTLA4 exon 2; Set A
aggucaacucauuccccaucauguagg

SEQ ID NO: 407 - RNA, 29 nt, Artificial Sequence
  Synthetic Oligonucleotide; CTLA4 exon 2; Set A
aaggucaacucauuccccaucauguaggu

SEQ ID NO: 408 - RNA, 26 nt, Artificial Sequence
  Synthetic Oligonucleotide; CTLA4 exon 2; Set A
aggucaacucauuccccaucauguag

SEQ ID NO: 409 - RNA, 28 nt, Artificial Sequence
  Synthetic Oligonucleotide; CTLA4 exon 2; Set A
aaggucaacucauuccccaucauguagg

SEQ ID NO: 410 - RNA, 27 nt, Artificial Sequence
  Synthetic Oligonucleotide; CTLA4 exon 2; Set A
aaggucaacucauuccccaucauguag

SEQ ID NO: 411 - RNA, 39 nt, Artificial Sequence
  Synthetic Oligonucleotide; CTLA4 exon 2; Set C
gaaucaucuaggaaggucaacucauuccccaucauguag

SEQ ID NO: 412 - RNA, 15 nt, Artificial Sequence
  Synthetic Oligonucleotide; CTLA4 exon 2; Set C
aaggucaacucauuc

SEQ ID NO: 413 - RNA, 25 nt, Artificial Sequence
  Synthetic Oligonucleotide; CTLA4 exon 2; Set C
aaucaucuaggaaggucaacucauu

SEQ ID NO: 414 - RNA, 26 nt, Artificial Sequence
  Synthetic Oligonucleotide; CTLA4 exon 2; Set C
gaaucaucuaggaaggucaacucauu

SEQ ID NO: 415 - RNA, 24 nt, Artificial Sequence
  Synthetic Oligonucleotide; CTLA4 exon 2; Set C
aaucaucuaggaaggucaacucau

SEQ ID NO: 416 - RNA, 27 nt, Artificial Sequence
  Synthetic Oligonucleotide; CTLA4 exon 2; Set A
ggaaucaucuaggaaggucaacucauu

SEQ ID NO: 417 - RNA, 25 nt, Artificial Sequence
  Synthetic Oligonucleotide; CTLA4 exon 2; Set C
gaaucaucuaggaaggucaacucau

SEQ ID NO: 418 - RNA, 23 nt, Artificial Sequence
  Synthetic Oligonucleotide; CTLA4 exon 2; Set C
aaucaucuaggaaggucaacuca

SEQ ID NO: 419 - RNA, 28 nt, Artificial Sequence
  Synthetic Oligonucleotide; CTLA4 exon 2; Set A
uggaaucaucuaggaaggucaacucauu

SEQ ID NO: 420 - RNA, 24 nt, Artificial Sequence
  Synthetic Oligonucleotide; CTLA4 exon 2; Set C
gaaucaucuaggaaggucaacuca

SEQ ID NO: 421 - RNA, 29 nt, Artificial Sequence
  Synthetic Oligonucleotide; CTLA4 exon 2; Set A
auggaaucaucuaggaaggucaacucauu

SEQ ID NO: 422 - RNA, 23 nt, Artificial Sequence
  Synthetic Oligonucleotide; CTLA4 exon 2; Set C
gaaucaucuaggaaggucaacuc

SEQ ID NO: 423 - RNA, 33 nt, Artificial Sequence
  Synthetic Oligonucleotide; CTLA4 exon 2; Set C
gauuuccacuggaggugcccgugcagauggaau

SEQ ID NO: 424 - RNA, 32 nt, Artificial Sequence
  Synthetic Oligonucleotide; CTLA4 exon 2; Set C
gauuuccacuggaggugcccgugcagauggaa

SEQ ID NO: 425 - RNA, 34 nt, Artificial Sequence
  Synthetic Oligonucleotide; CTLA4 exon 2; Set C
ugauuuccacuggaggugcccgugcagauggaau

SEQ ID NO: 426 - RNA, 33 nt, Artificial Sequence
  Synthetic Oligonucleotide; CTLA4 exon 2; Set C
ugauuuccacuggaggugcccgugcagauggaa

SEQ ID NO: 427 - RNA, 40 nt, Artificial Sequence
  Synthetic Oligonucleotide; CTLA4 exon 2; Set C
guucacuugauuuccacuggaggugcccgugcagauggaa

SEQ ID NO: 428 - RNA, 15 nt, Artificial Sequence
  Synthetic Oligonucleotide; CTLA4 exon 2; Set C
auuuccacuggaggu

SEQ ID NO: 429 - RNA, 16 nt, Artificial Sequence
  Synthetic Oligonucleotide; CTLA4 exon 2; Set C
gauuuccacuggaggu

SEQ ID NO: 430 - RNA, 17 nt, Artificial Sequence
  Synthetic Oligonucleotide; CTLA4 exon 2; Set C
ugauuuccacuggaggu

SEQ ID NO: 431 - RNA, 24 nt, Artificial Sequence
  Synthetic Oligonucleotide; CTLA4 exon 2; Set A
guucacuugauuuccacuggaggu

SEQ ID NO: 432 - RNA, 25 nt, Artificial Sequence
  Synthetic Oligonucleotide; CTLA4 exon 2; Set A
gguucacuugauuuccacuggaggu

SEQ ID NO: 433 - RNA, 26 nt, Artificial Sequence
  Synthetic Oligonucleotide; CTLA4 exon 2; Set A
agguucacuugauuuccacuggaggu

SEQ ID NO: 434 - RNA, 15 nt, Artificial Sequence
  Synthetic Oligonucleotide; CTLA4 exon 2; Set C
agguucacuugauuu

SEQ ID NO: 435 - RNA, 20 nt, Artificial Sequence
  Synthetic Oligonucleotide; CTLA4 exon 2; Set B
augcccagguaguauggcgg

SEQ ID NO: 436 - RNA, 21 nt, Artificial Sequence
  Synthetic Oligonucleotide; CTLA4 exon 2; Set B
uaugcccagguaguauggcgg

SEQ ID NO: 437 - RNA, 22 nt, Artificial Sequence
  Synthetic Oligonucleotide; CTLA4 exon 2; Set B
cuaugcccagguaguauggcgg

SEQ ID NO: 438 - RNA, 27 nt, Artificial Sequence
  Synthetic Oligonucleotide; CTLA4 exon 2; Set C
guugccuaugcccagguaguauggcgg

SEQ ID NO: 439 - RNA, 18 nt, Artificial Sequence
  Synthetic Oligonucleotide; CTLA4 exon 2; Set C
ccuaugcccagguaguau

SEQ ID NO: 440 - RNA, 17 nt, Artificial Sequence
  Synthetic Oligonucleotide; CTLA4 exon 2; Set C
ccuaugcccagguagua

SEQ ID NO: 441 - RNA, 19 nt, Artificial Sequence
  Synthetic Oligonucleotide; CTLA4 exon 2; Set B
gccuaugcccagguaguau

SEQ ID NO: 442 - RNA, 16 nt, Artificial Sequence
  Synthetic Oligonucleotide; CTLA4 exon 2; Set C
ccuaugcccagguagu

SEQ ID NO: 443 - RNA, 18 nt, Artificial Sequence
  Synthetic Oligonucleotide; CTLA4 exon 2; Set B
gccuaugcccagguagua

SEQ ID NO: 444 - RNA, 20 nt, Artificial Sequence
  Synthetic Oligonucleotide; CTLA4 exon 2; Set B
ugccuaugcccagguaguau

SEQ ID NO: 445 - RNA, 15 nt, Artificial Sequence
  Synthetic Oligonucleotide; CTLA4 exon 2; Set C
ccuaugcccagguag

SEQ ID NO: 446 - RNA, 17 nt, Artificial Sequence
  Synthetic Oligonucleotide; CTLA4 exon 2; Set B
gccuaugcccagguagu

SEQ ID NO: 447 - RNA, 19 nt, Artificial Sequence
  Synthetic Oligonucleotide; CTLA4 exon 2; Set B
ugccuaugcccagguagua

SEQ ID NO: 448 - RNA, 21 nt, Artificial Sequence
  Synthetic Oligonucleotide; CTLA4 exon 2; Set B
uugccuaugcccagguaguau

SEQ ID NO: 449 - RNA, 20 nt, Artificial Sequence
  Synthetic Oligonucleotide; CTLA4 exon 2; Set B
uugccuaugcccagguagua

SEQ ID NO: 450 - RNA, 16 nt, Artificial Sequence
  Synthetic Oligonucleotide; CTLA4 exon 2; Set C
gccuaugcccagguag

SEQ ID NO: 451 - RNA, 18 nt, Artificial Sequence
  Synthetic Oligonucleotide; CTLA4 exon 2; Set B
ugccuaugcccagguagu

SEQ ID NO: 452 - RNA, 32 nt, Artificial Sequence
  Synthetic Oligonucleotide; CTLA4 exon 2; Set C
guuccguugccuaugcccagguaguauggcgg

SEQ ID NO: 453 - RNA, 19 nt, Artificial Sequence
  Synthetic Oligonucleotide; CTLA4 exon 2; Set B
uugccuaugcccagguagu

SEQ ID NO: 454 - RNA, 17 nt, Artificial Sequence
  Synthetic Oligonucleotide; CTLA4 exon 2; Set C
ugccuaugcccagguag

SEQ ID NO: 455 - RNA, 23 nt, Artificial Sequence
  Synthetic Oligonucleotide; CTLA4 exon 2; Set B
cguugccuaugcccagguaguau

SEQ ID NO: 456 - RNA, 15 nt, Artificial Sequence
  Synthetic Oligonucleotide; CTLA4 exon 2; Set C
gccuaugcccaggua

SEQ ID NO: 457 - RNA, 33 nt, Artificial Sequence
  Synthetic Oligonucleotide; CTLA4 exon 2; Set C
gguuccguugccuaugcccagguaguauggcgg

SEQ ID NO: 458 - RNA, 18 nt, Artificial Sequence
  Synthetic Oligonucleotide; CTLA4 exon 2; Set C
uugccuaugcccagguag

SEQ ID NO: 459 - RNA, 22 nt, Artificial Sequence
  Synthetic Oligonucleotide; CTLA4 exon 2; Set B
cguugccuaugcccagguagua

SEQ ID NO: 460 - RNA, 24 nt, Artificial Sequence
  Synthetic Oligonucleotide; CTLA4 exon 2; Set C
ccguugccuaugcccagguaguau

SEQ ID NO: 461 - RNA, 16 nt, Artificial Sequence
  Synthetic Oligonucleotide; CTLA4 exon 2; Set C
ugccuaugcccaggua

SEQ ID NO: 462 - RNA, 34 nt, Artificial Sequence
  Synthetic Oligonucleotide; CTLA4 exon 2; Set C
ggguuccguugccuaugcccagguaguauggcgg

SEQ ID NO: 463 - RNA, 21 nt, Artificial Sequence
  Synthetic Oligonucleotide; CTLA4 exon 2; Set B
cguugccuaugcccagguagu

SEQ ID NO: 464 - RNA, 23 nt, Artificial Sequence
  Synthetic Oligonucleotide; CTLA4 exon 2; Set C
ccguugccuaugcccagguagua

SEQ ID NO: 465 - RNA, 25 nt, Artificial Sequence
  Synthetic Oligonucleotide; CTLA4 exon 2; Set C
uccguugccuaugcccagguaguau

SEQ ID NO: 466 - RNA, 17 nt, Artificial Sequence
  Synthetic Oligonucleotide; CTLA4 exon 2; Set C
uugccuaugcccaggua

SEQ ID NO: 467 - RNA, 35 nt, Artificial Sequence
  Synthetic Oligonucleotide; CTLA4 exon 2; Set C
uggguuccguugccuaugcccagguaguauggcgg

SEQ ID NO: 468 - RNA, 24 nt, Artificial Sequence
  Synthetic Oligonucleotide; CTLA4 exon 2; Set C
uccguugccuaugcccagguagua

SEQ ID NO: 469 - RNA, 20 nt, Artificial Sequence
  Synthetic Oligonucleotide; CTLA4 exon 2; Set B
cguugccuaugcccagguag

SEQ ID NO: 470 - RNA, 22 nt, Artificial Sequence
  Synthetic Oligonucleotide; CTLA4 exon 2; Set C
ccguugccuaugcccagguagu

SEQ ID NO: 471 - RNA, 26 nt, Artificial Sequence
  Synthetic Oligonucleotide; CTLA4 exon 2; Set C
uuccguugccuaugcccagguaguau

SEQ ID NO: 472 - RNA, 36 nt, Artificial Sequence
  Synthetic Oligonucleotide; CTLA4 exon 2; Set C
cuggguuccguugccuaugcccagguaguauggcgg

SEQ ID NO: 473 - RNA, 25 nt, Artificial Sequence
  Synthetic Oligonucleotide; CTLA4 exon 2; Set C
uuccguugccuaugcccagguagua

SEQ ID NO: 474 - RNA, 23 nt, Artificial Sequence
  Synthetic Oligonucleotide; CTLA4 exon 2; Set C
uccguugccuaugcccagguagu

SEQ ID NO: 475 - RNA, 21 nt, Artificial Sequence
  Synthetic Oligonucleotide; CTLA4 exon 2; Set B
ccguugccuaugcccagguag

SEQ ID NO: 476 - RNA, 19 nt, Artificial Sequence
  Synthetic Oligonucleotide; CTLA4 exon 2; Set B
cguugccuaugcccaggua

SEQ ID NO: 477 - RNA, 37 nt, Artificial Sequence
  Synthetic Oligonucleotide; CTLA4 exon 2; Set C
ucuggguuccguugccuaugcccagguaguauggcgg

SEQ ID NO: 478 - RNA, 24 nt, Artificial Sequence
  Synthetic Oligonucleotide; CTLA4 exon 2; Set C
uuccguugccuaugcccagguagu

SEQ ID NO: 479 - RNA, 22 nt, Artificial Sequence
  Synthetic Oligonucleotide; CTLA4 exon 2; Set B
uccguugccuaugcccagguag

SEQ ID NO: 480 - RNA, 20 nt, Artificial Sequence
  Synthetic Oligonucleotide; CTLA4 exon 2; Set B
ccguugccuaugcccaggua

SEQ ID NO: 481 - RNA, 38 nt, Artificial Sequence
  Synthetic Oligonucleotide; CTLA4 exon 2; Set C
aucuggguuccguugccuaugcccagguaguauggcgg

SEQ ID NO: 482 - RNA, 23 nt, Artificial Sequence
  Synthetic Oligonucleotide; CTLA4 exon 2; Set B
uuccguugccuaugcccagguag

SEQ ID NO: 483 - RNA, 21 nt, Artificial Sequence
  Synthetic Oligonucleotide; CTLA4 exon 2; Set C
uccguugccuaugcccaggua

SEQ ID NO: 484 - RNA, 39 nt, Artificial Sequence
  Synthetic Oligonucleotide; CTLA4 exon 2; Set C
aaucuggguuccguugccuaugcccagguaguauggcgg

SEQ ID NO: 485 - RNA, 22 nt, Artificial Sequence
  Synthetic Oligonucleotide; CTLA4 exon 2; Set C
uuccguugccuaugcccaggua

SEQ ID NO: 486 - RNA, 40 nt, Artificial Sequence
  Synthetic Oligonucleotide; CTLA4 exon 2; Set C
aaaucuggguuccguugccuaugcccagguaguauggcgg

SEQ ID NO: 487 - RNA, 19 nt, Artificial Sequence
  Synthetic Oligonucleotide; CTLA4 exon 2; Set B
guuccguugccuaugccca

SEQ ID NO: 488 - RNA, 20 nt, Artificial Sequence
  Synthetic Oligonucleotide; CTLA4 exon 2; Set C
gguuccguugccuaugccca

SEQ ID NO: 489 - RNA, 21 nt, Artificial Sequence
  Synthetic Oligonucleotide; CTLA4 exon 2; Set C
ggguuccguugccuaugccca

SEQ ID NO: 490 - RNA, 17 nt, Artificial Sequence
  Synthetic Oligonucleotide; CTLA4 exon 2; Set C
guuccguugccuaugcc

SEQ ID NO: 491 - RNA, 22 nt, Artificial Sequence
  Synthetic Oligonucleotide; CTLA4 exon 2; Set C
uggguuccguugccuaugccca

SEQ ID NO: 492 - RNA, 16 nt, Artificial Sequence
  Synthetic Oligonucleotide; CTLA4 exon 2; Set C
guuccguugccuaugc

SEQ ID NO: 493 - RNA, 23 nt, Artificial Sequence
  Synthetic Oligonucleotide; CTLA4 exon 2; Set C
cuggguuccguugccuaugccca

SEQ ID NO: 494 - RNA, 17 nt, Artificial Sequence
  Synthetic Oligonucleotide; CTLA4 exon 2; Set C
gguuccguugccuaugc

SEQ ID NO: 495 - RNA, 19 nt, Artificial Sequence
  Synthetic Oligonucleotide; CTLA4 exon 2; Set B
ggguuccguugccuaugcc

SEQ ID NO: 496 - RNA, 16 nt, Artificial Sequence
  Synthetic Oligonucleotide; CTLA4 exon 2; Set C
gguuccguugccuaug

SEQ ID NO: 497 - RNA, 24 nt, Artificial Sequence
  Synthetic Oligonucleotide; CTLA4 exon 2; Set C
ucuggguuccguugccuaugccca

SEQ ID NO: 498 - RNA, 18 nt, Artificial Sequence
  Synthetic Oligonucleotide; CTLA4 exon 2; Set B
ggguuccguugccuaugc

SEQ ID NO: 499 - RNA, 20 nt, Artificial Sequence
  Synthetic Oligonucleotide; CTLA4 exon 2; Set B
uggguuccguugccuaugcc

SEQ ID NO: 500 - RNA, 17 nt, Artificial Sequence
  Synthetic Oligonucleotide; CTLA4 exon 2; Set C
ggguuccguugccuaug

SEQ ID NO: 501 - RNA, 25 nt, Artificial Sequence
  Synthetic Oligonucleotide; CTLA4 exon 2; Set C
aucuggguuccguugccuaugccca

SEQ ID NO: 502 - RNA, 19 nt, Artificial Sequence
  Synthetic Oligonucleotide; CTLA4 exon 2; Set B
uggguuccguugccuaugc

SEQ ID NO: 503 - RNA, 18 nt, Artificial Sequence
  Synthetic Oligonucleotide; CTLA4 exon 2; Set C
uggguuccguugccuaug

SEQ ID NO: 504 - RNA, 26 nt, Artificial Sequence
  Synthetic Oligonucleotide; CTLA4 exon 2; Set C
aaucuggguuccguugccuaugccca

SEQ ID NO: 505 - RNA, 20 nt, Artificial Sequence
  Synthetic Oligonucleotide; CTLA4 exon 2; Set B
cuggguuccguugccuaugc

SEQ ID NO: 506 - RNA, 22 nt, Artificial Sequence
  Synthetic Oligonucleotide; CTLA4 exon 2; Set C
ucuggguuccguugccuaugcc

SEQ ID NO: 507 - RNA, 19 nt, Artificial Sequence
  Synthetic Oligonucleotide; CTLA4 exon 2; Set B
cuggguuccguugccuaug

SEQ ID NO: 508 - RNA, 27 nt, Artificial Sequence
  Synthetic Oligonucleotide; CTLA4 exon 2; Set C
aaaucuggguuccguugccuaugccca

SEQ ID NO: 509 - RNA, 21 nt, Artificial Sequence
  Synthetic Oligonucleotide; CTLA4 exon 2; Set B
ucuggguuccguugccuaugc

SEQ ID NO: 510 - RNA, 23 nt, Artificial Sequence
  Synthetic Oligonucleotide; CTLA4 exon 2; Set C
aucuggguuccguugccuaugcc

SEQ ID NO: 511 - RNA, 20 nt, Artificial Sequence
  Synthetic Oligonucleotide; CTLA4 exon 2; Set B
ucuggguuccguugccuaug

SEQ ID NO: 512 - RNA, 28 nt, Artificial Sequence
  Synthetic Oligonucleotide; CTLA4 exon 2; Set C
uaaaucuggguuccguugccuaugccca

SEQ ID NO: 513 - RNA, 22 nt, Artificial Sequence
  Synthetic Oligonucleotide; CTLA4 exon 2; Set B
aucuggguuccguugccuaugc

SEQ ID NO: 514 - RNA, 24 nt, Artificial Sequence
  Synthetic Oligonucleotide; CTLA4 exon 2; Set B
aaucuggguuccguugccuaugcc

SEQ ID NO: 515 - RNA, 29 nt, Artificial Sequence
  Synthetic Oligonucleotide; CTLA4 exon 2; Set C
auaaaucuggguuccguugccuaugccca

SEQ ID NO: 516 - RNA, 15 nt, Artificial Sequence
  Synthetic Oligonucleotide; CTLA4 exon 2; Set C
uggguuccguugccu

SEQ ID NO: 517 - RNA, 23 nt, Artificial Sequence
  Synthetic Oligonucleotide; CTLA4 exon 2; Set B
aaucuggguuccguugccuaugc

SEQ ID NO: 518 - RNA, 25 nt, Artificial Sequence
  Synthetic Oligonucleotide; CTLA4 exon 2; Set B
aaaucuggguuccguugccuaugcc

SEQ ID NO: 519 - RNA, 30 nt, Artificial Sequence
  Synthetic Oligonucleotide; CTLA4 exon 2; Set C
cauaaaucuggguuccguugccuaugccca

SEQ ID NO: 520 - RNA, 16 nt, Artificial Sequence
  Synthetic Oligonucleotide; CTLA4 exon 2; Set C
cuggguuccguugccu

SEQ ID NO: 521 - RNA, 24 nt, Artificial Sequence
  Synthetic Oligonucleotide; CTLA4 exon 2; Set B
aaaucuggguuccguugccuaugc

SEQ ID NO: 522 - RNA, 26 nt, Artificial Sequence
  Synthetic Oligonucleotide; CTLA4 exon 2; Set B
uaaaucuggguuccguugccuaugcc

SEQ ID NO: 523 - RNA, 31 nt, Artificial Sequence
  Synthetic Oligonucleotide; CTLA4 exon 2; Set C
acauaaaucuggguuccguugccuaugccca

SEQ ID NO: 524 - RNA, 17 nt, Artificial Sequence
  Synthetic Oligonucleotide; CTLA4 exon 2; Set B
ucuggguuccguugccu

SEQ ID NO: 525 - RNA, 25 nt, Artificial Sequence
  Synthetic Oligonucleotide; CTLA4 exon 2; Set B
uaaaucuggguuccguugccuaugc

SEQ ID NO: 526 - RNA, 27 nt, Artificial Sequence
  Synthetic Oligonucleotide; CTLA4 exon 2; Set B
auaaaucuggguuccguugccuaugcc

SEQ ID NO: 527 - RNA, 32 nt, Artificial Sequence
  Synthetic Oligonucleotide; CTLA4 exon 2; Set C
uacauaaaucuggguuccguugccuaugccca

SEQ ID NO: 528 - RNA, 18 nt, Artificial Sequence
  Synthetic Oligonucleotide; CTLA4 exon 2; Set B
aucuggguuccguugccu

SEQ ID NO: 529 - RNA, 26 nt, Artificial Sequence
  Synthetic Oligonucleotide; CTLA4 exon 2; Set B
auaaaucuggguuccguugccuaugc

SEQ ID NO: 530 - RNA, 28 nt, Artificial Sequence
  Synthetic Oligonucleotide; CTLA4 exon 2; Set B
cauaaaucuggguuccguugccuaugcc

SEQ ID NO: 531 - RNA, 16 nt, Artificial Sequence
  Synthetic Oligonucleotide; CTLA4 exon 2; Set C
ucuggguuccguugcc

SEQ ID NO: 532 - RNA, 33 nt, Artificial Sequence
  Synthetic Oligonucleotide; CTLA4 exon 2; Set C
uuacauaaaucuggguuccguugccuaugccca

SEQ ID NO: 533 - RNA, 19 nt, Artificial Sequence
  Synthetic Oligonucleotide; CTLA4 exon 2; Set B
aaucuggguuccguugccu

SEQ ID NO: 534 - RNA, 27 nt, Artificial Sequence
  Synthetic Oligonucleotide; CTLA4 exon 2; Set B
cauaaaucuggguuccguugccuaugc

SEQ ID NO: 535 - RNA, 29 nt, Artificial Sequence
  Synthetic Oligonucleotide; CTLA4 exon 2; Set C
acauaaaucuggguuccguugccuaugcc

SEQ ID NO: 536 - RNA, 17 nt, Artificial Sequence
  Synthetic Oligonucleotide; CTLA4 exon 2; Set C
aucuggguuccguugcc

SEQ ID NO: 537 - RNA, 15 nt, Artificial Sequence
  Synthetic Oligonucleotide; CTLA4 exon 2; Set C
ucuggguuccguugc

SEQ ID NO: 538 - RNA, 34 nt, Artificial Sequence
  Synthetic Oligonucleotide; CTLA4 exon 2; Set C
auuacauaaaucuggguuccguugccuaugccca

SEQ ID NO: 539 - RNA, 20 nt, Artificial Sequence
  Synthetic Oligonucleotide; CTLA4 exon 2; Set C
aaaucuggguuccguugccu

SEQ ID NO: 540 - RNA, 28 nt, Artificial Sequence
  Synthetic Oligonucleotide; CTLA4 exon 2; Set B
acauaaaucuggguuccguugccuaugc

SEQ ID NO: 541 - RNA, 30 nt, Artificial Sequence
  Synthetic Oligonucleotide; CTLA4 exon 2; Set C
uacauaaaucuggguuccguugccuaugcc

SEQ ID NO: 542 - RNA, 18 nt, Artificial Sequence
  Synthetic Oligonucleotide; CTLA4 exon 2; Set C
aaucuggguuccguugcc

SEQ ID NO: 543 - RNA, 16 nt, Artificial Sequence
  Synthetic Oligonucleotide; CTLA4 exon 2; Set C
aucuggguuccguugc

SEQ ID NO: 544 - RNA, 35 nt, Artificial Sequence
  Synthetic Oligonucleotide; CTLA4 exon 2; Set C
aauuacauaaaucuggguuccguugccuaugccca

SEQ ID NO: 545 - RNA, 15 nt, Artificial Sequence
  Synthetic Oligonucleotide; CTLA4 exon 2; Set C
aucuggguuccguug

SEQ ID NO: 546 - RNA, 21 nt, Artificial Sequence
  Synthetic Oligonucleotide; CTLA4 exon 2; Set B
uaaaucuggguuccguugccu

SEQ ID NO: 547 - RNA, 29 nt, Artificial Sequence
  Synthetic Oligonucleotide; CTLA4 exon 2; Set B
uacauaaaucuggguuccguugccuaugc

SEQ ID NO: 548 - RNA, 31 nt, Artificial Sequence
  Synthetic Oligonucleotide; CTLA4 exon 2; Set C
uuacauaaaucuggguuccguugccuaugcc

SEQ ID NO: 549 - RNA, 19 nt, Artificial Sequence
  Synthetic Oligonucleotide; CTLA4 exon 2; Set C
aaaucuggguuccguugcc

SEQ ID NO: 550 - RNA, 17 nt, Artificial Sequence
  Synthetic Oligonucleotide; CTLA4 exon 2; Set C
aaucuggguuccguugc

SEQ ID NO: 551 - RNA, 16 nt, Artificial Sequence
  Synthetic Oligonucleotide; CTLA4 exon 2; Set C
aaucuggguuccguug

SEQ ID NO: 552 - RNA, 22 nt, Artificial Sequence
  Synthetic Oligonucleotide; CTLA4 exon 2; Set B
auaaaucuggguuccguugccu

SEQ ID NO: 553 - RNA, 30 nt, Artificial Sequence
  Synthetic Oligonucleotide; CTLA4 exon 2; Set B
uuacauaaaucuggguuccguugccuaugc

SEQ ID NO: 554 - RNA, 32 nt, Artificial Sequence
  Synthetic Oligonucleotide; CTLA4 exon 2; Set C
auuacauaaaucuggguuccguugccuaugcc

SEQ ID NO: 555 - RNA, 20 nt, Artificial Sequence
  Synthetic Oligonucleotide; CTLA4 exon 2; Set C
uaaaucuggguuccguugcc

SEQ ID NO: 556 - RNA, 18 nt, Artificial Sequence
  Synthetic Oligonucleotide; CTLA4 exon 2; Set C
aaaucuggguuccguugc

SEQ ID NO: 557 - RNA, 29 nt, Artificial Sequence
  Synthetic Oligonucleotide; CTLA4 exon 2; Set B
uuacauaaaucuggguuccguugccuaug

SEQ ID NO: 558 - RNA, 17 nt, Artificial Sequence
  Synthetic Oligonucleotide; CTLA4 exon 2; Set C
aaaucuggguuccguug

SEQ ID NO: 559 - RNA, 23 nt, Artificial Sequence
  Synthetic Oligonucleotide; CTLA4 exon 2; Set B
cauaaaucuggguuccguugccu

SEQ ID NO: 560 - RNA, 31 nt, Artificial Sequence
  Synthetic Oligonucleotide; CTLA4 exon 2; Set B
auuacauaaaucuggguuccguugccuaugc

SEQ ID NO: 561 - RNA, 21 nt, Artificial Sequence
  Synthetic Oligonucleotide; CTLA4 exon 2; Set C
auaaaucuggguuccguugcc

SEQ ID NO: 562 - RNA, 19 nt, Artificial Sequence
  Synthetic Oligonucleotide; CTLA4 exon 2; Set C
uaaaucuggguuccguugc

SEQ ID NO: 563 - RNA, 18 nt, Artificial Sequence
  Synthetic Oligonucleotide; CTLA4 exon 2; Set C
uaaaucuggguuccguug

SEQ ID NO: 564 - RNA, 24 nt, Artificial Sequence
  Synthetic Oligonucleotide; CTLA4 exon 2; Set B
acauaaaucuggguuccguugccu

SEQ ID NO: 565 - RNA, 32 nt, Artificial Sequence
  Synthetic Oligonucleotide; CTLA4 exon 2; Set B
aauuacauaaaucuggguuccguugccuaugc

SEQ ID NO: 566 - RNA, 22 nt, Artificial Sequence
  Synthetic Oligonucleotide; CTLA4 exon 2; Set B
cauaaaucuggguuccguugcc

SEQ ID NO: 567 - RNA, 20 nt, Artificial Sequence
  Synthetic Oligonucleotide; CTLA4 exon 2; Set C
auaaaucuggguuccguugc

SEQ ID NO: 568 - RNA, 31 nt, Artificial Sequence
  Synthetic Oligonucleotide; CTLA4 exon 2; Set B
aauuacauaaaucuggguuccguugccuaug

SEQ ID NO: 569 - RNA, 19 nt, Artificial Sequence
  Synthetic Oligonucleotide; CTLA4 exon 2; Set C
auaaaucuggguuccguug

SEQ ID NO: 570 - RNA, 25 nt, Artificial Sequence
  Synthetic Oligonucleotide; CTLA4 exon 2; Set B
uacauaaaucuggguuccguugccu

SEQ ID NO: 571 - RNA, 23 nt, Artificial Sequence
  Synthetic Oligonucleotide; CTLA4 exon 2; Set B
acauaaaucuggguuccguugcc

SEQ ID NO: 572 - RNA, 21 nt, Artificial Sequence
  Synthetic Oligonucleotide; CTLA4 exon 2; Set C
cauaaaucuggguuccguugc

SEQ ID NO: 573 - RNA, 15 nt, Artificial Sequence
  Synthetic Oligonucleotide; CTLA4 exon 2; Set C
aaaucuggguuccgu

SEQ ID NO: 574 - RNA, 20 nt, Artificial Sequence
  Synthetic Oligonucleotide; CTLA4 exon 2; Set C
cauaaaucuggguuccguug

SEQ ID NO: 575 - RNA, 26 nt, Artificial Sequence
  Synthetic Oligonucleotide; CTLA4 exon 2; Set B
uuacauaaaucuggguuccguugccu

SEQ ID NO: 576 - RNA, 24 nt, Artificial Sequence
  Synthetic Oligonucleotide; CTLA4 exon 2; Set B
uacauaaaucuggguuccguugcc

SEQ ID NO: 577 - RNA, 22 nt, Artificial Sequence
  Synthetic Oligonucleotide; CTLA4 exon 2; Set C
acauaaaucuggguuccguugc

SEQ ID NO: 578 - RNA, 16 nt, Artificial Sequence
  Synthetic Oligonucleotide; CTLA4 exon 2; Set C
uaaaucuggguuccgu

SEQ ID NO: 579 - RNA, 21 nt, Artificial Sequence
  Synthetic Oligonucleotide; CTLA4 exon 2; Set C
acauaaaucuggguuccguug

SEQ ID NO: 580 - RNA, 27 nt, Artificial Sequence
  Synthetic Oligonucleotide; CTLA4 exon 2; Set B
auuacauaaaucuggguuccguugccu

SEQ ID NO: 581 - RNA, 25 nt, Artificial Sequence
  Synthetic Oligonucleotide; CTLA4 exon 2; Set B
uuacauaaaucuggguuccguugcc

SEQ ID NO: 582 - RNA, 23 nt, Artificial Sequence
  Synthetic Oligonucleotide; CTLA4 exon 2; Set C
uacauaaaucuggguuccguugc

SEQ ID NO: 583 - RNA, 15 nt, Artificial Sequence
  Synthetic Oligonucleotide; CTLA4 exon 2; Set C
uaaaucuggguuccg

SEQ ID NO: 584 - RNA, 17 nt, Artificial Sequence
  Synthetic Oligonucleotide; CTLA4 exon 2; Set C
auaaaucuggguuccgu

SEQ ID NO: 585 - RNA, 22 nt, Artificial Sequence
  Synthetic Oligonucleotide; CTLA4 exon 2; Set C
uacauaaaucuggguuccguug

SEQ ID NO: 586 - RNA, 28 nt, Artificial Sequence
  Synthetic Oligonucleotide; CTLA4 exon 2; Set B
aauuacauaaaucuggguuccguugccu

SEQ ID NO: 587 - RNA, 26 nt, Artificial Sequence
  Synthetic Oligonucleotide; CTLA4 exon 2; Set B
auuacauaaaucuggguuccguugcc

SEQ ID NO: 588 - RNA, 24 nt, Artificial Sequence
  Synthetic Oligonucleotide; CTLA4 exon 2; Set C
uuacauaaaucuggguuccguugc

SEQ ID NO: 589 - RNA, 16 nt, Artificial Sequence
  Synthetic Oligonucleotide; CTLA4 exon 2; Set C
auaaaucuggguuccg

SEQ ID NO: 590 - RNA, 18 nt, Artificial Sequence
  Synthetic Oligonucleotide; CTLA4 exon 2; Set C
cauaaaucuggguuccgu

SEQ ID NO: 591 - RNA, 15 nt, Artificial Sequence
  Synthetic Oligonucleotide; CTLA4 exon 2; Set C
auaaaucuggguucc

SEQ ID NO: 592 - RNA, 23 nt, Artificial Sequence
  Synthetic Oligonucleotide; CTLA4 exon 2; Set C
uuacauaaaucuggguuccguug

SEQ ID NO: 593 - RNA, 25 nt, Artificial Sequence
  Synthetic Oligonucleotide; CTLA4 exon 2; Set C
auuacauaaaucuggguuccguugc

SEQ ID NO: 594 - RNA, 17 nt, Artificial Sequence
  Synthetic Oligonucleotide; CTLA4 exon 2; Set C
cauaaaucuggguuccg

SEQ ID NO: 595 - RNA, 19 nt, Artificial Sequence
  Synthetic Oligonucleotide; CTLA4 exon 2; Set C
acauaaaucuggguuccgu

SEQ ID NO: 596 - RNA, 16 nt, Artificial Sequence
  Synthetic Oligonucleotide; CTLA4 exon 2; Set C
cauaaaucuggguucc

SEQ ID NO: 597 - RNA, 24 nt, Artificial Sequence
  Synthetic Oligonucleotide; CTLA4 exon 2; Set C
auuacauaaaucuggguuccguug

SEQ ID NO: 598 - RNA, 38 nt, Artificial Sequence
  Synthetic Oligonucleotide; CTLA4 exon 2; Set C
cucaccaauuacauaaaucuggguuccguugccuaugc

SEQ ID NO: 599 - RNA, 18 nt, Artificial Sequence
  Synthetic Oligonucleotide; CTLA4 exon 2; Set C
acauaaaucuggguuccg

SEQ ID NO: 600 - RNA, 20 nt, Artificial Sequence
  Synthetic Oligonucleotide; CTLA4 exon 2; Set C
uacauaaaucuggguuccgu

SEQ ID NO: 601 - RNA, 37 nt, Artificial Sequence
  Synthetic Oligonucleotide; CTLA4 exon 2; Set C
cucaccaauuacauaaaucuggguuccguugccuaug

SEQ ID NO: 602 - RNA, 15 nt, Artificial Sequence
  Synthetic Oligonucleotide; CTLA4 exon 2; Set C
cauaaaucuggguuc

SEQ ID NO: 603 - RNA, 17 nt, Artificial Sequence
  Synthetic Oligonucleotide; CTLA4 exon 2; Set C
acauaaaucuggguucc

SEQ ID NO: 604 - RNA, 25 nt, Artificial Sequence
  Synthetic Oligonucleotide; CTLA4 exon 2; Set C
aauuacauaaaucuggguuccguug

SEQ ID NO: 605 - RNA, 39 nt, Artificial Sequence
  Synthetic Oligonucleotide; CTLA4 exon 2; Set C
gcucaccaauuacauaaaucuggguuccguugccuaugc

SEQ ID NO: 606 - RNA, 19 nt, Artificial Sequence
  Synthetic Oligonucleotide; CTLA4 exon 2; Set C
uacauaaaucuggguuccg

SEQ ID NO: 607 - RNA, 21 nt, Artificial Sequence
  Synthetic Oligonucleotide; CTLA4 exon 2; Set C
uuacauaaaucuggguuccgu

SEQ ID NO: 608 - RNA, 24 nt, Artificial Sequence
  Synthetic Oligonucleotide; CTLA4 exon 2; Set C
aauuacauaaaucuggguuccguu

SEQ ID NO: 609 - RNA, 38 nt, Artificial Sequence
  Synthetic Oligonucleotide; CTLA4 exon 2; Set C
gcucaccaauuacauaaaucuggguuccguugccuaug

SEQ ID NO: 610 - RNA, 16 nt, Artificial Sequence
  Synthetic Oligonucleotide; CTLA4 exon 2; Set C
acauaaaucuggguuc

SEQ ID NO: 611 - RNA, 18 nt, Artificial Sequence
  Synthetic Oligonucleotide; CTLA4 exon 2; Set C
uacauaaaucuggguucc

SEQ ID NO: 612 - RNA, 40 nt, Artificial Sequence
  Synthetic Oligonucleotide; CTLA4 exon 2; Set C
ugcucaccaauuacauaaaucuggguuccguugccuaugc

SEQ ID NO: 613 - RNA, 22 nt, Artificial Sequence
  Synthetic Oligonucleotide; CTLA4 exon 2; Set C
auuacauaaaucuggguuccgu

SEQ ID NO: 614 - RNA, 20 nt, Artificial Sequence
  Synthetic Oligonucleotide; CTLA4 exon 2; Set C
uuacauaaaucuggguuccg

SEQ ID NO: 615 - RNA, 39 nt, Artificial Sequence
  Synthetic Oligonucleotide; CTLA4 exon 2; Set C
ugcucaccaauuacauaaaucuggguuccguugccuaug

SEQ ID NO: 616 - RNA, 17 nt, Artificial Sequence
  Synthetic Oligonucleotide; CTLA4 exon 2; Set C
uacauaaaucuggguuc

SEQ ID NO: 617 - RNA, 19 nt, Artificial Sequence
  Synthetic Oligonucleotide; CTLA4 exon 2; Set C
uuacauaaaucuggguucc

SEQ ID NO: 618 - RNA, 21 nt, Artificial Sequence
  Synthetic Oligonucleotide; CTLA4 exon 2; Set C
auuacauaaaucuggguuccg

SEQ ID NO: 619 - RNA, 40 nt, Artificial Sequence
  Synthetic Oligonucleotide; CTLA4 exon 2; Set C
uugcucaccaauuacauaaaucuggguuccguugccuaug

SEQ ID NO: 620 - RNA, 18 nt, Artificial Sequence
  Synthetic Oligonucleotide; CTLA4 exon 2; Set C
uuacauaaaucuggguuc

SEQ ID NO: 621 - RNA, 20 nt, Artificial Sequence
  Synthetic Oligonucleotide; CTLA4 exon 2; Set C
auuacauaaaucuggguucc

SEQ ID NO: 622 - RNA, 34 nt, Artificial Sequence
  Synthetic Oligonucleotide; CTLA4 exon 2; Set C
cucaccaauuacauaaaucuggguuccguugccu

SEQ ID NO: 623 - RNA, 19 nt, Artificial Sequence
  Synthetic Oligonucleotide; CTLA4 exon 2; Set C
auuacauaaaucuggguuc

SEQ ID NO: 624 - RNA, 21 nt, Artificial Sequence
  Synthetic Oligonucleotide; CTLA4 exon 2; Set C
aauuacauaaaucuggguucc

SEQ ID NO: 625 - RNA, 35 nt, Artificial Sequence
  Synthetic Oligonucleotide; CTLA4 exon 2; Set C
gcucaccaauuacauaaaucuggguuccguugccu

SEQ ID NO: 626 - RNA, 20 nt, Artificial Sequence
  Synthetic Oligonucleotide; CTLA4 exon 2; Set C
aauuacauaaaucuggguuc

SEQ ID NO: 627 - RNA, 36 nt, Artificial Sequence
  Synthetic Oligonucleotide; CTLA4 exon 2; Set C
ugcucaccaauuacauaaaucuggguuccguugccu

SEQ ID NO: 628 - RNA, 31 nt, Artificial Sequence
  Synthetic Oligonucleotide; CTLA4 exon 2; Set B
cucaccaauuacauaaaucuggguuccguug

SEQ ID NO: 629 - RNA, 37 nt, Artificial Sequence
  Synthetic Oligonucleotide; CTLA4 exon 2; Set C
uugcucaccaauuacauaaaucuggguuccguugccu

SEQ ID NO: 630 - RNA, 30 nt, Artificial Sequence
  Synthetic Oligonucleotide; CTLA4 exon 2; Set B
cucaccaauuacauaaaucuggguuccguu

SEQ ID NO: 631 - RNA, 32 nt, Artificial Sequence
  Synthetic Oligonucleotide; CTLA4 exon 2; Set B
gcucaccaauuacauaaaucuggguuccguug

SEQ ID NO: 632 - RNA, 38 nt, Artificial Sequence
  Synthetic Oligonucleotide; CTLA4 exon 2; Set C
uuugcucaccaauuacauaaaucuggguuccguugccu

SEQ ID NO: 633 - RNA, 31 nt, Artificial Sequence
  Synthetic Oligonucleotide; CTLA4 exon 2; Set B
gcucaccaauuacauaaaucuggguuccguu

SEQ ID NO: 634 - RNA, 33 nt, Artificial Sequence
  Synthetic Oligonucleotide; CTLA4 exon 2; Set B
ugcucaccaauuacauaaaucuggguuccguug

SEQ ID NO: 635 - RNA, 39 nt, Artificial Sequence
  Synthetic Oligonucleotide; CTLA4 exon 2; Set C
cuuugcucaccaauuacauaaaucuggguuccguugccu

SEQ ID NO: 636 - RNA, 32 nt, Artificial Sequence
  Synthetic Oligonucleotide; CTLA4 exon 2; Set B
ugcucaccaauuacauaaaucuggguuccguu

SEQ ID NO: 637 - RNA, 34 nt, Artificial Sequence
  Synthetic Oligonucleotide; CTLA4 exon 2; Set B
uugcucaccaauuacauaaaucuggguuccguug

SEQ ID NO: 638 - RNA, 40 nt, Artificial Sequence
  Synthetic Oligonucleotide; CTLA4 exon 2; Set C
gcuuugcucaccaauuacauaaaucuggguuccguugccu

SEQ ID NO: 639 - RNA, 33 nt, Artificial Sequence
  Synthetic Oligonucleotide; CTLA4 exon 2; Set B
uugcucaccaauuacauaaaucuggguuccguu

SEQ ID NO: 640 - RNA, 35 nt, Artificial Sequence
  Synthetic Oligonucleotide; CTLA4 exon 2; Set B
uuugcucaccaauuacauaaaucuggguuccguug

SEQ ID NO: 641 - RNA, 27 nt, Artificial Sequence
  Synthetic Oligonucleotide; CTLA4 exon 2; Set B
cucaccaauuacauaaaucuggguucc

SEQ ID NO: 642 - RNA, 34 nt, Artificial Sequence
  Synthetic Oligonucleotide; CTLA4 exon 2; Set C
uuugcucaccaauuacauaaaucuggguuccguu

SEQ ID NO: 643 - RNA, 26 nt, Artificial Sequence
  Synthetic Oligonucleotide; CTLA4 exon 2; Set C
cucaccaauuacauaaaucuggguuc

SEQ ID NO: 644 - RNA, 28 nt, Artificial Sequence
  Synthetic Oligonucleotide; CTLA4 exon 2; Set B
gcucaccaauuacauaaaucuggguucc

SEQ ID NO: 645 - RNA, 36 nt, Artificial Sequence
  Synthetic Oligonucleotide; CTLA4 exon 2; Set C
cuuugcucaccaauuacauaaaucuggguuccguug

SEQ ID NO: 646 - RNA, 35 nt, Artificial Sequence
  Synthetic Oligonucleotide; CTLA4 exon 2; Set C
cuuugcucaccaauuacauaaaucuggguuccguu

SEQ ID NO: 647 - RNA, 27 nt, Artificial Sequence
  Synthetic Oligonucleotide; CTLA4 exon 2; Set B
gcucaccaauuacauaaaucuggguuc

SEQ ID NO: 648 - RNA, 29 nt, Artificial Sequence
  Synthetic Oligonucleotide; CTLA4 exon 2; Set B
ugcucaccaauuacauaaaucuggguucc

SEQ ID NO: 649 - RNA, 37 nt, Artificial Sequence
  Synthetic Oligonucleotide; CTLA4 exon 2; Set C
gcuuugcucaccaauuacauaaaucuggguuccguug

SEQ ID NO: 650 - RNA, 24 nt, Artificial Sequence
  Synthetic Oligonucleotide; CTLA4 exon 2; Set C
cucaccaauuacauaaaucugggu

SEQ ID NO: 651 - RNA, 36 nt, Artificial Sequence
  Synthetic Oligonucleotide; CTLA4 exon 2; Set C
gcuuugcucaccaauuacauaaaucuggguuccguu

SEQ ID NO: 652 - RNA, 28 nt, Artificial Sequence
  Synthetic Oligonucleotide; CTLA4 exon 2; Set B
ugcucaccaauuacauaaaucuggguuc

SEQ ID NO: 653 - RNA, 30 nt, Artificial Sequence
  Synthetic Oligonucleotide; CTLA4 exon 2; Set B
uugcucaccaauuacauaaaucuggguucc

SEQ ID NO: 654 - RNA, 23 nt, Artificial Sequence
  Synthetic Oligonucleotide; CTLA4 exon 2; Set C
cucaccaauuacauaaaucuggg

SEQ ID NO: 655 - RNA, 25 nt, Artificial Sequence
  Synthetic Oligonucleotide; CTLA4 exon 2; Set B
gcucaccaauuacauaaaucugggu

SEQ ID NO: 656 - RNA, 29 nt, Artificial Sequence
  Synthetic Oligonucleotide; CTLA4 exon 2; Set B
uugcucaccaauuacauaaaucuggguuc

SEQ ID NO: 657 - RNA, 31 nt, Artificial Sequence
  Synthetic Oligonucleotide; CTLA4 exon 2; Set B
uuugcucaccaauuacauaaaucuggguucc

SEQ ID NO: 658 - RNA, 22 nt, Artificial Sequence
  Synthetic Oligonucleotide; CTLA4 exon 2; Set C
cucaccaauuacauaaaucugg

SEQ ID NO: 659 - RNA, 24 nt, Artificial Sequence
  Synthetic Oligonucleotide; CTLA4 exon 2; Set C
gcucaccaauuacauaaaucuggg

SEQ ID NO: 660 - RNA, 26 nt, Artificial Sequence
  Synthetic Oligonucleotide; CTLA4 exon 2; Set B
ugcucaccaauuacauaaaucugggu

SEQ ID NO: 661 - RNA, 30 nt, Artificial Sequence
  Synthetic Oligonucleotide; CTLA4 exon 2; Set B
uuugcucaccaauuacauaaaucuggguuc

SEQ ID NO: 662 - RNA, 32 nt, Artificial Sequence
  Synthetic Oligonucleotide; CTLA4 exon 2; Set B
cuuugcucaccaauuacauaaaucuggguucc

SEQ ID NO: 663 - RNA, 23 nt, Artificial Sequence
  Synthetic Oligonucleotide; CTLA4 exon 2; Set C
gcucaccaauuacauaaaucugg

SEQ ID NO: 664 - RNA, 25 nt, Artificial Sequence
  Synthetic Oligonucleotide; CTLA4 exon 2; Set C
ugcucaccaauuacauaaaucuggg

SEQ ID NO: 665 - RNA, 27 nt, Artificial Sequence
  Synthetic Oligonucleotide; CTLA4 exon 2; Set B
uugcucaccaauuacauaaaucugggu

SEQ ID NO: 666 - RNA, 21 nt, Artificial Sequence
  Synthetic Oligonucleotide; CTLA4 exon 2; Set C
cucaccaauuacauaaaucug

SEQ ID NO: 667 - RNA, 31 nt, Artificial Sequence
  Synthetic Oligonucleotide; CTLA4 exon 2; Set B
cuuugcucaccaauuacauaaaucuggguuc

SEQ ID NO: 668 - RNA, 33 nt, Artificial Sequence
  Synthetic Oligonucleotide; CTLA4 exon 2; Set C
gcuuugcucaccaauuacauaaaucuggguucc

SEQ ID NO: 669 - RNA, 24 nt, Artificial Sequence
  Synthetic Oligonucleotide; CTLA4 exon 2; Set C
ugcucaccaauuacauaaaucugg

SEQ ID NO: 670 - RNA, 20 nt, Artificial Sequence
  Synthetic Oligonucleotide; CTLA4 exon 2; Set C
cucaccaauuacauaaaucu

SEQ ID NO: 671 - RNA, 26 nt, Artificial Sequence
  Synthetic Oligonucleotide; CTLA4 exon 2; Set C
uugcucaccaauuacauaaaucuggg

SEQ ID NO: 672 - RNA, 28 nt, Artificial Sequence
  Synthetic Oligonucleotide; CTLA4 exon 2; Set B
uuugcucaccaauuacauaaaucugggu

SEQ ID NO: 673 - RNA, 22 nt, Artificial Sequence
  Synthetic Oligonucleotide; CTLA4 exon 2; Set C
gcucaccaauuacauaaaucug

SEQ ID NO: 674 - RNA, 40 nt, Artificial Sequence
  Synthetic Oligonucleotide; CTLA4 exon 2; Set C
aauggcuuugcucaccaauuacauaaaucuggguuccguu

SEQ ID NO: 675 - RNA, 32 nt, Artificial Sequence
  Synthetic Oligonucleotide; CTLA4 exon 2; Set B
gcuuugcucaccaauuacauaaaucuggguuc

SEQ ID NO: 676 - RNA, 19 nt, Artificial Sequence
  Synthetic Oligonucleotide; CTLA4 exon 2; Set C
cucaccaauuacauaaauc

SEQ ID NO: 677 - RNA, 25 nt, Artificial Sequence
  Synthetic Oligonucleotide; CTLA4 exon 2; Set C
uugcucaccaauuacauaaaucugg

SEQ ID NO: 678 - RNA, 21 nt, Artificial Sequence
  Synthetic Oligonucleotide; CTLA4 exon 2; Set C
gcucaccaauuacauaaaucu

SEQ ID NO: 679 - RNA, 27 nt, Artificial Sequence
  Synthetic Oligonucleotide; CTLA4 exon 2; Set C
uuugcucaccaauuacauaaaucuggg

SEQ ID NO: 680 - RNA, 29 nt, Artificial Sequence
  Synthetic Oligonucleotide; CTLA4 exon 2; Set B
cuuugcucaccaauuacauaaaucugggu

SEQ ID NO: 681 - RNA, 23 nt, Artificial Sequence
  Synthetic Oligonucleotide; CTLA4 exon 2; Set C
ugcucaccaauuacauaaaucug

SEQ ID NO: 682 - RNA, 18 nt, Artificial Sequence
  Synthetic Oligonucleotide; CTLA4 exon 2; Set C
cucaccaauuacauaaau

SEQ ID NO: 683 - RNA, 20 nt, Artificial Sequence
  Synthetic Oligonucleotide; CTLA4 exon 2; Set C
gcucaccaauuacauaaauc

SEQ ID NO: 684 - RNA, 26 nt, Artificial Sequence
  Synthetic Oligonucleotide; CTLA4 exon 2; Set C
uuugcucaccaauuacauaaaucugg

SEQ ID NO: 685 - RNA, 22 nt, Artificial Sequence
  Synthetic Oligonucleotide; CTLA4 exon 2; Set C
ugcucaccaauuacauaaaucu

SEQ ID NO: 686 - RNA, 28 nt, Artificial Sequence
  Synthetic Oligonucleotide; CTLA4 exon 2; Set B
cuuugcucaccaauuacauaaaucuggg

SEQ ID NO: 687 - RNA, 30 nt, Artificial Sequence
  Synthetic Oligonucleotide; CTLA4 exon 2; Set B
gcuuugcucaccaauuacauaaaucugggu

SEQ ID NO: 688 - RNA, 24 nt, Artificial Sequence
  Synthetic Oligonucleotide; CTLA4 exon 2; Set C
uugcucaccaauuacauaaaucug

SEQ ID NO: 689 - RNA, 17 nt, Artificial Sequence
  Synthetic Oligonucleotide; CTLA4 exon 2; Set C
cucaccaauuacauaaa

SEQ ID NO: 690 - RNA, 21 nt, Artificial Sequence
  Synthetic Oligonucleotide; CTLA4 exon 2; Set C
ugcucaccaauuacauaaauc

SEQ ID NO: 691 - RNA, 23 nt, Artificial Sequence
  Synthetic Oligonucleotide; CTLA4 exon 2; Set C
uugcucaccaauuacauaaaucu

SEQ ID NO: 692 - RNA, 29 nt, Artificial Sequence
  Synthetic Oligonucleotide; CTLA4 exon 2; Set B
gcuuugcucaccaauuacauaaaucuggg

SEQ ID NO: 693 - RNA, 25 nt, Artificial Sequence
  Synthetic Oligonucleotide; CTLA4 exon 2; Set C
uuugcucaccaauuacauaaaucug

SEQ ID NO: 694 - RNA, 18 nt, Artificial Sequence
  Synthetic Oligonucleotide; CTLA4 exon 2; Set C
gcucaccaauuacauaaa

SEQ ID NO: 695 - RNA, 16 nt, Artificial Sequence
  Synthetic Oligonucleotide; CTLA4 exon 2; Set C
cucaccaauuacauaa

SEQ ID NO: 696 - RNA, 22 nt, Artificial Sequence
  Synthetic Oligonucleotide; CTLA4 exon 2; Set C
uugcucaccaauuacauaaauc

SEQ ID NO: 697 - RNA, 28 nt, Artificial Sequence
  Synthetic Oligonucleotide; CTLA4 exon 2; Set B
gcuuugcucaccaauuacauaaaucugg

SEQ ID NO: 698 - RNA, 24 nt, Artificial Sequence
  Synthetic Oligonucleotide; CTLA4 exon 2; Set C
uuugcucaccaauuacauaaaucu

SEQ ID NO: 699 - RNA, 26 nt, Artificial Sequence
  Synthetic Oligonucleotide; CTLA4 exon 2; Set C
cuuugcucaccaauuacauaaaucug

SEQ ID NO: 700 - RNA, 36 nt, Artificial Sequence
  Synthetic Oligonucleotide; CTLA4 exon 2; Set B
aauggcuuugcucaccaauuacauaaaucuggguuc

SEQ ID NO: 701 - RNA, 38 nt, Artificial Sequence
  Synthetic Oligonucleotide; CTLA4 exon 2; Set C
aaauggcuuugcucaccaauuacauaaaucuggguucc

SEQ ID NO: 702 - RNA, 17 nt, Artificial Sequence
  Synthetic Oligonucleotide; CTLA4 exon 2; Set C
gcucaccaauuacauaa

SEQ ID NO: 703 - RNA, 15 nt, Artificial Sequence
  Synthetic Oligonucleotide; CTLA4 exon 2; Set C
cucaccaauuacaua

SEQ ID NO: 704 - RNA, 23 nt, Artificial Sequence
  Synthetic Oligonucleotide; CTLA4 exon 2; Set C
uuugcucaccaauuacauaaauc

SEQ ID NO: 705 - RNA, 25 nt, Artificial Sequence
  Synthetic Oligonucleotide; CTLA4 exon 2; Set C
cuuugcucaccaauuacauaaaucu

SEQ ID NO: 706 - RNA, 27 nt, Artificial Sequence
  Synthetic Oligonucleotide; CTLA4 exon 2; Set C
gcuuugcucaccaauuacauaaaucug

SEQ ID NO: 707 - RNA, 37 nt, Artificial Sequence
  Synthetic Oligonucleotide; CTLA4 exon 2; Set B
aaauggcuuugcucaccaauuacauaaaucuggguuc

SEQ ID NO: 708 - RNA, 18 nt, Artificial Sequence
  Synthetic Oligonucleotide; CTLA4 exon 2; Set C
ugcucaccaauuacauaa

SEQ ID NO: 709 - RNA, 16 nt, Artificial Sequence
  Synthetic Oligonucleotide; CTLA4 exon 2; Set C
gcucaccaauuacaua

SEQ ID NO: 710 - RNA, 26 nt, Artificial Sequence
  Synthetic Oligonucleotide; CTLA4 exon 2; Set C
gcuuugcucaccaauuacauaaaucu

SEQ ID NO: 711 - RNA, 34 nt, Artificial Sequence
  Synthetic Oligonucleotide; CTLA4 exon 2; Set B
aauggcuuugcucaccaauuacauaaaucugggu

SEQ ID NO: 712 - RNA, 38 nt, Artificial Sequence
  Synthetic Oligonucleotide; CTLA4 exon 2; Set C
gaaauggcuuugcucaccaauuacauaaaucuggguuc

SEQ ID NO: 713 - RNA, 40 nt, Artificial Sequence
  Synthetic Oligonucleotide; CTLA4 exon 2; Set C
ugaaauggcuuugcucaccaauuacauaaaucuggguucc

SEQ ID NO: 714 - RNA, 19 nt, Artificial Sequence
  Synthetic Oligonucleotide; CTLA4 exon 2; Set C
uugcucaccaauuacauaa

SEQ ID NO: 715 - RNA, 17 nt, Artificial Sequence
  Synthetic Oligonucleotide; CTLA4 exon 2; Set C
ugcucaccaauuacaua

SEQ ID NO: 716 - RNA, 15 nt, Artificial Sequence
  Synthetic Oligonucleotide; CTLA4 exon 2; Set C
gcucaccaauuacau

SEQ ID NO: 717 - RNA, 25 nt, Artificial Sequence
  Synthetic Oligonucleotide; CTLA4 exon 2; Set C
gcuuugcucaccaauuacauaaauc

SEQ ID NO: 718 - RNA, 33 nt, Artificial Sequence
  Synthetic Oligonucleotide; CTLA4 exon 2; Set B
aauggcuuugcucaccaauuacauaaaucuggg

SEQ ID NO: 719 - RNA, 35 nt, Artificial Sequence
  Synthetic Oligonucleotide; CTLA4 exon 2; Set B
aaauggcuuugcucaccaauuacauaaaucugggu

SEQ ID NO: 720 - RNA, 39 nt, Artificial Sequence
  Synthetic Oligonucleotide; CTLA4 exon 2; Set C
ugaaauggcuuugcucaccaauuacauaaaucuggguuc

SEQ ID NO: 721 - RNA, 18 nt, Artificial Sequence
  Synthetic Oligonucleotide; CTLA4 exon 2; Set C
uugcucaccaauuacaua

SEQ ID NO: 722 - RNA, 16 nt, Artificial Sequence
  Synthetic Oligonucleotide; CTLA4 exon 2; Set C
ugcucaccaauuacau

SEQ ID NO: 723 - RNA, 32 nt, Artificial Sequence
  Synthetic Oligonucleotide; CTLA4 exon 2; Set B
aauggcuuugcucaccaauuacauaaaucugg

SEQ ID NO: 724 - RNA, 36 nt, Artificial Sequence
  Synthetic Oligonucleotide; CTLA4 exon 2; Set B
gaaauggcuuugcucaccaauuacauaaaucugggu

SEQ ID NO: 725 - RNA, 40 nt, Artificial Sequence
  Synthetic Oligonucleotide; CTLA4 exon 2; Set C
gugaaauggcuuugcucaccaauuacauaaaucuggguuc

SEQ ID NO: 726 - RNA, 19 nt, Artificial Sequence
  Synthetic Oligonucleotide; CTLA4 exon 2; Set C
uuugcucaccaauuacaua

SEQ ID NO: 727 - RNA, 17 nt, Artificial Sequence
  Synthetic Oligonucleotide; CTLA4 exon 2; Set C
uugcucaccaauuacau

SEQ ID NO: 728 - RNA, 15 nt, Artificial Sequence
  Synthetic Oligonucleotide; CTLA4 exon 2; Set C
ugcucaccaauuaca

SEQ ID NO: 729 - RNA, 35 nt, Artificial Sequence
  Synthetic Oligonucleotide; CTLA4 exon 2; Set B
gaaauggcuuugcucaccaauuacauaaaucuggg

SEQ ID NO: 730 - RNA, 37 nt, Artificial Sequence
  Synthetic Oligonucleotide; CTLA4 exon 2; Set C
ugaaauggcuuugcucaccaauuacauaaaucugggu

SEQ ID NO: 731 - RNA, 31 nt, Artificial Sequence
  Synthetic Oligonucleotide; CTLA4 exon 2; Set B
aauggcuuugcucaccaauuacauaaaucug

SEQ ID NO: 732 - RNA, 18 nt, Artificial Sequence
  Synthetic Oligonucleotide; CTLA4 exon 2; Set C
uuugcucaccaauuacau

SEQ ID NO: 733 - RNA, 16 nt, Artificial Sequence
  Synthetic Oligonucleotide; CTLA4 exon 2; Set C
uugcucaccaauuaca

SEQ ID NO: 734 - RNA, 40 nt, Artificial Sequence
  Synthetic Oligonucleotide; CTLA4 exon 2; Set C
agugaaauggcuuugcucaccaauuacauaaaucuggguu

SEQ ID NO: 735 - RNA, 34 nt, Artificial Sequence
  Synthetic Oligonucleotide; CTLA4 exon 2; Set B
gaaauggcuuugcucaccaauuacauaaaucugg

SEQ ID NO: 736 - RNA, 30 nt, Artificial Sequence
  Synthetic Oligonucleotide; CTLA4 exon 2; Set B
aauggcuuugcucaccaauuacauaaaucu

SEQ ID NO: 737 - RNA, 36 nt, Artificial Sequence
  Synthetic Oligonucleotide; CTLA4 exon 2; Set B
ugaaauggcuuugcucaccaauuacauaaaucuggg

SEQ ID NO: 738 - RNA, 38 nt, Artificial Sequence
  Synthetic Oligonucleotide; CTLA4 exon 2; Set C
gugaaauggcuuugcucaccaauuacauaaaucugggu

SEQ ID NO: 739 - RNA, 32 nt, Artificial Sequence
  Synthetic Oligonucleotide; CTLA4 exon 2; Set B
aaauggcuuugcucaccaauuacauaaaucug

SEQ ID NO: 740 - RNA, 19 nt, Artificial Sequence
  Synthetic Oligonucleotide; CTLA4 exon 2; Set C
cuuugcucaccaauuacau

SEQ ID NO: 741 - RNA, 17 nt, Artificial Sequence
  Synthetic Oligonucleotide; CTLA4 exon 2; Set C
uuugcucaccaauuaca

SEQ ID NO: 742 - RNA, 15 nt, Artificial Sequence
  Synthetic Oligonucleotide; CTLA4 exon 2; Set C
uugcucaccaauuac

SEQ ID NO: 743 - RNA, 29 nt, Artificial Sequence
  Synthetic Oligonucleotide; CTLA4 exon 2; Set B
aauggcuuugcucaccaauuacauaaauc

SEQ ID NO: 744 - RNA, 35 nt, Artificial Sequence
  Synthetic Oligonucleotide; CTLA4 exon 2; Set B
ugaaauggcuuugcucaccaauuacauaaaucugg

SEQ ID NO: 745 - RNA, 31 nt, Artificial Sequence
  Synthetic Oligonucleotide; CTLA4 exon 2; Set B
aaauggcuuugcucaccaauuacauaaaucu

SEQ ID NO: 746 - RNA, 37 nt, Artificial Sequence
  Synthetic Oligonucleotide; CTLA4 exon 2; Set B
gugaaauggcuuugcucaccaauuacauaaaucuggg

SEQ ID NO: 747 - RNA, 39 nt, Artificial Sequence
  Synthetic Oligonucleotide; CTLA4 exon 2; Set C
agugaaauggcuuugcucaccaauuacauaaaucugggu

SEQ ID NO: 748 - RNA, 33 nt, Artificial Sequence
  Synthetic Oligonucleotide; CTLA4 exon 2; Set B
gaaauggcuuugcucaccaauuacauaaaucug

SEQ ID NO: 749 - RNA, 20 nt, Artificial Sequence
  Synthetic Oligonucleotide; CTLA4 exon 2; Set C
gcuuugcucaccaauuacau

SEQ ID NO: 750 - RNA, 18 nt, Artificial Sequence
  Synthetic Oligonucleotide; CTLA4 exon 2; Set C
cuuugcucaccaauuaca

SEQ ID NO: 751 - RNA, 16 nt, Artificial Sequence
  Synthetic Oligonucleotide; CTLA4 exon 2; Set C
uuugcucaccaauuac

SEQ ID NO: 752 - RNA, 36 nt, Artificial Sequence
  Synthetic Oligonucleotide; CTLA4 exon 2; Set B
gugaaauggcuuugcucaccaauuacauaaaucugg

SEQ ID NO: 753 - RNA, 32 nt, Artificial Sequence
  Synthetic Oligonucleotide; CTLA4 exon 2; Set B
gaaauggcuuugcucaccaauuacauaaaucu

SEQ ID NO: 754 - RNA, 38 nt, Artificial Sequence
  Synthetic Oligonucleotide; CTLA4 exon 2; Set B
agugaaauggcuuugcucaccaauuacauaaaucuggg

SEQ ID NO: 755 - RNA, 40 nt, Artificial Sequence
  Synthetic Oligonucleotide; CTLA4 exon 2; Set C
cagugaaauggcuuugcucaccaauuacauaaaucugggu

SEQ ID NO: 756 - RNA, 34 nt, Artificial Sequence
  Synthetic Oligonucleotide; CTLA4 exon 2; Set B
ugaaauggcuuugcucaccaauuacauaaaucug

SEQ ID NO: 757 - RNA, 27 nt, Artificial Sequence
  Synthetic Oligonucleotide; CTLA4 exon 2; Set C
aauggcuuugcucaccaauuacauaaa

SEQ ID NO: 758 - RNA, 19 nt, Artificial Sequence
  Synthetic Oligonucleotide; CTLA4 exon 2; Set C
gcuuugcucaccaauuaca

SEQ ID NO: 759 - RNA, 17 nt, Artificial Sequence
  Synthetic Oligonucleotide; CTLA4 exon 2; Set C
cuuugcucaccaauuac

SEQ ID NO: 760 - RNA, 31 nt, Artificial Sequence
  Synthetic Oligonucleotide; CTLA4 exon 2; Set B
gaaauggcuuugcucaccaauuacauaaauc

SEQ ID NO: 761 - RNA, 37 nt, Artificial Sequence
  Synthetic Oligonucleotide; CTLA4 exon 2; Set B
agugaaauggcuuugcucaccaauuacauaaaucugg

SEQ ID NO: 762 - RNA, 33 nt, Artificial Sequence
  Synthetic Oligonucleotide; CTLA4 exon 2; Set B
ugaaauggcuuugcucaccaauuacauaaaucu

SEQ ID NO: 763 - RNA, 39 nt, Artificial Sequence
  Synthetic Oligonucleotide; CTLA4 exon 2; Set C
cagugaaauggcuuugcucaccaauuacauaaaucuggg

SEQ ID NO: 764 - RNA, 35 nt, Artificial Sequence
  Synthetic Oligonucleotide; CTLA4 exon 2; Set B
gugaaauggcuuugcucaccaauuacauaaaucug

SEQ ID NO: 765 - RNA, 15 nt, Artificial Sequence
  Synthetic Oligonucleotide; CTLA4 exon 2; Set C
uuugcucaccaauua

SEQ ID NO: 766 - RNA, 26 nt, Artificial Sequence
  Synthetic Oligonucleotide; CTLA4 exon 2; Set C
aauggcuuugcucaccaauuacauaa

SEQ ID NO: 767 - RNA, 18 nt, Artificial Sequence
  Synthetic Oligonucleotide; CTLA4 exon 2; Set C
gcuuugcucaccaauuac

SEQ ID NO: 768 - RNA, 32 nt, Artificial Sequence
  Synthetic Oligonucleotide; CTLA4 exon 2; Set B
ugaaauggcuuugcucaccaauuacauaaauc

SEQ ID NO: 769 - RNA, 38 nt, Artificial Sequence
  Synthetic Oligonucleotide; CTLA4 exon 2; Set B
cagugaaauggcuuugcucaccaauuacauaaaucugg

SEQ ID NO: 770 - RNA, 34 nt, Artificial Sequence
  Synthetic Oligonucleotide; CTLA4 exon 2; Set B
gugaaauggcuuugcucaccaauuacauaaaucu

SEQ ID NO: 771 - RNA, 36 nt, Artificial Sequence
  Synthetic Oligonucleotide; CTLA4 exon 2; Set B
agugaaauggcuuugcucaccaauuacauaaaucug

SEQ ID NO: 772 - RNA, 16 nt, Artificial Sequence
  Synthetic Oligonucleotide; CTLA4 exon 2; Set C
cuuugcucaccaauua

SEQ ID NO: 773 - RNA, 25 nt, Artificial Sequence
  Synthetic Oligonucleotide; CTLA4 exon 2; Set B
aauggcuuugcucaccaauuacaua

SEQ ID NO: 774 - RNA, 33 nt, Artificial Sequence
  Synthetic Oligonucleotide; CTLA4 exon 2; Set B
gugaaauggcuuugcucaccaauuacauaaauc

SEQ ID NO: 775 - RNA, 35 nt, Artificial Sequence
  Synthetic Oligonucleotide; CTLA4 exon 2; Set B
agugaaauggcuuugcucaccaauuacauaaaucu

SEQ ID NO: 776 - RNA, 15 nt, Artificial Sequence
  Synthetic Oligonucleotide; CTLA4 exon 2; Set C
cuuugcucaccaauu

SEQ ID NO: 777 - RNA, 37 nt, Artificial Sequence
  Synthetic Oligonucleotide; CTLA4 exon 2; Set B
cagugaaauggcuuugcucaccaauuacauaaaucug

SEQ ID NO: 778 - RNA, 17 nt, Artificial Sequence
  Synthetic Oligonucleotide; CTLA4 exon 2; Set C
gcuuugcucaccaauua

SEQ ID NO: 779 - RNA, 24 nt, Artificial Sequence
  Synthetic Oligonucleotide; CTLA4 exon 2; Set B
aauggcuuugcucaccaauuacau

SEQ ID NO: 780 - RNA, 34 nt, Artificial Sequence
  Synthetic Oligonucleotide; CTLA4 exon 2; Set B
agugaaauggcuuugcucaccaauuacauaaauc

SEQ ID NO: 781 - RNA, 40 nt, Artificial Sequence
  Synthetic Oligonucleotide; CTLA4 exon 2; Set C
cucagugaaauggcuuugcucaccaauuacauaaaucugg

SEQ ID NO: 782 - RNA, 36 nt, Artificial Sequence
  Synthetic Oligonucleotide; CTLA4 exon 2; Set B
cagugaaauggcuuugcucaccaauuacauaaaucu

SEQ ID NO: 783 - RNA, 16 nt, Artificial Sequence
  Synthetic Oligonucleotide; CTLA4 exon 2; Set C
gcuuugcucaccaauu

SEQ ID NO: 784 - RNA, 33 nt, Artificial Sequence
  Synthetic Oligonucleotide; CTLA4 exon 2; Set B
agugaaauggcuuugcucaccaauuacauaaau

SEQ ID NO: 785 - RNA, 27 nt, Artificial Sequence
  Synthetic Oligonucleotide; CTLA4 exon 2; Set B
gaaauggcuuugcucaccaauuacaua

SEQ ID NO: 786 - RNA, 23 nt, Artificial Sequence
  Synthetic Oligonucleotide; CTLA4 exon 2; Set B
aauggcuuugcucaccaauuaca

SEQ ID NO: 787 - RNA, 35 nt, Artificial Sequence
  Synthetic Oligonucleotide; CTLA4 exon 2; Set B
cagugaaauggcuuugcucaccaauuacauaaauc

SEQ ID NO: 788 - RNA, 39 nt, Artificial Sequence
  Synthetic Oligonucleotide; CTLA4 exon 2; Set B
cucagugaaauggcuuugcucaccaauuacauaaaucug

SEQ ID NO: 789 - RNA, 15 nt, Artificial Sequence
  Synthetic Oligonucleotide; CTLA4 exon 2; Set C
gcuuugcucaccaau

SEQ ID NO: 790 - RNA, 32 nt, Artificial Sequence
  Synthetic Oligonucleotide; CTLA4 exon 2; Set B
agugaaauggcuuugcucaccaauuacauaaa

SEQ ID NO: 791 - RNA, 34 nt, Artificial Sequence
  Synthetic Oligonucleotide; CTLA4 exon 2; Set B
cagugaaauggcuuugcucaccaauuacauaaau

SEQ ID NO: 792 - RNA, 26 nt, Artificial Sequence
  Synthetic Oligonucleotide; CTLA4 exon 2; Set B
gaaauggcuuugcucaccaauuacau

SEQ ID NO: 793 - RNA, 22 nt, Artificial Sequence
  Synthetic Oligonucleotide; CTLA4 exon 2; Set C
aauggcuuugcucaccaauuac

SEQ ID NO: 794 - RNA, 38 nt, Artificial Sequence
  Synthetic Oligonucleotide; CTLA4 exon 2; Set B
cucagugaaauggcuuugcucaccaauuacauaaaucu

SEQ ID NO: 795 - RNA, 40 nt, Artificial Sequence
  Synthetic Oligonucleotide; CTLA4 exon 2; Set B
acucagugaaauggcuuugcucaccaauuacauaaaucug

SEQ ID NO: 796 - RNA, 31 nt, Artificial Sequence
  Synthetic Oligonucleotide; CTLA4 exon 2; Set B
agugaaauggcuuugcucaccaauuacauaa

SEQ ID NO: 797 - RNA, 33 nt, Artificial Sequence
  Synthetic Oligonucleotide; CTLA4 exon 2; Set B
cagugaaauggcuuugcucaccaauuacauaaa

SEQ ID NO: 798 - RNA, 27 nt, Artificial Sequence
  Synthetic Oligonucleotide; CTLA4 exon 2; Set B
ugaaauggcuuugcucaccaauuacau

SEQ ID NO: 799 - RNA, 25 nt, Artificial Sequence
  Synthetic Oligonucleotide; CTLA4 exon 2; Set B
gaaauggcuuugcucaccaauuaca

SEQ ID NO: 800 - RNA, 23 nt, Artificial Sequence
  Synthetic Oligonucleotide; CTLA4 exon 2; Set C
aaauggcuuugcucaccaauuac

SEQ ID NO: 801 - RNA, 37 nt, Artificial Sequence
  Synthetic Oligonucleotide; CTLA4 exon 2; Set B
cucagugaaauggcuuugcucaccaauuacauaaauc

SEQ ID NO: 802 - RNA, 39 nt, Artificial Sequence
  Synthetic Oligonucleotide; CTLA4 exon 2; Set B
acucagugaaauggcuuugcucaccaauuacauaaaucu

SEQ ID NO: 803 - RNA, 21 nt, Artificial Sequence
  Synthetic Oligonucleotide; CTLA4 exon 2; Set C
aauggcuuugcucaccaauua

SEQ ID NO: 804 - RNA, 32 nt, Artificial Sequence
  Synthetic Oligonucleotide; CTLA4 exon 2; Set B
cagugaaauggcuuugcucaccaauuacauaa

SEQ ID NO: 805 - RNA, 36 nt, Artificial Sequence
  Synthetic Oligonucleotide; CTLA4 exon 2; Set B
cucagugaaauggcuuugcucaccaauuacauaaau

SEQ ID NO: 806 - RNA, 30 nt, Artificial Sequence
  Synthetic Oligonucleotide; CTLA4 exon 2; Set B
agugaaauggcuuugcucaccaauuacaua

SEQ ID NO: 807 - RNA, 26 nt, Artificial Sequence
  Synthetic Oligonucleotide; CTLA4 exon 2; Set B
ugaaauggcuuugcucaccaauuaca

SEQ ID NO: 808 - RNA, 24 nt, Artificial Sequence
  Synthetic Oligonucleotide; CTLA4 exon 2; Set C
gaaauggcuuugcucaccaauuac

SEQ ID NO: 809 - RNA, 38 nt, Artificial Sequence
  Synthetic Oligonucleotide; CTLA4 exon 2; Set B
acucagugaaauggcuuugcucaccaauuacauaaauc

SEQ ID NO: 810 - RNA, 40 nt, Artificial Sequence
  Synthetic Oligonucleotide; CTLA4 exon 2; Set B
aacucagugaaauggcuuugcucaccaauuacauaaaucu

SEQ ID NO: 811 - RNA, 20 nt, Artificial Sequence
  Synthetic Oligonucleotide; CTLA4 exon 2; Set C
aauggcuuugcucaccaauu

SEQ ID NO: 812 - RNA, 22 nt, Artificial Sequence
  Synthetic Oligonucleotide; CTLA4 exon 2; Set C
aaauggcuuugcucaccaauua

SEQ ID NO: 813 - RNA, 37 nt, Artificial Sequence
  Synthetic Oligonucleotide; CTLA4 exon 2; Set B
acucagugaaauggcuuugcucaccaauuacauaaau

SEQ ID NO: 814 - RNA, 35 nt, Artificial Sequence
  Synthetic Oligonucleotide; CTLA4 exon 2; Set B
cucagugaaauggcuuugcucaccaauuacauaaa

SEQ ID NO: 815 - RNA, 31 nt, Artificial Sequence
  Synthetic Oligonucleotide; CTLA4 exon 2; Set B
cagugaaauggcuuugcucaccaauuacaua

SEQ ID NO: 816 - RNA, 29 nt, Artificial Sequence
  Synthetic Oligonucleotide; CTLA4 exon 2; Set B
agugaaauggcuuugcucaccaauuacau

SEQ ID NO: 817 - RNA, 27 nt, Artificial Sequence
  Synthetic Oligonucleotide; CTLA4 exon 2; Set B
gugaaauggcuuugcucaccaauuaca

SEQ ID NO: 818 - RNA, 25 nt, Artificial Sequence
  Synthetic Oligonucleotide; CTLA4 exon 2; Set B
ugaaauggcuuugcucaccaauuac

SEQ ID NO: 819 - RNA, 39 nt, Artificial Sequence
  Synthetic Oligonucleotide; CTLA4 exon 2; Set B
aacucagugaaauggcuuugcucaccaauuacauaaauc

SEQ ID NO: 820 - RNA, 21 nt, Artificial Sequence
  Synthetic Oligonucleotide; CTLA4 exon 2; Set C
aaauggcuuugcucaccaauu

SEQ ID NO: 821 - RNA, 23 nt, Artificial Sequence
  Synthetic Oligonucleotide; CTLA4 exon 2; Set C
gaaauggcuuugcucaccaauua

SEQ ID NO: 822 - RNA, 19 nt, Artificial Sequence
  Synthetic Oligonucleotide; CTLA4 exon 2; Set C
aauggcuuugcucaccaau

SEQ ID NO: 823 - RNA, 38 nt, Artificial Sequence
  Synthetic Oligonucleotide; CTLA4 exon 2; Set B
aacucagugaaauggcuuugcucaccaauuacauaaau

SEQ ID NO: 824 - RNA, 36 nt, Artificial Sequence
  Synthetic Oligonucleotide; CTLA4 exon 2; Set B
acucagugaaauggcuuugcucaccaauuacauaaa

SEQ ID NO: 825 - RNA, 34 nt, Artificial Sequence
  Synthetic Oligonucleotide; CTLA4 exon 2; Set B
cucagugaaauggcuuugcucaccaauuacauaa

SEQ ID NO: 826 - RNA, 30 nt, Artificial Sequence
  Synthetic Oligonucleotide; CTLA4 exon 2; Set B
cagugaaauggcuuugcucaccaauuacau

SEQ ID NO: 827 - RNA, 28 nt, Artificial Sequence
  Synthetic Oligonucleotide; CTLA4 exon 2; Set B
agugaaauggcuuugcucaccaauuaca

SEQ ID NO: 828 - RNA, 26 nt, Artificial Sequence
  Synthetic Oligonucleotide; CTLA4 exon 2; Set B
gugaaauggcuuugcucaccaauuac

SEQ ID NO: 829 - RNA, 40 nt, Artificial Sequence
  Synthetic Oligonucleotide; CTLA4 exon 2; Set B
caacucagugaaauggcuuugcucaccaauuacauaaauc

SEQ ID NO: 830 - RNA, 22 nt, Artificial Sequence
  Synthetic Oligonucleotide; CTLA4 exon 2; Set C
gaaauggcuuugcucaccaauu

SEQ ID NO: 831 - RNA, 24 nt, Artificial Sequence
  Synthetic Oligonucleotide; CTLA4 exon 2; Set C
ugaaauggcuuugcucaccaauua

SEQ ID NO: 832 - RNA, 20 nt, Artificial Sequence
  Synthetic Oligonucleotide; CTLA4 exon 2; Set C
aaauggcuuugcucaccaau

SEQ ID NO: 833 - RNA, 37 nt, Artificial Sequence
  Synthetic Oligonucleotide; CTLA4 exon 2; Set B
aacucagugaaauggcuuugcucaccaauuacauaaa

SEQ ID NO: 834 - RNA, 35 nt, Artificial Sequence
  Synthetic Oligonucleotide; CTLA4 exon 2; Set B
acucagugaaauggcuuugcucaccaauuacauaa

SEQ ID NO: 835 - RNA, 33 nt, Artificial Sequence
  Synthetic Oligonucleotide; CTLA4 exon 2; Set B
cucagugaaauggcuuugcucaccaauuacaua

SEQ ID NO: 836 - RNA, 29 nt, Artificial Sequence
  Synthetic Oligonucleotide; CTLA4 exon 2; Set B
cagugaaauggcuuugcucaccaauuaca

SEQ ID NO: 837 - RNA, 27 nt, Artificial Sequence
  Synthetic Oligonucleotide; CTLA4 exon 2; Set B
agugaaauggcuuugcucaccaauuac

SEQ ID NO: 838 - RNA, 23 nt, Artificial Sequence
  Synthetic Oligonucleotide; CTLA4 exon 2; Set C
ugaaauggcuuugcucaccaauu

SEQ ID NO: 839 - RNA, 25 nt, Artificial Sequence
  Synthetic Oligonucleotide; CTLA4 exon 2; Set B
gugaaauggcuuugcucaccaauua

SEQ ID NO: 840 - RNA, 21 nt, Artificial Sequence
  Synthetic Oligonucleotide; CTLA4 exon 2; Set C
gaaauggcuuugcucaccaau

SEQ ID NO: 841 - RNA, 36 nt, Artificial Sequence
  Synthetic Oligonucleotide; CTLA4 exon 2; Set B
aacucagugaaauggcuuugcucaccaauuacauaa

SEQ ID NO: 842 - RNA, 34 nt, Artificial Sequence
  Synthetic Oligonucleotide; CTLA4 exon 2; Set C
acucagugaaauggcuuugcucaccaauuacaua

SEQ ID NO: 843 - RNA, 32 nt, Artificial Sequence
  Synthetic Oligonucleotide; CTLA4 exon 2; Set B
cucagugaaauggcuuugcucaccaauuacau

SEQ ID NO: 844 - RNA, 28 nt, Artificial Sequence
  Synthetic Oligonucleotide; CTLA4 exon 2; Set B
cagugaaauggcuuugcucaccaauuac

SEQ ID NO: 845 - RNA, 24 nt, Artificial Sequence
  Synthetic Oligonucleotide; CTLA4 exon 2; Set B
gugaaauggcuuugcucaccaauu

SEQ ID NO: 846 - RNA, 26 nt, Artificial Sequence
  Synthetic Oligonucleotide; CTLA4 exon 2; Set B
agugaaauggcuuugcucaccaauua

SEQ ID NO: 847 - RNA, 22 nt, Artificial Sequence
  Synthetic Oligonucleotide; CTLA4 exon 2; Set C
ugaaauggcuuugcucaccaau

SEQ ID NO: 848 - RNA, 35 nt, Artificial Sequence
  Synthetic Oligonucleotide; CTLA4 exon 2; Set B
aacucagugaaauggcuuugcucaccaauuacaua

SEQ ID NO: 849 - RNA, 33 nt, Artificial Sequence
  Synthetic Oligonucleotide; CTLA4 exon 2; Set B
acucagugaaauggcuuugcucaccaauuacau

SEQ ID NO: 850 - RNA, 31 nt, Artificial Sequence
  Synthetic Oligonucleotide; CTLA4 exon 2; Set B
cucagugaaauggcuuugcucaccaauuaca

SEQ ID NO: 851 - RNA, 25 nt, Artificial Sequence
  Synthetic Oligonucleotide; CTLA4 exon 2; Set B
agugaaauggcuuugcucaccaauu

SEQ ID NO: 852 - RNA, 23 nt, Artificial Sequence
  Synthetic Oligonucleotide; CTLA4 exon 2; Set B
gugaaauggcuuugcucaccaau

SEQ ID NO: 853 - RNA, 36 nt, Artificial Sequence
  Synthetic Oligonucleotide; CTLA4 exon 2; Set C
caacucagugaaauggcuuugcucaccaauuacaua

SEQ ID NO: 854 - RNA, 34 nt, Artificial Sequence
  Synthetic Oligonucleotide; CTLA4 exon 2; Set B
aacucagugaaauggcuuugcucaccaauuacau

SEQ ID NO: 855 - RNA, 32 nt, Artificial Sequence
  Synthetic Oligonucleotide; CTLA4 exon 2; Set B
acucagugaaauggcuuugcucaccaauuaca

SEQ ID NO: 856 - RNA, 30 nt, Artificial Sequence
  Synthetic Oligonucleotide; CTLA4 exon 2; Set B
cucagugaaauggcuuugcucaccaauuac

SEQ ID NO: 857 - RNA, 24 nt, Artificial Sequence
  Synthetic Oligonucleotide; CTLA4 exon 2; Set B
agugaaauggcuuugcucaccaau

SEQ ID NO: 858 - RNA, 35 nt, Artificial Sequence
  Synthetic Oligonucleotide; CTLA4 exon 2; Set C
caacucagugaaauggcuuugcucaccaauuacau

SEQ ID NO: 859 - RNA, 33 nt, Artificial Sequence
  Synthetic Oligonucleotide; CTLA4 exon 2; Set B
aacucagugaaauggcuuugcucaccaauuaca

SEQ ID NO: 860 - RNA, 31 nt, Artificial Sequence
  Synthetic Oligonucleotide; CTLA4 exon 2; Set B
acucagugaaauggcuuugcucaccaauuac

SEQ ID NO: 861 - RNA, 34 nt, Artificial Sequence
  Synthetic Oligonucleotide; CTLA4 exon 2; Set C
caacucagugaaauggcuuugcucaccaauuaca

SEQ ID NO: 862 - RNA, 32 nt, Artificial Sequence
  Synthetic Oligonucleotide; CTLA4 exon 2; Set B
aacucagugaaauggcuuugcucaccaauuac

SEQ ID NO: 863 - RNA, 30 nt, Artificial Sequence
  Synthetic Oligonucleotide; CTLA4 exon 2; Set B
acucagugaaauggcuuugcucaccaauua

SEQ ID NO: 864 - RNA, 35 nt, Artificial Sequence
  Synthetic Oligonucleotide; CTLA4 exon 2; Set C
ucaacucagugaaauggcuuugcucaccaauuaca

SEQ ID NO: 865 - RNA, 33 nt, Artificial Sequence
  Synthetic Oligonucleotide; CTLA4 exon 2; Set B
caacucagugaaauggcuuugcucaccaauuac

SEQ ID NO: 866 - RNA, 29 nt, Artificial Sequence
  Synthetic Oligonucleotide; CTLA4 exon 2; Set B
acucagugaaauggcuuugcucaccaauu

SEQ ID NO: 867 - RNA, 31 nt, Artificial Sequence
  Synthetic Oligonucleotide; CTLA4 exon 2; Set B
aacucagugaaauggcuuugcucaccaauua

SEQ ID NO: 868 - RNA, 34 nt, Artificial Sequence
  Synthetic Oligonucleotide; CTLA4 exon 2; Set B
ucaacucagugaaauggcuuugcucaccaauuac

SEQ ID NO: 869 - RNA, 30 nt, Artificial Sequence
  Synthetic Oligonucleotide; CTLA4 exon 2; Set B
aacucagugaaauggcuuugcucaccaauu

SEQ ID NO: 870 - RNA, 32 nt, Artificial Sequence
  Synthetic Oligonucleotide; CTLA4 exon 2; Set B
caacucagugaaauggcuuugcucaccaauua

SEQ ID NO: 871 - RNA, 31 nt, Artificial Sequence
  Synthetic Oligonucleotide; CTLA4 exon 2; Set B
caacucagugaaauggcuuugcucaccaauu

SEQ ID NO: 872 - RNA, 33 nt, Artificial Sequence
  Synthetic Oligonucleotide; CTLA4 exon 2; Set B
ucaacucagugaaauggcuuugcucaccaauua

SEQ ID NO: 873 - RNA, 29 nt, Artificial Sequence
  Synthetic Oligonucleotide; CTLA4 exon 2; Set B
aacucagugaaauggcuuugcucaccaau

SEQ ID NO: 874 - RNA, 32 nt, Artificial Sequence
  Synthetic Oligonucleotide; CTLA4 exon 2; Set B
ucaacucagugaaauggcuuugcucaccaauu

SEQ ID NO: 875 - RNA, 34 nt, Artificial Sequence
  Synthetic Oligonucleotide; CTLA4 exon 2; Set C
gucaacucagugaaauggcuuugcucaccaauua

SEQ ID NO: 876 - RNA, 30 nt, Artificial Sequence
  Synthetic Oligonucleotide; CTLA4 exon 2; Set B
caacucagugaaauggcuuugcucaccaau

SEQ ID NO: 877 - RNA, 19 nt, Artificial Sequence
  Synthetic Oligonucleotide; CTLA4 exon 2; Set C
cagugaaauggcuuugcuc

SEQ ID NO: 878 - RNA, 33 nt, Artificial Sequence
  Synthetic Oligonucleotide; CTLA4 exon 2; Set C
gucaacucagugaaauggcuuugcucaccaauu

SEQ ID NO: 879 - RNA, 35 nt, Artificial Sequence
  Synthetic Oligonucleotide; CTLA4 exon 2; Set C
ugucaacucagugaaauggcuuugcucaccaauua

SEQ ID NO: 880 - RNA, 31 nt, Artificial Sequence
  Synthetic Oligonucleotide; CTLA4 exon 2; Set B
ucaacucagugaaauggcuuugcucaccaau

SEQ ID NO: 881 - RNA, 18 nt, Artificial Sequence
  Synthetic Oligonucleotide; CTLA4 exon 2; Set C
cagugaaauggcuuugcu

SEQ ID NO: 882 - RNA, 20 nt, Artificial Sequence
  Synthetic Oligonucleotide; CTLA4 exon 2; Set C
ucagugaaauggcuuugcuc

SEQ ID NO: 883 - RNA, 32 nt, Artificial Sequence
  Synthetic Oligonucleotide; CTLA4 exon 2; Set B
gucaacucagugaaauggcuuugcucaccaau

SEQ ID NO: 884 - RNA, 17 nt, Artificial Sequence
  Synthetic Oligonucleotide; CTLA4 exon 2; Set C
cagugaaauggcuuugc

SEQ ID NO: 885 - RNA, 19 nt, Artificial Sequence
  Synthetic Oligonucleotide; CTLA4 exon 2; Set C
ucagugaaauggcuuugcu

SEQ ID NO: 886 - RNA, 21 nt, Artificial Sequence
  Synthetic Oligonucleotide; CTLA4 exon 2; Set C
cucagugaaauggcuuugcuc

SEQ ID NO: 887 - RNA, 33 nt, Artificial Sequence
  Synthetic Oligonucleotide; CTLA4 exon 2; Set C
ugucaacucagugaaauggcuuugcucaccaau

SEQ ID NO: 888 - RNA, 20 nt, Artificial Sequence
  Synthetic Oligonucleotide; CTLA4 exon 2; Set C
cucagugaaauggcuuugcu

SEQ ID NO: 889 - RNA, 18 nt, Artificial Sequence
  Synthetic Oligonucleotide; CTLA4 exon 2; Set C
ucagugaaauggcuuugc

SEQ ID NO: 890 - RNA, 22 nt, Artificial Sequence
  Synthetic Oligonucleotide; CTLA4 exon 2; Set C
acucagugaaauggcuuugcuc

SEQ ID NO: 891 - RNA, 16 nt, Artificial Sequence
  Synthetic Oligonucleotide; CTLA4 exon 2; Set C
cagugaaauggcuuug

SEQ ID NO: 892 - RNA, 34 nt, Artificial Sequence
  Synthetic Oligonucleotide; CTLA4 exon 2; Set C
gugucaacucagugaaauggcuuugcucaccaau

SEQ ID NO: 893 - RNA, 21 nt, Artificial Sequence
  Synthetic Oligonucleotide; CTLA4 exon 2; Set C
acucagugaaauggcuuugcu

SEQ ID NO: 894 - RNA, 19 nt, Artificial Sequence
  Synthetic Oligonucleotide; CTLA4 exon 2; Set C
cucagugaaauggcuuugc

SEQ ID NO: 895 - RNA, 15 nt, Artificial Sequence
  Synthetic Oligonucleotide; CTLA4 exon 2; Set C
cagugaaauggcuuu

SEQ ID NO: 896 - RNA, 17 nt, Artificial Sequence
  Synthetic Oligonucleotide; CTLA4 exon 2; Set C
ucagugaaauggcuuug

SEQ ID NO: 897 - RNA, 20 nt, Artificial Sequence
  Synthetic Oligonucleotide; CTLA4 exon 2; Set C
acucagugaaauggcuuugc

SEQ ID NO: 898 - RNA, 16 nt, Artificial Sequence
  Synthetic Oligonucleotide; CTLA4 exon 2; Set C
ucagugaaauggcuuu

SEQ ID NO: 899 - RNA, 18 nt, Artificial Sequence
  Synthetic Oligonucleotide; CTLA4 exon 2; Set C
cucagugaaauggcuuug

SEQ ID NO: 900 - RNA, 15 nt, Artificial Sequence
  Synthetic Oligonucleotide; CTLA4 exon 2; Set C
ucagugaaauggcuu

SEQ ID NO: 901 - RNA, 17 nt, Artificial Sequence
  Synthetic Oligonucleotide; CTLA4 exon 2; Set C
cucagugaaauggcuuu

SEQ ID NO: 902 - RNA, 19 nt, Artificial Sequence
  Synthetic Oligonucleotide; CTLA4 exon 2; Set C
acucagugaaauggcuuug

SEQ ID NO: 903 - RNA, 16 nt, Artificial Sequence
  Synthetic Oligonucleotide; CTLA4 exon 2; Set C
cucagugaaauggcuu

SEQ ID NO: 904 - RNA, 18 nt, Artificial Sequence
  Synthetic Oligonucleotide; CTLA4 exon 2; Set C
acucagugaaauggcuuu

SEQ ID NO: 905 - RNA, 17 nt, Artificial Sequence
  Synthetic Oligonucleotide; CTLA4 exon 2; Set C
acucagugaaauggcuu

SEQ ID NO: 906 - RNA, 15 nt, Artificial Sequence
  Synthetic Oligonucleotide; CTLA4 exon 2; Set C
cucagugaaauggcu

SEQ ID NO: 907 - RNA, 16 nt, Artificial Sequence
  Synthetic Oligonucleotide; CTLA4 exon 2; Set C
acucagugaaauggcu

SEQ ID NO: 908 - RNA, 19 nt, Artificial Sequence
  Synthetic Oligonucleotide; CTLA4 exon 2; Set C
gucaacucagugaaauggc

SEQ ID NO: 909 - RNA, 20 nt, Artificial Sequence
  Synthetic Oligonucleotide; CTLA4 exon 2; Set C
ugucaacucagugaaauggc

SEQ ID NO: 910 - RNA, 18 nt, Artificial Sequence
  Synthetic Oligonucleotide; CTLA4 exon 2; Set C
gucaacucagugaaaugg

SEQ ID NO: 911 - RNA, 17 nt, Artificial Sequence
  Synthetic Oligonucleotide; CTLA4 exon 2; Set C
gucaacucagugaaaug

SEQ ID NO: 912 - RNA, 19 nt, Artificial Sequence
  Synthetic Oligonucleotide; CTLA4 exon 2; Set C
ugucaacucagugaaaugg

SEQ ID NO: 913 - RNA, 21 nt, Artificial Sequence
  Synthetic Oligonucleotide; CTLA4 exon 2; Set C
gugucaacucagugaaauggc

SEQ ID NO: 914 - RNA, 36 nt, Artificial Sequence
  Synthetic Oligonucleotide; CTLA4 exon 2; Set C
ugcaacaggugucaacucagugaaauggcuuugcuc

SEQ ID NO: 915 - RNA, 18 nt, Artificial Sequence
  Synthetic Oligonucleotide; CTLA4 exon 2; Set C
ugucaacucagugaaaug

SEQ ID NO: 916 - RNA, 20 nt, Artificial Sequence
  Synthetic Oligonucleotide; CTLA4 exon 2; Set C
gugucaacucagugaaaugg

SEQ ID NO: 917 - RNA, 35 nt, Artificial Sequence
  Synthetic Oligonucleotide; CTLA4 exon 2; Set C
ugcaacaggugucaacucagugaaauggcuuugcu

SEQ ID NO: 918 - RNA, 37 nt, Artificial Sequence
  Synthetic Oligonucleotide; CTLA4 exon 2; Set C
augcaacaggugucaacucagugaaauggcuuugcuc

SEQ ID NO: 919 - RNA, 19 nt, Artificial Sequence
  Synthetic Oligonucleotide; CTLA4 exon 2; Set C
gugucaacucagugaaaug

SEQ ID NO: 920 - RNA, 36 nt, Artificial Sequence
  Synthetic Oligonucleotide; CTLA4 exon 2; Set C
augcaacaggugucaacucagugaaauggcuuugcu

SEQ ID NO: 921 - RNA, 34 nt, Artificial Sequence
  Synthetic Oligonucleotide; CTLA4 exon 2; Set C
ugcaacaggugucaacucagugaaauggcuuugc

SEQ ID NO: 922 - RNA, 35 nt, Artificial Sequence
  Synthetic Oligonucleotide; CTLA4 exon 2; Set C
augcaacaggugucaacucagugaaauggcuuugc

SEQ ID NO: 923 - RNA, 33 nt, Artificial Sequence
  Synthetic Oligonucleotide; CTLA4 exon 2; Set B
ugcaacaggugucaacucagugaaauggcuuug

SEQ ID NO: 924 - RNA, 32 nt, Artificial Sequence
  Synthetic Oligonucleotide; CTLA4 exon 2; Set B
ugcaacaggugucaacucagugaaauggcuuu

SEQ ID NO: 925 - RNA, 34 nt, Artificial Sequence
  Synthetic Oligonucleotide; CTLA4 exon 2; Set B
augcaacaggugucaacucagugaaauggcuuug

SEQ ID NO: 926 - RNA, 31 nt, Artificial Sequence
  Synthetic Oligonucleotide; CTLA4 exon 2; Set B
ugcaacaggugucaacucagugaaauggcuu

SEQ ID NO: 927 - RNA, 33 nt, Artificial Sequence
  Synthetic Oligonucleotide; CTLA4 exon 2; Set B
augcaacaggugucaacucagugaaauggcuuu

SEQ ID NO: 928 - RNA, 32 nt, Artificial Sequence
  Synthetic Oligonucleotide; CTLA4 exon 2; Set B
augcaacaggugucaacucagugaaauggcuu

SEQ ID NO: 929 - RNA, 30 nt, Artificial Sequence
  Synthetic Oligonucleotide; CTLA4 exon 2; Set B
ugcaacaggugucaacucagugaaauggcu

SEQ ID NO: 930 - RNA, 31 nt, Artificial Sequence
  Synthetic Oligonucleotide; CTLA4 exon 2; Set B
augcaacaggugucaacucagugaaauggcu

SEQ ID NO: 931 - RNA, 32 nt, Artificial Sequence
  Synthetic Oligonucleotide; CTLA4 exon 2; Set B
aaugcaacaggugucaacucagugaaauggcu

SEQ ID NO: 932 - RNA, 26 nt, Artificial Sequence
  Synthetic Oligonucleotide; CTLA4 exon 2; Set B
ugcaacaggugucaacucagugaaau

SEQ ID NO: 933 - RNA, 25 nt, Artificial Sequence
  Synthetic Oligonucleotide; CTLA4 exon 2; Set B
ugcaacaggugucaacucagugaaa

SEQ ID NO: 934 - RNA, 27 nt, Artificial Sequence
  Synthetic Oligonucleotide; CTLA4 exon 2; Set B
augcaacaggugucaacucagugaaau

SEQ ID NO: 935 - RNA, 40 nt, Artificial Sequence
  Synthetic Oligonucleotide; CTLA4 exon 2; Set C
gacugcaaugcaacaggugucaacucagugaaauggcuuu

SEQ ID NO: 936 - RNA, 26 nt, Artificial Sequence
  Synthetic Oligonucleotide; CTLA4 exon 2; Set B
augcaacaggugucaacucagugaaa

SEQ ID NO: 937 - RNA, 24 nt, Artificial Sequence
  Synthetic Oligonucleotide; CTLA4 exon 2; Set B
ugcaacaggugucaacucagugaa

SEQ ID NO: 938 - RNA, 28 nt, Artificial Sequence
  Synthetic Oligonucleotide; CTLA4 exon 2; Set B
aaugcaacaggugucaacucagugaaau

SEQ ID NO: 939 - RNA, 39 nt, Artificial Sequence
  Synthetic Oligonucleotide; CTLA4 exon 2; Set C
gacugcaaugcaacaggugucaacucagugaaauggcuu

SEQ ID NO: 940 - RNA, 27 nt, Artificial Sequence
  Synthetic Oligonucleotide; CTLA4 exon 2; Set B
aaugcaacaggugucaacucagugaaa

SEQ ID NO: 941 - RNA, 23 nt, Artificial Sequence
  Synthetic Oligonucleotide; CTLA4 exon 2; Set B
ugcaacaggugucaacucaguga

SEQ ID NO: 942 - RNA, 25 nt, Artificial Sequence
  Synthetic Oligonucleotide; CTLA4 exon 2; Set B
augcaacaggugucaacucagugaa

SEQ ID NO: 943 - RNA, 38 nt, Artificial Sequence
  Synthetic Oligonucleotide; CTLA4 exon 2; Set C
gacugcaaugcaacaggugucaacucagugaaauggcu

SEQ ID NO: 944 - RNA, 22 nt, Artificial Sequence
  Synthetic Oligonucleotide; CTLA4 exon 2; Set B
ugcaacaggugucaacucagug

SEQ ID NO: 945 - RNA, 24 nt, Artificial Sequence
  Synthetic Oligonucleotide; CTLA4 exon 2; Set B
augcaacaggugucaacucaguga

SEQ ID NO: 946 - RNA, 26 nt, Artificial Sequence
  Synthetic Oligonucleotide; CTLA4 exon 2; Set B
aaugcaacaggugucaacucagugaa

SEQ ID NO: 947 - RNA, 39 nt, Artificial Sequence
  Synthetic Oligonucleotide; CTLA4 exon 2; Set C
agacugcaaugcaacaggugucaacucagugaaauggcu

SEQ ID NO: 948 - RNA, 23 nt, Artificial Sequence
  Synthetic Oligonucleotide; CTLA4 exon 2; Set B
augcaacaggugucaacucagug

SEQ ID NO: 949 - RNA, 25 nt, Artificial Sequence
  Synthetic Oligonucleotide; CTLA4 exon 2; Set B
aaugcaacaggugucaacucaguga

SEQ ID NO: 950 - RNA, 40 nt, Artificial Sequence
  Synthetic Oligonucleotide; CTLA4 exon 2; Set C
aagacugcaaugcaacaggugucaacucagugaaauggcu

SEQ ID NO: 951 - RNA, 24 nt, Artificial Sequence
  Synthetic Oligonucleotide; CTLA4 exon 2; Set B
aaugcaacaggugucaacucagug

SEQ ID NO: 952 - RNA, 22 nt, Artificial Sequence
  Synthetic Oligonucleotide; CTLA4 exon 2; Set B
augcaacaggugucaacucagu

SEQ ID NO: 953 - RNA, 23 nt, Artificial Sequence
  Synthetic Oligonucleotide; CTLA4 exon 2; Set C
aaugcaacaggugucaacucagu

SEQ ID NO: 954 - RNA, 34 nt, Artificial Sequence
  Synthetic Oligonucleotide; CTLA4 exon 2; Set C
gacugcaaugcaacaggugucaacucagugaaau

SEQ ID NO: 955 - RNA, 33 nt, Artificial Sequence
  Synthetic Oligonucleotide; CTLA4 exon 2; Set C
gacugcaaugcaacaggugucaacucagugaaa

SEQ ID NO: 956 - RNA, 35 nt, Artificial Sequence
  Synthetic Oligonucleotide; CTLA4 exon 2; Set C
agacugcaaugcaacaggugucaacucagugaaau

SEQ ID NO: 957 - RNA, 34 nt, Artificial Sequence
  Synthetic Oligonucleotide; CTLA4 exon 2; Set C
agacugcaaugcaacaggugucaacucagugaaa

SEQ ID NO: 958 - RNA, 32 nt, Artificial Sequence
  Synthetic Oligonucleotide; CTLA4 exon 2; Set C
gacugcaaugcaacaggugucaacucagugaa

SEQ ID NO: 959 - RNA, 36 nt, Artificial Sequence
  Synthetic Oligonucleotide; CTLA4 exon 2; Set B
aagacugcaaugcaacaggugucaacucagugaaau

SEQ ID NO: 960 - RNA, 35 nt, Artificial Sequence
  Synthetic Oligonucleotide; CTLA4 exon 2; Set B
aagacugcaaugcaacaggugucaacucagugaaa

SEQ ID NO: 961 - RNA, 31 nt, Artificial Sequence
  Synthetic Oligonucleotide; CTLA4 exon 2; Set C
gacugcaaugcaacaggugucaacucaguga

SEQ ID NO: 962 - RNA, 33 nt, Artificial Sequence
  Synthetic Oligonucleotide; CTLA4 exon 2; Set C
agacugcaaugcaacaggugucaacucagugaa

SEQ ID NO: 963 - RNA, 37 nt, Artificial Sequence
  Synthetic Oligonucleotide; CTLA4 exon 2; Set C
gaagacugcaaugcaacaggugucaacucagugaaau

SEQ ID NO: 964 - RNA, 30 nt, Artificial Sequence
  Synthetic Oligonucleotide; CTLA4 exon 2; Set C
gacugcaaugcaacaggugucaacucagug

SEQ ID NO: 965 - RNA, 32 nt, Artificial Sequence
  Synthetic Oligonucleotide; CTLA4 exon 2; Set C
agacugcaaugcaacaggugucaacucaguga

SEQ ID NO: 966 - RNA, 34 nt, Artificial Sequence
  Synthetic Oligonucleotide; CTLA4 exon 2; Set C
aagacugcaaugcaacaggugucaacucagugaa

SEQ ID NO: 967 - RNA, 38 nt, Artificial Sequence
  Synthetic Oligonucleotide; CTLA4 exon 2; Set C
agaagacugcaaugcaacaggugucaacucagugaaau

SEQ ID NO: 968 - RNA, 18 nt, Artificial Sequence
  Synthetic Oligonucleotide; CTLA4 exon 2; Set C
aaugcaacaggugucaac

SEQ ID NO: 969 - RNA, 31 nt, Artificial Sequence
  Synthetic Oligonucleotide; CTLA4 exon 2; Set C
agacugcaaugcaacaggugucaacucagug

SEQ ID NO: 970 - RNA, 33 nt, Artificial Sequence
  Synthetic Oligonucleotide; CTLA4 exon 2; Set C
aagacugcaaugcaacaggugucaacucaguga

SEQ ID NO: 971 - RNA, 35 nt, Artificial Sequence
  Synthetic Oligonucleotide; CTLA4 exon 2; Set C
gaagacugcaaugcaacaggugucaacucagugaa

SEQ ID NO: 972 - RNA, 17 nt, Artificial Sequence
  Synthetic Oligonucleotide; CTLA4 exon 2; Set C
aaugcaacaggugucaa

SEQ ID NO: 973 - RNA, 29 nt, Artificial Sequence
  Synthetic Oligonucleotide; CTLA4 exon 2; Set C
gacugcaaugcaacaggugucaacucagu

SEQ ID NO: 974 - RNA, 32 nt, Artificial Sequence
  Synthetic Oligonucleotide; CTLA4 exon 2; Set B
aagacugcaaugcaacaggugucaacucagug

SEQ ID NO: 975 - RNA, 34 nt, Artificial Sequence
  Synthetic Oligonucleotide; CTLA4 exon 2; Set C
gaagacugcaaugcaacaggugucaacucaguga

SEQ ID NO: 976 - RNA, 36 nt, Artificial Sequence
  Synthetic Oligonucleotide; CTLA4 exon 2; Set C
agaagacugcaaugcaacaggugucaacucagugaa

SEQ ID NO: 977 - RNA, 16 nt, Artificial Sequence
  Synthetic Oligonucleotide; CTLA4 exon 2; Set C
aaugcaacagguguca

SEQ ID NO: 978 - RNA, 30 nt, Artificial Sequence
  Synthetic Oligonucleotide; CTLA4 exon 2; Set C
agacugcaaugcaacaggugucaacucagu

SEQ ID NO: 979 - RNA, 15 nt, Artificial Sequence
  Synthetic Oligonucleotide; CTLA4 exon 2; Set C
aaugcaacagguguc

SEQ ID NO: 980 - RNA, 33 nt, Artificial Sequence
  Synthetic Oligonucleotide; CTLA4 exon 2; Set C
gaagacugcaaugcaacaggugucaacucagug

SEQ ID NO: 981 - RNA, 35 nt, Artificial Sequence
  Synthetic Oligonucleotide; CTLA4 exon 2; Set C
agaagacugcaaugcaacaggugucaacucaguga

SEQ ID NO: 982 - RNA, 31 nt, Artificial Sequence
  Synthetic Oligonucleotide; CTLA4 exon 2; Set B
aagacugcaaugcaacaggugucaacucagu

SEQ ID NO: 983 - RNA, 34 nt, Artificial Sequence
  Synthetic Oligonucleotide; CTLA4 exon 2; Set C
agaagacugcaaugcaacaggugucaacucagug

SEQ ID NO: 984 - RNA, 32 nt, Artificial Sequence
  Synthetic Oligonucleotide; CTLA4 exon 2; Set C
gaagacugcaaugcaacaggugucaacucagu

SEQ ID NO: 985 - RNA, 33 nt, Artificial Sequence
  Synthetic Oligonucleotide; CTLA4 exon 2; Set C
agaagacugcaaugcaacaggugucaacucagu

SEQ ID NO: 986 - RNA, 31 nt, Artificial Sequence
  Synthetic Oligonucleotide; CTLA4 exon 2; Set B
gaagacugcaaugcaacaggugucaacucag

SEQ ID NO: 987 - RNA, 24 nt, Artificial Sequence
  Synthetic Oligonucleotide; CTLA4 exon 2; Set B
gacugcaaugcaacaggugucaac

SEQ ID NO: 988 - RNA, 32 nt, Artificial Sequence
  Synthetic Oligonucleotide; CTLA4 exon 2; Set B
agaagacugcaaugcaacaggugucaacucag

SEQ ID NO: 989 - RNA, 23 nt, Artificial Sequence
  Synthetic Oligonucleotide; CTLA4 exon 2; Set B
gacugcaaugcaacaggugucaa

SEQ ID NO: 990 - RNA, 25 nt, Artificial Sequence
  Synthetic Oligonucleotide; CTLA4 exon 2; Set B
agacugcaaugcaacaggugucaac

SEQ ID NO: 991 - RNA, 27 nt, Artificial Sequence
  Synthetic Oligonucleotide; CTLA4 exon 2; Set B
aagacugcaaugcaacaggugucaacu

SEQ ID NO: 992 - RNA, 22 nt, Artificial Sequence
  Synthetic Oligonucleotide; CTLA4 exon 2; Set B
gacugcaaugcaacagguguca

SEQ ID NO: 993 - RNA, 24 nt, Artificial Sequence
  Synthetic Oligonucleotide; CTLA4 exon 2; Set B
agacugcaaugcaacaggugucaa

SEQ ID NO: 994 - RNA, 26 nt, Artificial Sequence
  Synthetic Oligonucleotide; CTLA4 exon 2; Set B
aagacugcaaugcaacaggugucaac

SEQ ID NO: 995 - RNA, 28 nt, Artificial Sequence
  Synthetic Oligonucleotide; CTLA4 exon 2; Set B
gaagacugcaaugcaacaggugucaacu

SEQ ID NO: 996 - RNA, 30 nt, Artificial Sequence
  Synthetic Oligonucleotide; CTLA4 exon 2; Set B
agaagacugcaaugcaacaggugucaacuc

SEQ ID NO: 997 - RNA, 21 nt, Artificial Sequence
  Synthetic Oligonucleotide; CTLA4 exon 2; Set B
gacugcaaugcaacagguguc

SEQ ID NO: 998 - RNA, 23 nt, Artificial Sequence
  Synthetic Oligonucleotide; CTLA4 exon 2; Set B
agacugcaaugcaacagguguca

SEQ ID NO: 999 - RNA, 25 nt, Artificial Sequence
  Synthetic Oligonucleotide; CTLA4 exon 2; Set B
aagacugcaaugcaacaggugucaa

SEQ ID NO: 1000 - RNA, 27 nt, Artificial Sequence
  Synthetic Oligonucleotide; CTLA4 exon 2; Set B
gaagacugcaaugcaacaggugucaac

SEQ ID NO: 1001 - RNA, 29 nt, Artificial Sequence
  Synthetic Oligonucleotide; CTLA4 exon 2; Set B
agaagacugcaaugcaacaggugucaacu

SEQ ID NO: 1002 - RNA, 22 nt, Artificial Sequence
  Synthetic Oligonucleotide; CTLA4 exon 2; Set B
agacugcaaugcaacagguguc

SEQ ID NO: 1003 - RNA, 20 nt, Artificial Sequence
  Synthetic Oligonucleotide; CTLA4 exon 2; Set B
gacugcaaugcaacaggugu

SEQ ID NO: 1004 - RNA, 24 nt, Artificial Sequence
  Synthetic Oligonucleotide; CTLA4 exon 2; Set B
aagacugcaaugcaacagguguca

SEQ ID NO: 1005 - RNA, 26 nt, Artificial Sequence
  Synthetic Oligonucleotide; CTLA4 exon 2; Set B
gaagacugcaaugcaacaggugucaa

SEQ ID NO: 1006 - RNA, 28 nt, Artificial Sequence
  Synthetic Oligonucleotide; CTLA4 exon 2; Set B
agaagacugcaaugcaacaggugucaac

SEQ ID NO: 1007 - RNA, 23 nt, Artificial Sequence
  Synthetic Oligonucleotide; CTLA4 exon 2; Set B
aagacugcaaugcaacagguguc

SEQ ID NO: 1008 - RNA, 21 nt, Artificial Sequence
  Synthetic Oligonucleotide; CTLA4 exon 2; Set B
agacugcaaugcaacaggugu

SEQ ID NO: 1009 - RNA, 19 nt, Artificial Sequence
  Synthetic Oligonucleotide; CTLA4 exon 2; Set C
gacugcaaugcaacaggug

SEQ ID NO: 1010 - RNA, 25 nt, Artificial Sequence
  Synthetic Oligonucleotide; CTLA4 exon 2; Set B
gaagacugcaaugcaacagguguca

SEQ ID NO: 1011 - RNA, 27 nt, Artificial Sequence
  Synthetic Oligonucleotide; CTLA4 exon 2; Set B
agaagacugcaaugcaacaggugucaa

SEQ ID NO: 1012 - RNA, 24 nt, Artificial Sequence
  Synthetic Oligonucleotide; CTLA4 exon 2; Set B
gaagacugcaaugcaacagguguc

SEQ ID NO: 1013 - RNA, 22 nt, Artificial Sequence
  Synthetic Oligonucleotide; CTLA4 exon 2; Set C
aagacugcaaugcaacaggugu

SEQ ID NO: 1014 - RNA, 20 nt, Artificial Sequence
  Synthetic Oligonucleotide; CTLA4 exon 2; Set C
agacugcaaugcaacaggug

SEQ ID NO: 1015 - RNA, 26 nt, Artificial Sequence
  Synthetic Oligonucleotide; CTLA4 exon 2; Set B
agaagacugcaaugcaacagguguca

SEQ ID NO: 1016 - RNA, 25 nt, Artificial Sequence
  Synthetic Oligonucleotide; CTLA4 exon 2; Set B
agaagacugcaaugcaacagguguc

SEQ ID NO: 1017 - RNA, 23 nt, Artificial Sequence
  Synthetic Oligonucleotide; CTLA4 exon 2; Set B
gaagacugcaaugcaacaggugu

SEQ ID NO: 1018 - RNA, 21 nt, Artificial Sequence
  Synthetic Oligonucleotide; CTLA4 exon 2; Set C
aagacugcaaugcaacaggug

SEQ ID NO: 1019 - RNA, 24 nt, Artificial Sequence
  Synthetic Oligonucleotide; CTLA4 exon 2; Set B
agaagacugcaaugcaacaggugu

SEQ ID NO: 1020 - RNA, 22 nt, Artificial Sequence
  Synthetic Oligonucleotide; CTLA4 exon 2; Set C
gaagacugcaaugcaacaggug

SEQ ID NO: 1021 - RNA, 23 nt, Artificial Sequence
  Synthetic Oligonucleotide; CTLA4 exon 2; Set C
agaagacugcaaugcaacaggug

SEQ ID NO: 1022 - RNA, 15 nt, Artificial Sequence
  Synthetic Oligonucleotide; CTLA4 exon 2; Set C
agaagacugcaaugc

SEQ ID NO: 1023 - RNA, 20 nt, Artificial Sequence
  Synthetic Oligonucleotide; CTLA4 exon 2; Set C
gugaacucaugcuccuucau

SEQ ID NO: 1024 - RNA, 19 nt, Artificial Sequence
  Synthetic Oligonucleotide; CTLA4 exon 2; Set C
gugaacucaugcuccuuca

SEQ ID NO: 1025 - RNA, 18 nt, Artificial Sequence
  Synthetic Oligonucleotide; CTLA4 exon 2; Set C
gugaacucaugcuccuuc

SEQ ID NO: 1026 - RNA, 32 nt, Artificial Sequence
  Synthetic Oligonucleotide; CTLA4 exon 2; Set A
aagggaacucagugaacucaugcuccuucaug

SEQ ID NO: 1027 - RNA, 39 nt, Artificial Sequence
  Synthetic Oligonucleotide; CTLA4 exon 2; Set C
aaagccaaagggaacucagugaacucaugcuccuucaug

SEQ ID NO: 1028 - RNA, 38 nt, Artificial Sequence
  Synthetic Oligonucleotide; CTLA4 exon 2; Set C
aaagccaaagggaacucagugaacucaugcuccuucau

SEQ ID NO: 1029 - RNA, 40 nt, Artificial Sequence
  Synthetic Oligonucleotide; CTLA4 exon 2; Set C
aaaagccaaagggaacucagugaacucaugcuccuucaug

SEQ ID NO: 1030 - RNA, 37 nt, Artificial Sequence
  Synthetic Oligonucleotide; CTLA4 exon 2; Set C
aaagccaaagggaacucagugaacucaugcuccuuca

SEQ ID NO: 1031 - RNA, 36 nt, Artificial Sequence
  Synthetic Oligonucleotide; CTLA4 exon 2; Set C
aaagccaaagggaacucagugaacucaugcuccuuc

SEQ ID NO: 1032 - RNA, 40 nt, Artificial Sequence
  Synthetic Oligonucleotide; CTLA4 exon 2; Set C
gaaaagccaaagggaacucagugaacucaugcuccuucau

SEQ ID NO: 1033 - RNA, 37 nt, Artificial Sequence
  Synthetic Oligonucleotide; CTLA4 exon 2; Set C
aaaagccaaagggaacucagugaacucaugcuccuuc

SEQ ID NO: 1034 - RNA, 39 nt, Artificial Sequence
  Synthetic Oligonucleotide; CTLA4 exon 2; Set C
gaaaagccaaagggaacucagugaacucaugcuccuuca

SEQ ID NO: 1035 - RNA, 21 nt, Artificial Sequence
  Synthetic Oligonucleotide; CTLA4 exon 2; Set C
aagggaacucagugaacucau

SEQ ID NO: 1036 - RNA, 38 nt, Artificial Sequence
  Synthetic Oligonucleotide; CTLA4 exon 2; Set C
gaaaagccaaagggaacucagugaacucaugcuccuuc

SEQ ID NO: 1037 - RNA, 40 nt, Artificial Sequence
  Synthetic Oligonucleotide; CTLA4 exon 2; Set C
ggaaaagccaaagggaacucagugaacucaugcuccuuca

SEQ ID NO: 1038 - RNA, 39 nt, Artificial Sequence
  Synthetic Oligonucleotide; CTLA4 exon 2; Set C
ggaaaagccaaagggaacucagugaacucaugcuccuuc

SEQ ID NO: 1039 - RNA, 40 nt, Artificial Sequence
  Synthetic Oligonucleotide; CTLA4 exon 2; Set C
uggaaaagccaaagggaacucagugaacucaugcuccuuc

SEQ ID NO: 1040 - RNA, 16 nt, Artificial Sequence
  Synthetic Oligonucleotide; CTLA4 exon 2; Set C
aagggaacucagugaa

SEQ ID NO: 1041 - RNA, 15 nt, Artificial Sequence
  Synthetic Oligonucleotide; CTLA4 exon 2; Set C
aagggaacucaguga

SEQ ID NO: 1042 - RNA, 29 nt, Artificial Sequence
  Synthetic Oligonucleotide; CTLA4 exon 2; Set A
aaaagccaaagggaacucagugaacucau

SEQ ID NO: 1043 - RNA, 23 nt, Artificial Sequence
  Synthetic Oligonucleotide; CTLA4 exon 2; Set C
aaagccaaagggaacucagugaa

SEQ ID NO: 1044 - RNA, 22 nt, Artificial Sequence
  Synthetic Oligonucleotide; CTLA4 exon 2; Set C
aaagccaaagggaacucaguga

SEQ ID NO: 1045 - RNA, 24 nt, Artificial Sequence
  Synthetic Oligonucleotide; CTLA4 exon 2; Set C
aaaagccaaagggaacucagugaa

SEQ ID NO: 1046 - RNA, 23 nt, Artificial Sequence
  Synthetic Oligonucleotide; CTLA4 exon 2; Set C
aaaagccaaagggaacucaguga

SEQ ID NO: 1047 - RNA, 25 nt, Artificial Sequence
  Synthetic Oligonucleotide; CTLA4 exon 2; Set C
gaaaagccaaagggaacucagugaa

SEQ ID NO: 1048 - RNA, 24 nt, Artificial Sequence
  Synthetic Oligonucleotide; CTLA4 exon 2; Set C
gaaaagccaaagggaacucaguga

SEQ ID NO: 1049 - RNA, 26 nt, Artificial Sequence
  Synthetic Oligonucleotide; CTLA4 exon 2; Set C
ggaaaagccaaagggaacucagugaa

SEQ ID NO: 1050 - RNA, 25 nt, Artificial Sequence
  Synthetic Oligonucleotide; CTLA4 exon 2; Set A
ggaaaagccaaagggaacucaguga

SEQ ID NO: 1051 - RNA, 27 nt, Artificial Sequence
  Synthetic Oligonucleotide; CTLA4 exon 2; Set A
uggaaaagccaaagggaacucagugaa

SEQ ID NO: 1052 - RNA, 26 nt, Artificial Sequence
  Synthetic Oligonucleotide; CTLA4 exon 2; Set A
uggaaaagccaaagggaacucaguga

SEQ ID NO: 1053 - RNA, 28 nt, Artificial Sequence
  Synthetic Oligonucleotide; CTLA4 exon 2; Set A
auggaaaagccaaagggaacucagugaa

SEQ ID NO: 1054 - RNA, 27 nt, Artificial Sequence
  Synthetic Oligonucleotide; CTLA4 exon 2; Set A
auggaaaagccaaagggaacucaguga

SEQ ID NO: 1055 - RNA, 29 nt, Artificial Sequence
  Synthetic Oligonucleotide; CTLA4 exon 2; Set A
cauggaaaagccaaagggaacucagugaa

SEQ ID NO: 1056 - RNA, 28 nt, Artificial Sequence
  Synthetic Oligonucleotide; CTLA4 exon 2; Set A
cauggaaaagccaaagggaacucaguga

SEQ ID NO: 1057 - RNA, 36 nt, Artificial Sequence
  Synthetic Oligonucleotide; CTLA4 exon 2; Set C
uugcuagcauggaaaagccaaagggaacucagugaa

SEQ ID NO: 1058 - RNA, 35 nt, Artificial Sequence
  Synthetic Oligonucleotide; CTLA4 exon 2; Set C
uugcuagcauggaaaagccaaagggaacucaguga

SEQ ID NO: 1059 - RNA, 37 nt, Artificial Sequence
  Synthetic Oligonucleotide; CTLA4 exon 2; Set C
auugcuagcauggaaaagccaaagggaacucagugaa

SEQ ID NO: 1060 - RNA, 36 nt, Artificial Sequence
  Synthetic Oligonucleotide; CTLA4 exon 2; Set C
auugcuagcauggaaaagccaaagggaacucaguga

SEQ ID NO: 1061 - RNA, 38 nt, Artificial Sequence
  Synthetic Oligonucleotide; CTLA4 exon 2; Set C
cauugcuagcauggaaaagccaaagggaacucagugaa

SEQ ID NO: 1062 - RNA, 37 nt, Artificial Sequence
  Synthetic Oligonucleotide; CTLA4 exon 2; Set C
cauugcuagcauggaaaagccaaagggaacucaguga

SEQ ID NO: 1063 - RNA, 39 nt, Artificial Sequence
  Synthetic Oligonucleotide; CTLA4 exon 2; Set C
gcauugcuagcauggaaaagccaaagggaacucagugaa

SEQ ID NO: 1064 - RNA, 38 nt, Artificial Sequence
  Synthetic Oligonucleotide; CTLA4 exon 2; Set C
gcauugcuagcauggaaaagccaaagggaacucaguga

SEQ ID NO: 1065 - RNA, 40 nt, Artificial Sequence
  Synthetic Oligonucleotide; CTLA4 exon 2; Set C
ugcauugcuagcauggaaaagccaaagggaacucagugaa

SEQ ID NO: 1066 - RNA, 15 nt, Artificial Sequence
  Synthetic Oligonucleotide; CTLA4 exon 2; Set C
auggaaaagccaaag

SEQ ID NO: 1067 - RNA, 39 nt, Artificial Sequence
  Synthetic Oligonucleotide; CTLA4 exon 2; Set C
ugcauugcuagcauggaaaagccaaagggaacucaguga

SEQ ID NO: 1068 - RNA, 16 nt, Artificial Sequence
  Synthetic Oligonucleotide; CTLA4 exon 2; Set C
cauggaaaagccaaag

SEQ ID NO: 1069 - RNA, 23 nt, Artificial Sequence
  Synthetic Oligonucleotide; CTLA4 exon 2; Set C
uugcuagcauggaaaagccaaag

SEQ ID NO: 1070 - RNA, 26 nt, Artificial Sequence
  Synthetic Oligonucleotide; CTLA4 exon 2; Set A
gcauugcuagcauggaaaagccaaag

SEQ ID NO: 1071 - RNA, 27 nt, Artificial Sequence
  Synthetic Oligonucleotide; CTLA4 exon 2; Set A
ugcauugcuagcauggaaaagccaaag

SEQ ID NO: 1072 - RNA, 15 nt, Artificial Sequence
  Synthetic Oligonucleotide; CTLA4 exon 2; Set C
ugcauugcuagcaug

SEQ ID NO: 1073 - RNA, 23 nt, Artificial Sequence
  Synthetic Oligonucleotide; CTLA4 exon 2; Set A
guggcuuugccuggagaugcaua

SEQ ID NO: 1074 - RNA, 22 nt, Artificial Sequence
  Synthetic Oligonucleotide; CTLA4 exon 2; Set A
guggcuuugccuggagaugcau

SEQ ID NO: 1075 - RNA, 21 nt, Artificial Sequence
  Synthetic Oligonucleotide; CTLA4 exon 2; Set A
guggcuuugccuggagaugca

SEQ ID NO: 1076 - RNA, 20 nt, Artificial Sequence
  Synthetic Oligonucleotide; CTLA4 exon 2; Set A
guggcuuugccuggagaugc

SEQ ID NO: 1077 - RNA, 19 nt, Artificial Sequence
  Synthetic Oligonucleotide; CTLA4 exon 2; Set A
guggcuuugccuggagaug

SEQ ID NO: 1078 - RNA, 15 nt, Artificial Sequence
  Synthetic Oligonucleotide; CTLA4 exon 2; Set C
cagucaccuggcugu

SEQ ID NO: 1079 - RNA, 16 nt, Artificial Sequence
  Synthetic Oligonucleotide; CTLA4 exon 2; Set C
ucagucaccuggcugu

SEQ ID NO: 1080 - RNA, 15 nt, Artificial Sequence
  Synthetic Oligonucleotide; CTLA4 exon 2; Set C
ucagucaccuggcug

SEQ ID NO: 1081 - RNA, 16 nt, Artificial Sequence
  Synthetic Oligonucleotide; CTLA4 exon 2; Set C
uucagucaccuggcug

SEQ ID NO: 1082 - RNA, 15 nt, Artificial Sequence
  Synthetic Oligonucleotide; CTLA4 exon 2; Set C
uucagucaccuggcu

SEQ ID NO: 1083 - RNA, 30 nt, Artificial Sequence
  Synthetic Oligonucleotide; CTLA4 exon 2; Set C
uugccgcacagacuucagucaccuggcugu

SEQ ID NO: 1084 - RNA, 31 nt, Artificial Sequence
  Synthetic Oligonucleotide; CTLA4 exon 2; Set C
guugccgcacagacuucagucaccuggcugu

SEQ ID NO: 1085 - RNA, 29 nt, Artificial Sequence
  Synthetic Oligonucleotide; CTLA4 exon 2; Set C
uugccgcacagacuucagucaccuggcug

SEQ ID NO: 1086 - RNA, 32 nt, Artificial Sequence
  Synthetic Oligonucleotide; CTLA4 exon 2; Set C
gguugccgcacagacuucagucaccuggcugu

SEQ ID NO: 1087 - RNA, 30 nt, Artificial Sequence
  Synthetic Oligonucleotide; CTLA4 exon 2; Set C
guugccgcacagacuucagucaccuggcug

SEQ ID NO: 1088 - RNA, 33 nt, Artificial Sequence
  Synthetic Oligonucleotide; CTLA4 exon 2; Set C
agguugccgcacagacuucagucaccuggcugu

SEQ ID NO: 1089 - RNA, 31 nt, Artificial Sequence
  Synthetic Oligonucleotide; CTLA4 exon 2; Set C
gguugccgcacagacuucagucaccuggcug

SEQ ID NO: 1090 - RNA, 29 nt, Artificial Sequence
  Synthetic Oligonucleotide; CTLA4 exon 2; Set C
guugccgcacagacuucagucaccuggcu

SEQ ID NO: 1091 - RNA, 34 nt, Artificial Sequence
  Synthetic Oligonucleotide; CTLA4 exon 2; Set C
uagguugccgcacagacuucagucaccuggcugu

SEQ ID NO: 1092 - RNA, 32 nt, Artificial Sequence
  Synthetic Oligonucleotide; CTLA4 exon 2; Set C
agguugccgcacagacuucagucaccuggcug

SEQ ID NO: 1093 - RNA, 30 nt, Artificial Sequence
  Synthetic Oligonucleotide; CTLA4 exon 2; Set C
gguugccgcacagacuucagucaccuggcu

SEQ ID NO: 1094 - RNA, 33 nt, Artificial Sequence
  Synthetic Oligonucleotide; CTLA4 exon 2; Set C
uagguugccgcacagacuucagucaccuggcug

SEQ ID NO: 1095 - RNA, 31 nt, Artificial Sequence
  Synthetic Oligonucleotide; CTLA4 exon 2; Set C
agguugccgcacagacuucagucaccuggcu

SEQ ID NO: 1096 - RNA, 32 nt, Artificial Sequence
  Synthetic Oligonucleotide; CTLA4 exon 2; Set C
uagguugccgcacagacuucagucaccuggcu

SEQ ID NO: 1097 - RNA, 22 nt, Artificial Sequence
  Synthetic Oligonucleotide; CTLA4 exon 2; Set A
uugccgcacagacuucagucac

SEQ ID NO: 1098 - RNA, 21 nt, Artificial Sequence
  Synthetic Oligonucleotide; CTLA4 exon 2; Set A
uugccgcacagacuucaguca

SEQ ID NO: 1099 - RNA, 23 nt, Artificial Sequence
  Synthetic Oligonucleotide; CTLA4 exon 2; Set C
guugccgcacagacuucagucac

SEQ ID NO: 1100 - RNA, 22 nt, Artificial Sequence
  Synthetic Oligonucleotide; CTLA4 exon 2; Set A
guugccgcacagacuucaguca

SEQ ID NO: 1101 - RNA, 24 nt, Artificial Sequence
  Synthetic Oligonucleotide; CTLA4 exon 2; Set C
gguugccgcacagacuucagucac

SEQ ID NO: 1102 - RNA, 23 nt, Artificial Sequence
  Synthetic Oligonucleotide; CTLA4 exon 2; Set C
gguugccgcacagacuucaguca

SEQ ID NO: 1103 - RNA, 25 nt, Artificial Sequence
  Synthetic Oligonucleotide; CTLA4 exon 2; Set C
agguugccgcacagacuucagucac

SEQ ID NO: 1104 - RNA, 21 nt, Artificial Sequence
  Synthetic Oligonucleotide; CTLA4 exon 2; Set A
guugccgcacagacuucaguc

SEQ ID NO: 1105 - RNA, 27 nt, Artificial Sequence
  Synthetic Oligonucleotide; CTLA4 exon 2; Set C
uagguugccgcacagacuucagucacc

SEQ ID NO: 1106 - RNA, 20 nt, Artificial Sequence
  Synthetic Oligonucleotide; CTLA4 exon 2; Set A
guugccgcacagacuucagu

SEQ ID NO: 1107 - RNA, 24 nt, Artificial Sequence
  Synthetic Oligonucleotide; CTLA4 exon 2; Set C
agguugccgcacagacuucaguca

SEQ ID NO: 1108 - RNA, 26 nt, Artificial Sequence
  Synthetic Oligonucleotide; CTLA4 exon 2; Set C
uagguugccgcacagacuucagucac

SEQ ID NO: 1109 - RNA, 22 nt, Artificial Sequence
  Synthetic Oligonucleotide; CTLA4 exon 2; Set A
gguugccgcacagacuucaguc

SEQ ID NO: 1110 - RNA, 25 nt, Artificial Sequence
  Synthetic Oligonucleotide; CTLA4 exon 2; Set C
uagguugccgcacagacuucaguca

SEQ ID NO: 1111 - RNA, 21 nt, Artificial Sequence
  Synthetic Oligonucleotide; CTLA4 exon 2; Set A
gguugccgcacagacuucagu

SEQ ID NO: 1112 - RNA, 23 nt, Artificial Sequence
  Synthetic Oligonucleotide; CTLA4 exon 2; Set A
agguugccgcacagacuucaguc

SEQ ID NO: 1113 - RNA, 22 nt, Artificial Sequence
  Synthetic Oligonucleotide; CTLA4 exon 2; Set A
agguugccgcacagacuucagu

SEQ ID NO: 1114 - RNA, 24 nt, Artificial Sequence
  Synthetic Oligonucleotide; CTLA4 exon 2; Set C
uagguugccgcacagacuucaguc

SEQ ID NO: 1115 - RNA, 23 nt, Artificial Sequence
  Synthetic Oligonucleotide; CTLA4 exon 2; Set A
uagguugccgcacagacuucagu

SEQ ID NO: 1116 - RNA, 38 nt, Artificial Sequence
  Synthetic Oligonucleotide; CTLA4 exon 2; Set C
uuccccaucauguagguugccgcacagacuucagucac

SEQ ID NO: 1117 - RNA, 40 nt, Artificial Sequence
  Synthetic Oligonucleotide; CTLA4 exon 2; Set C
auuccccaucauguagguugccgcacagacuucagucacc

SEQ ID NO: 1118 - RNA, 37 nt, Artificial Sequence
  Synthetic Oligonucleotide; CTLA4 exon 2; Set C
uuccccaucauguagguugccgcacagacuucaguca

SEQ ID NO: 1119 - RNA, 39 nt, Artificial Sequence
  Synthetic Oligonucleotide; CTLA4 exon 2; Set C
auuccccaucauguagguugccgcacagacuucagucac

SEQ ID NO: 1120 - RNA, 38 nt, Artificial Sequence
  Synthetic Oligonucleotide; CTLA4 exon 2; Set C
auuccccaucauguagguugccgcacagacuucaguca

SEQ ID NO: 1121 - RNA, 40 nt, Artificial Sequence
  Synthetic Oligonucleotide; CTLA4 exon 2; Set C
cauuccccaucauguagguugccgcacagacuucagucac

SEQ ID NO: 1122 - RNA, 36 nt, Artificial Sequence
  Synthetic Oligonucleotide; CTLA4 exon 2; Set C
uuccccaucauguagguugccgcacagacuucaguc

SEQ ID NO: 1123 - RNA, 39 nt, Artificial Sequence
  Synthetic Oligonucleotide; CTLA4 exon 2; Set C
cauuccccaucauguagguugccgcacagacuucaguca

SEQ ID NO: 1124 - RNA, 35 nt, Artificial Sequence
  Synthetic Oligonucleotide; CTLA4 exon 2; Set C
uuccccaucauguagguugccgcacagacuucagu

SEQ ID NO: 1125 - RNA, 37 nt, Artificial Sequence
  Synthetic Oligonucleotide; CTLA4 exon 2; Set C
auuccccaucauguagguugccgcacagacuucaguc

SEQ ID NO: 1126 - RNA, 36 nt, Artificial Sequence
  Synthetic Oligonucleotide; CTLA4 exon 2; Set C
auuccccaucauguagguugccgcacagacuucagu

SEQ ID NO: 1127 - RNA, 40 nt, Artificial Sequence
  Synthetic Oligonucleotide; CTLA4 exon 2; Set C
ucauuccccaucauguagguugccgcacagacuucaguca

SEQ ID NO: 1128 - RNA, 38 nt, Artificial Sequence
  Synthetic Oligonucleotide; CTLA4 exon 2; Set C
cauuccccaucauguagguugccgcacagacuucaguc

SEQ ID NO: 1129 - RNA, 37 nt, Artificial Sequence
  Synthetic Oligonucleotide; CTLA4 exon 2; Set C
cauuccccaucauguagguugccgcacagacuucagu

SEQ ID NO: 1130 - RNA, 39 nt, Artificial Sequence
  Synthetic Oligonucleotide; CTLA4 exon 2; Set C
ucauuccccaucauguagguugccgcacagacuucaguc

SEQ ID NO: 1131 - RNA, 38 nt, Artificial Sequence
  Synthetic Oligonucleotide; CTLA4 exon 2; Set C
ucauuccccaucauguagguugccgcacagacuucagu

SEQ ID NO: 1132 - RNA, 40 nt, Artificial Sequence
  Synthetic Oligonucleotide; CTLA4 exon 2; Set C
cucauuccccaucauguagguugccgcacagacuucaguc

SEQ ID NO: 1133 - RNA, 39 nt, Artificial Sequence
  Synthetic Oligonucleotide; CTLA4 exon 2; Set C
cucauuccccaucauguagguugccgcacagacuucagu

SEQ ID NO: 1134 - RNA, 37 nt, Artificial Sequence
  Synthetic Oligonucleotide; CTLA4 exon 2; Set C
ucauuccccaucauguagguugccgcacagacuucag

SEQ ID NO: 1135 - RNA, 40 nt, Artificial Sequence
  Synthetic Oligonucleotide; CTLA4 exon 2; Set C
acucauuccccaucauguagguugccgcacagacuucagu

SEQ ID NO: 1136 - RNA, 38 nt, Artificial Sequence
  Synthetic Oligonucleotide; CTLA4 exon 2; Set C
cucauuccccaucauguagguugccgcacagacuucag

SEQ ID NO: 1137 - RNA, 37 nt, Artificial Sequence
  Synthetic Oligonucleotide; CTLA4 exon 2; Set C
cucauuccccaucauguagguugccgcacagacuuca

SEQ ID NO: 1138 - RNA, 39 nt, Artificial Sequence
  Synthetic Oligonucleotide; CTLA4 exon 2; Set C
acucauuccccaucauguagguugccgcacagacuucag

SEQ ID NO: 1139 - RNA, 38 nt, Artificial Sequence
  Synthetic Oligonucleotide; CTLA4 exon 2; Set C
acucauuccccaucauguagguugccgcacagacuuca

SEQ ID NO: 1140 - RNA, 40 nt, Artificial Sequence
  Synthetic Oligonucleotide; CTLA4 exon 2; Set C
aacucauuccccaucauguagguugccgcacagacuucag

SEQ ID NO: 1141 - RNA, 37 nt, Artificial Sequence
  Synthetic Oligonucleotide; CTLA4 exon 2; Set C
acucauuccccaucauguagguugccgcacagacuuc

SEQ ID NO: 1142 - RNA, 39 nt, Artificial Sequence
  Synthetic Oligonucleotide; CTLA4 exon 2; Set C
aacucauuccccaucauguagguugccgcacagacuuca

SEQ ID NO: 1143 - RNA, 38 nt, Artificial Sequence
  Synthetic Oligonucleotide; CTLA4 exon 2; Set C
aacucauuccccaucauguagguugccgcacagacuuc

SEQ ID NO: 1144 - RNA, 40 nt, Artificial Sequence
  Synthetic Oligonucleotide; CTLA4 exon 2; Set C
caacucauuccccaucauguagguugccgcacagacuuca

SEQ ID NO: 1145 - RNA, 39 nt, Artificial Sequence
  Synthetic Oligonucleotide; CTLA4 exon 2; Set C
caacucauuccccaucauguagguugccgcacagacuuc

SEQ ID NO: 1146 - RNA, 40 nt, Artificial Sequence
  Synthetic Oligonucleotide; CTLA4 exon 2; Set C
ucaacucauuccccaucauguagguugccgcacagacuuc

SEQ ID NO: 1147 - RNA, 19 nt, Artificial Sequence
  Synthetic Oligonucleotide; CTLA4 exon 2; Set C
uuccccaucauguagguug

SEQ ID NO: 1148 - RNA, 18 nt, Artificial Sequence
  Synthetic Oligonucleotide; CTLA4 exon 2; Set C
uuccccaucauguagguu

SEQ ID NO: 1149 - RNA, 17 nt, Artificial Sequence
  Synthetic Oligonucleotide; CTLA4 exon 2; Set C
uuccccaucauguaggu

SEQ ID NO: 1150 - RNA, 16 nt, Artificial Sequence
  Synthetic Oligonucleotide; CTLA4 exon 2; Set C
uuccccaucauguagg

SEQ ID NO: 1151 - RNA, 15 nt, Artificial Sequence
  Synthetic Oligonucleotide; CTLA4 exon 2; Set C
uuccccaucauguag

SEQ ID NO: 1152 - RNA, 16 nt, Artificial Sequence
  Synthetic Oligonucleotide; CTLA4 exon 2; Set C
cauuccccaucaugua

SEQ ID NO: 1153 - RNA, 17 nt, Artificial Sequence
  Synthetic Oligonucleotide; CTLA4 exon 2; Set C
ucauuccccaucaugua

SEQ ID NO: 1154 - RNA, 18 nt, Artificial Sequence
  Synthetic Oligonucleotide; CTLA4 exon 2; Set C
cucauuccccaucaugua

SEQ ID NO: 1155 - RNA, 19 nt, Artificial Sequence
  Synthetic Oligonucleotide; CTLA4 exon 2; Set C
acucauuccccaucaugua

SEQ ID NO: 1156 - RNA, 20 nt, Artificial Sequence
  Synthetic Oligonucleotide; CTLA4 exon 2; Set C
aacucauuccccaucaugua

SEQ ID NO: 1157 - RNA, 21 nt, Artificial Sequence
  Synthetic Oligonucleotide; CTLA4 exon 2; Set C
caacucauuccccaucaugua

SEQ ID NO: 1158 - RNA, 19 nt, Artificial Sequence
  Synthetic Oligonucleotide; CTLA4 exon 2; Set C
aacucauuccccaucaugu

SEQ ID NO: 1159 - RNA, 22 nt, Artificial Sequence
  Synthetic Oligonucleotide; CTLA4 exon 2; Set C
ucaacucauuccccaucaugua

SEQ ID NO: 1160 - RNA, 16 nt, Artificial Sequence
  Synthetic Oligonucleotide; CTLA4 exon 2; Set C
acucauuccccaucau

SEQ ID NO: 1161 - RNA, 20 nt, Artificial Sequence
  Synthetic Oligonucleotide; CTLA4 exon 2; Set C
caacucauuccccaucaugu

SEQ ID NO: 1162 - RNA, 15 nt, Artificial Sequence
  Synthetic Oligonucleotide; CTLA4 exon 2; Set C
acucauuccccauca

SEQ ID NO: 1163 - RNA, 23 nt, Artificial Sequence
  Synthetic Oligonucleotide; CTLA4 exon 2; Set A
gucaacucauuccccaucaugua

SEQ ID NO: 1164 - RNA, 17 nt, Artificial Sequence
  Synthetic Oligonucleotide; CTLA4 exon 2; Set C
aacucauuccccaucau

SEQ ID NO: 1165 - RNA, 19 nt, Artificial Sequence
  Synthetic Oligonucleotide; CTLA4 exon 2; Set C
caacucauuccccaucaug

SEQ ID NO: 1166 - RNA, 21 nt, Artificial Sequence
  Synthetic Oligonucleotide; CTLA4 exon 2; Set C
ucaacucauuccccaucaugu

SEQ ID NO: 1167 - RNA, 16 nt, Artificial Sequence
  Synthetic Oligonucleotide; CTLA4 exon 2; Set C
aacucauuccccauca

SEQ ID NO: 1168 - RNA, 24 nt, Artificial Sequence
  Synthetic Oligonucleotide; CTLA4 exon 2; Set A
ggucaacucauuccccaucaugua

SEQ ID NO: 1169 - RNA, 18 nt, Artificial Sequence
  Synthetic Oligonucleotide; CTLA4 exon 2; Set C
caacucauuccccaucau

SEQ ID NO: 1170 - RNA, 20 nt, Artificial Sequence
  Synthetic Oligonucleotide; CTLA4 exon 2; Set C
ucaacucauuccccaucaug

SEQ ID NO: 1171 - RNA, 22 nt, Artificial Sequence
  Synthetic Oligonucleotide; CTLA4 exon 2; Set A
gucaacucauuccccaucaugu

SEQ ID NO: 1172 - RNA, 17 nt, Artificial Sequence
  Synthetic Oligonucleotide; CTLA4 exon 2; Set C
caacucauuccccauca

SEQ ID NO: 1173 - RNA, 25 nt, Artificial Sequence
  Synthetic Oligonucleotide; CTLA4 exon 2; Set A
aggucaacucauuccccaucaugua

SEQ ID NO: 1174 - RNA, 19 nt, Artificial Sequence
  Synthetic Oligonucleotide; CTLA4 exon 2; Set C
ucaacucauuccccaucau

SEQ ID NO: 1175 - RNA, 23 nt, Artificial Sequence
  Synthetic Oligonucleotide; CTLA4 exon 2; Set A
ggucaacucauuccccaucaugu

SEQ ID NO: 1176 - RNA, 18 nt, Artificial Sequence
  Synthetic Oligonucleotide; CTLA4 exon 2; Set C
ucaacucauuccccauca

SEQ ID NO: 1177 - RNA, 26 nt, Artificial Sequence
  Synthetic Oligonucleotide; CTLA4 exon 2; Set A
aaggucaacucauuccccaucaugua

SEQ ID NO: 1178 - RNA, 20 nt, Artificial Sequence
  Synthetic Oligonucleotide; CTLA4 exon 2; Set C
gucaacucauuccccaucau

SEQ ID NO: 1179 - RNA, 22 nt, Artificial Sequence
  Synthetic Oligonucleotide; CTLA4 exon 2; Set A
ggucaacucauuccccaucaug

SEQ ID NO: 1180 - RNA, 24 nt, Artificial Sequence
  Synthetic Oligonucleotide; CTLA4 exon 2; Set A
aggucaacucauuccccaucaugu

SEQ ID NO: 1181 - RNA, 19 nt, Artificial Sequence
  Synthetic Oligonucleotide; CTLA4 exon 2; Set C
gucaacucauuccccauca

SEQ ID NO: 1182 - RNA, 21 nt, Artificial Sequence
  Synthetic Oligonucleotide; CTLA4 exon 2; Set A
ggucaacucauuccccaucau

SEQ ID NO: 1183 - RNA, 23 nt, Artificial Sequence
  Synthetic Oligonucleotide; CTLA4 exon 2; Set A
aggucaacucauuccccaucaug

SEQ ID NO: 1184 - RNA, 20 nt, Artificial Sequence
  Synthetic Oligonucleotide; CTLA4 exon 2; Set A
ggucaacucauuccccauca

SEQ ID NO: 1185 - RNA, 22 nt, Artificial Sequence
  Synthetic Oligonucleotide; CTLA4 exon 2; Set A
aggucaacucauuccccaucau

SEQ ID NO: 1186 - RNA, 21 nt, Artificial Sequence
  Synthetic Oligonucleotide; CTLA4 exon 2; Set A
aggucaacucauuccccauca

SEQ ID NO: 1187 - RNA, 23 nt, Artificial Sequence
  Synthetic Oligonucleotide; CTLA4 exon 2; Set A
aaggucaacucauuccccaucau

SEQ ID NO: 1188 - RNA, 22 nt, Artificial Sequence
  Synthetic Oligonucleotide; CTLA4 exon 2; Set A
aaggucaacucauuccccauca

SEQ ID NO: 1189 - RNA, 40 nt, Artificial Sequence
  Synthetic Oligonucleotide; CTLA4 exon 2; Set C
aaucaucuaggaaggucaacucauuccccaucauguaggu

SEQ ID NO: 1190 - RNA, 39 nt, Artificial Sequence
  Synthetic Oligonucleotide; CTLA4 exon 2; Set C
aaucaucuaggaaggucaacucauuccccaucauguagg

SEQ ID NO: 1191 - RNA, 38 nt, Artificial Sequence
  Synthetic Oligonucleotide; CTLA4 exon 2; Set C
aaucaucuaggaaggucaacucauuccccaucauguag

SEQ ID NO: 1192 - RNA, 40 nt, Artificial Sequence
  Synthetic Oligonucleotide; CTLA4 exon 2; Set C
gaaucaucuaggaaggucaacucauuccccaucauguagg

SEQ ID NO: 1193 - RNA, 40 nt, Artificial Sequence
  Synthetic Oligonucleotide; CTLA4 exon 2; Set C
ggaaucaucuaggaaggucaacucauuccccaucauguag

SEQ ID NO: 1194 - RNA, 16 nt, Artificial Sequence
  Synthetic Oligonucleotide; CTLA4 exon 2; Set C
gaaggucaacucauuc

SEQ ID NO: 1195 - RNA, 15 nt, Artificial Sequence
  Synthetic Oligonucleotide; CTLA4 exon 2; Set C
gaaggucaacucauu

SEQ ID NO: 1196 - RNA, 17 nt, Artificial Sequence
  Synthetic Oligonucleotide; CTLA4 exon 2; Set C
ggaaggucaacucauuc

SEQ ID NO: 1197 - RNA, 16 nt, Artificial Sequence
  Synthetic Oligonucleotide; CTLA4 exon 2; Set C
ggaaggucaacucauu

SEQ ID NO: 1198 - RNA, 15 nt, Artificial Sequence
  Synthetic Oligonucleotide; CTLA4 exon 2; Set C
ggaaggucaacucau

SEQ ID NO: 1199 - RNA, 26 nt, Artificial Sequence
  Synthetic Oligonucleotide; CTLA4 exon 2; Set C
aaucaucuaggaaggucaacucauuc

SEQ ID NO: 1200 - RNA, 27 nt, Artificial Sequence
  Synthetic Oligonucleotide; CTLA4 exon 2; Set C
gaaucaucuaggaaggucaacucauuc

SEQ ID NO: 1201 - RNA, 28 nt, Artificial Sequence
  Synthetic Oligonucleotide; CTLA4 exon 2; Set A
ggaaucaucuaggaaggucaacucauuc

SEQ ID NO: 1202 - RNA, 29 nt, Artificial Sequence
  Synthetic Oligonucleotide; CTLA4 exon 2; Set A
uggaaucaucuaggaaggucaacucauuc

SEQ ID NO: 1203 - RNA, 26 nt, Artificial Sequence
  Synthetic Oligonucleotide; CTLA4 exon 2; Set A
ggaaucaucuaggaaggucaacucau

SEQ ID NO: 1204 - RNA, 22 nt, Artificial Sequence
  Synthetic Oligonucleotide; CTLA4 exon 2; Set C
aaucaucuaggaaggucaacuc

SEQ ID NO: 1205 - RNA, 30 nt, Artificial Sequence
  Synthetic Oligonucleotide; CTLA4 exon 2; Set A
auggaaucaucuaggaaggucaacucauuc

SEQ ID NO: 1206 - RNA, 27 nt, Artificial Sequence
  Synthetic Oligonucleotide; CTLA4 exon 2; Set A
uggaaucaucuaggaaggucaacucau

SEQ ID NO: 1207 - RNA, 25 nt, Artificial Sequence
  Synthetic Oligonucleotide; CTLA4 exon 2; Set A
ggaaucaucuaggaaggucaacuca

SEQ ID NO: 1208 - RNA, 21 nt, Artificial Sequence
  Synthetic Oligonucleotide; CTLA4 exon 2; Set C
aaucaucuaggaaggucaacu

SEQ ID NO: 1209 - RNA, 28 nt, Artificial Sequence
  Synthetic Oligonucleotide; CTLA4 exon 2; Set A
auggaaucaucuaggaaggucaacucau

SEQ ID NO: 1210 - RNA, 26 nt, Artificial Sequence
  Synthetic Oligonucleotide; CTLA4 exon 2; Set A
uggaaucaucuaggaaggucaacuca

SEQ ID NO: 1211 - RNA, 22 nt, Artificial Sequence
  Synthetic Oligonucleotide; CTLA4 exon 2; Set C
gaaucaucuaggaaggucaacu

SEQ ID NO: 1212 - RNA, 24 nt, Artificial Sequence
  Synthetic Oligonucleotide; CTLA4 exon 2; Set C
ggaaucaucuaggaaggucaacuc

SEQ ID NO: 1213 - RNA, 20 nt, Artificial Sequence
  Synthetic Oligonucleotide; CTLA4 exon 2; Set C
aaucaucuaggaaggucaac

SEQ ID NO: 1214 - RNA, 27 nt, Artificial Sequence
  Synthetic Oligonucleotide; CTLA4 exon 2; Set A
auggaaucaucuaggaaggucaacuca

SEQ ID NO: 1215 - RNA, 23 nt, Artificial Sequence
  Synthetic Oligonucleotide; CTLA4 exon 2; Set C
ggaaucaucuaggaaggucaacu

SEQ ID NO: 1216 - RNA, 25 nt, Artificial Sequence
  Synthetic Oligonucleotide; CTLA4 exon 2; Set C
uggaaucaucuaggaaggucaacuc

SEQ ID NO: 1217 - RNA, 21 nt, Artificial Sequence
  Synthetic Oligonucleotide; CTLA4 exon 2; Set C
gaaucaucuaggaaggucaac

SEQ ID NO: 1218 - RNA, 19 nt, Artificial Sequence
  Synthetic Oligonucleotide; CTLA4 exon 2; Set C
aaucaucuaggaaggucaa

SEQ ID NO: 1219 - RNA, 26 nt, Artificial Sequence
  Synthetic Oligonucleotide; CTLA4 exon 2; Set C
auggaaucaucuaggaaggucaacuc

SEQ ID NO: 1220 - RNA, 24 nt, Artificial Sequence
  Synthetic Oligonucleotide; CTLA4 exon 2; Set C
uggaaucaucuaggaaggucaacu

SEQ ID NO: 1221 - RNA, 20 nt, Artificial Sequence
  Synthetic Oligonucleotide; CTLA4 exon 2; Set C
gaaucaucuaggaaggucaa

SEQ ID NO: 1222 - RNA, 18 nt, Artificial Sequence
  Synthetic Oligonucleotide; CTLA4 exon 2; Set C
aaucaucuaggaagguca

SEQ ID NO: 1223 - RNA, 22 nt, Artificial Sequence
  Synthetic Oligonucleotide; CTLA4 exon 2; Set C
ggaaucaucuaggaaggucaac

SEQ ID NO: 1224 - RNA, 25 nt, Artificial Sequence
  Synthetic Oligonucleotide; CTLA4 exon 2; Set C
auggaaucaucuaggaaggucaacu

SEQ ID NO: 1225 - RNA, 19 nt, Artificial Sequence
  Synthetic Oligonucleotide; CTLA4 exon 2; Set C
gaaucaucuaggaagguca

SEQ ID NO: 1226 - RNA, 21 nt, Artificial Sequence
  Synthetic Oligonucleotide; CTLA4 exon 2; Set C
ggaaucaucuaggaaggucaa

SEQ ID NO: 1227 - RNA, 23 nt, Artificial Sequence
  Synthetic Oligonucleotide; CTLA4 exon 2; Set C
uggaaucaucuaggaaggucaac

SEQ ID NO: 1228 - RNA, 17 nt, Artificial Sequence
  Synthetic Oligonucleotide; CTLA4 exon 2; Set C
aaucaucuaggaagguc

SEQ ID NO: 1229 - RNA, 20 nt, Artificial Sequence
  Synthetic Oligonucleotide; CTLA4 exon 2; Set C
ggaaucaucuaggaagguca

SEQ ID NO: 1230 - RNA, 24 nt, Artificial Sequence
  Synthetic Oligonucleotide; CTLA4 exon 2; Set C
auggaaucaucuaggaaggucaac

SEQ ID NO: 1231 - RNA, 22 nt, Artificial Sequence
  Synthetic Oligonucleotide; CTLA4 exon 2; Set C
uggaaucaucuaggaaggucaa

SEQ ID NO: 1232 - RNA, 16 nt, Artificial Sequence
  Synthetic Oligonucleotide; CTLA4 exon 2; Set C
aaucaucuaggaaggu

SEQ ID NO: 1233 - RNA, 18 nt, Artificial Sequence
  Synthetic Oligonucleotide; CTLA4 exon 2; Set C
gaaucaucuaggaagguc

SEQ ID NO: 1234 - RNA, 23 nt, Artificial Sequence
  Synthetic Oligonucleotide; CTLA4 exon 2; Set C
auggaaucaucuaggaaggucaa

SEQ ID NO: 1235 - RNA, 21 nt, Artificial Sequence
  Synthetic Oligonucleotide; CTLA4 exon 2; Set C
uggaaucaucuaggaagguca

SEQ ID NO: 1236 - RNA, 15 nt, Artificial Sequence
  Synthetic Oligonucleotide; CTLA4 exon 2; Set C
aaucaucuaggaagg

SEQ ID NO: 1237 - RNA, 17 nt, Artificial Sequence
  Synthetic Oligonucleotide; CTLA4 exon 2; Set C
gaaucaucuaggaaggu

SEQ ID NO: 1238 - RNA, 19 nt, Artificial Sequence
  Synthetic Oligonucleotide; CTLA4 exon 2; Set C
ggaaucaucuaggaagguc

SEQ ID NO: 1239 - RNA, 22 nt, Artificial Sequence
  Synthetic Oligonucleotide; CTLA4 exon 2; Set C
auggaaucaucuaggaagguca

SEQ ID NO: 1240 - RNA, 16 nt, Artificial Sequence
  Synthetic Oligonucleotide; CTLA4 exon 2; Set C
gaaucaucuaggaagg

SEQ ID NO: 1241 - RNA, 18 nt, Artificial Sequence
  Synthetic Oligonucleotide; CTLA4 exon 2; Set C
ggaaucaucuaggaaggu

SEQ ID NO: 1242 - RNA, 20 nt, Artificial Sequence
  Synthetic Oligonucleotide; CTLA4 exon 2; Set C
uggaaucaucuaggaagguc

SEQ ID NO: 1243 - RNA, 17 nt, Artificial Sequence
  Synthetic Oligonucleotide; CTLA4 exon 2; Set C
ggaaucaucuaggaagg

SEQ ID NO: 1244 - RNA, 19 nt, Artificial Sequence
  Synthetic Oligonucleotide; CTLA4 exon 2; Set C
uggaaucaucuaggaaggu

SEQ ID NO: 1245 - RNA, 21 nt, Artificial Sequence
  Synthetic Oligonucleotide; CTLA4 exon 2; Set C
auggaaucaucuaggaagguc

SEQ ID NO: 1246 - RNA, 18 nt, Artificial Sequence
  Synthetic Oligonucleotide; CTLA4 exon 2; Set C
uggaaucaucuaggaagg

SEQ ID NO: 1247 - RNA, 20 nt, Artificial Sequence
  Synthetic Oligonucleotide; CTLA4 exon 2; Set C
auggaaucaucuaggaaggu

SEQ ID NO: 1248 - RNA, 19 nt, Artificial Sequence
  Synthetic Oligonucleotide; CTLA4 exon 2; Set C
auggaaucaucuaggaagg

SEQ ID NO: 1249 - RNA, 40 nt, Artificial Sequence
  Synthetic Oligonucleotide; CTLA4 exon 2; Set C
ggugcccgugcagauggaaucaucuaggaaggucaacuca

SEQ ID NO: 1250 - RNA, 39 nt, Artificial Sequence
  Synthetic Oligonucleotide; CTLA4 exon 2; Set C
ggugcccgugcagauggaaucaucuaggaaggucaacuc

SEQ ID NO: 1251 - RNA, 38 nt, Artificial Sequence
  Synthetic Oligonucleotide; CTLA4 exon 2; Set C
ggugcccgugcagauggaaucaucuaggaaggucaacu

SEQ ID NO: 1252 - RNA, 37 nt, Artificial Sequence
  Synthetic Oligonucleotide; CTLA4 exon 2; Set C
ggugcccgugcagauggaaucaucuaggaaggucaac

SEQ ID NO: 1253 - RNA, 36 nt, Artificial Sequence
  Synthetic Oligonucleotide; CTLA4 exon 2; Set C
ggugcccgugcagauggaaucaucuaggaaggucaa

SEQ ID NO: 1254 - RNA, 35 nt, Artificial Sequence
  Synthetic Oligonucleotide; CTLA4 exon 2; Set C
ggugcccgugcagauggaaucaucuaggaagguca

SEQ ID NO: 1255 - RNA, 34 nt, Artificial Sequence
  Synthetic Oligonucleotide; CTLA4 exon 2; Set C
ggugcccgugcagauggaaucaucuaggaagguc

SEQ ID NO: 1256 - RNA, 33 nt, Artificial Sequence
  Synthetic Oligonucleotide; CTLA4 exon 2; Set C
ggugcccgugcagauggaaucaucuaggaaggu

SEQ ID NO: 1257 - RNA, 32 nt, Artificial Sequence
  Synthetic Oligonucleotide; CTLA4 exon 2; Set C
ggugcccgugcagauggaaucaucuaggaagg

SEQ ID NO: 1258 - RNA, 20 nt, Artificial Sequence
  Synthetic Oligonucleotide; CTLA4 exon 2; Set A
ggugcccgugcagauggaau

SEQ ID NO: 1259 - RNA, 19 nt, Artificial Sequence
  Synthetic Oligonucleotide; CTLA4 exon 2; Set A
ggugcccgugcagauggaa

SEQ ID NO: 1260 - RNA, 18 nt, Artificial Sequence
  Synthetic Oligonucleotide; CTLA4 exon 2; Set A
ggugcccgugcagaugga

SEQ ID NO: 1261 - RNA, 17 nt, Artificial Sequence
  Synthetic Oligonucleotide; CTLA4 exon 2; Set A
ggugcccgugcagaugg

SEQ ID NO: 1262 - RNA, 31 nt, Artificial Sequence
  Synthetic Oligonucleotide; CTLA4 exon 2; Set C
uuuccacuggaggugcccgugcagauggaau

SEQ ID NO: 1263 - RNA, 30 nt, Artificial Sequence
  Synthetic Oligonucleotide; CTLA4 exon 2; Set C
uuuccacuggaggugcccgugcagauggaa

SEQ ID NO: 1264 - RNA, 32 nt, Artificial Sequence
  Synthetic Oligonucleotide; CTLA4 exon 2; Set C
auuuccacuggaggugcccgugcagauggaau

SEQ ID NO: 1265 - RNA, 31 nt, Artificial Sequence
  Synthetic Oligonucleotide; CTLA4 exon 2; Set C
auuuccacuggaggugcccgugcagauggaa

SEQ ID NO: 1266 - RNA, 29 nt, Artificial Sequence
  Synthetic Oligonucleotide; CTLA4 exon 2; Set C
uuuccacuggaggugcccgugcagaugga

SEQ ID NO: 1267 - RNA, 30 nt, Artificial Sequence
  Synthetic Oligonucleotide; CTLA4 exon 2; Set C
auuuccacuggaggugcccgugcagaugga

SEQ ID NO: 1268 - RNA, 28 nt, Artificial Sequence
  Synthetic Oligonucleotide; CTLA4 exon 2; Set C
uuuccacuggaggugcccgugcagaugg

SEQ ID NO: 1269 - RNA, 31 nt, Artificial Sequence
  Synthetic Oligonucleotide; CTLA4 exon 2; Set C
gauuuccacuggaggugcccgugcagaugga

SEQ ID NO: 1270 - RNA, 29 nt, Artificial Sequence
  Synthetic Oligonucleotide; CTLA4 exon 2; Set C
auuuccacuggaggugcccgugcagaugg

SEQ ID NO: 1271 - RNA, 27 nt, Artificial Sequence
  Synthetic Oligonucleotide; CTLA4 exon 2; Set C
uuuccacuggaggugcccgugcagaug

SEQ ID NO: 1272 - RNA, 32 nt, Artificial Sequence
  Synthetic Oligonucleotide; CTLA4 exon 2; Set C
ugauuuccacuggaggugcccgugcagaugga

SEQ ID NO: 1273 - RNA, 30 nt, Artificial Sequence
  Synthetic Oligonucleotide; CTLA4 exon 2; Set C
gauuuccacuggaggugcccgugcagaugg

SEQ ID NO: 1274 - RNA, 28 nt, Artificial Sequence
  Synthetic Oligonucleotide; CTLA4 exon 2; Set C
auuuccacuggaggugcccgugcagaug

SEQ ID NO: 1275 - RNA, 31 nt, Artificial Sequence
  Synthetic Oligonucleotide; CTLA4 exon 2; Set C
ugauuuccacuggaggugcccgugcagaugg

SEQ ID NO: 1276 - RNA, 29 nt, Artificial Sequence
  Synthetic Oligonucleotide; CTLA4 exon 2; Set C
gauuuccacuggaggugcccgugcagaug

SEQ ID NO: 1277 - RNA, 30 nt, Artificial Sequence
  Synthetic Oligonucleotide; CTLA4 exon 2; Set C
ugauuuccacuggaggugcccgugcagaug

SEQ ID NO: 1278 - RNA, 39 nt, Artificial Sequence
  Synthetic Oligonucleotide; CTLA4 exon 2; Set C
guucacuugauuuccacuggaggugcccgugcagaugga

SEQ ID NO: 1279 - RNA, 40 nt, Artificial Sequence
  Synthetic Oligonucleotide; CTLA4 exon 2; Set C
gguucacuugauuuccacuggaggugcccgugcagaugga

SEQ ID NO: 1280 - RNA, 38 nt, Artificial Sequence
  Synthetic Oligonucleotide; CTLA4 exon 2; Set C
guucacuugauuuccacuggaggugcccgugcagaugg

SEQ ID NO: 1281 - RNA, 37 nt, Artificial Sequence
  Synthetic Oligonucleotide; CTLA4 exon 2; Set C
guucacuugauuuccacuggaggugcccgugcagaug

SEQ ID NO: 1282 - RNA, 39 nt, Artificial Sequence
  Synthetic Oligonucleotide; CTLA4 exon 2; Set C
gguucacuugauuuccacuggaggugcccgugcagaugg

SEQ ID NO: 1283 - RNA, 38 nt, Artificial Sequence
  Synthetic Oligonucleotide; CTLA4 exon 2; Set C
gguucacuugauuuccacuggaggugcccgugcagaug

SEQ ID NO: 1284 - RNA, 40 nt, Artificial Sequence
  Synthetic Oligonucleotide; CTLA4 exon 2; Set C
agguucacuugauuuccacuggaggugcccgugcagaugg

SEQ ID NO: 1285 - RNA, 39 nt, Artificial Sequence
  Synthetic Oligonucleotide; CTLA4 exon 2; Set C
agguucacuugauuuccacuggaggugcccgugcagaug

SEQ ID NO: 1286 - RNA, 19 nt, Artificial Sequence
  Synthetic Oligonucleotide; CTLA4 exon 2; Set C
guucacuugauuuccacug

SEQ ID NO: 1287 - RNA, 33 nt, Artificial Sequence
  Synthetic Oligonucleotide; CTLA4 exon 2; Set C
gauagugagguucacuugauuuccacuggaggu

SEQ ID NO: 1288 - RNA, 37 nt, Artificial Sequence
  Synthetic Oligonucleotide; CTLA4 exon 2; Set C
cuuggauagugagguucacuugauuuccacuggaggu

SEQ ID NO: 1289 - RNA, 22 nt, Artificial Sequence
  Synthetic Oligonucleotide; CTLA4 exon 2; Set C
gauagugagguucacuugauuu

SEQ ID NO: 1290 - RNA, 21 nt, Artificial Sequence
  Synthetic Oligonucleotide; CTLA4 exon 2; Set C
gauagugagguucacuugauu

SEQ ID NO: 1291 - RNA, 20 nt, Artificial Sequence
  Synthetic Oligonucleotide; CTLA4 exon 2; Set C
gauagugagguucacuugau

SEQ ID NO: 1292 - RNA, 19 nt, Artificial Sequence
  Synthetic Oligonucleotide; CTLA4 exon 2; Set C
gauagugagguucacuuga

SEQ ID NO: 1293 - RNA, 26 nt, Artificial Sequence
  Synthetic Oligonucleotide; CTLA4 exon 2; Set A
cuuggauagugagguucacuugauuu

SEQ ID NO: 1294 - RNA, 25 nt, Artificial Sequence
  Synthetic Oligonucleotide; CTLA4 exon 2; Set A
cuuggauagugagguucacuugauu

SEQ ID NO: 1295 - RNA, 24 nt, Artificial Sequence
  Synthetic Oligonucleotide; CTLA4 exon 2; Set A
cuuggauagugagguucacuugau

SEQ ID NO: 1296 - RNA, 23 nt, Artificial Sequence
  Synthetic Oligonucleotide; CTLA4 exon 2; Set A
cuuggauagugagguucacuuga

SEQ ID NO: 1297 - RNA, 30 nt, Artificial Sequence
  Synthetic Oligonucleotide; CTLA4 exon 2; Set A
aguccuuggauagugagguucacuugauuu

SEQ ID NO: 1298 - RNA, 29 nt, Artificial Sequence
  Synthetic Oligonucleotide; CTLA4 exon 2; Set A
aguccuuggauagugagguucacuugauu

SEQ ID NO: 1299 - RNA, 31 nt, Artificial Sequence
  Synthetic Oligonucleotide; CTLA4 exon 2; Set A
caguccuuggauagugagguucacuugauuu

SEQ ID NO: 1300 - RNA, 28 nt, Artificial Sequence
  Synthetic Oligonucleotide; CTLA4 exon 2; Set A
aguccuuggauagugagguucacuugau

SEQ ID NO: 1301 - RNA, 30 nt, Artificial Sequence
  Synthetic Oligonucleotide; CTLA4 exon 2; Set A
caguccuuggauagugagguucacuugauu

SEQ ID NO: 1302 - RNA, 32 nt, Artificial Sequence
  Synthetic Oligonucleotide; CTLA4 exon 2; Set A
ucaguccuuggauagugagguucacuugauuu

SEQ ID NO: 1303 - RNA, 27 nt, Artificial Sequence
  Synthetic Oligonucleotide; CTLA4 exon 2; Set A
aguccuuggauagugagguucacuuga

SEQ ID NO: 1304 - RNA, 29 nt, Artificial Sequence
  Synthetic Oligonucleotide; CTLA4 exon 2; Set A
caguccuuggauagugagguucacuugau

SEQ ID NO: 1305 - RNA, 31 nt, Artificial Sequence
  Synthetic Oligonucleotide; CTLA4 exon 2; Set A
ucaguccuuggauagugagguucacuugauu

SEQ ID NO: 1306 - RNA, 33 nt, Artificial Sequence
  Synthetic Oligonucleotide; CTLA4 exon 2; Set C
cucaguccuuggauagugagguucacuugauuu

SEQ ID NO: 1307 - RNA, 30 nt, Artificial Sequence
  Synthetic Oligonucleotide; CTLA4 exon 2; Set A
ucaguccuuggauagugagguucacuugau

SEQ ID NO: 1308 - RNA, 28 nt, Artificial Sequence
  Synthetic Oligonucleotide; CTLA4 exon 2; Set A
caguccuuggauagugagguucacuuga

SEQ ID NO: 1309 - RNA, 32 nt, Artificial Sequence
  Synthetic Oligonucleotide; CTLA4 exon 2; Set C
cucaguccuuggauagugagguucacuugauu

SEQ ID NO: 1310 - RNA, 31 nt, Artificial Sequence
  Synthetic Oligonucleotide; CTLA4 exon 2; Set C
cucaguccuuggauagugagguucacuugau

SEQ ID NO: 1311 - RNA, 29 nt, Artificial Sequence
  Synthetic Oligonucleotide; CTLA4 exon 2; Set A
ucaguccuuggauagugagguucacuuga

SEQ ID NO: 1312 - RNA, 30 nt, Artificial Sequence
  Synthetic Oligonucleotide; CTLA4 exon 2; Set C
cucaguccuuggauagugagguucacuuga

SEQ ID NO: 1313 - RNA, 16 nt, Artificial Sequence
  Synthetic Oligonucleotide; CTLA4 exon 2; Set C
cuuggauagugagguu

SEQ ID NO: 1314 - RNA, 20 nt, Artificial Sequence
  Synthetic Oligonucleotide; CTLA4 exon 2; Set C
aguccuuggauagugagguu

SEQ ID NO: 1315 - RNA, 21 nt, Artificial Sequence
  Synthetic Oligonucleotide; CTLA4 exon 2; Set C
caguccuuggauagugagguu

SEQ ID NO: 1316 - RNA, 19 nt, Artificial Sequence
  Synthetic Oligonucleotide; CTLA4 exon 2; Set C
aguccuuggauagugaggu

SEQ ID NO: 1317 - RNA, 22 nt, Artificial Sequence
  Synthetic Oligonucleotide; CTLA4 exon 2; Set A
ucaguccuuggauagugagguu

SEQ ID NO: 1318 - RNA, 20 nt, Artificial Sequence
  Synthetic Oligonucleotide; CTLA4 exon 2; Set C
caguccuuggauagugaggu

SEQ ID NO: 1319 - RNA, 18 nt, Artificial Sequence
  Synthetic Oligonucleotide; CTLA4 exon 2; Set C
aguccuuggauagugagg

SEQ ID NO: 1320 - RNA, 23 nt, Artificial Sequence
  Synthetic Oligonucleotide; CTLA4 exon 2; Set A
cucaguccuuggauagugagguu

SEQ ID NO: 1321 - RNA, 21 nt, Artificial Sequence
  Synthetic Oligonucleotide; CTLA4 exon 2; Set A
ucaguccuuggauagugaggu

SEQ ID NO: 1322 - RNA, 19 nt, Artificial Sequence
  Synthetic Oligonucleotide; CTLA4 exon 2; Set C
caguccuuggauagugagg

SEQ ID NO: 1323 - RNA, 22 nt, Artificial Sequence
  Synthetic Oligonucleotide; CTLA4 exon 2; Set A
cucaguccuuggauagugaggu

SEQ ID NO: 1324 - RNA, 20 nt, Artificial Sequence
  Synthetic Oligonucleotide; CTLA4 exon 2; Set C
ucaguccuuggauagugagg

SEQ ID NO: 1325 - RNA, 21 nt, Artificial Sequence
  Synthetic Oligonucleotide; CTLA4 exon 2; Set C
cucaguccuuggauagugagg

SEQ ID NO: 1326 - RNA, 34 nt, Artificial Sequence
  Synthetic Oligonucleotide; CTLA4 exon 2; Set C
gcagauguagagucccguguccauggcccucagu

SEQ ID NO: 1327 - RNA, 35 nt, Artificial Sequence
  Synthetic Oligonucleotide; CTLA4 exon 2; Set C
ugcagauguagagucccguguccauggcccucagu

SEQ ID NO: 1328 - RNA, 36 nt, Artificial Sequence
  Synthetic Oligonucleotide; CTLA4 exon 2; Set C
uugcagauguagagucccguguccauggcccucagu

SEQ ID NO: 1329 - RNA, 35 nt, Artificial Sequence
  Synthetic Oligonucleotide; CTLA4 exon 2; Set C
uauggcgguggguacaugagcuccaccuugcagau

SEQ ID NO: 1330 - RNA, 36 nt, Artificial Sequence
  Synthetic Oligonucleotide; CTLA4 exon 2; Set C
guauggcgguggguacaugagcuccaccuugcagau

SEQ ID NO: 1331 - RNA, 34 nt, Artificial Sequence
  Synthetic Oligonucleotide; CTLA4 exon 2; Set C
uauggcgguggguacaugagcuccaccuugcaga

SEQ ID NO: 1332 - RNA, 37 nt, Artificial Sequence
  Synthetic Oligonucleotide; CTLA4 exon 2; Set C
aguauggcgguggguacaugagcuccaccuugcagau

SEQ ID NO: 1333 - RNA, 35 nt, Artificial Sequence
  Synthetic Oligonucleotide; CTLA4 exon 2; Set C
guauggcgguggguacaugagcuccaccuugcaga

SEQ ID NO: 1334 - RNA, 32 nt, Artificial Sequence
  Synthetic Oligonucleotide; CTLA4 exon 2; Set C
uauggcgguggguacaugagcuccaccuugca

SEQ ID NO: 1335 - RNA, 38 nt, Artificial Sequence
  Synthetic Oligonucleotide; CTLA4 exon 2; Set C
uaguauggcgguggguacaugagcuccaccuugcagau

SEQ ID NO: 1336 - RNA, 36 nt, Artificial Sequence
  Synthetic Oligonucleotide; CTLA4 exon 2; Set C
aguauggcgguggguacaugagcuccaccuugcaga

SEQ ID NO: 1337 - RNA, 34 nt, Artificial Sequence
  Synthetic Oligonucleotide; CTLA4 exon 2; Set C
guauggcgguggguacaugagcuccaccuugcag

SEQ ID NO: 1338 - RNA, 31 nt, Artificial Sequence
  Synthetic Oligonucleotide; CTLA4 exon 2; Set C
uauggcgguggguacaugagcuccaccuugc

SEQ ID NO: 1339 - RNA, 33 nt, Artificial Sequence
  Synthetic Oligonucleotide; CTLA4 exon 2; Set C
guauggcgguggguacaugagcuccaccuugca

SEQ ID NO: 1340 - RNA, 37 nt, Artificial Sequence
  Synthetic Oligonucleotide; CTLA4 exon 2; Set C
uaguauggcgguggguacaugagcuccaccuugcaga

SEQ ID NO: 1341 - RNA, 39 nt, Artificial Sequence
  Synthetic Oligonucleotide; CTLA4 exon 2; Set C
guaguauggcgguggguacaugagcuccaccuugcagau

SEQ ID NO: 1342 - RNA, 35 nt, Artificial Sequence
  Synthetic Oligonucleotide; CTLA4 exon 2; Set C
aguauggcgguggguacaugagcuccaccuugcag

SEQ ID NO: 1343 - RNA, 30 nt, Artificial Sequence
  Synthetic Oligonucleotide; CTLA4 exon 2; Set C
uauggcgguggguacaugagcuccaccuug

SEQ ID NO: 1344 - RNA, 32 nt, Artificial Sequence
  Synthetic Oligonucleotide; CTLA4 exon 2; Set C
guauggcgguggguacaugagcuccaccuugc

SEQ ID NO: 1345 - RNA, 34 nt, Artificial Sequence
  Synthetic Oligonucleotide; CTLA4 exon 2; Set C
aguauggcgguggguacaugagcuccaccuugca

SEQ ID NO: 1346 - RNA, 38 nt, Artificial Sequence
  Synthetic Oligonucleotide; CTLA4 exon 2; Set C
guaguauggcgguggguacaugagcuccaccuugcaga

SEQ ID NO: 1347 - RNA, 36 nt, Artificial Sequence
  Synthetic Oligonucleotide; CTLA4 exon 2; Set C
uaguauggcgguggguacaugagcuccaccuugcag

SEQ ID NO: 1348 - RNA, 31 nt, Artificial Sequence
  Synthetic Oligonucleotide; CTLA4 exon 2; Set C
guauggcgguggguacaugagcuccaccuug

SEQ ID NO: 1349 - RNA, 33 nt, Artificial Sequence
  Synthetic Oligonucleotide; CTLA4 exon 2; Set C
aguauggcgguggguacaugagcuccaccuugc

SEQ ID NO: 1350 - RNA, 35 nt, Artificial Sequence
  Synthetic Oligonucleotide; CTLA4 exon 2; Set C
uaguauggcgguggguacaugagcuccaccuugca

SEQ ID NO: 1351 - RNA, 37 nt, Artificial Sequence
  Synthetic Oligonucleotide; CTLA4 exon 2; Set C
guaguauggcgguggguacaugagcuccaccuugcag

SEQ ID NO: 1352 - RNA, 32 nt, Artificial Sequence
  Synthetic Oligonucleotide; CTLA4 exon 2; Set C
aguauggcgguggguacaugagcuccaccuug

SEQ ID NO: 1353 - RNA, 34 nt, Artificial Sequence
  Synthetic Oligonucleotide; CTLA4 exon 2; Set C
uaguauggcgguggguacaugagcuccaccuugc

SEQ ID NO: 1354 - RNA, 36 nt, Artificial Sequence
  Synthetic Oligonucleotide; CTLA4 exon 2; Set C
guaguauggcgguggguacaugagcuccaccuugca

SEQ ID NO: 1355 - RNA, 33 nt, Artificial Sequence
  Synthetic Oligonucleotide; CTLA4 exon 2; Set C
uaguauggcgguggguacaugagcuccaccuug

SEQ ID NO: 1356 - RNA, 35 nt, Artificial Sequence
  Synthetic Oligonucleotide; CTLA4 exon 2; Set C
guaguauggcgguggguacaugagcuccaccuugc

SEQ ID NO: 1357 - RNA, 34 nt, Artificial Sequence
  Synthetic Oligonucleotide; CTLA4 exon 2; Set C
guaguauggcgguggguacaugagcuccaccuug

SEQ ID NO: 1358 - RNA, 32 nt, Artificial Sequence
  Synthetic Oligonucleotide; CTLA4 exon 2; Set C
uaguauggcgguggguacaugagcuccaccuu

SEQ ID NO: 1359 - RNA, 15 nt, Artificial Sequence
  Synthetic Oligonucleotide; CTLA4 exon 2; Set C
guauggcggugggua

SEQ ID NO: 1360 - RNA, 16 nt, Artificial Sequence
  Synthetic Oligonucleotide; CTLA4 exon 2; Set C
aguauggcggugggua

SEQ ID NO: 1361 - RNA, 17 nt, Artificial Sequence
  Synthetic Oligonucleotide; CTLA4 exon 2; Set C
uaguauggcggugggua

SEQ ID NO: 1362 - RNA, 18 nt, Artificial Sequence
  Synthetic Oligonucleotide; CTLA4 exon 2; Set B
guaguauggcggugggua

SEQ ID NO: 1363 - RNA, 26 nt, Artificial Sequence
  Synthetic Oligonucleotide; CTLA4 exon 2; Set C
augcccagguaguauggcggugggua

SEQ ID NO: 1364 - RNA, 27 nt, Artificial Sequence
  Synthetic Oligonucleotide; CTLA4 exon 2; Set C
uaugcccagguaguauggcggugggua

SEQ ID NO: 1365 - RNA, 16 nt, Artificial Sequence
  Synthetic Oligonucleotide; CTLA4 exon 2; Set C
ccagguaguauggcgg

SEQ ID NO: 1366 - RNA, 28 nt, Artificial Sequence
  Synthetic Oligonucleotide; CTLA4 exon 2; Set C
cuaugcccagguaguauggcggugggua

SEQ ID NO: 1367 - RNA, 18 nt, Artificial Sequence
  Synthetic Oligonucleotide; CTLA4 exon 2; Set B
gcccagguaguauggcgg

SEQ ID NO: 1368 - RNA, 19 nt, Artificial Sequence
  Synthetic Oligonucleotide; CTLA4 exon 2; Set B
ugcccagguaguauggcgg

SEQ ID NO: 1369 - RNA, 21 nt, Artificial Sequence
  Synthetic Oligonucleotide; CTLA4 exon 2; Set B
augcccagguaguauggcggu

SEQ ID NO: 1370 - RNA, 22 nt, Artificial Sequence
  Synthetic Oligonucleotide; CTLA4 exon 2; Set B
uaugcccagguaguauggcggu

SEQ ID NO: 1371 - RNA, 33 nt, Artificial Sequence
  Synthetic Oligonucleotide; CTLA4 exon 2; Set C
guugccuaugcccagguaguauggcggugggua

SEQ ID NO: 1372 - RNA, 23 nt, Artificial Sequence
  Synthetic Oligonucleotide; CTLA4 exon 2; Set C
cuaugcccagguaguauggcggu

SEQ ID NO: 1373 - RNA, 23 nt, Artificial Sequence
  Synthetic Oligonucleotide; CTLA4 exon 2; Set C
ccuaugcccagguaguauggcgg

SEQ ID NO: 1374 - RNA, 24 nt, Artificial Sequence
  Synthetic Oligonucleotide; CTLA4 exon 2; Set C
gccuaugcccagguaguauggcgg

SEQ ID NO: 1375 - RNA, 25 nt, Artificial Sequence
  Synthetic Oligonucleotide; CTLA4 exon 2; Set C
ugccuaugcccagguaguauggcgg

SEQ ID NO: 1376 - RNA, 26 nt, Artificial Sequence
  Synthetic Oligonucleotide; CTLA4 exon 2; Set C
uugccuaugcccagguaguauggcgg

SEQ ID NO: 1377 - RNA, 38 nt, Artificial Sequence
  Synthetic Oligonucleotide; CTLA4 exon 2; Set C
guuccguugccuaugcccagguaguauggcggugggua

SEQ ID NO: 1378 - RNA, 28 nt, Artificial Sequence
  Synthetic Oligonucleotide; CTLA4 exon 2; Set C
guugccuaugcccagguaguauggcggu

SEQ ID NO: 1379 - RNA, 39 nt, Artificial Sequence
  Synthetic Oligonucleotide; CTLA4 exon 2; Set C
gguuccguugccuaugcccagguaguauggcggugggua

SEQ ID NO: 1380 - RNA, 28 nt, Artificial Sequence
  Synthetic Oligonucleotide; CTLA4 exon 2; Set C
cguugccuaugcccagguaguauggcgg

SEQ ID NO: 1381 - RNA, 40 nt, Artificial Sequence
  Synthetic Oligonucleotide; CTLA4 exon 2; Set C
ggguuccguugccuaugcccagguaguauggcggugggua

SEQ ID NO: 1382 - RNA, 29 nt, Artificial Sequence
  Synthetic Oligonucleotide; CTLA4 exon 2; Set C
ccguugccuaugcccagguaguauggcgg

SEQ ID NO: 1383 - RNA, 30 nt, Artificial Sequence
  Synthetic Oligonucleotide; CTLA4 exon 2; Set C
uccguugccuaugcccagguaguauggcgg

SEQ ID NO: 1384 - RNA, 31 nt, Artificial Sequence
  Synthetic Oligonucleotide; CTLA4 exon 2; Set C
uuccguugccuaugcccagguaguauggcgg

SEQ ID NO: 1385 - RNA, 33 nt, Artificial Sequence
  Synthetic Oligonucleotide; CTLA4 exon 2; Set C
guuccguugccuaugcccagguaguauggcggu

SEQ ID NO: 1386 - RNA, 34 nt, Artificial Sequence
  Synthetic Oligonucleotide; CTLA4 exon 2; Set C
gguuccguugccuaugcccagguaguauggcggu

SEQ ID NO: 1387 - RNA, 35 nt, Artificial Sequence
  Synthetic Oligonucleotide; CTLA4 exon 2; Set C
ggguuccguugccuaugcccagguaguauggcggu

SEQ ID NO: 1388 - RNA, 36 nt, Artificial Sequence
  Synthetic Oligonucleotide; CTLA4 exon 2; Set C
uggguuccguugccuaugcccagguaguauggcggu

SEQ ID NO: 1389 - RNA, 37 nt, Artificial Sequence
  Synthetic Oligonucleotide; CTLA4 exon 2; Set C
cuggguuccguugccuaugcccagguaguauggcggu

SEQ ID NO: 1390 - RNA, 38 nt, Artificial Sequence
  Synthetic Oligonucleotide; CTLA4 exon 2; Set C
ucuggguuccguugccuaugcccagguaguauggcggu

SEQ ID NO: 1391 - RNA, 39 nt, Artificial Sequence
  Synthetic Oligonucleotide; CTLA4 exon 2; Set C
aucuggguuccguugccuaugcccagguaguauggcggu

SEQ ID NO: 1392 - RNA, 40 nt, Artificial Sequence
  Synthetic Oligonucleotide; CTLA4 exon 2; Set C
aaucuggguuccguugccuaugcccagguaguauggcggu

SEQ ID NO: 1393 - RNA, 15 nt, Artificial Sequence
  Synthetic Oligonucleotide; CTLA4 exon 2; Set C
cguugccuaugccca

SEQ ID NO: 1394 - RNA, 16 nt, Artificial Sequence
  Synthetic Oligonucleotide; CTLA4 exon 2; Set B
ccguugccuaugccca

SEQ ID NO: 1395 - RNA, 17 nt, Artificial Sequence
  Synthetic Oligonucleotide; CTLA4 exon 2; Set B
uccguugccuaugccca

SEQ ID NO: 1396 - RNA, 18 nt, Artificial Sequence
  Synthetic Oligonucleotide; CTLA4 exon 2; Set B
uuccguugccuaugccca

SEQ ID NO: 1397 - RNA, 15 nt, Artificial Sequence
  Synthetic Oligonucleotide; CTLA4 exon 2; Set C
uccguugccuaugcc

SEQ ID NO: 1398 - RNA, 16 nt, Artificial Sequence
  Synthetic Oligonucleotide; CTLA4 exon 2; Set C
uuccguugccuaugcc

SEQ ID NO: 1399 - RNA, 18 nt, Artificial Sequence
  Synthetic Oligonucleotide; CTLA4 exon 2; Set B
guuccguugccuaugccc

SEQ ID NO: 1400 - RNA, 15 nt, Artificial Sequence
  Synthetic Oligonucleotide; CTLA4 exon 2; Set C
uuccguugccuaugc

SEQ ID NO: 1401 - RNA, 19 nt, Artificial Sequence
  Synthetic Oligonucleotide; CTLA4 exon 2; Set B
gguuccguugccuaugccc

SEQ ID NO: 1402 - RNA, 18 nt, Artificial Sequence
  Synthetic Oligonucleotide; CTLA4 exon 2; Set B
gguuccguugccuaugcc

SEQ ID NO: 1403 - RNA, 20 nt, Artificial Sequence
  Synthetic Oligonucleotide; CTLA4 exon 2; Set C
ggguuccguugccuaugccc

SEQ ID NO: 1404 - RNA, 21 nt, Artificial Sequence
  Synthetic Oligonucleotide; CTLA4 exon 2; Set C
uggguuccguugccuaugccc

SEQ ID NO: 1405 - RNA, 29 nt, Artificial Sequence
  Synthetic Oligonucleotide; CTLA4 exon 2; Set C
aaucuggguuccguugccuaugcccaggu

SEQ ID NO: 1406 - RNA, 22 nt, Artificial Sequence
  Synthetic Oligonucleotide; CTLA4 exon 2; Set C
cuggguuccguugccuaugccc

SEQ ID NO: 1407 - RNA, 30 nt, Artificial Sequence
  Synthetic Oligonucleotide; CTLA4 exon 2; Set C
aaaucuggguuccguugccuaugcccaggu

SEQ ID NO: 1408 - RNA, 21 nt, Artificial Sequence
  Synthetic Oligonucleotide; CTLA4 exon 2; Set B
cuggguuccguugccuaugcc

SEQ ID NO: 1409 - RNA, 23 nt, Artificial Sequence
  Synthetic Oligonucleotide; CTLA4 exon 2; Set C
ucuggguuccguugccuaugccc

SEQ ID NO: 1410 - RNA, 31 nt, Artificial Sequence
  Synthetic Oligonucleotide; CTLA4 exon 2; Set C
uaaaucuggguuccguugccuaugcccaggu

SEQ ID NO: 1411 - RNA, 24 nt, Artificial Sequence
  Synthetic Oligonucleotide; CTLA4 exon 2; Set C
aucuggguuccguugccuaugccc

SEQ ID NO: 1412 - RNA, 32 nt, Artificial Sequence
  Synthetic Oligonucleotide; CTLA4 exon 2; Set C
auaaaucuggguuccguugccuaugcccaggu

SEQ ID NO: 1413 - RNA, 25 nt, Artificial Sequence
  Synthetic Oligonucleotide; CTLA4 exon 2; Set C
aaucuggguuccguugccuaugccc

SEQ ID NO: 1414 - RNA, 33 nt, Artificial Sequence
  Synthetic Oligonucleotide; CTLA4 exon 2; Set C
cauaaaucuggguuccguugccuaugcccaggu

SEQ ID NO: 1415 - RNA, 26 nt, Artificial Sequence
  Synthetic Oligonucleotide; CTLA4 exon 2; Set C
aaaucuggguuccguugccuaugccc

SEQ ID NO: 1416 - RNA, 34 nt, Artificial Sequence
  Synthetic Oligonucleotide; CTLA4 exon 2; Set C
acauaaaucuggguuccguugccuaugcccaggu

SEQ ID NO: 1417 - RNA, 27 nt, Artificial Sequence
  Synthetic Oligonucleotide; CTLA4 exon 2; Set C
uaaaucuggguuccguugccuaugccc

SEQ ID NO: 1418 - RNA, 35 nt, Artificial Sequence
  Synthetic Oligonucleotide; CTLA4 exon 2; Set C
uacauaaaucuggguuccguugccuaugcccaggu

SEQ ID NO: 1419 - RNA, 28 nt, Artificial Sequence
  Synthetic Oligonucleotide; CTLA4 exon 2; Set C
auaaaucuggguuccguugccuaugccc

SEQ ID NO: 1420 - RNA, 15 nt, Artificial Sequence
  Synthetic Oligonucleotide; CTLA4 exon 2; Set C
cuggguuccguugcc

SEQ ID NO: 1421 - RNA, 29 nt, Artificial Sequence
  Synthetic Oligonucleotide; CTLA4 exon 2; Set C
cauaaaucuggguuccguugccuaugccc

SEQ ID NO: 1422 - RNA, 40 nt, Artificial Sequence
  Synthetic Oligonucleotide; CTLA4 exon 2; Set C
caauuacauaaaucuggguuccguugccuaugcccaggua

SEQ ID NO: 1423 - RNA, 30 nt, Artificial Sequence
  Synthetic Oligonucleotide; CTLA4 exon 2; Set C
acauaaaucuggguuccguugccuaugccc

SEQ ID NO: 1424 - RNA, 31 nt, Artificial Sequence
  Synthetic Oligonucleotide; CTLA4 exon 2; Set C
uacauaaaucuggguuccguugccuaugccc

SEQ ID NO: 1425 - RNA, 32 nt, Artificial Sequence
  Synthetic Oligonucleotide; CTLA4 exon 2; Set C
uuacauaaaucuggguuccguugccuaugccc

SEQ ID NO: 1426 - RNA, 33 nt, Artificial Sequence
  Synthetic Oligonucleotide; CTLA4 exon 2; Set C
auuacauaaaucuggguuccguugccuaugccc

SEQ ID NO: 1427 - RNA, 34 nt, Artificial Sequence
  Synthetic Oligonucleotide; CTLA4 exon 2; Set C
aauuacauaaaucuggguuccguugccuaugccc

SEQ ID NO: 1428 - RNA, 33 nt, Artificial Sequence
  Synthetic Oligonucleotide; CTLA4 exon 2; Set C
aauuacauaaaucuggguuccguugccuaugcc

SEQ ID NO: 1429 - RNA, 32 nt, Artificial Sequence
  Synthetic Oligonucleotide; CTLA4 exon 2; Set B
caauuacauaaaucuggguuccguugccuaug

SEQ ID NO: 1430 - RNA, 31 nt, Artificial Sequence
  Synthetic Oligonucleotide; CTLA4 exon 2; Set B
caauuacauaaaucuggguuccguugccuau

SEQ ID NO: 1431 - RNA, 30 nt, Artificial Sequence
  Synthetic Oligonucleotide; CTLA4 exon 2; Set B
caauuacauaaaucuggguuccguugccua

SEQ ID NO: 1432 - RNA, 40 nt, Artificial Sequence
  Synthetic Oligonucleotide; CTLA4 exon 2; Set C
cucaccaauuacauaaaucuggguuccguugccuaugccc

SEQ ID NO: 1433 - RNA, 39 nt, Artificial Sequence
  Synthetic Oligonucleotide; CTLA4 exon 2; Set C
cucaccaauuacauaaaucuggguuccguugccuaugcc

SEQ ID NO: 1434 - RNA, 27 nt, Artificial Sequence
  Synthetic Oligonucleotide; CTLA4 exon 2; Set B
aauuacauaaaucuggguuccguugcc

SEQ ID NO: 1435 - RNA, 40 nt, Artificial Sequence
  Synthetic Oligonucleotide; CTLA4 exon 2; Set C
gcucaccaauuacauaaaucuggguuccguugccuaugcc

SEQ ID NO: 1436 - RNA, 26 nt, Artificial Sequence
  Synthetic Oligonucleotide; CTLA4 exon 2; Set C
aauuacauaaaucuggguuccguugc

SEQ ID NO: 1437 - RNA, 25 nt, Artificial Sequence
  Synthetic Oligonucleotide; CTLA4 exon 2; Set C
caauuacauaaaucuggguuccguu

SEQ ID NO: 1438 - RNA, 23 nt, Artificial Sequence
  Synthetic Oligonucleotide; CTLA4 exon 2; Set C
aauuacauaaaucuggguuccgu

SEQ ID NO: 1439 - RNA, 22 nt, Artificial Sequence
  Synthetic Oligonucleotide; CTLA4 exon 2; Set C
aauuacauaaaucuggguuccg

SEQ ID NO: 1440 - RNA, 33 nt, Artificial Sequence
  Synthetic Oligonucleotide; CTLA4 exon 2; Set C
cucaccaauuacauaaaucuggguuccguugcc

SEQ ID NO: 1441 - RNA, 34 nt, Artificial Sequence
  Synthetic Oligonucleotide; CTLA4 exon 2; Set C
gcucaccaauuacauaaaucuggguuccguugcc

SEQ ID NO: 1442 - RNA, 32 nt, Artificial Sequence
  Synthetic Oligonucleotide; CTLA4 exon 2; Set B
cucaccaauuacauaaaucuggguuccguugc

SEQ ID NO: 1443 - RNA, 35 nt, Artificial Sequence
  Synthetic Oligonucleotide; CTLA4 exon 2; Set C
ugcucaccaauuacauaaaucuggguuccguugcc

SEQ ID NO: 1444 - RNA, 33 nt, Artificial Sequence
  Synthetic Oligonucleotide; CTLA4 exon 2; Set C
gcucaccaauuacauaaaucuggguuccguugc

SEQ ID NO: 1445 - RNA, 20 nt, Artificial Sequence
  Synthetic Oligonucleotide; CTLA4 exon 2; Set C
caauuacauaaaucuggguu

SEQ ID NO: 1446 - RNA, 36 nt, Artificial Sequence
  Synthetic Oligonucleotide; CTLA4 exon 2; Set C
uugcucaccaauuacauaaaucuggguuccguugcc

SEQ ID NO: 1447 - RNA, 34 nt, Artificial Sequence
  Synthetic Oligonucleotide; CTLA4 exon 2; Set C
ugcucaccaauuacauaaaucuggguuccguugc

SEQ ID NO: 1448 - RNA, 19 nt, Artificial Sequence
  Synthetic Oligonucleotide; CTLA4 exon 2; Set C
caauuacauaaaucugggu

SEQ ID NO: 1449 - RNA, 37 nt, Artificial Sequence
  Synthetic Oligonucleotide; CTLA4 exon 2; Set C
uuugcucaccaauuacauaaaucuggguuccguugcc

SEQ ID NO: 1450 - RNA, 35 nt, Artificial Sequence
  Synthetic Oligonucleotide; CTLA4 exon 2; Set C
uugcucaccaauuacauaaaucuggguuccguugc

SEQ ID NO: 1451 - RNA, 29 nt, Artificial Sequence
  Synthetic Oligonucleotide; CTLA4 exon 2; Set B
cucaccaauuacauaaaucuggguuccgu

SEQ ID NO: 1452 - RNA, 18 nt, Artificial Sequence
  Synthetic Oligonucleotide; CTLA4 exon 2; Set C
caauuacauaaaucuggg

SEQ ID NO: 1453 - RNA, 38 nt, Artificial Sequence
  Synthetic Oligonucleotide; CTLA4 exon 2; Set C
cuuugcucaccaauuacauaaaucuggguuccguugcc

SEQ ID NO: 1454 - RNA, 36 nt, Artificial Sequence
  Synthetic Oligonucleotide; CTLA4 exon 2; Set C
uuugcucaccaauuacauaaaucuggguuccguugc

SEQ ID NO: 1455 - RNA, 30 nt, Artificial Sequence
  Synthetic Oligonucleotide; CTLA4 exon 2; Set B
gcucaccaauuacauaaaucuggguuccgu

SEQ ID NO: 1456 - RNA, 28 nt, Artificial Sequence
  Synthetic Oligonucleotide; CTLA4 exon 2; Set B
cucaccaauuacauaaaucuggguuccg

SEQ ID NO: 1457 - RNA, 17 nt, Artificial Sequence
  Synthetic Oligonucleotide; CTLA4 exon 2; Set C
caauuacauaaaucugg

SEQ ID NO: 1458 - RNA, 39 nt, Artificial Sequence
  Synthetic Oligonucleotide; CTLA4 exon 2; Set C
gcuuugcucaccaauuacauaaaucuggguuccguugcc

SEQ ID NO: 1459 - RNA, 37 nt, Artificial Sequence
  Synthetic Oligonucleotide; CTLA4 exon 2; Set C
cuuugcucaccaauuacauaaaucuggguuccguugc

SEQ ID NO: 1460 - RNA, 31 nt, Artificial Sequence
  Synthetic Oligonucleotide; CTLA4 exon 2; Set B
ugcucaccaauuacauaaaucuggguuccgu

SEQ ID NO: 1461 - RNA, 29 nt, Artificial Sequence
  Synthetic Oligonucleotide; CTLA4 exon 2; Set B
gcucaccaauuacauaaaucuggguuccg

SEQ ID NO: 1462 - RNA, 16 nt, Artificial Sequence
  Synthetic Oligonucleotide; CTLA4 exon 2; Set C
caauuacauaaaucug

SEQ ID NO: 1463 - RNA, 38 nt, Artificial Sequence
  Synthetic Oligonucleotide; CTLA4 exon 2; Set C
gcuuugcucaccaauuacauaaaucuggguuccguugc

SEQ ID NO: 1464 - RNA, 30 nt, Artificial Sequence
  Synthetic Oligonucleotide; CTLA4 exon 2; Set B
ugcucaccaauuacauaaaucuggguuccg

SEQ ID NO: 1465 - RNA, 32 nt, Artificial Sequence
  Synthetic Oligonucleotide; CTLA4 exon 2; Set B
uugcucaccaauuacauaaaucuggguuccgu

SEQ ID NO: 1466 - RNA, 15 nt, Artificial Sequence
  Synthetic Oligonucleotide; CTLA4 exon 2; Set C
caauuacauaaaucu

SEQ ID NO: 1467 - RNA, 33 nt, Artificial Sequence
  Synthetic Oligonucleotide; CTLA4 exon 2; Set B
uuugcucaccaauuacauaaaucuggguuccgu

SEQ ID NO: 1468 - RNA, 31 nt, Artificial Sequence
  Synthetic Oligonucleotide; CTLA4 exon 2; Set B
uugcucaccaauuacauaaaucuggguuccg

SEQ ID NO: 1469 - RNA, 34 nt, Artificial Sequence
  Synthetic Oligonucleotide; CTLA4 exon 2; Set C
cuuugcucaccaauuacauaaaucuggguuccgu

SEQ ID NO: 1470 - RNA, 32 nt, Artificial Sequence
  Synthetic Oligonucleotide; CTLA4 exon 2; Set B
uuugcucaccaauuacauaaaucuggguuccg

SEQ ID NO: 1471 - RNA, 37 nt, Artificial Sequence
  Synthetic Oligonucleotide; CTLA4 exon 2; Set C
ggcuuugcucaccaauuacauaaaucuggguuccguu

SEQ ID NO: 1472 - RNA, 33 nt, Artificial Sequence
  Synthetic Oligonucleotide; CTLA4 exon 2; Set B
cuuugcucaccaauuacauaaaucuggguuccg

SEQ ID NO: 1473 - RNA, 35 nt, Artificial Sequence
  Synthetic Oligonucleotide; CTLA4 exon 2; Set C
gcuuugcucaccaauuacauaaaucuggguuccgu

SEQ ID NO: 1474 - RNA, 38 nt, Artificial Sequence
  Synthetic Oligonucleotide; CTLA4 exon 2; Set C
uggcuuugcucaccaauuacauaaaucuggguuccguu

SEQ ID NO: 1475 - RNA, 34 nt, Artificial Sequence
  Synthetic Oligonucleotide; CTLA4 exon 2; Set C
gcuuugcucaccaauuacauaaaucuggguuccg

SEQ ID NO: 1476 - RNA, 39 nt, Artificial Sequence
  Synthetic Oligonucleotide; CTLA4 exon 2; Set C
auggcuuugcucaccaauuacauaaaucuggguuccguu

SEQ ID NO: 1477 - RNA, 39 nt, Artificial Sequence
  Synthetic Oligonucleotide; CTLA4 exon 2; Set C
aauggcuuugcucaccaauuacauaaaucuggguuccgu

SEQ ID NO: 1478 - RNA, 32 nt, Artificial Sequence
  Synthetic Oligonucleotide; CTLA4 exon 2; Set B
ggcuuugcucaccaauuacauaaaucuggguu

SEQ ID NO: 1479 - RNA, 40 nt, Artificial Sequence
  Synthetic Oligonucleotide; CTLA4 exon 2; Set C
aaauggcuuugcucaccaauuacauaaaucuggguuccgu

SEQ ID NO: 1480 - RNA, 38 nt, Artificial Sequence
  Synthetic Oligonucleotide; CTLA4 exon 2; Set C
aauggcuuugcucaccaauuacauaaaucuggguuccg

SEQ ID NO: 1481 - RNA, 33 nt, Artificial Sequence
  Synthetic Oligonucleotide; CTLA4 exon 2; Set C
uggcuuugcucaccaauuacauaaaucuggguu

SEQ ID NO: 1482 - RNA, 31 nt, Artificial Sequence
  Synthetic Oligonucleotide; CTLA4 exon 2; Set B
ggcuuugcucaccaauuacauaaaucugggu

SEQ ID NO: 1483 - RNA, 37 nt, Artificial Sequence
  Synthetic Oligonucleotide; CTLA4 exon 2; Set C
aauggcuuugcucaccaauuacauaaaucuggguucc

SEQ ID NO: 1484 - RNA, 39 nt, Artificial Sequence
  Synthetic Oligonucleotide; CTLA4 exon 2; Set C
aaauggcuuugcucaccaauuacauaaaucuggguuccg

SEQ ID NO: 1485 - RNA, 34 nt, Artificial Sequence
  Synthetic Oligonucleotide; CTLA4 exon 2; Set C
auggcuuugcucaccaauuacauaaaucuggguu

SEQ ID NO: 1486 - RNA, 30 nt, Artificial Sequence
  Synthetic Oligonucleotide; CTLA4 exon 2; Set B
ggcuuugcucaccaauuacauaaaucuggg

SEQ ID NO: 1487 - RNA, 32 nt, Artificial Sequence
  Synthetic Oligonucleotide; CTLA4 exon 2; Set C
uggcuuugcucaccaauuacauaaaucugggu

SEQ ID NO: 1488 - RNA, 40 nt, Artificial Sequence
  Synthetic Oligonucleotide; CTLA4 exon 2; Set C
gaaauggcuuugcucaccaauuacauaaaucuggguuccg

SEQ ID NO: 1489 - RNA, 29 nt, Artificial Sequence
  Synthetic Oligonucleotide; CTLA4 exon 2; Set B
ggcuuugcucaccaauuacauaaaucugg

SEQ ID NO: 1490 - RNA, 31 nt, Artificial Sequence
  Synthetic Oligonucleotide; CTLA4 exon 2; Set B
uggcuuugcucaccaauuacauaaaucuggg

SEQ ID NO: 1491 - RNA, 33 nt, Artificial Sequence
  Synthetic Oligonucleotide; CTLA4 exon 2; Set B
auggcuuugcucaccaauuacauaaaucugggu

SEQ ID NO: 1492 - RNA, 39 nt, Artificial Sequence
  Synthetic Oligonucleotide; CTLA4 exon 2; Set C
gaaauggcuuugcucaccaauuacauaaaucuggguucc

SEQ ID NO: 1493 - RNA, 30 nt, Artificial Sequence
  Synthetic Oligonucleotide; CTLA4 exon 2; Set B
uggcuuugcucaccaauuacauaaaucugg

SEQ ID NO: 1494 - RNA, 32 nt, Artificial Sequence
  Synthetic Oligonucleotide; CTLA4 exon 2; Set B
auggcuuugcucaccaauuacauaaaucuggg

SEQ ID NO: 1495 - RNA, 28 nt, Artificial Sequence
  Synthetic Oligonucleotide; CTLA4 exon 2; Set B
ggcuuugcucaccaauuacauaaaucug

SEQ ID NO: 1496 - RNA, 31 nt, Artificial Sequence
  Synthetic Oligonucleotide; CTLA4 exon 2; Set B
auggcuuugcucaccaauuacauaaaucugg

SEQ ID NO: 1497 - RNA, 27 nt, Artificial Sequence
  Synthetic Oligonucleotide; CTLA4 exon 2; Set B
ggcuuugcucaccaauuacauaaaucu

SEQ ID NO: 1498 - RNA, 29 nt, Artificial Sequence
  Synthetic Oligonucleotide; CTLA4 exon 2; Set B
uggcuuugcucaccaauuacauaaaucug

SEQ ID NO: 1499 - RNA, 26 nt, Artificial Sequence
  Synthetic Oligonucleotide; CTLA4 exon 2; Set B
ggcuuugcucaccaauuacauaaauc

SEQ ID NO: 1500 - RNA, 28 nt, Artificial Sequence
  Synthetic Oligonucleotide; CTLA4 exon 2; Set B
uggcuuugcucaccaauuacauaaaucu

SEQ ID NO: 1501 - RNA, 30 nt, Artificial Sequence
  Synthetic Oligonucleotide; CTLA4 exon 2; Set B
auggcuuugcucaccaauuacauaaaucug

SEQ ID NO: 1502 - RNA, 25 nt, Artificial Sequence
  Synthetic Oligonucleotide; CTLA4 exon 2; Set C
ggcuuugcucaccaauuacauaaau

SEQ ID NO: 1503 - RNA, 27 nt, Artificial Sequence
  Synthetic Oligonucleotide; CTLA4 exon 2; Set B
uggcuuugcucaccaauuacauaaauc

SEQ ID NO: 1504 - RNA, 29 nt, Artificial Sequence
  Synthetic Oligonucleotide; CTLA4 exon 2; Set B
auggcuuugcucaccaauuacauaaaucu

SEQ ID NO: 1505 - RNA, 26 nt, Artificial Sequence
  Synthetic Oligonucleotide; CTLA4 exon 2; Set C
uggcuuugcucaccaauuacauaaau

SEQ ID NO: 1506 - RNA, 24 nt, Artificial Sequence
  Synthetic Oligonucleotide; CTLA4 exon 2; Set C
ggcuuugcucaccaauuacauaaa

SEQ ID NO: 1507 - RNA, 28 nt, Artificial Sequence
  Synthetic Oligonucleotide; CTLA4 exon 2; Set B
auggcuuugcucaccaauuacauaaauc

SEQ ID NO: 1508 - RNA, 27 nt, Artificial Sequence
  Synthetic Oligonucleotide; CTLA4 exon 2; Set C
auggcuuugcucaccaauuacauaaau

SEQ ID NO: 1509 - RNA, 25 nt, Artificial Sequence
  Synthetic Oligonucleotide; CTLA4 exon 2; Set C
uggcuuugcucaccaauuacauaaa

SEQ ID NO: 1510 - RNA, 23 nt, Artificial Sequence
  Synthetic Oligonucleotide; CTLA4 exon 2; Set C
ggcuuugcucaccaauuacauaa

SEQ ID NO: 1511 - RNA, 26 nt, Artificial Sequence
  Synthetic Oligonucleotide; CTLA4 exon 2; Set C
auggcuuugcucaccaauuacauaaa

SEQ ID NO: 1512 - RNA, 24 nt, Artificial Sequence
  Synthetic Oligonucleotide; CTLA4 exon 2; Set B
uggcuuugcucaccaauuacauaa

SEQ ID NO: 1513 - RNA, 22 nt, Artificial Sequence
  Synthetic Oligonucleotide; CTLA4 exon 2; Set B
ggcuuugcucaccaauuacaua

SEQ ID NO: 1514 - RNA, 25 nt, Artificial Sequence
  Synthetic Oligonucleotide; CTLA4 exon 2; Set B
auggcuuugcucaccaauuacauaa

SEQ ID NO: 1515 - RNA, 23 nt, Artificial Sequence
  Synthetic Oligonucleotide; CTLA4 exon 2; Set B
uggcuuugcucaccaauuacaua

SEQ ID NO: 1516 - RNA, 21 nt, Artificial Sequence
  Synthetic Oligonucleotide; CTLA4 exon 2; Set C
ggcuuugcucaccaauuacau

SEQ ID NO: 1517 - RNA, 24 nt, Artificial Sequence
  Synthetic Oligonucleotide; CTLA4 exon 2; Set B
auggcuuugcucaccaauuacaua

SEQ ID NO: 1518 - RNA, 22 nt, Artificial Sequence
  Synthetic Oligonucleotide; CTLA4 exon 2; Set B
uggcuuugcucaccaauuacau

SEQ ID NO: 1519 - RNA, 20 nt, Artificial Sequence
  Synthetic Oligonucleotide; CTLA4 exon 2; Set C
ggcuuugcucaccaauuaca

SEQ ID NO: 1520 - RNA, 40 nt, Artificial Sequence
  Synthetic Oligonucleotide; CTLA4 exon 2; Set C
ucagugaaauggcuuugcucaccaauuacauaaaucuggg

SEQ ID NO: 1521 - RNA, 23 nt, Artificial Sequence
  Synthetic Oligonucleotide; CTLA4 exon 2; Set B
auggcuuugcucaccaauuacau

SEQ ID NO: 1522 - RNA, 21 nt, Artificial Sequence
  Synthetic Oligonucleotide; CTLA4 exon 2; Set B
uggcuuugcucaccaauuaca

SEQ ID NO: 1523 - RNA, 19 nt, Artificial Sequence
  Synthetic Oligonucleotide; CTLA4 exon 2; Set C
ggcuuugcucaccaauuac

SEQ ID NO: 1524 - RNA, 39 nt, Artificial Sequence
  Synthetic Oligonucleotide; CTLA4 exon 2; Set B
ucagugaaauggcuuugcucaccaauuacauaaaucugg

SEQ ID NO: 1525 - RNA, 22 nt, Artificial Sequence
  Synthetic Oligonucleotide; CTLA4 exon 2; Set B
auggcuuugcucaccaauuaca

SEQ ID NO: 1526 - RNA, 20 nt, Artificial Sequence
  Synthetic Oligonucleotide; CTLA4 exon 2; Set C
uggcuuugcucaccaauuac

SEQ ID NO: 1527 - RNA, 38 nt, Artificial Sequence
  Synthetic Oligonucleotide; CTLA4 exon 2; Set B
ucagugaaauggcuuugcucaccaauuacauaaaucug

SEQ ID NO: 1528 - RNA, 18 nt, Artificial Sequence
  Synthetic Oligonucleotide; CTLA4 exon 2; Set C
ggcuuugcucaccaauua

SEQ ID NO: 1529 - RNA, 21 nt, Artificial Sequence
  Synthetic Oligonucleotide; CTLA4 exon 2; Set C
auggcuuugcucaccaauuac

SEQ ID NO: 1530 - RNA, 37 nt, Artificial Sequence
  Synthetic Oligonucleotide; CTLA4 exon 2; Set B
ucagugaaauggcuuugcucaccaauuacauaaaucu

SEQ ID NO: 1531 - RNA, 17 nt, Artificial Sequence
  Synthetic Oligonucleotide; CTLA4 exon 2; Set C
ggcuuugcucaccaauu

SEQ ID NO: 1532 - RNA, 19 nt, Artificial Sequence
  Synthetic Oligonucleotide; CTLA4 exon 2; Set C
uggcuuugcucaccaauua

SEQ ID NO: 1533 - RNA, 36 nt, Artificial Sequence
  Synthetic Oligonucleotide; CTLA4 exon 2; Set B
ucagugaaauggcuuugcucaccaauuacauaaauc

SEQ ID NO: 1534 - RNA, 18 nt, Artificial Sequence
  Synthetic Oligonucleotide; CTLA4 exon 2; Set C
uggcuuugcucaccaauu

SEQ ID NO: 1535 - RNA, 20 nt, Artificial Sequence
  Synthetic Oligonucleotide; CTLA4 exon 2; Set C
auggcuuugcucaccaauua

SEQ ID NO: 1536 - RNA, 35 nt, Artificial Sequence
  Synthetic Oligonucleotide; CTLA4 exon 2; Set B
ucagugaaauggcuuugcucaccaauuacauaaau

SEQ ID NO: 1537 - RNA, 19 nt, Artificial Sequence
  Synthetic Oligonucleotide; CTLA4 exon 2; Set C
auggcuuugcucaccaauu

SEQ ID NO: 1538 - RNA, 34 nt, Artificial Sequence
  Synthetic Oligonucleotide; CTLA4 exon 2; Set B
ucagugaaauggcuuugcucaccaauuacauaaa

SEQ ID NO: 1539 - RNA, 33 nt, Artificial Sequence
  Synthetic Oligonucleotide; CTLA4 exon 2; Set B
ucagugaaauggcuuugcucaccaauuacauaa

SEQ ID NO: 1540 - RNA, 32 nt, Artificial Sequence
  Synthetic Oligonucleotide; CTLA4 exon 2; Set B
ucagugaaauggcuuugcucaccaauuacaua

SEQ ID NO: 1541 - RNA, 31 nt, Artificial Sequence
  Synthetic Oligonucleotide; CTLA4 exon 2; Set B
ucagugaaauggcuuugcucaccaauuacau

SEQ ID NO: 1542 - RNA, 19 nt, Artificial Sequence
  Synthetic Oligonucleotide; CTLA4 exon 2; Set C
aaauggcuuugcucaccaa

SEQ ID NO: 1543 - RNA, 30 nt, Artificial Sequence
  Synthetic Oligonucleotide; CTLA4 exon 2; Set B
ucagugaaauggcuuugcucaccaauuaca

SEQ ID NO: 1544 - RNA, 29 nt, Artificial Sequence
  Synthetic Oligonucleotide; CTLA4 exon 2; Set B
ucagugaaauggcuuugcucaccaauuac

SEQ ID NO: 1545 - RNA, 27 nt, Artificial Sequence
  Synthetic Oligonucleotide; CTLA4 exon 2; Set B
cagugaaauggcuuugcucaccaauua

SEQ ID NO: 1546 - RNA, 21 nt, Artificial Sequence
  Synthetic Oligonucleotide; CTLA4 exon 2; Set C
ugaaauggcuuugcucaccaa

SEQ ID NO: 1547 - RNA, 26 nt, Artificial Sequence
  Synthetic Oligonucleotide; CTLA4 exon 2; Set B
cagugaaauggcuuugcucaccaauu

SEQ ID NO: 1548 - RNA, 28 nt, Artificial Sequence
  Synthetic Oligonucleotide; CTLA4 exon 2; Set B
ucagugaaauggcuuugcucaccaauua

SEQ ID NO: 1549 - RNA, 22 nt, Artificial Sequence
  Synthetic Oligonucleotide; CTLA4 exon 2; Set B
gugaaauggcuuugcucaccaa

SEQ ID NO: 1550 - RNA, 27 nt, Artificial Sequence
  Synthetic Oligonucleotide; CTLA4 exon 2; Set B
ucagugaaauggcuuugcucaccaauu

SEQ ID NO: 1551 - RNA, 29 nt, Artificial Sequence
  Synthetic Oligonucleotide; CTLA4 exon 2; Set B
cucagugaaauggcuuugcucaccaauua

SEQ ID NO: 1552 - RNA, 25 nt, Artificial Sequence
  Synthetic Oligonucleotide; CTLA4 exon 2; Set B
cagugaaauggcuuugcucaccaau

SEQ ID NO: 1553 - RNA, 28 nt, Artificial Sequence
  Synthetic Oligonucleotide; CTLA4 exon 2; Set B
cucagugaaauggcuuugcucaccaauu

SEQ ID NO: 1554 - RNA, 26 nt, Artificial Sequence
  Synthetic Oligonucleotide; CTLA4 exon 2; Set B
ucagugaaauggcuuugcucaccaau

SEQ ID NO: 1555 - RNA, 27 nt, Artificial Sequence
  Synthetic Oligonucleotide; CTLA4 exon 2; Set B
cucagugaaauggcuuugcucaccaau

SEQ ID NO: 1556 - RNA, 28 nt, Artificial Sequence
  Synthetic Oligonucleotide; CTLA4 exon 2; Set B
acucagugaaauggcuuugcucaccaau

SEQ ID NO: 1557 - RNA, 29 nt, Artificial Sequence
  Synthetic Oligonucleotide; CTLA4 exon 2; Set B
caacucagugaaauggcuuugcucaccaa

SEQ ID NO: 1558 - RNA, 30 nt, Artificial Sequence
  Synthetic Oligonucleotide; CTLA4 exon 2; Set B
ucaacucagugaaauggcuuugcucaccaa

SEQ ID NO: 1559 - RNA, 31 nt, Artificial Sequence
  Synthetic Oligonucleotide; CTLA4 exon 2; Set C
gucaacucagugaaauggcuuugcucaccaa

SEQ ID NO: 1560 - RNA, 32 nt, Artificial Sequence
  Synthetic Oligonucleotide; CTLA4 exon 2; Set C
ugucaacucagugaaauggcuuugcucaccaa

SEQ ID NO: 1561 - RNA, 33 nt, Artificial Sequence
  Synthetic Oligonucleotide; CTLA4 exon 2; Set C
gugucaacucagugaaauggcuuugcucaccaa

SEQ ID NO: 1562 - RNA, 15 nt, Artificial Sequence
  Synthetic Oligonucleotide; CTLA4 exon 2; Set C
acucagugaaauggc

SEQ ID NO: 1563 - RNA, 16 nt, Artificial Sequence
  Synthetic Oligonucleotide; CTLA4 exon 2; Set C
aacucagugaaauggc

SEQ ID NO: 1564 - RNA, 17 nt, Artificial Sequence
  Synthetic Oligonucleotide; CTLA4 exon 2; Set C
caacucagugaaauggc

SEQ ID NO: 1565 - RNA, 15 nt, Artificial Sequence
  Synthetic Oligonucleotide; CTLA4 exon 2; Set C
aacucagugaaaugg

SEQ ID NO: 1566 - RNA, 18 nt, Artificial Sequence
  Synthetic Oligonucleotide; CTLA4 exon 2; Set C
ucaacucagugaaauggc

SEQ ID NO: 1567 - RNA, 16 nt, Artificial Sequence
  Synthetic Oligonucleotide; CTLA4 exon 2; Set C
caacucagugaaaugg

SEQ ID NO: 1568 - RNA, 15 nt, Artificial Sequence
  Synthetic Oligonucleotide; CTLA4 exon 2; Set C
caacucagugaaaug

SEQ ID NO: 1569 - RNA, 17 nt, Artificial Sequence
  Synthetic Oligonucleotide; CTLA4 exon 2; Set C
ucaacucagugaaaugg

SEQ ID NO: 1570 - RNA, 16 nt, Artificial Sequence
  Synthetic Oligonucleotide; CTLA4 exon 2; Set C
ucaacucagugaaaug

SEQ ID NO: 1571 - RNA, 39 nt, Artificial Sequence
  Synthetic Oligonucleotide; CTLA4 exon 2; Set C
caaugcaacaggugucaacucagugaaauggcuuugcuc

SEQ ID NO: 1572 - RNA, 38 nt, Artificial Sequence
  Synthetic Oligonucleotide; CTLA4 exon 2; Set C
caaugcaacaggugucaacucagugaaauggcuuugcu

SEQ ID NO: 1573 - RNA, 37 nt, Artificial Sequence
  Synthetic Oligonucleotide; CTLA4 exon 2; Set C
caaugcaacaggugucaacucagugaaauggcuuugc

SEQ ID NO: 1574 - RNA, 36 nt, Artificial Sequence
  Synthetic Oligonucleotide; CTLA4 exon 2; Set C
caaugcaacaggugucaacucagugaaauggcuuug

SEQ ID NO: 1575 - RNA, 35 nt, Artificial Sequence
  Synthetic Oligonucleotide; CTLA4 exon 2; Set C
caaugcaacaggugucaacucagugaaauggcuuu

SEQ ID NO: 1576 - RNA, 29 nt, Artificial Sequence
  Synthetic Oligonucleotide; CTLA4 exon 2; Set B
ugcaacaggugucaacucagugaaauggc

SEQ ID NO: 1577 - RNA, 34 nt, Artificial Sequence
  Synthetic Oligonucleotide; CTLA4 exon 2; Set C
caaugcaacaggugucaacucagugaaauggcuu

SEQ ID NO: 1578 - RNA, 30 nt, Artificial Sequence
  Synthetic Oligonucleotide; CTLA4 exon 2; Set B
augcaacaggugucaacucagugaaauggc

SEQ ID NO: 1579 - RNA, 28 nt, Artificial Sequence
  Synthetic Oligonucleotide; CTLA4 exon 2; Set B
ugcaacaggugucaacucagugaaaugg

SEQ ID NO: 1580 - RNA, 33 nt, Artificial Sequence
  Synthetic Oligonucleotide; CTLA4 exon 2; Set C
caaugcaacaggugucaacucagugaaauggcu

SEQ ID NO: 1581 - RNA, 27 nt, Artificial Sequence
  Synthetic Oligonucleotide; CTLA4 exon 2; Set B
ugcaacaggugucaacucagugaaaug

SEQ ID NO: 1582 - RNA, 31 nt, Artificial Sequence
  Synthetic Oligonucleotide; CTLA4 exon 2; Set B
aaugcaacaggugucaacucagugaaauggc

SEQ ID NO: 1583 - RNA, 29 nt, Artificial Sequence
  Synthetic Oligonucleotide; CTLA4 exon 2; Set B
augcaacaggugucaacucagugaaaugg

SEQ ID NO: 1584 - RNA, 40 nt, Artificial Sequence
  Synthetic Oligonucleotide; CTLA4 exon 2; Set C
acugcaaugcaacaggugucaacucagugaaauggcuuug

SEQ ID NO: 1585 - RNA, 28 nt, Artificial Sequence
  Synthetic Oligonucleotide; CTLA4 exon 2; Set B
augcaacaggugucaacucagugaaaug

SEQ ID NO: 1586 - RNA, 30 nt, Artificial Sequence
  Synthetic Oligonucleotide; CTLA4 exon 2; Set B
aaugcaacaggugucaacucagugaaaugg

SEQ ID NO: 1587 - RNA, 39 nt, Artificial Sequence
  Synthetic Oligonucleotide; CTLA4 exon 2; Set C
acugcaaugcaacaggugucaacucagugaaauggcuuu

SEQ ID NO: 1588 - RNA, 29 nt, Artificial Sequence
  Synthetic Oligonucleotide; CTLA4 exon 2; Set B
aaugcaacaggugucaacucagugaaaug

SEQ ID NO: 1589 - RNA, 38 nt, Artificial Sequence
  Synthetic Oligonucleotide; CTLA4 exon 2; Set C
acugcaaugcaacaggugucaacucagugaaauggcuu

SEQ ID NO: 1590 - RNA, 37 nt, Artificial Sequence
  Synthetic Oligonucleotide; CTLA4 exon 2; Set C
acugcaaugcaacaggugucaacucagugaaauggcu

SEQ ID NO: 1591 - RNA, 29 nt, Artificial Sequence
  Synthetic Oligonucleotide; CTLA4 exon 2; Set B
caaugcaacaggugucaacucagugaaau

SEQ ID NO: 1592 - RNA, 28 nt, Artificial Sequence
  Synthetic Oligonucleotide; CTLA4 exon 2; Set B
caaugcaacaggugucaacucagugaaa

SEQ ID NO: 1593 - RNA, 27 nt, Artificial Sequence
  Synthetic Oligonucleotide; CTLA4 exon 2; Set B
caaugcaacaggugucaacucagugaa

SEQ ID NO: 1594 - RNA, 21 nt, Artificial Sequence
  Synthetic Oligonucleotide; CTLA4 exon 2; Set B
ugcaacaggugucaacucagu

SEQ ID NO: 1595 - RNA, 37 nt, Artificial Sequence
  Synthetic Oligonucleotide; CTLA4 exon 2; Set C
gacugcaaugcaacaggugucaacucagugaaauggc

SEQ ID NO: 1596 - RNA, 26 nt, Artificial Sequence
  Synthetic Oligonucleotide; CTLA4 exon 2; Set B
caaugcaacaggugucaacucaguga

SEQ ID NO: 1597 - RNA, 20 nt, Artificial Sequence
  Synthetic Oligonucleotide; CTLA4 exon 2; Set C
ugcaacaggugucaacucag

SEQ ID NO: 1598 - RNA, 38 nt, Artificial Sequence
  Synthetic Oligonucleotide; CTLA4 exon 2; Set C
agacugcaaugcaacaggugucaacucagugaaauggc

SEQ ID NO: 1599 - RNA, 36 nt, Artificial Sequence
  Synthetic Oligonucleotide; CTLA4 exon 2; Set C
gacugcaaugcaacaggugucaacucagugaaaugg

SEQ ID NO: 1600 - RNA, 25 nt, Artificial Sequence
  Synthetic Oligonucleotide; CTLA4 exon 2; Set B
caaugcaacaggugucaacucagug

SEQ ID NO: 1601 - RNA, 33 nt, Artificial Sequence
  Synthetic Oligonucleotide; CTLA4 exon 2; Set B
acugcaaugcaacaggugucaacucagugaaau

SEQ ID NO: 1602 - RNA, 21 nt, Artificial Sequence
  Synthetic Oligonucleotide; CTLA4 exon 2; Set C
augcaacaggugucaacucag

SEQ ID NO: 1603 - RNA, 35 nt, Artificial Sequence
  Synthetic Oligonucleotide; CTLA4 exon 2; Set C
gacugcaaugcaacaggugucaacucagugaaaug

SEQ ID NO: 1604 - RNA, 39 nt, Artificial Sequence
  Synthetic Oligonucleotide; CTLA4 exon 2; Set C
aagacugcaaugcaacaggugucaacucagugaaauggc

SEQ ID NO: 1605 - RNA, 37 nt, Artificial Sequence
  Synthetic Oligonucleotide; CTLA4 exon 2; Set C
agacugcaaugcaacaggugucaacucagugaaaugg

SEQ ID NO: 1606 - RNA, 32 nt, Artificial Sequence
  Synthetic Oligonucleotide; CTLA4 exon 2; Set B
acugcaaugcaacaggugucaacucagugaaa

SEQ ID NO: 1607 - RNA, 22 nt, Artificial Sequence
  Synthetic Oligonucleotide; CTLA4 exon 2; Set C
aaugcaacaggugucaacucag

SEQ ID NO: 1608 - RNA, 18 nt, Artificial Sequence
  Synthetic Oligonucleotide; CTLA4 exon 2; Set C
ugcaacaggugucaacuc

SEQ ID NO: 1609 - RNA, 20 nt, Artificial Sequence
  Synthetic Oligonucleotide; CTLA4 exon 2; Set C
augcaacaggugucaacuca

SEQ ID NO: 1610 - RNA, 36 nt, Artificial Sequence
  Synthetic Oligonucleotide; CTLA4 exon 2; Set C
agacugcaaugcaacaggugucaacucagugaaaug

SEQ ID NO: 1611 - RNA, 40 nt, Artificial Sequence
  Synthetic Oligonucleotide; CTLA4 exon 2; Set C
gaagacugcaaugcaacaggugucaacucagugaaauggc

SEQ ID NO: 1612 - RNA, 38 nt, Artificial Sequence
  Synthetic Oligonucleotide; CTLA4 exon 2; Set C
aagacugcaaugcaacaggugucaacucagugaaaugg

SEQ ID NO: 1613 - RNA, 31 nt, Artificial Sequence
  Synthetic Oligonucleotide; CTLA4 exon 2; Set C
acugcaaugcaacaggugucaacucagugaa

SEQ ID NO: 1614 - RNA, 17 nt, Artificial Sequence
  Synthetic Oligonucleotide; CTLA4 exon 2; Set C
ugcaacaggugucaacu

SEQ ID NO: 1615 - RNA, 19 nt, Artificial Sequence
  Synthetic Oligonucleotide; CTLA4 exon 2; Set C
augcaacaggugucaacuc

SEQ ID NO: 1616 - RNA, 21 nt, Artificial Sequence
  Synthetic Oligonucleotide; CTLA4 exon 2; Set C
aaugcaacaggugucaacuca

SEQ ID NO: 1617 - RNA, 37 nt, Artificial Sequence
  Synthetic Oligonucleotide; CTLA4 exon 2; Set B
aagacugcaaugcaacaggugucaacucagugaaaug

SEQ ID NO: 1618 - RNA, 39 nt, Artificial Sequence
  Synthetic Oligonucleotide; CTLA4 exon 2; Set C
gaagacugcaaugcaacaggugucaacucagugaaaugg

SEQ ID NO: 1619 - RNA, 30 nt, Artificial Sequence
  Synthetic Oligonucleotide; CTLA4 exon 2; Set C
acugcaaugcaacaggugucaacucaguga

SEQ ID NO: 1620 - RNA, 16 nt, Artificial Sequence
  Synthetic Oligonucleotide; CTLA4 exon 2; Set C
ugcaacaggugucaac

SEQ ID NO: 1621 - RNA, 18 nt, Artificial Sequence
  Synthetic Oligonucleotide; CTLA4 exon 2; Set C
augcaacaggugucaacu

SEQ ID NO: 1622 - RNA, 20 nt, Artificial Sequence
  Synthetic Oligonucleotide; CTLA4 exon 2; Set C
aaugcaacaggugucaacuc

SEQ ID NO: 1623 - RNA, 38 nt, Artificial Sequence
  Synthetic Oligonucleotide; CTLA4 exon 2; Set C
gaagacugcaaugcaacaggugucaacucagugaaaug

SEQ ID NO: 1624 - RNA, 40 nt, Artificial Sequence
  Synthetic Oligonucleotide; CTLA4 exon 2; Set C
agaagacugcaaugcaacaggugucaacucagugaaaugg

SEQ ID NO: 1625 - RNA, 29 nt, Artificial Sequence
  Synthetic Oligonucleotide; CTLA4 exon 2; Set B
acugcaaugcaacaggugucaacucagug

SEQ ID NO: 1626 - RNA, 15 nt, Artificial Sequence
  Synthetic Oligonucleotide; CTLA4 exon 2; Set C
ugcaacaggugucaa

SEQ ID NO: 1627 - RNA, 17 nt, Artificial Sequence
  Synthetic Oligonucleotide; CTLA4 exon 2; Set C
augcaacaggugucaac

SEQ ID NO: 1628 - RNA, 19 nt, Artificial Sequence
  Synthetic Oligonucleotide; CTLA4 exon 2; Set C
aaugcaacaggugucaacu

SEQ ID NO: 1629 - RNA, 39 nt, Artificial Sequence
  Synthetic Oligonucleotide; CTLA4 exon 2; Set C
agaagacugcaaugcaacaggugucaacucagugaaaug

SEQ ID NO: 1630 - RNA, 16 nt, Artificial Sequence
  Synthetic Oligonucleotide; CTLA4 exon 2; Set C
augcaacaggugucaa

SEQ ID NO: 1631 - RNA, 15 nt, Artificial Sequence
  Synthetic Oligonucleotide; CTLA4 exon 2; Set C
augcaacagguguca

SEQ ID NO: 1632 - RNA, 28 nt, Artificial Sequence
  Synthetic Oligonucleotide; CTLA4 exon 2; Set B
gacugcaaugcaacaggugucaacucag

SEQ ID NO: 1633 - RNA, 29 nt, Artificial Sequence
  Synthetic Oligonucleotide; CTLA4 exon 2; Set B
agacugcaaugcaacaggugucaacucag

SEQ ID NO: 1634 - RNA, 27 nt, Artificial Sequence
  Synthetic Oligonucleotide; CTLA4 exon 2; Set B
gacugcaaugcaacaggugucaacuca

SEQ ID NO: 1635 - RNA, 16 nt, Artificial Sequence
  Synthetic Oligonucleotide; CTLA4 exon 2; Set C
caaugcaacagguguc

SEQ ID NO: 1636 - RNA, 30 nt, Artificial Sequence
  Synthetic Oligonucleotide; CTLA4 exon 2; Set B
aagacugcaaugcaacaggugucaacucag

SEQ ID NO: 1637 - RNA, 26 nt, Artificial Sequence
  Synthetic Oligonucleotide; CTLA4 exon 2; Set B
gacugcaaugcaacaggugucaacuc

SEQ ID NO: 1638 - RNA, 28 nt, Artificial Sequence
  Synthetic Oligonucleotide; CTLA4 exon 2; Set B
agacugcaaugcaacaggugucaacuca

SEQ ID NO: 1639 - RNA, 25 nt, Artificial Sequence
  Synthetic Oligonucleotide; CTLA4 exon 2; Set B
gacugcaaugcaacaggugucaacu

SEQ ID NO: 1640 - RNA, 27 nt, Artificial Sequence
  Synthetic Oligonucleotide; CTLA4 exon 2; Set B
agacugcaaugcaacaggugucaacuc

SEQ ID NO: 1641 - RNA, 29 nt, Artificial Sequence
  Synthetic Oligonucleotide; CTLA4 exon 2; Set B
aagacugcaaugcaacaggugucaacuca

SEQ ID NO: 1642 - RNA, 26 nt, Artificial Sequence
  Synthetic Oligonucleotide; CTLA4 exon 2; Set B
agacugcaaugcaacaggugucaacu

SEQ ID NO: 1643 - RNA, 28 nt, Artificial Sequence
  Synthetic Oligonucleotide; CTLA4 exon 2; Set B
aagacugcaaugcaacaggugucaacuc

SEQ ID NO: 1644 - RNA, 30 nt, Artificial Sequence
  Synthetic Oligonucleotide; CTLA4 exon 2; Set B
gaagacugcaaugcaacaggugucaacuca

SEQ ID NO: 1645 - RNA, 29 nt, Artificial Sequence
  Synthetic Oligonucleotide; CTLA4 exon 2; Set B
gaagacugcaaugcaacaggugucaacuc

SEQ ID NO: 1646 - RNA, 31 nt, Artificial Sequence
  Synthetic Oligonucleotide; CTLA4 exon 2; Set B
agaagacugcaaugcaacaggugucaacuca

SEQ ID NO: 1647 - RNA, 20 nt, Artificial Sequence
  Synthetic Oligonucleotide; CTLA4 exon 2; Set C
acugcaaugcaacagguguc

SEQ ID NO: 1648 - RNA, 19 nt, Artificial Sequence
  Synthetic Oligonucleotide; CTLA4 exon 2; Set C
acugcaaugcaacaggugu

SEQ ID NO: 1649 - RNA, 18 nt, Artificial Sequence
  Synthetic Oligonucleotide; CTLA4 exon 2; Set C
acugcaaugcaacaggug

SEQ ID NO: 1650 - RNA, 15 nt, Artificial Sequence
  Synthetic Oligonucleotide; CTLA4 exon 2; Set C
ucaugcuccuucaug

SEQ ID NO: 1651 - RNA, 20 nt, Artificial Sequence
  Synthetic Oligonucleotide; CTLA4 exon 2; Set C
gaacucaugcuccuucaugg

SEQ ID NO: 1652 - RNA, 21 nt, Artificial Sequence
  Synthetic Oligonucleotide; CTLA4 exon 2; Set C
ugaacucaugcuccuucaugg

SEQ ID NO: 1653 - RNA, 21 nt, Artificial Sequence
  Synthetic Oligonucleotide; CTLA4 exon 2; Set C
gugaacucaugcuccuucaug

SEQ ID NO: 1654 - RNA, 22 nt, Artificial Sequence
  Synthetic Oligonucleotide; CTLA4 exon 2; Set C
agugaacucaugcuccuucaug

SEQ ID NO: 1655 - RNA, 21 nt, Artificial Sequence
  Synthetic Oligonucleotide; CTLA4 exon 2; Set C
agugaacucaugcuccuucau

SEQ ID NO: 1656 - RNA, 23 nt, Artificial Sequence
  Synthetic Oligonucleotide; CTLA4 exon 2; Set A
cagugaacucaugcuccuucaug

SEQ ID NO: 1657 - RNA, 15 nt, Artificial Sequence
  Synthetic Oligonucleotide; CTLA4 exon 2; Set C
gaacucaugcuccuu

SEQ ID NO: 1658 - RNA, 20 nt, Artificial Sequence
  Synthetic Oligonucleotide; CTLA4 exon 2; Set C
agugaacucaugcuccuuca

SEQ ID NO: 1659 - RNA, 22 nt, Artificial Sequence
  Synthetic Oligonucleotide; CTLA4 exon 2; Set C
cagugaacucaugcuccuucau

SEQ ID NO: 1660 - RNA, 16 nt, Artificial Sequence
  Synthetic Oligonucleotide; CTLA4 exon 2; Set C
ugaacucaugcuccuu

SEQ ID NO: 1661 - RNA, 19 nt, Artificial Sequence
  Synthetic Oligonucleotide; CTLA4 exon 2; Set C
agugaacucaugcuccuuc

SEQ ID NO: 1662 - RNA, 21 nt, Artificial Sequence
  Synthetic Oligonucleotide; CTLA4 exon 2; Set C
cagugaacucaugcuccuuca

SEQ ID NO: 1663 - RNA, 23 nt, Artificial Sequence
  Synthetic Oligonucleotide; CTLA4 exon 2; Set A
ucagugaacucaugcuccuucau

SEQ ID NO: 1664 - RNA, 20 nt, Artificial Sequence
  Synthetic Oligonucleotide; CTLA4 exon 2; Set C
cagugaacucaugcuccuuc

SEQ ID NO: 1665 - RNA, 22 nt, Artificial Sequence
  Synthetic Oligonucleotide; CTLA4 exon 2; Set A
ucagugaacucaugcuccuuca

SEQ ID NO: 1666 - RNA, 21 nt, Artificial Sequence
  Synthetic Oligonucleotide; CTLA4 exon 2; Set C
ucagugaacucaugcuccuuc

SEQ ID NO: 1667 - RNA, 28 nt, Artificial Sequence
  Synthetic Oligonucleotide; CTLA4 exon 2; Set A
aaagccaaagggaacucagugaacucau

SEQ ID NO: 1668 - RNA, 30 nt, Artificial Sequence
  Synthetic Oligonucleotide; CTLA4 exon 2; Set A
gaaaagccaaagggaacucagugaacucau

SEQ ID NO: 1669 - RNA, 31 nt, Artificial Sequence
  Synthetic Oligonucleotide; CTLA4 exon 2; Set A
ggaaaagccaaagggaacucagugaacucau

SEQ ID NO: 1670 - RNA, 32 nt, Artificial Sequence
  Synthetic Oligonucleotide; CTLA4 exon 2; Set A
uggaaaagccaaagggaacucagugaacucau

SEQ ID NO: 1671 - RNA, 33 nt, Artificial Sequence
  Synthetic Oligonucleotide; CTLA4 exon 2; Set A
auggaaaagccaaagggaacucagugaacucau

SEQ ID NO: 1672 - RNA, 34 nt, Artificial Sequence
  Synthetic Oligonucleotide; CTLA4 exon 2; Set A
cauggaaaagccaaagggaacucagugaacucau

SEQ ID NO: 1673 - RNA, 27 nt, Artificial Sequence
  Synthetic Oligonucleotide; CTLA4 exon 2; Set A
cauggaaaagccaaagggaacucagug

SEQ ID NO: 1674 - RNA, 34 nt, Artificial Sequence
  Synthetic Oligonucleotide; CTLA4 exon 2; Set A
uugcuagcauggaaaagccaaagggaacucagug

SEQ ID NO: 1675 - RNA, 35 nt, Artificial Sequence
  Synthetic Oligonucleotide; CTLA4 exon 2; Set A
auugcuagcauggaaaagccaaagggaacucagug

SEQ ID NO: 1676 - RNA, 36 nt, Artificial Sequence
  Synthetic Oligonucleotide; CTLA4 exon 2; Set C
cauugcuagcauggaaaagccaaagggaacucagug

SEQ ID NO: 1677 - RNA, 37 nt, Artificial Sequence
  Synthetic Oligonucleotide; CTLA4 exon 2; Set C
gcauugcuagcauggaaaagccaaagggaacucagug

SEQ ID NO: 1678 - RNA, 38 nt, Artificial Sequence
  Synthetic Oligonucleotide; CTLA4 exon 2; Set C
ugcauugcuagcauggaaaagccaaagggaacucagug

SEQ ID NO: 1679 - RNA, 37 nt, Artificial Sequence
  Synthetic Oligonucleotide; CTLA4 exon 2; Set C
cuggccaguaccacagcaggcugggccacgugcauug

SEQ ID NO: 1680 - RNA, 36 nt, Artificial Sequence
  Synthetic Oligonucleotide; CTLA4 exon 2; Set C
cuggccaguaccacagcaggcugggccacgugcauu

SEQ ID NO: 1681 - RNA, 22 nt, Artificial Sequence
  Synthetic Oligonucleotide; CTLA4 exon 2; Set C
uggcgaugccucggcugcuggc

SEQ ID NO: 1682 - RNA, 21 nt, Artificial Sequence
  Synthetic Oligonucleotide; CTLA4 exon 2; Set C
uggcgaugccucggcugcugg

SEQ ID NO: 1683 - RNA, 20 nt, Artificial Sequence
  Synthetic Oligonucleotide; CTLA4 exon 2; Set C
uggcgaugccucggcugcug

SEQ ID NO: 1684 - RNA, 24 nt, Artificial Sequence
  Synthetic Oligonucleotide; CTLA4 exon 2; Set A
augcauacucacacacaaagcugg

SEQ ID NO: 1685 - RNA, 40 nt, Artificial Sequence
  Synthetic Oligonucleotide; CTLA4 exon 2; Set C
guggcuuugccuggagaugcauacucacacacaaagcugg

SEQ ID NO: 1686 - RNA, 15 nt, Artificial Sequence
  Synthetic Oligonucleotide; CTLA4 exon 2; Set C
gucaccuggcuguca

SEQ ID NO: 1687 - RNA, 16 nt, Artificial Sequence
  Synthetic Oligonucleotide; CTLA4 exon 2; Set C
agucaccuggcuguca

SEQ ID NO: 1688 - RNA, 15 nt, Artificial Sequence
  Synthetic Oligonucleotide; CTLA4 exon 2; Set C
agucaccuggcuguc

SEQ ID NO: 1689 - RNA, 17 nt, Artificial Sequence
  Synthetic Oligonucleotide; CTLA4 exon 2; Set A
cagucaccuggcuguca

SEQ ID NO: 1690 - RNA, 16 nt, Artificial Sequence
  Synthetic Oligonucleotide; CTLA4 exon 2; Set C
cagucaccuggcuguc

SEQ ID NO: 1691 - RNA, 18 nt, Artificial Sequence
  Synthetic Oligonucleotide; CTLA4 exon 2; Set A
ucagucaccuggcuguca

SEQ ID NO: 1692 - RNA, 17 nt, Artificial Sequence
  Synthetic Oligonucleotide; CTLA4 exon 2; Set C
ucagucaccuggcuguc

SEQ ID NO: 1693 - RNA, 19 nt, Artificial Sequence
  Synthetic Oligonucleotide; CTLA4 exon 2; Set A
uucagucaccuggcuguca

SEQ ID NO: 1694 - RNA, 18 nt, Artificial Sequence
  Synthetic Oligonucleotide; CTLA4 exon 2; Set C
uucagucaccuggcuguc

SEQ ID NO: 1695 - RNA, 32 nt, Artificial Sequence
  Synthetic Oligonucleotide; CTLA4 exon 2; Set C
guugccgcacagacuucagucaccuggcuguc

SEQ ID NO: 1696 - RNA, 34 nt, Artificial Sequence
  Synthetic Oligonucleotide; CTLA4 exon 2; Set C
gguugccgcacagacuucagucaccuggcuguca

SEQ ID NO: 1697 - RNA, 33 nt, Artificial Sequence
  Synthetic Oligonucleotide; CTLA4 exon 2; Set C
gguugccgcacagacuucagucaccuggcuguc

SEQ ID NO: 1698 - RNA, 35 nt, Artificial Sequence
  Synthetic Oligonucleotide; CTLA4 exon 2; Set C
agguugccgcacagacuucagucaccuggcuguca

SEQ ID NO: 1699 - RNA, 28 nt, Artificial Sequence
  Synthetic Oligonucleotide; CTLA4 exon 2; Set C
uugccgcacagacuucagucaccuggcu

SEQ ID NO: 1700 - RNA, 34 nt, Artificial Sequence
  Synthetic Oligonucleotide; CTLA4 exon 2; Set C
agguugccgcacagacuucagucaccuggcuguc

SEQ ID NO: 1701 - RNA, 36 nt, Artificial Sequence
  Synthetic Oligonucleotide; CTLA4 exon 2; Set C
uagguugccgcacagacuucagucaccuggcuguca

SEQ ID NO: 1702 - RNA, 35 nt, Artificial Sequence
  Synthetic Oligonucleotide; CTLA4 exon 2; Set C
uagguugccgcacagacuucagucaccuggcuguc

SEQ ID NO: 1703 - RNA, 35 nt, Artificial Sequence
  Synthetic Oligonucleotide; CTLA4 exon 2; Set C
guagguugccgcacagacuucagucaccuggcugu

SEQ ID NO: 1704 - RNA, 36 nt, Artificial Sequence
  Synthetic Oligonucleotide; CTLA4 exon 2; Set C
uguagguugccgcacagacuucagucaccuggcugu

SEQ ID NO: 1705 - RNA, 34 nt, Artificial Sequence
  Synthetic Oligonucleotide; CTLA4 exon 2; Set C
guagguugccgcacagacuucagucaccuggcug

SEQ ID NO: 1706 - RNA, 37 nt, Artificial Sequence
  Synthetic Oligonucleotide; CTLA4 exon 2; Set C
auguagguugccgcacagacuucagucaccuggcugu

SEQ ID NO: 1707 - RNA, 35 nt, Artificial Sequence
  Synthetic Oligonucleotide; CTLA4 exon 2; Set C
uguagguugccgcacagacuucagucaccuggcug

SEQ ID NO: 1708 - RNA, 33 nt, Artificial Sequence
  Synthetic Oligonucleotide; CTLA4 exon 2; Set C
guagguugccgcacagacuucagucaccuggcu

SEQ ID NO: 1709 - RNA, 23 nt, Artificial Sequence
  Synthetic Oligonucleotide; CTLA4 exon 2; Set C
uugccgcacagacuucagucacc

SEQ ID NO: 1710 - RNA, 38 nt, Artificial Sequence
  Synthetic Oligonucleotide; CTLA4 exon 2; Set C
cauguagguugccgcacagacuucagucaccuggcugu

SEQ ID NO: 1711 - RNA, 36 nt, Artificial Sequence
  Synthetic Oligonucleotide; CTLA4 exon 2; Set C
auguagguugccgcacagacuucagucaccuggcug

SEQ ID NO: 1712 - RNA, 34 nt, Artificial Sequence
  Synthetic Oligonucleotide; CTLA4 exon 2; Set C
uguagguugccgcacagacuucagucaccuggcu

SEQ ID NO: 1713 - RNA, 24 nt, Artificial Sequence
  Synthetic Oligonucleotide; CTLA4 exon 2; Set C
guugccgcacagacuucagucacc

SEQ ID NO: 1714 - RNA, 39 nt, Artificial Sequence
  Synthetic Oligonucleotide; CTLA4 exon 2; Set C
ucauguagguugccgcacagacuucagucaccuggcugu

SEQ ID NO: 1715 - RNA, 37 nt, Artificial Sequence
  Synthetic Oligonucleotide; CTLA4 exon 2; Set C
cauguagguugccgcacagacuucagucaccuggcug

SEQ ID NO: 1716 - RNA, 35 nt, Artificial Sequence
  Synthetic Oligonucleotide; CTLA4 exon 2; Set C
auguagguugccgcacagacuucagucaccuggcu

SEQ ID NO: 1717 - RNA, 25 nt, Artificial Sequence
  Synthetic Oligonucleotide; CTLA4 exon 2; Set C
gguugccgcacagacuucagucacc

SEQ ID NO: 1718 - RNA, 20 nt, Artificial Sequence
  Synthetic Oligonucleotide; CTLA4 exon 2; Set A
uugccgcacagacuucaguc

SEQ ID NO: 1719 - RNA, 38 nt, Artificial Sequence
  Synthetic Oligonucleotide; CTLA4 exon 2; Set C
ucauguagguugccgcacagacuucagucaccuggcug

SEQ ID NO: 1720 - RNA, 36 nt, Artificial Sequence
  Synthetic Oligonucleotide; CTLA4 exon 2; Set C
cauguagguugccgcacagacuucagucaccuggcu

SEQ ID NO: 1721 - RNA, 26 nt, Artificial Sequence
  Synthetic Oligonucleotide; CTLA4 exon 2; Set C
agguugccgcacagacuucagucacc

SEQ ID NO: 1722 - RNA, 19 nt, Artificial Sequence
  Synthetic Oligonucleotide; CTLA4 exon 2; Set A
uugccgcacagacuucagu

SEQ ID NO: 1723 - RNA, 37 nt, Artificial Sequence
  Synthetic Oligonucleotide; CTLA4 exon 2; Set C
ucauguagguugccgcacagacuucagucaccuggcu

SEQ ID NO: 1724 - RNA, 18 nt, Artificial Sequence
  Synthetic Oligonucleotide; CTLA4 exon 2; Set C
uugccgcacagacuucag

SEQ ID NO: 1725 - RNA, 28 nt, Artificial Sequence
  Synthetic Oligonucleotide; CTLA4 exon 2; Set C
guagguugccgcacagacuucagucacc

SEQ ID NO: 1726 - RNA, 27 nt, Artificial Sequence
  Synthetic Oligonucleotide; CTLA4 exon 2; Set C
guagguugccgcacagacuucagucac

SEQ ID NO: 1727 - RNA, 17 nt, Artificial Sequence
  Synthetic Oligonucleotide; CTLA4 exon 2; Set C
uugccgcacagacuuca

SEQ ID NO: 1728 - RNA, 19 nt, Artificial Sequence
  Synthetic Oligonucleotide; CTLA4 exon 2; Set A
guugccgcacagacuucag

SEQ ID NO: 1729 - RNA, 26 nt, Artificial Sequence
  Synthetic Oligonucleotide; CTLA4 exon 2; Set C
guagguugccgcacagacuucaguca

SEQ ID NO: 1730 - RNA, 28 nt, Artificial Sequence
  Synthetic Oligonucleotide; CTLA4 exon 2; Set C
uguagguugccgcacagacuucagucac

SEQ ID NO: 1731 - RNA, 18 nt, Artificial Sequence
  Synthetic Oligonucleotide; CTLA4 exon 2; Set A
guugccgcacagacuuca

SEQ ID NO: 1732 - RNA, 20 nt, Artificial Sequence
  Synthetic Oligonucleotide; CTLA4 exon 2; Set A
gguugccgcacagacuucag

SEQ ID NO: 1733 - RNA, 27 nt, Artificial Sequence
  Synthetic Oligonucleotide; CTLA4 exon 2; Set C
uguagguugccgcacagacuucaguca

SEQ ID NO: 1734 - RNA, 29 nt, Artificial Sequence
  Synthetic Oligonucleotide; CTLA4 exon 2; Set C
auguagguugccgcacagacuucagucac

SEQ ID NO: 1735 - RNA, 25 nt, Artificial Sequence
  Synthetic Oligonucleotide; CTLA4 exon 2; Set C
guagguugccgcacagacuucaguc

SEQ ID NO: 1736 - RNA, 17 nt, Artificial Sequence
  Synthetic Oligonucleotide; CTLA4 exon 2; Set C
guugccgcacagacuuc

SEQ ID NO: 1737 - RNA, 19 nt, Artificial Sequence
  Synthetic Oligonucleotide; CTLA4 exon 2; Set A
gguugccgcacagacuuca

SEQ ID NO: 1738 - RNA, 21 nt, Artificial Sequence
  Synthetic Oligonucleotide; CTLA4 exon 2; Set A
agguugccgcacagacuucag

SEQ ID NO: 1739 - RNA, 31 nt, Artificial Sequence
  Synthetic Oligonucleotide; CTLA4 exon 2; Set C
cauguagguugccgcacagacuucagucacc

SEQ ID NO: 1740 - RNA, 24 nt, Artificial Sequence
  Synthetic Oligonucleotide; CTLA4 exon 2; Set C
guagguugccgcacagacuucagu

SEQ ID NO: 1741 - RNA, 28 nt, Artificial Sequence
  Synthetic Oligonucleotide; CTLA4 exon 2; Set C
auguagguugccgcacagacuucaguca

SEQ ID NO: 1742 - RNA, 30 nt, Artificial Sequence
  Synthetic Oligonucleotide; CTLA4 exon 2; Set C
cauguagguugccgcacagacuucagucac

SEQ ID NO: 1743 - RNA, 26 nt, Artificial Sequence
  Synthetic Oligonucleotide; CTLA4 exon 2; Set C
uguagguugccgcacagacuucaguc

SEQ ID NO: 1744 - RNA, 18 nt, Artificial Sequence
  Synthetic Oligonucleotide; CTLA4 exon 2; Set A
gguugccgcacagacuuc

SEQ ID NO: 1745 - RNA, 20 nt, Artificial Sequence
  Synthetic Oligonucleotide; CTLA4 exon 2; Set A
agguugccgcacagacuuca

SEQ ID NO: 1746 - RNA, 22 nt, Artificial Sequence
  Synthetic Oligonucleotide; CTLA4 exon 2; Set A
uagguugccgcacagacuucag

SEQ ID NO: 1747 - RNA, 32 nt, Artificial Sequence
  Synthetic Oligonucleotide; CTLA4 exon 2; Set C
ucauguagguugccgcacagacuucagucacc

SEQ ID NO: 1748 - RNA, 29 nt, Artificial Sequence
  Synthetic Oligonucleotide; CTLA4 exon 2; Set C
cauguagguugccgcacagacuucaguca

SEQ ID NO: 1749 - RNA, 25 nt, Artificial Sequence
  Synthetic Oligonucleotide; CTLA4 exon 2; Set C
uguagguugccgcacagacuucagu

SEQ ID NO: 1750 - RNA, 31 nt, Artificial Sequence
  Synthetic Oligonucleotide; CTLA4 exon 2; Set C
ucauguagguugccgcacagacuucagucac

SEQ ID NO: 1751 - RNA, 27 nt, Artificial Sequence
  Synthetic Oligonucleotide; CTLA4 exon 2; Set C
auguagguugccgcacagacuucaguc

SEQ ID NO: 1752 - RNA, 19 nt, Artificial Sequence
  Synthetic Oligonucleotide; CTLA4 exon 2; Set A
agguugccgcacagacuuc

SEQ ID NO: 1753 - RNA, 21 nt, Artificial Sequence
  Synthetic Oligonucleotide; CTLA4 exon 2; Set A
uagguugccgcacagacuuca

SEQ ID NO: 1754 - RNA, 30 nt, Artificial Sequence
  Synthetic Oligonucleotide; CTLA4 exon 2; Set C
ucauguagguugccgcacagacuucaguca

SEQ ID NO: 1755 - RNA, 26 nt, Artificial Sequence
  Synthetic Oligonucleotide; CTLA4 exon 2; Set C
auguagguugccgcacagacuucagu

SEQ ID NO: 1756 - RNA, 28 nt, Artificial Sequence
  Synthetic Oligonucleotide; CTLA4 exon 2; Set C
cauguagguugccgcacagacuucaguc

SEQ ID NO: 1757 - RNA, 20 nt, Artificial Sequence
  Synthetic Oligonucleotide; CTLA4 exon 2; Set A
uagguugccgcacagacuuc

SEQ ID NO: 1758 - RNA, 27 nt, Artificial Sequence
  Synthetic Oligonucleotide; CTLA4 exon 2; Set C
cauguagguugccgcacagacuucagu

SEQ ID NO: 1759 - RNA, 29 nt, Artificial Sequence
  Synthetic Oligonucleotide; CTLA4 exon 2; Set C
ucauguagguugccgcacagacuucaguc

SEQ ID NO: 1760 - RNA, 28 nt, Artificial Sequence
  Synthetic Oligonucleotide; CTLA4 exon 2; Set C
ucauguagguugccgcacagacuucagu

SEQ ID NO: 1761 - RNA, 39 nt, Artificial Sequence
  Synthetic Oligonucleotide; CTLA4 exon 2; Set C
uuccccaucauguagguugccgcacagacuucagucacc

SEQ ID NO: 1762 - RNA, 34 nt, Artificial Sequence
  Synthetic Oligonucleotide; CTLA4 exon 2; Set C
uuccccaucauguagguugccgcacagacuucag

SEQ ID NO: 1763 - RNA, 33 nt, Artificial Sequence
  Synthetic Oligonucleotide; CTLA4 exon 2; Set C
uuccccaucauguagguugccgcacagacuuca

SEQ ID NO: 1764 - RNA, 35 nt, Artificial Sequence
  Synthetic Oligonucleotide; CTLA4 exon 2; Set C
auuccccaucauguagguugccgcacagacuucag

SEQ ID NO: 1765 - RNA, 32 nt, Artificial Sequence
  Synthetic Oligonucleotide; CTLA4 exon 2; Set C
uuccccaucauguagguugccgcacagacuuc

SEQ ID NO: 1766 - RNA, 34 nt, Artificial Sequence
  Synthetic Oligonucleotide; CTLA4 exon 2; Set C
auuccccaucauguagguugccgcacagacuuca

SEQ ID NO: 1767 - RNA, 36 nt, Artificial Sequence
  Synthetic Oligonucleotide; CTLA4 exon 2; Set C
cauuccccaucauguagguugccgcacagacuucag

SEQ ID NO: 1768 - RNA, 33 nt, Artificial Sequence
  Synthetic Oligonucleotide; CTLA4 exon 2; Set C
auuccccaucauguagguugccgcacagacuuc

SEQ ID NO: 1769 - RNA, 35 nt, Artificial Sequence
  Synthetic Oligonucleotide; CTLA4 exon 2; Set C
cauuccccaucauguagguugccgcacagacuuca

SEQ ID NO: 1770 - RNA, 34 nt, Artificial Sequence
  Synthetic Oligonucleotide; CTLA4 exon 2; Set C
cauuccccaucauguagguugccgcacagacuuc

SEQ ID NO: 1771 - RNA, 36 nt, Artificial Sequence
  Synthetic Oligonucleotide; CTLA4 exon 2; Set C
ucauuccccaucauguagguugccgcacagacuuca

SEQ ID NO: 1772 - RNA, 35 nt, Artificial Sequence
  Synthetic Oligonucleotide; CTLA4 exon 2; Set C
ucauuccccaucauguagguugccgcacagacuuc

SEQ ID NO: 1773 - RNA, 36 nt, Artificial Sequence
  Synthetic Oligonucleotide; CTLA4 exon 2; Set C
cucauuccccaucauguagguugccgcacagacuuc

SEQ ID NO: 1774 - RNA, 15 nt, Artificial Sequence
  Synthetic Oligonucleotide; CTLA4 exon 2; Set C
auuccccaucaugua

SEQ ID NO: 1775 - RNA, 15 nt, Artificial Sequence
  Synthetic Oligonucleotide; CTLA4 exon 2; Set C
cauuccccaucaugu

SEQ ID NO: 1776 - RNA, 16 nt, Artificial Sequence
  Synthetic Oligonucleotide; CTLA4 exon 2; Set C
ucauuccccaucaugu

SEQ ID NO: 1777 - RNA, 15 nt, Artificial Sequence
  Synthetic Oligonucleotide; CTLA4 exon 2; Set C
ucauuccccaucaug

SEQ ID NO: 1778 - RNA, 17 nt, Artificial Sequence
  Synthetic Oligonucleotide; CTLA4 exon 2; Set C
cucauuccccaucaugu

SEQ ID NO: 1779 - RNA, 16 nt, Artificial Sequence
  Synthetic Oligonucleotide; CTLA4 exon 2; Set C
cucauuccccaucaug

SEQ ID NO: 1780 - RNA, 18 nt, Artificial Sequence
  Synthetic Oligonucleotide; CTLA4 exon 2; Set C
acucauuccccaucaugu

SEQ ID NO: 1781 - RNA, 15 nt, Artificial Sequence
  Synthetic Oligonucleotide; CTLA4 exon 2; Set C
cucauuccccaucau

SEQ ID NO: 1782 - RNA, 17 nt, Artificial Sequence
  Synthetic Oligonucleotide; CTLA4 exon 2; Set C
acucauuccccaucaug

SEQ ID NO: 1783 - RNA, 32 nt, Artificial Sequence
  Synthetic Oligonucleotide; CTLA4 exon 2; Set C
gaaggucaacucauuccccaucauguagguug

SEQ ID NO: 1784 - RNA, 18 nt, Artificial Sequence
  Synthetic Oligonucleotide; CTLA4 exon 2; Set C
aacucauuccccaucaug

SEQ ID NO: 1785 - RNA, 31 nt, Artificial Sequence
  Synthetic Oligonucleotide; CTLA4 exon 2; Set C
gaaggucaacucauuccccaucauguagguu

SEQ ID NO: 1786 - RNA, 33 nt, Artificial Sequence
  Synthetic Oligonucleotide; CTLA4 exon 2; Set C
ggaaggucaacucauuccccaucauguagguug

SEQ ID NO: 1787 - RNA, 32 nt, Artificial Sequence
  Synthetic Oligonucleotide; CTLA4 exon 2; Set C
ggaaggucaacucauuccccaucauguagguu

SEQ ID NO: 1788 - RNA, 30 nt, Artificial Sequence
  Synthetic Oligonucleotide; CTLA4 exon 2; Set C
gaaggucaacucauuccccaucauguaggu

SEQ ID NO: 1789 - RNA, 31 nt, Artificial Sequence
  Synthetic Oligonucleotide; CTLA4 exon 2; Set C
ggaaggucaacucauuccccaucauguaggu

SEQ ID NO: 1790 - RNA, 29 nt, Artificial Sequence
  Synthetic Oligonucleotide; CTLA4 exon 2; Set A
gaaggucaacucauuccccaucauguagg

SEQ ID NO: 1791 - RNA, 21 nt, Artificial Sequence
  Synthetic Oligonucleotide; CTLA4 exon 2; Set C
gucaacucauuccccaucaug

SEQ ID NO: 1792 - RNA, 15 nt, Artificial Sequence
  Synthetic Oligonucleotide; CTLA4 exon 2; Set C
aacucauuccccauc

SEQ ID NO: 1793 - RNA, 28 nt, Artificial Sequence
  Synthetic Oligonucleotide; CTLA4 exon 2; Set A
gaaggucaacucauuccccaucauguag

SEQ ID NO: 1794 - RNA, 30 nt, Artificial Sequence
  Synthetic Oligonucleotide; CTLA4 exon 2; Set C
ggaaggucaacucauuccccaucauguagg

SEQ ID NO: 1795 - RNA, 16 nt, Artificial Sequence
  Synthetic Oligonucleotide; CTLA4 exon 2; Set C
caacucauuccccauc

SEQ ID NO: 1796 - RNA, 29 nt, Artificial Sequence
  Synthetic Oligonucleotide; CTLA4 exon 2; Set A
ggaaggucaacucauuccccaucauguag

SEQ ID NO: 1797 - RNA, 25 nt, Artificial Sequence
  Synthetic Oligonucleotide; CTLA4 exon 2; Set A
aaggucaacucauuccccaucaugu

SEQ ID NO: 1798 - RNA, 17 nt, Artificial Sequence
  Synthetic Oligonucleotide; CTLA4 exon 2; Set C
ucaacucauuccccauc

SEQ ID NO: 1799 - RNA, 24 nt, Artificial Sequence
  Synthetic Oligonucleotide; CTLA4 exon 2; Set A
aaggucaacucauuccccaucaug

SEQ ID NO: 1800 - RNA, 18 nt, Artificial Sequence
  Synthetic Oligonucleotide; CTLA4 exon 2; Set C
gucaacucauuccccauc

SEQ ID NO: 1801 - RNA, 19 nt, Artificial Sequence
  Synthetic Oligonucleotide; CTLA4 exon 2; Set C
ggucaacucauuccccauc

SEQ ID NO: 1802 - RNA, 20 nt, Artificial Sequence
  Synthetic Oligonucleotide; CTLA4 exon 2; Set C
aggucaacucauuccccauc

SEQ ID NO: 1803 - RNA, 21 nt, Artificial Sequence
  Synthetic Oligonucleotide; CTLA4 exon 2; Set C
aaggucaacucauuccccauc

SEQ ID NO: 1804 - RNA, 37 nt, Artificial Sequence
  Synthetic Oligonucleotide; CTLA4 exon 2; Set C
aaucaucuaggaaggucaacucauuccccaucaugua

SEQ ID NO: 1805 - RNA, 38 nt, Artificial Sequence
  Synthetic Oligonucleotide; CTLA4 exon 2; Set C
gaaucaucuaggaaggucaacucauuccccaucaugua

SEQ ID NO: 1806 - RNA, 36 nt, Artificial Sequence
  Synthetic Oligonucleotide; CTLA4 exon 2; Set C
aaucaucuaggaaggucaacucauuccccaucaugu

SEQ ID NO: 1807 - RNA, 39 nt, Artificial Sequence
  Synthetic Oligonucleotide; CTLA4 exon 2; Set C
ggaaucaucuaggaaggucaacucauuccccaucaugua

SEQ ID NO: 1808 - RNA, 35 nt, Artificial Sequence
  Synthetic Oligonucleotide; CTLA4 exon 2; Set A
aaucaucuaggaaggucaacucauuccccaucaug

SEQ ID NO: 1809 - RNA, 37 nt, Artificial Sequence
  Synthetic Oligonucleotide; CTLA4 exon 2; Set C
gaaucaucuaggaaggucaacucauuccccaucaugu

SEQ ID NO: 1810 - RNA, 40 nt, Artificial Sequence
  Synthetic Oligonucleotide; CTLA4 exon 2; Set C
uggaaucaucuaggaaggucaacucauuccccaucaugua

SEQ ID NO: 1811 - RNA, 34 nt, Artificial Sequence
  Synthetic Oligonucleotide; CTLA4 exon 2; Set A
aaucaucuaggaaggucaacucauuccccaucau

SEQ ID NO: 1812 - RNA, 36 nt, Artificial Sequence
  Synthetic Oligonucleotide; CTLA4 exon 2; Set C
gaaucaucuaggaaggucaacucauuccccaucaug

SEQ ID NO: 1813 - RNA, 38 nt, Artificial Sequence
  Synthetic Oligonucleotide; CTLA4 exon 2; Set C
ggaaucaucuaggaaggucaacucauuccccaucaugu

SEQ ID NO: 1814 - RNA, 33 nt, Artificial Sequence
  Synthetic Oligonucleotide; CTLA4 exon 2; Set C
aaucaucuaggaaggucaacucauuccccauca

SEQ ID NO: 1815 - RNA, 35 nt, Artificial Sequence
  Synthetic Oligonucleotide; CTLA4 exon 2; Set C
gaaucaucuaggaaggucaacucauuccccaucau

SEQ ID NO: 1816 - RNA, 37 nt, Artificial Sequence
  Synthetic Oligonucleotide; CTLA4 exon 2; Set C
ggaaucaucuaggaaggucaacucauuccccaucaug

SEQ ID NO: 1817 - RNA, 39 nt, Artificial Sequence
  Synthetic Oligonucleotide; CTLA4 exon 2; Set C
uggaaucaucuaggaaggucaacucauuccccaucaugu

SEQ ID NO: 1818 - RNA, 34 nt, Artificial Sequence
  Synthetic Oligonucleotide; CTLA4 exon 2; Set C
gaaucaucuaggaaggucaacucauuccccauca

SEQ ID NO: 1819 - RNA, 36 nt, Artificial Sequence
  Synthetic Oligonucleotide; CTLA4 exon 2; Set C
ggaaucaucuaggaaggucaacucauuccccaucau

SEQ ID NO: 1820 - RNA, 38 nt, Artificial Sequence
  Synthetic Oligonucleotide; CTLA4 exon 2; Set C
uggaaucaucuaggaaggucaacucauuccccaucaug

SEQ ID NO: 1821 - RNA, 40 nt, Artificial Sequence
  Synthetic Oligonucleotide; CTLA4 exon 2; Set C
auggaaucaucuaggaaggucaacucauuccccaucaugu

SEQ ID NO: 1822 - RNA, 35 nt, Artificial Sequence
  Synthetic Oligonucleotide; CTLA4 exon 2; Set C
ggaaucaucuaggaaggucaacucauuccccauca

SEQ ID NO: 1823 - RNA, 37 nt, Artificial Sequence
  Synthetic Oligonucleotide; CTLA4 exon 2; Set C
uggaaucaucuaggaaggucaacucauuccccaucau

SEQ ID NO: 1824 - RNA, 39 nt, Artificial Sequence
  Synthetic Oligonucleotide; CTLA4 exon 2; Set C
auggaaucaucuaggaaggucaacucauuccccaucaug

SEQ ID NO: 1825 - RNA, 36 nt, Artificial Sequence
  Synthetic Oligonucleotide; CTLA4 exon 2; Set C
uggaaucaucuaggaaggucaacucauuccccauca

SEQ ID NO: 1826 - RNA, 38 nt, Artificial Sequence
  Synthetic Oligonucleotide; CTLA4 exon 2; Set C
auggaaucaucuaggaaggucaacucauuccccaucau

SEQ ID NO: 1827 - RNA, 37 nt, Artificial Sequence
  Synthetic Oligonucleotide; CTLA4 exon 2; Set C
auggaaucaucuaggaaggucaacucauuccccauca

SEQ ID NO: 1828 - RNA, 15 nt, Artificial Sequence
  Synthetic Oligonucleotide; CTLA4 exon 2; Set C
gaaucaucuaggaag

SEQ ID NO: 1829 - RNA, 16 nt, Artificial Sequence
  Synthetic Oligonucleotide; CTLA4 exon 2; Set C
ggaaucaucuaggaag

SEQ ID NO: 1830 - RNA, 17 nt, Artificial Sequence
  Synthetic Oligonucleotide; CTLA4 exon 2; Set C
uggaaucaucuaggaag

SEQ ID NO: 1831 - RNA, 18 nt, Artificial Sequence
  Synthetic Oligonucleotide; CTLA4 exon 2; Set C
auggaaucaucuaggaag

SEQ ID NO: 1832 - RNA, 31 nt, Artificial Sequence
  Synthetic Oligonucleotide; CTLA4 exon 2; Set C
ggugcccgugcagauggaaucaucuaggaag

SEQ ID NO: 1833 - RNA, 16 nt, Artificial Sequence
  Synthetic Oligonucleotide; CTLA4 exon 2; Set A
ggugcccgugcagaug

SEQ ID NO: 1834 - RNA, 25 nt, Artificial Sequence
  Synthetic Oligonucleotide; CTLA4 exon 2; Set C
cuggaggugcccgugcagauggaau

SEQ ID NO: 1835 - RNA, 24 nt, Artificial Sequence
  Synthetic Oligonucleotide; CTLA4 exon 2; Set C
cuggaggugcccgugcagauggaa

SEQ ID NO: 1836 - RNA, 35 nt, Artificial Sequence
  Synthetic Oligonucleotide; CTLA4 exon 2; Set C
uugauuuccacuggaggugcccgugcagauggaau

SEQ ID NO: 1837 - RNA, 34 nt, Artificial Sequence
  Synthetic Oligonucleotide; CTLA4 exon 2; Set C
uugauuuccacuggaggugcccgugcagauggaa

SEQ ID NO: 1838 - RNA, 33 nt, Artificial Sequence
  Synthetic Oligonucleotide; CTLA4 exon 2; Set C
uugauuuccacuggaggugcccgugcagaugga

SEQ ID NO: 1839 - RNA, 18 nt, Artificial Sequence
  Synthetic Oligonucleotide; CTLA4 exon 2; Set C
uugauuuccacuggaggu

SEQ ID NO: 1840 - RNA, 19 nt, Artificial Sequence
  Synthetic Oligonucleotide; CTLA4 exon 2; Set C
cuugauuuccacuggaggu

SEQ ID NO: 1841 - RNA, 20 nt, Artificial Sequence
  Synthetic Oligonucleotide; CTLA4 exon 2; Set C
gguucacuugauuuccacug

SEQ ID NO: 1842 - RNA, 21 nt, Artificial Sequence
  Synthetic Oligonucleotide; CTLA4 exon 2; Set C
agguucacuugauuuccacug

SEQ ID NO: 1843 - RNA, 15 nt, Artificial Sequence
  Synthetic Oligonucleotide; CTLA4 exon 2; Set C
gguucacuugauuuc

SEQ ID NO: 1844 - RNA, 36 nt, Artificial Sequence
  Synthetic Oligonucleotide; CTLA4 exon 2; Set C
uuggauagugagguucacuugauuuccacuggaggu

SEQ ID NO: 1845 - RNA, 16 nt, Artificial Sequence
  Synthetic Oligonucleotide; CTLA4 exon 2; Set C
agguucacuugauuuc

SEQ ID NO: 1846 - RNA, 38 nt, Artificial Sequence
  Synthetic Oligonucleotide; CTLA4 exon 2; Set C
ccuuggauagugagguucacuugauuuccacuggaggu

SEQ ID NO: 1847 - RNA, 39 nt, Artificial Sequence
  Synthetic Oligonucleotide; CTLA4 exon 2; Set C
uccuuggauagugagguucacuugauuuccacuggaggu

SEQ ID NO: 1848 - RNA, 40 nt, Artificial Sequence
  Synthetic Oligonucleotide; CTLA4 exon 2; Set C
guccuuggauagugagguucacuugauuuccacuggaggu

SEQ ID NO: 1849 - RNA, 36 nt, Artificial Sequence
  Synthetic Oligonucleotide; CTLA4 exon 2; Set C
aguccuuggauagugagguucacuugauuuccacug

SEQ ID NO: 1850 - RNA, 25 nt, Artificial Sequence
  Synthetic Oligonucleotide; CTLA4 exon 2; Set C
uuggauagugagguucacuugauuu

SEQ ID NO: 1851 - RNA, 24 nt, Artificial Sequence
  Synthetic Oligonucleotide; CTLA4 exon 2; Set C
uuggauagugagguucacuugauu

SEQ ID NO: 1852 - RNA, 23 nt, Artificial Sequence
  Synthetic Oligonucleotide; CTLA4 exon 2; Set C
uuggauagugagguucacuugau

SEQ ID NO: 1853 - RNA, 27 nt, Artificial Sequence
  Synthetic Oligonucleotide; CTLA4 exon 2; Set A
ccuuggauagugagguucacuugauuu

SEQ ID NO: 1854 - RNA, 22 nt, Artificial Sequence
  Synthetic Oligonucleotide; CTLA4 exon 2; Set C
uuggauagugagguucacuuga

SEQ ID NO: 1855 - RNA, 26 nt, Artificial Sequence
  Synthetic Oligonucleotide; CTLA4 exon 2; Set A
ccuuggauagugagguucacuugauu

SEQ ID NO: 1856 - RNA, 28 nt, Artificial Sequence
  Synthetic Oligonucleotide; CTLA4 exon 2; Set A
uccuuggauagugagguucacuugauuu

SEQ ID NO: 1857 - RNA, 25 nt, Artificial Sequence
  Synthetic Oligonucleotide; CTLA4 exon 2; Set A
ccuuggauagugagguucacuugau

SEQ ID NO: 1858 - RNA, 27 nt, Artificial Sequence
  Synthetic Oligonucleotide; CTLA4 exon 2; Set A
uccuuggauagugagguucacuugauu

SEQ ID NO: 1859 - RNA, 29 nt, Artificial Sequence
  Synthetic Oligonucleotide; CTLA4 exon 2; Set A
guccuuggauagugagguucacuugauuu

SEQ ID NO: 1860 - RNA, 24 nt, Artificial Sequence
  Synthetic Oligonucleotide; CTLA4 exon 2; Set A
ccuuggauagugagguucacuuga

SEQ ID NO: 1861 - RNA, 26 nt, Artificial Sequence
  Synthetic Oligonucleotide; CTLA4 exon 2; Set A
uccuuggauagugagguucacuugau

SEQ ID NO: 1862 - RNA, 28 nt, Artificial Sequence
  Synthetic Oligonucleotide; CTLA4 exon 2; Set A
guccuuggauagugagguucacuugauu

SEQ ID NO: 1863 - RNA, 25 nt, Artificial Sequence
  Synthetic Oligonucleotide; CTLA4 exon 2; Set A
uccuuggauagugagguucacuuga

SEQ ID NO: 1864 - RNA, 27 nt, Artificial Sequence
  Synthetic Oligonucleotide; CTLA4 exon 2; Set A
guccuuggauagugagguucacuugau

SEQ ID NO: 1865 - RNA, 26 nt, Artificial Sequence
  Synthetic Oligonucleotide; CTLA4 exon 2; Set A
guccuuggauagugagguucacuuga

SEQ ID NO: 1866 - RNA, 26 nt, Artificial Sequence
  Synthetic Oligonucleotide; CTLA4 exon 2; Set A
aguccuuggauagugagguucacuug

SEQ ID NO: 1867 - RNA, 17 nt, Artificial Sequence
  Synthetic Oligonucleotide; CTLA4 exon 2; Set C
ccuuggauagugagguu

SEQ ID NO: 1868 - RNA, 15 nt, Artificial Sequence
  Synthetic Oligonucleotide; CTLA4 exon 2; Set C
cuuggauagugaggu

SEQ ID NO: 1869 - RNA, 18 nt, Artificial Sequence
  Synthetic Oligonucleotide; CTLA4 exon 2; Set C
uccuuggauagugagguu

SEQ ID NO: 1870 - RNA, 16 nt, Artificial Sequence
  Synthetic Oligonucleotide; CTLA4 exon 2; Set C
ccuuggauagugaggu

SEQ ID NO: 1871 - RNA, 19 nt, Artificial Sequence
  Synthetic Oligonucleotide; CTLA4 exon 2; Set C
guccuuggauagugagguu

SEQ ID NO: 1872 - RNA, 17 nt, Artificial Sequence
  Synthetic Oligonucleotide; CTLA4 exon 2; Set C
uccuuggauagugaggu

SEQ ID NO: 1873 - RNA, 18 nt, Artificial Sequence
  Synthetic Oligonucleotide; CTLA4 exon 2; Set C
guccuuggauagugaggu

SEQ ID NO: 1874 - RNA, 17 nt, Artificial Sequence
  Synthetic Oligonucleotide; CTLA4 exon 2; Set C
guccuuggauagugagg

SEQ ID NO: 1875 - RNA, 39 nt, Artificial Sequence
  Synthetic Oligonucleotide; CTLA4 exon 2; Set C
gauguagagucccguguccauggcccucaguccuuggau

SEQ ID NO: 1876 - RNA, 40 nt, Artificial Sequence
  Synthetic Oligonucleotide; CTLA4 exon 2; Set C
agauguagagucccguguccauggcccucaguccuuggau

SEQ ID NO: 1877 - RNA, 35 nt, Artificial Sequence
  Synthetic Oligonucleotide; CTLA4 exon 2; Set C
gauguagagucccguguccauggcccucaguccuu

SEQ ID NO: 1878 - RNA, 36 nt, Artificial Sequence
  Synthetic Oligonucleotide; CTLA4 exon 2; Set C
agauguagagucccguguccauggcccucaguccuu

SEQ ID NO: 1879 - RNA, 37 nt, Artificial Sequence
  Synthetic Oligonucleotide; CTLA4 exon 2; Set C
cagauguagagucccguguccauggcccucaguccuu

SEQ ID NO: 1880 - RNA, 38 nt, Artificial Sequence
  Synthetic Oligonucleotide; CTLA4 exon 2; Set C
gcagauguagagucccguguccauggcccucaguccuu

SEQ ID NO: 1881 - RNA, 31 nt, Artificial Sequence
  Synthetic Oligonucleotide; CTLA4 exon 2; Set C
gauguagagucccguguccauggcccucagu

SEQ ID NO: 1882 - RNA, 39 nt, Artificial Sequence
  Synthetic Oligonucleotide; CTLA4 exon 2; Set C
ugcagauguagagucccguguccauggcccucaguccuu

SEQ ID NO: 1883 - RNA, 32 nt, Artificial Sequence
  Synthetic Oligonucleotide; CTLA4 exon 2; Set C
agauguagagucccguguccauggcccucagu

SEQ ID NO: 1884 - RNA, 40 nt, Artificial Sequence
  Synthetic Oligonucleotide; CTLA4 exon 2; Set C
uugcagauguagagucccguguccauggcccucaguccuu

SEQ ID NO: 1885 - RNA, 33 nt, Artificial Sequence
  Synthetic Oligonucleotide; CTLA4 exon 2; Set C
cagauguagagucccguguccauggcccucagu

SEQ ID NO: 1886 - RNA, 29 nt, Artificial Sequence
  Synthetic Oligonucleotide; CTLA4 exon 2; Set C
gauguagagucccguguccauggcccuca

SEQ ID NO: 1887 - RNA, 31 nt, Artificial Sequence
  Synthetic Oligonucleotide; CTLA4 exon 2; Set C
agauguagagucccguguccauggcccucag

SEQ ID NO: 1888 - RNA, 39 nt, Artificial Sequence
  Synthetic Oligonucleotide; CTLA4 exon 2; Set C
uugcagauguagagucccguguccauggcccucaguccu

SEQ ID NO: 1889 - RNA, 30 nt, Artificial Sequence
  Synthetic Oligonucleotide; CTLA4 exon 2; Set C
agauguagagucccguguccauggcccuca

SEQ ID NO: 1890 - RNA, 32 nt, Artificial Sequence
  Synthetic Oligonucleotide; CTLA4 exon 2; Set C
cagauguagagucccguguccauggcccucag

SEQ ID NO: 1891 - RNA, 29 nt, Artificial Sequence
  Synthetic Oligonucleotide; CTLA4 exon 2; Set C
agauguagagucccguguccauggcccuc

SEQ ID NO: 1892 - RNA, 31 nt, Artificial Sequence
  Synthetic Oligonucleotide; CTLA4 exon 2; Set C
cagauguagagucccguguccauggcccuca

SEQ ID NO: 1893 - RNA, 33 nt, Artificial Sequence
  Synthetic Oligonucleotide; CTLA4 exon 2; Set C
gcagauguagagucccguguccauggcccucag

SEQ ID NO: 1894 - RNA, 32 nt, Artificial Sequence
  Synthetic Oligonucleotide; CTLA4 exon 2; Set C
gcagauguagagucccguguccauggcccuca

SEQ ID NO: 1895 - RNA, 30 nt, Artificial Sequence
  Synthetic Oligonucleotide; CTLA4 exon 2; Set C
cagauguagagucccguguccauggcccuc

SEQ ID NO: 1896 - RNA, 34 nt, Artificial Sequence
  Synthetic Oligonucleotide; CTLA4 exon 2; Set C
ugcagauguagagucccguguccauggcccucag

SEQ ID NO: 1897 - RNA, 37 nt, Artificial Sequence
  Synthetic Oligonucleotide; CTLA4 exon 2; Set C
cuugcagauguagagucccguguccauggcccucagu

SEQ ID NO: 1898 - RNA, 33 nt, Artificial Sequence
  Synthetic Oligonucleotide; CTLA4 exon 2; Set C
ugcagauguagagucccguguccauggcccuca

SEQ ID NO: 1899 - RNA, 31 nt, Artificial Sequence
  Synthetic Oligonucleotide; CTLA4 exon 2; Set C
gcagauguagagucccguguccauggcccuc

SEQ ID NO: 1900 - RNA, 35 nt, Artificial Sequence
  Synthetic Oligonucleotide; CTLA4 exon 2; Set C
uugcagauguagagucccguguccauggcccucag

SEQ ID NO: 1901 - RNA, 34 nt, Artificial Sequence
  Synthetic Oligonucleotide; CTLA4 exon 2; Set C
uugcagauguagagucccguguccauggcccuca

SEQ ID NO: 1902 - RNA, 32 nt, Artificial Sequence
  Synthetic Oligonucleotide; CTLA4 exon 2; Set C
ugcagauguagagucccguguccauggcccuc

SEQ ID NO: 1903 - RNA, 36 nt, Artificial Sequence
  Synthetic Oligonucleotide; CTLA4 exon 2; Set C
cuugcagauguagagucccguguccauggcccucag

SEQ ID NO: 1904 - RNA, 33 nt, Artificial Sequence
  Synthetic Oligonucleotide; CTLA4 exon 2; Set C
uugcagauguagagucccguguccauggcccuc

SEQ ID NO: 1905 - RNA, 35 nt, Artificial Sequence
  Synthetic Oligonucleotide; CTLA4 exon 2; Set C
cuugcagauguagagucccguguccauggcccuca

SEQ ID NO: 1906 - RNA, 34 nt, Artificial Sequence
  Synthetic Oligonucleotide; CTLA4 exon 2; Set C
cuugcagauguagagucccguguccauggcccuc

SEQ ID NO: 1907 - RNA, 30 nt, Artificial Sequence
  Synthetic Oligonucleotide; CTLA4 exon 2; Set C
cgguggguacaugagcuccaccuugcagau

SEQ ID NO: 1908 - RNA, 29 nt, Artificial Sequence
  Synthetic Oligonucleotide; CTLA4 exon 2; Set C
cgguggguacaugagcuccaccuugcaga

SEQ ID NO: 1909 - RNA, 28 nt, Artificial Sequence
  Synthetic Oligonucleotide; CTLA4 exon 2; Set C
cgguggguacaugagcuccaccuugcag

SEQ ID NO: 1910 - RNA, 27 nt, Artificial Sequence
  Synthetic Oligonucleotide; CTLA4 exon 2; Set C
cgguggguacaugagcuccaccuugca

SEQ ID NO: 1911 - RNA, 26 nt, Artificial Sequence
  Synthetic Oligonucleotide; CTLA4 exon 2; Set C
cgguggguacaugagcuccaccuugc

SEQ ID NO: 1912 - RNA, 25 nt, Artificial Sequence
  Synthetic Oligonucleotide; CTLA4 exon 2; Set C
cgguggguacaugagcuccaccuug

SEQ ID NO: 1913 - RNA, 24 nt, Artificial Sequence
  Synthetic Oligonucleotide; CTLA4 exon 2; Set C
cgguggguacaugagcuccaccuu

SEQ ID NO: 1914 - RNA, 33 nt, Artificial Sequence
  Synthetic Oligonucleotide; CTLA4 exon 2; Set C
uauggcgguggguacaugagcuccaccuugcag

SEQ ID NO: 1915 - RNA, 29 nt, Artificial Sequence
  Synthetic Oligonucleotide; CTLA4 exon 2; Set C
uauggcgguggguacaugagcuccaccuu

SEQ ID NO: 1916 - RNA, 30 nt, Artificial Sequence
  Synthetic Oligonucleotide; CTLA4 exon 2; Set C
guauggcgguggguacaugagcuccaccuu

SEQ ID NO: 1917 - RNA, 31 nt, Artificial Sequence
  Synthetic Oligonucleotide; CTLA4 exon 2; Set C
aguauggcgguggguacaugagcuccaccuu

SEQ ID NO: 1918 - RNA, 33 nt, Artificial Sequence
  Synthetic Oligonucleotide; CTLA4 exon 2; Set C
guaguauggcgguggguacaugagcuccaccuu

SEQ ID NO: 1919 - RNA, 40 nt, Artificial Sequence
  Synthetic Oligonucleotide; CTLA4 exon 2; Set C
ccagguaguauggcgguggguacaugagcuccaccuugca

SEQ ID NO: 1920 - RNA, 39 nt, Artificial Sequence
  Synthetic Oligonucleotide; CTLA4 exon 2; Set C
ccagguaguauggcgguggguacaugagcuccaccuugc

SEQ ID NO: 1921 - RNA, 38 nt, Artificial Sequence
  Synthetic Oligonucleotide; CTLA4 exon 2; Set C
ccagguaguauggcgguggguacaugagcuccaccuug

SEQ ID NO: 1922 - RNA, 37 nt, Artificial Sequence
  Synthetic Oligonucleotide; CTLA4 exon 2; Set C
ccagguaguauggcgguggguacaugagcuccaccuu

SEQ ID NO: 1923 - RNA, 40 nt, Artificial Sequence
  Synthetic Oligonucleotide; CTLA4 exon 2; Set C
gcccagguaguauggcgguggguacaugagcuccaccuug

SEQ ID NO: 1924 - RNA, 39 nt, Artificial Sequence
  Synthetic Oligonucleotide; CTLA4 exon 2; Set C
gcccagguaguauggcgguggguacaugagcuccaccuu

SEQ ID NO: 1925 - RNA, 40 nt, Artificial Sequence
  Synthetic Oligonucleotide; CTLA4 exon 2; Set C
ugcccagguaguauggcgguggguacaugagcuccaccuu

SEQ ID NO: 1926 - RNA, 22 nt, Artificial Sequence
  Synthetic Oligonucleotide; CTLA4 exon 2; Set C
ccagguaguauggcggugggua

SEQ ID NO: 1927 - RNA, 24 nt, Artificial Sequence
  Synthetic Oligonucleotide; CTLA4 exon 2; Set C
gcccagguaguauggcggugggua

SEQ ID NO: 1928 - RNA, 25 nt, Artificial Sequence
  Synthetic Oligonucleotide; CTLA4 exon 2; Set C
ugcccagguaguauggcggugggua

SEQ ID NO: 1929 - RNA, 17 nt, Artificial Sequence
  Synthetic Oligonucleotide; CTLA4 exon 2; Set C
ccagguaguauggcggu

SEQ ID NO: 1930 - RNA, 17 nt, Artificial Sequence
  Synthetic Oligonucleotide; CTLA4 exon 2; Set C
cccagguaguauggcgg

SEQ ID NO: 1931 - RNA, 29 nt, Artificial Sequence
  Synthetic Oligonucleotide; CTLA4 exon 2; Set C
ccuaugcccagguaguauggcggugggua

SEQ ID NO: 1932 - RNA, 19 nt, Artificial Sequence
  Synthetic Oligonucleotide; CTLA4 exon 2; Set B
gcccagguaguauggcggu

SEQ ID NO: 1933 - RNA, 30 nt, Artificial Sequence
  Synthetic Oligonucleotide; CTLA4 exon 2; Set C
gccuaugcccagguaguauggcggugggua

SEQ ID NO: 1934 - RNA, 20 nt, Artificial Sequence
  Synthetic Oligonucleotide; CTLA4 exon 2; Set B
ugcccagguaguauggcggu

SEQ ID NO: 1935 - RNA, 22 nt, Artificial Sequence
  Synthetic Oligonucleotide; CTLA4 exon 2; Set B
augcccagguaguauggcggug

SEQ ID NO: 1936 - RNA, 31 nt, Artificial Sequence
  Synthetic Oligonucleotide; CTLA4 exon 2; Set C
ugccuaugcccagguaguauggcggugggua

SEQ ID NO: 1937 - RNA, 23 nt, Artificial Sequence
  Synthetic Oligonucleotide; CTLA4 exon 2; Set B
uaugcccagguaguauggcggug

SEQ ID NO: 1938 - RNA, 32 nt, Artificial Sequence
  Synthetic Oligonucleotide; CTLA4 exon 2; Set C
uugccuaugcccagguaguauggcggugggua

SEQ ID NO: 1939 - RNA, 24 nt, Artificial Sequence
  Synthetic Oligonucleotide; CTLA4 exon 2; Set C
cuaugcccagguaguauggcggug

SEQ ID NO: 1940 - RNA, 34 nt, Artificial Sequence
  Synthetic Oligonucleotide; CTLA4 exon 2; Set C
cguugccuaugcccagguaguauggcggugggua

SEQ ID NO: 1941 - RNA, 24 nt, Artificial Sequence
  Synthetic Oligonucleotide; CTLA4 exon 2; Set C
ccuaugcccagguaguauggcggu

SEQ ID NO: 1942 - RNA, 35 nt, Artificial Sequence
  Synthetic Oligonucleotide; CTLA4 exon 2; Set C
ccguugccuaugcccagguaguauggcggugggua

SEQ ID NO: 1943 - RNA, 25 nt, Artificial Sequence
  Synthetic Oligonucleotide; CTLA4 exon 2; Set C
gccuaugcccagguaguauggcggu

SEQ ID NO: 1944 - RNA, 36 nt, Artificial Sequence
  Synthetic Oligonucleotide; CTLA4 exon 2; Set C
uccguugccuaugcccagguaguauggcggugggua

SEQ ID NO: 1945 - RNA, 26 nt, Artificial Sequence
  Synthetic Oligonucleotide; CTLA4 exon 2; Set C
ugccuaugcccagguaguauggcggu

SEQ ID NO: 1946 - RNA, 37 nt, Artificial Sequence
  Synthetic Oligonucleotide; CTLA4 exon 2; Set C
uuccguugccuaugcccagguaguauggcggugggua

SEQ ID NO: 1947 - RNA, 27 nt, Artificial Sequence
  Synthetic Oligonucleotide; CTLA4 exon 2; Set C
uugccuaugcccagguaguauggcggu

SEQ ID NO: 1948 - RNA, 29 nt, Artificial Sequence
  Synthetic Oligonucleotide; CTLA4 exon 2; Set C
guugccuaugcccagguaguauggcggug

SEQ ID NO: 1949 - RNA, 39 nt, Artificial Sequence
  Synthetic Oligonucleotide; CTLA4 exon 2; Set C
guuccguugccuaugcccagguaguauggcgguggguac

SEQ ID NO: 1950 - RNA, 29 nt, Artificial Sequence
  Synthetic Oligonucleotide; CTLA4 exon 2; Set C
cguugccuaugcccagguaguauggcggu

SEQ ID NO: 1951 - RNA, 30 nt, Artificial Sequence
  Synthetic Oligonucleotide; CTLA4 exon 2; Set C
ccguugccuaugcccagguaguauggcggu

SEQ ID NO: 1952 - RNA, 31 nt, Artificial Sequence
  Synthetic Oligonucleotide; CTLA4 exon 2; Set C
uccguugccuaugcccagguaguauggcggu

SEQ ID NO: 1953 - RNA, 32 nt, Artificial Sequence
  Synthetic Oligonucleotide; CTLA4 exon 2; Set C
uuccguugccuaugcccagguaguauggcggu

SEQ ID NO: 1954 - RNA, 34 nt, Artificial Sequence
  Synthetic Oligonucleotide; CTLA4 exon 2; Set C
guuccguugccuaugcccagguaguauggcggug

SEQ ID NO: 1955 - RNA, 35 nt, Artificial Sequence
  Synthetic Oligonucleotide; CTLA4 exon 2; Set C
gguuccguugccuaugcccagguaguauggcggug

SEQ ID NO: 1956 - RNA, 36 nt, Artificial Sequence
  Synthetic Oligonucleotide; CTLA4 exon 2; Set C
ggguuccguugccuaugcccagguaguauggcggug

SEQ ID NO: 1957 - RNA, 37 nt, Artificial Sequence
  Synthetic Oligonucleotide; CTLA4 exon 2; Set C
uggguuccguugccuaugcccagguaguauggcggug

SEQ ID NO: 1958 - RNA, 38 nt, Artificial Sequence
  Synthetic Oligonucleotide; CTLA4 exon 2; Set C
cuggguuccguugccuaugcccagguaguauggcggug

SEQ ID NO: 1959 - RNA, 39 nt, Artificial Sequence
  Synthetic Oligonucleotide; CTLA4 exon 2; Set C
ucuggguuccguugccuaugcccagguaguauggcggug

SEQ ID NO: 1960 - RNA, 40 nt, Artificial Sequence
  Synthetic Oligonucleotide; CTLA4 exon 2; Set C
aucuggguuccguugccuaugcccagguaguauggcggug

SEQ ID NO: 1961 - RNA, 17 nt, Artificial Sequence
  Synthetic Oligonucleotide; CTLA4 exon 2; Set B
guugccuaugcccaggu

SEQ ID NO: 1962 - RNA, 16 nt, Artificial Sequence
  Synthetic Oligonucleotide; CTLA4 exon 2; Set C
guugccuaugcccagg

SEQ ID NO: 1963 - RNA, 15 nt, Artificial Sequence
  Synthetic Oligonucleotide; CTLA4 exon 2; Set C
guugccuaugcccag

SEQ ID NO: 1964 - RNA, 22 nt, Artificial Sequence
  Synthetic Oligonucleotide; CTLA4 exon 2; Set C
guuccguugccuaugcccaggu

SEQ ID NO: 1965 - RNA, 15 nt, Artificial Sequence
  Synthetic Oligonucleotide; CTLA4 exon 2; Set C
ccguugccuaugccc

SEQ ID NO: 1966 - RNA, 23 nt, Artificial Sequence
  Synthetic Oligonucleotide; CTLA4 exon 2; Set C
gguuccguugccuaugcccaggu

SEQ ID NO: 1967 - RNA, 21 nt, Artificial Sequence
  Synthetic Oligonucleotide; CTLA4 exon 2; Set B
guuccguugccuaugcccagg

SEQ ID NO: 1968 - RNA, 16 nt, Artificial Sequence
  Synthetic Oligonucleotide; CTLA4 exon 2; Set B
uccguugccuaugccc

SEQ ID NO: 1969 - RNA, 24 nt, Artificial Sequence
  Synthetic Oligonucleotide; CTLA4 exon 2; Set C
ggguuccguugccuaugcccaggu

SEQ ID NO: 1970 - RNA, 22 nt, Artificial Sequence
  Synthetic Oligonucleotide; CTLA4 exon 2; Set C
gguuccguugccuaugcccagg

SEQ ID NO: 1971 - RNA, 20 nt, Artificial Sequence
  Synthetic Oligonucleotide; CTLA4 exon 2; Set B
guuccguugccuaugcccag

SEQ ID NO: 1972 - RNA, 17 nt, Artificial Sequence
  Synthetic Oligonucleotide; CTLA4 exon 2; Set B
uuccguugccuaugccc

SEQ ID NO: 1973 - RNA, 25 nt, Artificial Sequence
  Synthetic Oligonucleotide; CTLA4 exon 2; Set C
uggguuccguugccuaugcccaggu

SEQ ID NO: 1974 - RNA, 23 nt, Artificial Sequence
  Synthetic Oligonucleotide; CTLA4 exon 2; Set C
ggguuccguugccuaugcccagg

SEQ ID NO: 1975 - RNA, 21 nt, Artificial Sequence
  Synthetic Oligonucleotide; CTLA4 exon 2; Set B
gguuccguugccuaugcccag

SEQ ID NO: 1976 - RNA, 26 nt, Artificial Sequence
  Synthetic Oligonucleotide; CTLA4 exon 2; Set C
cuggguuccguugccuaugcccaggu

SEQ ID NO: 1977 - RNA, 24 nt, Artificial Sequence
  Synthetic Oligonucleotide; CTLA4 exon 2; Set C
uggguuccguugccuaugcccagg

SEQ ID NO: 1978 - RNA, 22 nt, Artificial Sequence
  Synthetic Oligonucleotide; CTLA4 exon 2; Set C
ggguuccguugccuaugcccag

SEQ ID NO: 1979 - RNA, 27 nt, Artificial Sequence
  Synthetic Oligonucleotide; CTLA4 exon 2; Set C
ucuggguuccguugccuaugcccaggu

SEQ ID NO: 1980 - RNA, 25 nt, Artificial Sequence
  Synthetic Oligonucleotide; CTLA4 exon 2; Set C
cuggguuccguugccuaugcccagg

SEQ ID NO: 1981 - RNA, 23 nt, Artificial Sequence
  Synthetic Oligonucleotide; CTLA4 exon 2; Set C
uggguuccguugccuaugcccag

SEQ ID NO: 1982 - RNA, 28 nt, Artificial Sequence
  Synthetic Oligonucleotide; CTLA4 exon 2; Set C
aucuggguuccguugccuaugcccaggu

SEQ ID NO: 1983 - RNA, 26 nt, Artificial Sequence
  Synthetic Oligonucleotide; CTLA4 exon 2; Set C
ucuggguuccguugccuaugcccagg

SEQ ID NO: 1984 - RNA, 24 nt, Artificial Sequence
  Synthetic Oligonucleotide; CTLA4 exon 2; Set C
cuggguuccguugccuaugcccag

SEQ ID NO: 1985 - RNA, 27 nt, Artificial Sequence
  Synthetic Oligonucleotide; CTLA4 exon 2; Set C
aucuggguuccguugccuaugcccagg

SEQ ID NO: 1986 - RNA, 25 nt, Artificial Sequence
  Synthetic Oligonucleotide; CTLA4 exon 2; Set C
ucuggguuccguugccuaugcccag

SEQ ID NO: 1987 - RNA, 28 nt, Artificial Sequence
  Synthetic Oligonucleotide; CTLA4 exon 2; Set C
aaucuggguuccguugccuaugcccagg

SEQ ID NO: 1988 - RNA, 26 nt, Artificial Sequence
  Synthetic Oligonucleotide; CTLA4 exon 2; Set C
aucuggguuccguugccuaugcccag

SEQ ID NO: 1989 - RNA, 29 nt, Artificial Sequence
  Synthetic Oligonucleotide; CTLA4 exon 2; Set C
aaaucuggguuccguugccuaugcccagg

SEQ ID NO: 1990 - RNA, 27 nt, Artificial Sequence
  Synthetic Oligonucleotide; CTLA4 exon 2; Set C
aaucuggguuccguugccuaugcccag

SEQ ID NO: 1991 - RNA, 30 nt, Artificial Sequence
  Synthetic Oligonucleotide; CTLA4 exon 2; Set C
uaaaucuggguuccguugccuaugcccagg

SEQ ID NO: 1992 - RNA, 28 nt, Artificial Sequence
  Synthetic Oligonucleotide; CTLA4 exon 2; Set C
aaaucuggguuccguugccuaugcccag

SEQ ID NO: 1993 - RNA, 31 nt, Artificial Sequence
  Synthetic Oligonucleotide; CTLA4 exon 2; Set C
auaaaucuggguuccguugccuaugcccagg

SEQ ID NO: 1994 - RNA, 29 nt, Artificial Sequence
  Synthetic Oligonucleotide; CTLA4 exon 2; Set C
uaaaucuggguuccguugccuaugcccag

SEQ ID NO: 1995 - RNA, 32 nt, Artificial Sequence
  Synthetic Oligonucleotide; CTLA4 exon 2; Set C
cauaaaucuggguuccguugccuaugcccagg

SEQ ID NO: 1996 - RNA, 30 nt, Artificial Sequence
  Synthetic Oligonucleotide; CTLA4 exon 2; Set C
auaaaucuggguuccguugccuaugcccag

SEQ ID NO: 1997 - RNA, 33 nt, Artificial Sequence
  Synthetic Oligonucleotide; CTLA4 exon 2; Set C
acauaaaucuggguuccguugccuaugcccagg

SEQ ID NO: 1998 - RNA, 31 nt, Artificial Sequence
  Synthetic Oligonucleotide; CTLA4 exon 2; Set C
cauaaaucuggguuccguugccuaugcccag

SEQ ID NO: 1999 - RNA, 36 nt, Artificial Sequence
  Synthetic Oligonucleotide; CTLA4 exon 2; Set C
uuacauaaaucuggguuccguugccuaugcccaggu

SEQ ID NO: 2000 - RNA, 34 nt, Artificial Sequence
  Synthetic Oligonucleotide; CTLA4 exon 2; Set C
uacauaaaucuggguuccguugccuaugcccagg

SEQ ID NO: 2001 - RNA, 32 nt, Artificial Sequence
  Synthetic Oligonucleotide; CTLA4 exon 2; Set C
acauaaaucuggguuccguugccuaugcccag

SEQ ID NO: 2002 - RNA, 37 nt, Artificial Sequence
  Synthetic Oligonucleotide; CTLA4 exon 2; Set C
auuacauaaaucuggguuccguugccuaugcccaggu

SEQ ID NO: 2003 - RNA, 35 nt, Artificial Sequence
  Synthetic Oligonucleotide; CTLA4 exon 2; Set C
uuacauaaaucuggguuccguugccuaugcccagg

SEQ ID NO: 2004 - RNA, 33 nt, Artificial Sequence
  Synthetic Oligonucleotide; CTLA4 exon 2; Set C
uacauaaaucuggguuccguugccuaugcccag

SEQ ID NO: 2005 - RNA, 38 nt, Artificial Sequence
  Synthetic Oligonucleotide; CTLA4 exon 2; Set C
aauuacauaaaucuggguuccguugccuaugcccaggu

SEQ ID NO: 2006 - RNA, 36 nt, Artificial Sequence
  Synthetic Oligonucleotide; CTLA4 exon 2; Set C
auuacauaaaucuggguuccguugccuaugcccagg

SEQ ID NO: 2007 - RNA, 34 nt, Artificial Sequence
  Synthetic Oligonucleotide; CTLA4 exon 2; Set C
uuacauaaaucuggguuccguugccuaugcccag

SEQ ID NO: 2008 - RNA, 37 nt, Artificial Sequence
  Synthetic Oligonucleotide; CTLA4 exon 2; Set C
aauuacauaaaucuggguuccguugccuaugcccagg

SEQ ID NO: 2009 - RNA, 35 nt, Artificial Sequence
  Synthetic Oligonucleotide; CTLA4 exon 2; Set C
auuacauaaaucuggguuccguugccuaugcccag

SEQ ID NO: 2010 - RNA, 36 nt, Artificial Sequence
  Synthetic Oligonucleotide; CTLA4 exon 2; Set C
aauuacauaaaucuggguuccguugccuaugcccag

SEQ ID NO: 2011 - RNA, 36 nt, Artificial Sequence
  Synthetic Oligonucleotide; CTLA4 exon 2; Set C
caauuacauaaaucuggguuccguugccuaugccca

SEQ ID NO: 2012 - RNA, 35 nt, Artificial Sequence
  Synthetic Oligonucleotide; CTLA4 exon 2; Set C
caauuacauaaaucuggguuccguugccuaugccc

SEQ ID NO: 2013 - RNA, 34 nt, Artificial Sequence
  Synthetic Oligonucleotide; CTLA4 exon 2; Set C
caauuacauaaaucuggguuccguugccuaugcc

SEQ ID NO: 2014 - RNA, 33 nt, Artificial Sequence
  Synthetic Oligonucleotide; CTLA4 exon 2; Set B
caauuacauaaaucuggguuccguugccuaugc

SEQ ID NO: 2015 - RNA, 29 nt, Artificial Sequence
  Synthetic Oligonucleotide; CTLA4 exon 2; Set B
caauuacauaaaucuggguuccguugccu

SEQ ID NO: 2016 - RNA, 28 nt, Artificial Sequence
  Synthetic Oligonucleotide; CTLA4 exon 2; Set B
caauuacauaaaucuggguuccguugcc

SEQ ID NO: 2017 - RNA, 27 nt, Artificial Sequence
  Synthetic Oligonucleotide; CTLA4 exon 2; Set B
caauuacauaaaucuggguuccguugc

SEQ ID NO: 2018 - RNA, 26 nt, Artificial Sequence
  Synthetic Oligonucleotide; CTLA4 exon 2; Set C
caauuacauaaaucuggguuccguug

SEQ ID NO: 2019 - RNA, 24 nt, Artificial Sequence
  Synthetic Oligonucleotide; CTLA4 exon 2; Set C
caauuacauaaaucuggguuccgu

SEQ ID NO: 2020 - RNA, 23 nt, Artificial Sequence
  Synthetic Oligonucleotide; CTLA4 exon 2; Set C
caauuacauaaaucuggguuccg

SEQ ID NO: 2021 - RNA, 22 nt, Artificial Sequence
  Synthetic Oligonucleotide; CTLA4 exon 2; Set C
caauuacauaaaucuggguucc

SEQ ID NO: 2022 - RNA, 21 nt, Artificial Sequence
  Synthetic Oligonucleotide; CTLA4 exon 2; Set C
caauuacauaaaucuggguuc

SEQ ID NO: 2023 - RNA, 40 nt, Artificial Sequence
  Synthetic Oligonucleotide; CTLA4 exon 2; Set C
ggcuuugcucaccaauuacauaaaucuggguuccguugcc

SEQ ID NO: 2024 - RNA, 39 nt, Artificial Sequence
  Synthetic Oligonucleotide; CTLA4 exon 2; Set C
ggcuuugcucaccaauuacauaaaucuggguuccguugc

SEQ ID NO: 2025 - RNA, 38 nt, Artificial Sequence
  Synthetic Oligonucleotide; CTLA4 exon 2; Set C
ggcuuugcucaccaauuacauaaaucuggguuccguug

SEQ ID NO: 2026 - RNA, 40 nt, Artificial Sequence
  Synthetic Oligonucleotide; CTLA4 exon 2; Set C
uggcuuugcucaccaauuacauaaaucuggguuccguugc

SEQ ID NO: 2027 - RNA, 39 nt, Artificial Sequence
  Synthetic Oligonucleotide; CTLA4 exon 2; Set C
uggcuuugcucaccaauuacauaaaucuggguuccguug

SEQ ID NO: 2028 - RNA, 40 nt, Artificial Sequence
  Synthetic Oligonucleotide; CTLA4 exon 2; Set C
auggcuuugcucaccaauuacauaaaucuggguuccguug

SEQ ID NO: 2029 - RNA, 36 nt, Artificial Sequence
  Synthetic Oligonucleotide; CTLA4 exon 2; Set C
ggcuuugcucaccaauuacauaaaucuggguuccgu

SEQ ID NO: 2030 - RNA, 37 nt, Artificial Sequence
  Synthetic Oligonucleotide; CTLA4 exon 2; Set C
uggcuuugcucaccaauuacauaaaucuggguuccgu

SEQ ID NO: 2031 - RNA, 35 nt, Artificial Sequence
  Synthetic Oligonucleotide; CTLA4 exon 2; Set C
ggcuuugcucaccaauuacauaaaucuggguuccg

SEQ ID NO: 2032 - RNA, 34 nt, Artificial Sequence
  Synthetic Oligonucleotide; CTLA4 exon 2; Set C
ggcuuugcucaccaauuacauaaaucuggguucc

SEQ ID NO: 2033 - RNA, 38 nt, Artificial Sequence
  Synthetic Oligonucleotide; CTLA4 exon 2; Set C
auggcuuugcucaccaauuacauaaaucuggguuccgu

SEQ ID NO: 2034 - RNA, 36 nt, Artificial Sequence
  Synthetic Oligonucleotide; CTLA4 exon 2; Set C
uggcuuugcucaccaauuacauaaaucuggguuccg

SEQ ID NO: 2035 - RNA, 33 nt, Artificial Sequence
  Synthetic Oligonucleotide; CTLA4 exon 2; Set C
ggcuuugcucaccaauuacauaaaucuggguuc

SEQ ID NO: 2036 - RNA, 35 nt, Artificial Sequence
  Synthetic Oligonucleotide; CTLA4 exon 2; Set C
uggcuuugcucaccaauuacauaaaucuggguucc

SEQ ID NO: 2037 - RNA, 37 nt, Artificial Sequence
  Synthetic Oligonucleotide; CTLA4 exon 2; Set C
auggcuuugcucaccaauuacauaaaucuggguuccg

SEQ ID NO: 2038 - RNA, 34 nt, Artificial Sequence
  Synthetic Oligonucleotide; CTLA4 exon 2; Set C
uggcuuugcucaccaauuacauaaaucuggguuc

SEQ ID NO: 2039 - RNA, 36 nt, Artificial Sequence
  Synthetic Oligonucleotide; CTLA4 exon 2; Set C
auggcuuugcucaccaauuacauaaaucuggguucc

SEQ ID NO: 2040 - RNA, 35 nt, Artificial Sequence
  Synthetic Oligonucleotide; CTLA4 exon 2; Set C
auggcuuugcucaccaauuacauaaaucuggguuc

SEQ ID NO: 2041 - RNA, 16 nt, Artificial Sequence
  Synthetic Oligonucleotide; CTLA4 exon 2; Set C
ggcuuugcucaccaau

SEQ ID NO: 2042 - RNA, 17 nt, Artificial Sequence
  Synthetic Oligonucleotide; CTLA4 exon 2; Set C
uggcuuugcucaccaau

SEQ ID NO: 2043 - RNA, 18 nt, Artificial Sequence
  Synthetic Oligonucleotide; CTLA4 exon 2; Set C
auggcuuugcucaccaau

SEQ ID NO: 2044 - RNA, 18 nt, Artificial Sequence
  Synthetic Oligonucleotide; CTLA4 exon 2; Set C
aauggcuuugcucaccaa

SEQ ID NO: 2045 - RNA, 20 nt, Artificial Sequence
  Synthetic Oligonucleotide; CTLA4 exon 2; Set C
gaaauggcuuugcucaccaa

SEQ ID NO: 2046 - RNA, 23 nt, Artificial Sequence
  Synthetic Oligonucleotide; CTLA4 exon 2; Set B
agugaaauggcuuugcucaccaa

SEQ ID NO: 2047 - RNA, 24 nt, Artificial Sequence
  Synthetic Oligonucleotide; CTLA4 exon 2; Set B
cagugaaauggcuuugcucaccaa

SEQ ID NO: 2048 - RNA, 26 nt, Artificial Sequence
  Synthetic Oligonucleotide; CTLA4 exon 2; Set B
cucagugaaauggcuuugcucaccaa

SEQ ID NO: 2049 - RNA, 27 nt, Artificial Sequence
  Synthetic Oligonucleotide; CTLA4 exon 2; Set B
acucagugaaauggcuuugcucaccaa

SEQ ID NO: 2050 - RNA, 28 nt, Artificial Sequence
  Synthetic Oligonucleotide; CTLA4 exon 2; Set B
aacucagugaaauggcuuugcucaccaa

SEQ ID NO: 2051 - RNA, 35 nt, Artificial Sequence
  Synthetic Oligonucleotide; CTLA4 exon 2; Set C
gcaacaggugucaacucagugaaauggcuuugcuc

SEQ ID NO: 2052 - RNA, 34 nt, Artificial Sequence
  Synthetic Oligonucleotide; CTLA4 exon 2; Set C
gcaacaggugucaacucagugaaauggcuuugcu

SEQ ID NO: 2053 - RNA, 33 nt, Artificial Sequence
  Synthetic Oligonucleotide; CTLA4 exon 2; Set C
gcaacaggugucaacucagugaaauggcuuugc

SEQ ID NO: 2054 - RNA, 32 nt, Artificial Sequence
  Synthetic Oligonucleotide; CTLA4 exon 2; Set B
gcaacaggugucaacucagugaaauggcuuug

SEQ ID NO: 2055 - RNA, 31 nt, Artificial Sequence
  Synthetic Oligonucleotide; CTLA4 exon 2; Set B
gcaacaggugucaacucagugaaauggcuuu

SEQ ID NO: 2056 - RNA, 30 nt, Artificial Sequence
  Synthetic Oligonucleotide; CTLA4 exon 2; Set B
gcaacaggugucaacucagugaaauggcuu

SEQ ID NO: 2057 - RNA, 40 nt, Artificial Sequence
  Synthetic Oligonucleotide; CTLA4 exon 2; Set C
gcaaugcaacaggugucaacucagugaaauggcuuugcuc

SEQ ID NO: 2058 - RNA, 39 nt, Artificial Sequence
  Synthetic Oligonucleotide; CTLA4 exon 2; Set C
gcaaugcaacaggugucaacucagugaaauggcuuugcu

SEQ ID NO: 2059 - RNA, 29 nt, Artificial Sequence
  Synthetic Oligonucleotide; CTLA4 exon 2; Set B
gcaacaggugucaacucagugaaauggcu

SEQ ID NO: 2060 - RNA, 38 nt, Artificial Sequence
  Synthetic Oligonucleotide; CTLA4 exon 2; Set C
gcaaugcaacaggugucaacucagugaaauggcuuugc

SEQ ID NO: 2061 - RNA, 40 nt, Artificial Sequence
  Synthetic Oligonucleotide; CTLA4 exon 2; Set C
ugcaaugcaacaggugucaacucagugaaauggcuuugcu

SEQ ID NO: 2062 - RNA, 39 nt, Artificial Sequence
  Synthetic Oligonucleotide; CTLA4 exon 2; Set C
ugcaaugcaacaggugucaacucagugaaauggcuuugc

SEQ ID NO: 2063 - RNA, 37 nt, Artificial Sequence
  Synthetic Oligonucleotide; CTLA4 exon 2; Set C
gcaaugcaacaggugucaacucagugaaauggcuuug

SEQ ID NO: 2064 - RNA, 40 nt, Artificial Sequence
  Synthetic Oligonucleotide; CTLA4 exon 2; Set C
cugcaaugcaacaggugucaacucagugaaauggcuuugc

SEQ ID NO: 2065 - RNA, 36 nt, Artificial Sequence
  Synthetic Oligonucleotide; CTLA4 exon 2; Set C
gcaaugcaacaggugucaacucagugaaauggcuuu

SEQ ID NO: 2066 - RNA, 38 nt, Artificial Sequence
  Synthetic Oligonucleotide; CTLA4 exon 2; Set C
ugcaaugcaacaggugucaacucagugaaauggcuuug

SEQ ID NO: 2067 - RNA, 35 nt, Artificial Sequence
  Synthetic Oligonucleotide; CTLA4 exon 2; Set C
gcaaugcaacaggugucaacucagugaaauggcuu

SEQ ID NO: 2068 - RNA, 37 nt, Artificial Sequence
  Synthetic Oligonucleotide; CTLA4 exon 2; Set C
ugcaaugcaacaggugucaacucagugaaauggcuuu

SEQ ID NO: 2069 - RNA, 39 nt, Artificial Sequence
  Synthetic Oligonucleotide; CTLA4 exon 2; Set C
cugcaaugcaacaggugucaacucagugaaauggcuuug

SEQ ID NO: 2070 - RNA, 25 nt, Artificial Sequence
  Synthetic Oligonucleotide; CTLA4 exon 2; Set B
gcaacaggugucaacucagugaaau

SEQ ID NO: 2071 - RNA, 36 nt, Artificial Sequence
  Synthetic Oligonucleotide; CTLA4 exon 2; Set C
ugcaaugcaacaggugucaacucagugaaauggcuu

SEQ ID NO: 2072 - RNA, 38 nt, Artificial Sequence
  Synthetic Oligonucleotide; CTLA4 exon 2; Set C
cugcaaugcaacaggugucaacucagugaaauggcuuu

SEQ ID NO: 2073 - RNA, 24 nt, Artificial Sequence
  Synthetic Oligonucleotide; CTLA4 exon 2; Set B
gcaacaggugucaacucagugaaa

SEQ ID NO: 2074 - RNA, 34 nt, Artificial Sequence
  Synthetic Oligonucleotide; CTLA4 exon 2; Set C
gcaaugcaacaggugucaacucagugaaauggcu

SEQ ID NO: 2075 - RNA, 37 nt, Artificial Sequence
  Synthetic Oligonucleotide; CTLA4 exon 2; Set C
cugcaaugcaacaggugucaacucagugaaauggcuu

SEQ ID NO: 2076 - RNA, 35 nt, Artificial Sequence
  Synthetic Oligonucleotide; CTLA4 exon 2; Set C
ugcaaugcaacaggugucaacucagugaaauggcu

SEQ ID NO: 2077 - RNA, 23 nt, Artificial Sequence
  Synthetic Oligonucleotide; CTLA4 exon 2; Set B
gcaacaggugucaacucagugaa

SEQ ID NO: 2078 - RNA, 36 nt, Artificial Sequence
  Synthetic Oligonucleotide; CTLA4 exon 2; Set C
cugcaaugcaacaggugucaacucagugaaauggcu

SEQ ID NO: 2079 - RNA, 22 nt, Artificial Sequence
  Synthetic Oligonucleotide; CTLA4 exon 2; Set B
gcaacaggugucaacucaguga

SEQ ID NO: 2080 - RNA, 21 nt, Artificial Sequence
  Synthetic Oligonucleotide; CTLA4 exon 2; Set B
gcaacaggugucaacucagug

SEQ ID NO: 2081 - RNA, 30 nt, Artificial Sequence
  Synthetic Oligonucleotide; CTLA4 exon 2; Set B
gcaaugcaacaggugucaacucagugaaau

SEQ ID NO: 2082 - RNA, 20 nt, Artificial Sequence
  Synthetic Oligonucleotide; CTLA4 exon 2; Set C
gcaacaggugucaacucagu

SEQ ID NO: 2083 - RNA, 36 nt, Artificial Sequence
  Synthetic Oligonucleotide; CTLA4 exon 2; Set C
acugcaaugcaacaggugucaacucagugaaauggc

SEQ ID NO: 2084 - RNA, 29 nt, Artificial Sequence
  Synthetic Oligonucleotide; CTLA4 exon 2; Set B
gcaaugcaacaggugucaacucagugaaa

SEQ ID NO: 2085 - RNA, 31 nt, Artificial Sequence
  Synthetic Oligonucleotide; CTLA4 exon 2; Set B
ugcaaugcaacaggugucaacucagugaaau

SEQ ID NO: 2086 - RNA, 35 nt, Artificial Sequence
  Synthetic Oligonucleotide; CTLA4 exon 2; Set C
acugcaaugcaacaggugucaacucagugaaaugg

SEQ ID NO: 2087 - RNA, 30 nt, Artificial Sequence
  Synthetic Oligonucleotide; CTLA4 exon 2; Set B
ugcaaugcaacaggugucaacucagugaaa

SEQ ID NO: 2088 - RNA, 28 nt, Artificial Sequence
  Synthetic Oligonucleotide; CTLA4 exon 2; Set B
gcaaugcaacaggugucaacucagugaa

SEQ ID NO: 2089 - RNA, 32 nt, Artificial Sequence
  Synthetic Oligonucleotide; CTLA4 exon 2; Set B
cugcaaugcaacaggugucaacucagugaaau

SEQ ID NO: 2090 - RNA, 34 nt, Artificial Sequence
  Synthetic Oligonucleotide; CTLA4 exon 2; Set B
acugcaaugcaacaggugucaacucagugaaaug

SEQ ID NO: 2091 - RNA, 31 nt, Artificial Sequence
  Synthetic Oligonucleotide; CTLA4 exon 2; Set B
cugcaaugcaacaggugucaacucagugaaa

SEQ ID NO: 2092 - RNA, 27 nt, Artificial Sequence
  Synthetic Oligonucleotide; CTLA4 exon 2; Set B
gcaaugcaacaggugucaacucaguga

SEQ ID NO: 2093 - RNA, 29 nt, Artificial Sequence
  Synthetic Oligonucleotide; CTLA4 exon 2; Set B
ugcaaugcaacaggugucaacucagugaa

SEQ ID NO: 2094 - RNA, 19 nt, Artificial Sequence
  Synthetic Oligonucleotide; CTLA4 exon 2; Set C
ugcaacaggugucaacuca

SEQ ID NO: 2095 - RNA, 26 nt, Artificial Sequence
  Synthetic Oligonucleotide; CTLA4 exon 2; Set B
gcaaugcaacaggugucaacucagug

SEQ ID NO: 2096 - RNA, 28 nt, Artificial Sequence
  Synthetic Oligonucleotide; CTLA4 exon 2; Set B
ugcaaugcaacaggugucaacucaguga

SEQ ID NO: 2097 - RNA, 24 nt, Artificial Sequence
  Synthetic Oligonucleotide; CTLA4 exon 2; Set B
caaugcaacaggugucaacucagu

SEQ ID NO: 2098 - RNA, 27 nt, Artificial Sequence
  Synthetic Oligonucleotide; CTLA4 exon 2; Set B
ugcaaugcaacaggugucaacucagug

SEQ ID NO: 2099 - RNA, 23 nt, Artificial Sequence
  Synthetic Oligonucleotide; CTLA4 exon 2; Set C
caaugcaacaggugucaacucag

SEQ ID NO: 2100 - RNA, 21 nt, Artificial Sequence
  Synthetic Oligonucleotide; CTLA4 exon 2; Set C
caaugcaacaggugucaacuc

SEQ ID NO: 2101 - RNA, 28 nt, Artificial Sequence
  Synthetic Oligonucleotide; CTLA4 exon 2; Set B
acugcaaugcaacaggugucaacucagu

SEQ ID NO: 2102 - RNA, 20 nt, Artificial Sequence
  Synthetic Oligonucleotide; CTLA4 exon 2; Set C
caaugcaacaggugucaacu

SEQ ID NO: 2103 - RNA, 19 nt, Artificial Sequence
  Synthetic Oligonucleotide; CTLA4 exon 2; Set C
caaugcaacaggugucaac

SEQ ID NO: 2104 - RNA, 27 nt, Artificial Sequence
  Synthetic Oligonucleotide; CTLA4 exon 2; Set B
acugcaaugcaacaggugucaacucag

SEQ ID NO: 2105 - RNA, 18 nt, Artificial Sequence
  Synthetic Oligonucleotide; CTLA4 exon 2; Set C
caaugcaacaggugucaa

SEQ ID NO: 2106 - RNA, 17 nt, Artificial Sequence
  Synthetic Oligonucleotide; CTLA4 exon 2; Set C
caaugcaacagguguca

SEQ ID NO: 2107 - RNA, 25 nt, Artificial Sequence
  Synthetic Oligonucleotide; CTLA4 exon 2; Set B
acugcaaugcaacaggugucaacuc

SEQ ID NO: 2108 - RNA, 24 nt, Artificial Sequence
  Synthetic Oligonucleotide; CTLA4 exon 2; Set B
acugcaaugcaacaggugucaacu

SEQ ID NO: 2109 - RNA, 15 nt, Artificial Sequence
  Synthetic Oligonucleotide; CTLA4 exon 2; Set C
caaugcaacaggugu

SEQ ID NO: 2110 - RNA, 17 nt, Artificial Sequence
  Synthetic Oligonucleotide; CTLA4 exon 2; Set C
gcaaugcaacagguguc

SEQ ID NO: 2111 - RNA, 23 nt, Artificial Sequence
  Synthetic Oligonucleotide; CTLA4 exon 2; Set B
acugcaaugcaacaggugucaac

SEQ ID NO: 2112 - RNA, 22 nt, Artificial Sequence
  Synthetic Oligonucleotide; CTLA4 exon 2; Set B
acugcaaugcaacaggugucaa

SEQ ID NO: 2113 - RNA, 21 nt, Artificial Sequence
  Synthetic Oligonucleotide; CTLA4 exon 2; Set B
acugcaaugcaacagguguca

SEQ ID NO: 2114 - RNA, 15 nt, Artificial Sequence
  Synthetic Oligonucleotide; CTLA4 exon 2; Set C
gaagacugcaaugca

SEQ ID NO: 2115 - RNA, 16 nt, Artificial Sequence
  Synthetic Oligonucleotide; CTLA4 exon 2; Set C
agaagacugcaaugca

SEQ ID NO: 2116 - RNA, 15 nt, Artificial Sequence
  Synthetic Oligonucleotide; CTLA4 exon 2; Set C
caugcuccuucaugg

SEQ ID NO: 2117 - RNA, 24 nt, Artificial Sequence
  Synthetic Oligonucleotide; CTLA4 exon 2; Set A
ucagugaacucaugcuccuucaug

SEQ ID NO: 2118 - RNA, 25 nt, Artificial Sequence
  Synthetic Oligonucleotide; CTLA4 exon 2; Set A
cucagugaacucaugcuccuucaug

SEQ ID NO: 2119 - RNA, 17 nt, Artificial Sequence
  Synthetic Oligonucleotide; CTLA4 exon 2; Set C
gugaacucaugcuccuu

SEQ ID NO: 2120 - RNA, 15 nt, Artificial Sequence
  Synthetic Oligonucleotide; CTLA4 exon 2; Set C
ugaacucaugcuccu

SEQ ID NO: 2121 - RNA, 24 nt, Artificial Sequence
  Synthetic Oligonucleotide; CTLA4 exon 2; Set A
cucagugaacucaugcuccuucau

SEQ ID NO: 2122 - RNA, 23 nt, Artificial Sequence
  Synthetic Oligonucleotide; CTLA4 exon 2; Set A
cucagugaacucaugcuccuuca

SEQ ID NO: 2123 - RNA, 22 nt, Artificial Sequence
  Synthetic Oligonucleotide; CTLA4 exon 2; Set A
cucagugaacucaugcuccuuc

SEQ ID NO: 2124 - RNA, 33 nt, Artificial Sequence
  Synthetic Oligonucleotide; CTLA4 exon 2; Set C
aagggaacucagugaacucaugcuccuucaugg

SEQ ID NO: 2125 - RNA, 28 nt, Artificial Sequence
  Synthetic Oligonucleotide; CTLA4 exon 2; Set A
aagggaacucagugaacucaugcuccuu

SEQ ID NO: 2126 - RNA, 27 nt, Artificial Sequence
  Synthetic Oligonucleotide; CTLA4 exon 2; Set A
aagggaacucagugaacucaugcuccu

SEQ ID NO: 2127 - RNA, 26 nt, Artificial Sequence
  Synthetic Oligonucleotide; CTLA4 exon 2; Set A
aagggaacucagugaacucaugcucc

SEQ ID NO: 2128 - RNA, 40 nt, Artificial Sequence
  Synthetic Oligonucleotide; CTLA4 exon 2; Set C
aaagccaaagggaacucagugaacucaugcuccuucaugg

SEQ ID NO: 2129 - RNA, 25 nt, Artificial Sequence
  Synthetic Oligonucleotide; CTLA4 exon 2; Set A
aagggaacucagugaacucaugcuc

SEQ ID NO: 2130 - RNA, 35 nt, Artificial Sequence
  Synthetic Oligonucleotide; CTLA4 exon 2; Set C
aaagccaaagggaacucagugaacucaugcuccuu

SEQ ID NO: 2131 - RNA, 36 nt, Artificial Sequence
  Synthetic Oligonucleotide; CTLA4 exon 2; Set C
aaaagccaaagggaacucagugaacucaugcuccuu

SEQ ID NO: 2132 - RNA, 20 nt, Artificial Sequence
  Synthetic Oligonucleotide; CTLA4 exon 2; Set C
aagggaacucagugaacuca

SEQ ID NO: 2133 - RNA, 34 nt, Artificial Sequence
  Synthetic Oligonucleotide; CTLA4 exon 2; Set C
aaagccaaagggaacucagugaacucaugcuccu

SEQ ID NO: 2134 - RNA, 37 nt, Artificial Sequence
  Synthetic Oligonucleotide; CTLA4 exon 2; Set C
gaaaagccaaagggaacucagugaacucaugcuccuu

SEQ ID NO: 2135 - RNA, 35 nt, Artificial Sequence
  Synthetic Oligonucleotide; CTLA4 exon 2; Set C
aaaagccaaagggaacucagugaacucaugcuccu

SEQ ID NO: 2136 - RNA, 33 nt, Artificial Sequence
  Synthetic Oligonucleotide; CTLA4 exon 2; Set A
aaagccaaagggaacucagugaacucaugcucc

SEQ ID NO: 2137 - RNA, 38 nt, Artificial Sequence
  Synthetic Oligonucleotide; CTLA4 exon 2; Set C
ggaaaagccaaagggaacucagugaacucaugcuccuu

SEQ ID NO: 2138 - RNA, 36 nt, Artificial Sequence
  Synthetic Oligonucleotide; CTLA4 exon 2; Set C
gaaaagccaaagggaacucagugaacucaugcuccu

SEQ ID NO: 2139 - RNA, 34 nt, Artificial Sequence
  Synthetic Oligonucleotide; CTLA4 exon 2; Set A
aaaagccaaagggaacucagugaacucaugcucc

SEQ ID NO: 2140 - RNA, 39 nt, Artificial Sequence
  Synthetic Oligonucleotide; CTLA4 exon 2; Set C
uggaaaagccaaagggaacucagugaacucaugcuccuu

SEQ ID NO: 2141 - RNA, 37 nt, Artificial Sequence
  Synthetic Oligonucleotide; CTLA4 exon 2; Set C
ggaaaagccaaagggaacucagugaacucaugcuccu

SEQ ID NO: 2142 - RNA, 40 nt, Artificial Sequence
  Synthetic Oligonucleotide; CTLA4 exon 2; Set C
auggaaaagccaaagggaacucagugaacucaugcuccuu

SEQ ID NO: 2143 - RNA, 38 nt, Artificial Sequence
  Synthetic Oligonucleotide; CTLA4 exon 2; Set C
uggaaaagccaaagggaacucagugaacucaugcuccu

SEQ ID NO: 2144 - RNA, 39 nt, Artificial Sequence
  Synthetic Oligonucleotide; CTLA4 exon 2; Set C
auggaaaagccaaagggaacucagugaacucaugcuccu

SEQ ID NO: 2145 - RNA, 37 nt, Artificial Sequence
  Synthetic Oligonucleotide; CTLA4 exon 2; Set C
uggaaaagccaaagggaacucagugaacucaugcucc

SEQ ID NO: 2146 - RNA, 40 nt, Artificial Sequence
  Synthetic Oligonucleotide; CTLA4 exon 2; Set C
cauggaaaagccaaagggaacucagugaacucaugcuccu

SEQ ID NO: 2147 - RNA, 27 nt, Artificial Sequence
  Synthetic Oligonucleotide; CTLA4 exon 2; Set A
aaagccaaagggaacucagugaacuca

SEQ ID NO: 2148 - RNA, 39 nt, Artificial Sequence
  Synthetic Oligonucleotide; CTLA4 exon 2; Set C
cauggaaaagccaaagggaacucagugaacucaugcucc

SEQ ID NO: 2149 - RNA, 28 nt, Artificial Sequence
  Synthetic Oligonucleotide; CTLA4 exon 2; Set A
aaaagccaaagggaacucagugaacuca

SEQ ID NO: 2150 - RNA, 29 nt, Artificial Sequence
  Synthetic Oligonucleotide; CTLA4 exon 2; Set A
gaaaagccaaagggaacucagugaacuca

SEQ ID NO: 2151 - RNA, 30 nt, Artificial Sequence
  Synthetic Oligonucleotide; CTLA4 exon 2; Set A
ggaaaagccaaagggaacucagugaacuca

SEQ ID NO: 2152 - RNA, 31 nt, Artificial Sequence
  Synthetic Oligonucleotide; CTLA4 exon 2; Set A
uggaaaagccaaagggaacucagugaacuca

SEQ ID NO: 2153 - RNA, 32 nt, Artificial Sequence
  Synthetic Oligonucleotide; CTLA4 exon 2; Set A
auggaaaagccaaagggaacucagugaacuca

SEQ ID NO: 2154 - RNA, 21 nt, Artificial Sequence
  Synthetic Oligonucleotide; CTLA4 exon 2; Set C
aaagccaaagggaacucagug

SEQ ID NO: 2155 - RNA, 33 nt, Artificial Sequence
  Synthetic Oligonucleotide; CTLA4 exon 2; Set A
cauggaaaagccaaagggaacucagugaacuca

SEQ ID NO: 2156 - RNA, 22 nt, Artificial Sequence
  Synthetic Oligonucleotide; CTLA4 exon 2; Set C
aaaagccaaagggaacucagug

SEQ ID NO: 2157 - RNA, 20 nt, Artificial Sequence
  Synthetic Oligonucleotide; CTLA4 exon 2; Set C
aaagccaaagggaacucagu

SEQ ID NO: 2158 - RNA, 23 nt, Artificial Sequence
  Synthetic Oligonucleotide; CTLA4 exon 2; Set C
gaaaagccaaagggaacucagug

SEQ ID NO: 2159 - RNA, 21 nt, Artificial Sequence
  Synthetic Oligonucleotide; CTLA4 exon 2; Set C
aaaagccaaagggaacucagu

SEQ ID NO: 2160 - RNA, 24 nt, Artificial Sequence
  Synthetic Oligonucleotide; CTLA4 exon 2; Set C
ggaaaagccaaagggaacucagug

SEQ ID NO: 2161 - RNA, 22 nt, Artificial Sequence
  Synthetic Oligonucleotide; CTLA4 exon 2; Set C
gaaaagccaaagggaacucagu

SEQ ID NO: 2162 - RNA, 20 nt, Artificial Sequence
  Synthetic Oligonucleotide; CTLA4 exon 2; Set C
aaaagccaaagggaacucag

SEQ ID NO: 2163 - RNA, 25 nt, Artificial Sequence
  Synthetic Oligonucleotide; CTLA4 exon 2; Set C
uggaaaagccaaagggaacucagug

SEQ ID NO: 2164 - RNA, 23 nt, Artificial Sequence
  Synthetic Oligonucleotide; CTLA4 exon 2; Set C
ggaaaagccaaagggaacucagu

SEQ ID NO: 2165 - RNA, 26 nt, Artificial Sequence
  Synthetic Oligonucleotide; CTLA4 exon 2; Set C
auggaaaagccaaagggaacucagug

SEQ ID NO: 2166 - RNA, 24 nt, Artificial Sequence
  Synthetic Oligonucleotide; CTLA4 exon 2; Set C
uggaaaagccaaagggaacucagu

SEQ ID NO: 2167 - RNA, 22 nt, Artificial Sequence
  Synthetic Oligonucleotide; CTLA4 exon 2; Set C
ggaaaagccaaagggaacucag

SEQ ID NO: 2168 - RNA, 25 nt, Artificial Sequence
  Synthetic Oligonucleotide; CTLA4 exon 2; Set C
auggaaaagccaaagggaacucagu

SEQ ID NO: 2169 - RNA, 23 nt, Artificial Sequence
  Synthetic Oligonucleotide; CTLA4 exon 2; Set C
uggaaaagccaaagggaacucag

SEQ ID NO: 2170 - RNA, 26 nt, Artificial Sequence
  Synthetic Oligonucleotide; CTLA4 exon 2; Set A
cauggaaaagccaaagggaacucagu

SEQ ID NO: 2171 - RNA, 24 nt, Artificial Sequence
  Synthetic Oligonucleotide; CTLA4 exon 2; Set C
auggaaaagccaaagggaacucag

SEQ ID NO: 2172 - RNA, 40 nt, Artificial Sequence
  Synthetic Oligonucleotide; CTLA4 exon 2; Set C
uugcuagcauggaaaagccaaagggaacucagugaacuca

SEQ ID NO: 2173 - RNA, 25 nt, Artificial Sequence
  Synthetic Oligonucleotide; CTLA4 exon 2; Set C
cauggaaaagccaaagggaacucag

SEQ ID NO: 2174 - RNA, 33 nt, Artificial Sequence
  Synthetic Oligonucleotide; CTLA4 exon 2; Set A
uugcuagcauggaaaagccaaagggaacucagu

SEQ ID NO: 2175 - RNA, 34 nt, Artificial Sequence
  Synthetic Oligonucleotide; CTLA4 exon 2; Set A
auugcuagcauggaaaagccaaagggaacucagu

SEQ ID NO: 2176 - RNA, 32 nt, Artificial Sequence
  Synthetic Oligonucleotide; CTLA4 exon 2; Set A
uugcuagcauggaaaagccaaagggaacucag

SEQ ID NO: 2177 - RNA, 35 nt, Artificial Sequence
  Synthetic Oligonucleotide; CTLA4 exon 2; Set C
cauugcuagcauggaaaagccaaagggaacucagu

SEQ ID NO: 2178 - RNA, 33 nt, Artificial Sequence
  Synthetic Oligonucleotide; CTLA4 exon 2; Set A
auugcuagcauggaaaagccaaagggaacucag

SEQ ID NO: 2179 - RNA, 36 nt, Artificial Sequence
  Synthetic Oligonucleotide; CTLA4 exon 2; Set C
gcauugcuagcauggaaaagccaaagggaacucagu

SEQ ID NO: 2180 - RNA, 34 nt, Artificial Sequence
  Synthetic Oligonucleotide; CTLA4 exon 2; Set A
cauugcuagcauggaaaagccaaagggaacucag

SEQ ID NO: 2181 - RNA, 37 nt, Artificial Sequence
  Synthetic Oligonucleotide; CTLA4 exon 2; Set C
ugcauugcuagcauggaaaagccaaagggaacucagu

SEQ ID NO: 2182 - RNA, 35 nt, Artificial Sequence
  Synthetic Oligonucleotide; CTLA4 exon 2; Set C
gcauugcuagcauggaaaagccaaagggaacucag

SEQ ID NO: 2183 - RNA, 36 nt, Artificial Sequence
  Synthetic Oligonucleotide; CTLA4 exon 2; Set C
ugcauugcuagcauggaaaagccaaagggaacucag

SEQ ID NO: 2184 - RNA, 35 nt, Artificial Sequence
  Synthetic Oligonucleotide; CTLA4 exon 2; Set C
ggccaguaccacagcaggcugggccacgugcauug

SEQ ID NO: 2185 - RNA, 36 nt, Artificial Sequence
  Synthetic Oligonucleotide; CTLA4 exon 2; Set C
uggccaguaccacagcaggcugggccacgugcauug

SEQ ID NO: 2186 - RNA, 34 nt, Artificial Sequence
  Synthetic Oligonucleotide; CTLA4 exon 2; Set C
ggccaguaccacagcaggcugggccacgugcauu

SEQ ID NO: 2187 - RNA, 35 nt, Artificial Sequence
  Synthetic Oligonucleotide; CTLA4 exon 2; Set C
uggccaguaccacagcaggcugggccacgugcauu

SEQ ID NO: 2188 - RNA, 33 nt, Artificial Sequence
  Synthetic Oligonucleotide; CTLA4 exon 2; Set C
ggccaguaccacagcaggcugggccacgugcau

SEQ ID NO: 2189 - RNA, 34 nt, Artificial Sequence
  Synthetic Oligonucleotide; CTLA4 exon 2; Set C
uggccaguaccacagcaggcugggccacgugcau

SEQ ID NO: 2190 - RNA, 35 nt, Artificial Sequence
  Synthetic Oligonucleotide; CTLA4 exon 2; Set C
cuggccaguaccacagcaggcugggccacgugcau

SEQ ID NO: 2191 - RNA, 34 nt, Artificial Sequence
  Synthetic Oligonucleotide; CTLA4 exon 2; Set C
cuggccaguaccacagcaggcugggccacgugca

SEQ ID NO: 2192 - RNA, 33 nt, Artificial Sequence
  Synthetic Oligonucleotide; CTLA4 exon 2; Set C
cuggccaguaccacagcaggcugggccacgugc

SEQ ID NO: 2193 - RNA, 26 nt, Artificial Sequence
  Synthetic Oligonucleotide; CTLA4 exon 2; Set C
uggcgaugccucggcugcuggccagu

SEQ ID NO: 2194 - RNA, 25 nt, Artificial Sequence
  Synthetic Oligonucleotide; CTLA4 exon 2; Set C
uggcgaugccucggcugcuggccag

SEQ ID NO: 2195 - RNA, 39 nt, Artificial Sequence
  Synthetic Oligonucleotide; CTLA4 exon 2; Set C
auacucacacacaaagcuggcgaugccucggcugcuggc

SEQ ID NO: 2196 - RNA, 38 nt, Artificial Sequence
  Synthetic Oligonucleotide; CTLA4 exon 2; Set C
auacucacacacaaagcuggcgaugccucggcugcugg

SEQ ID NO: 2197 - RNA, 40 nt, Artificial Sequence
  Synthetic Oligonucleotide; CTLA4 exon 2; Set C
cauacucacacacaaagcuggcgaugccucggcugcuggc

SEQ ID NO: 2198 - RNA, 37 nt, Artificial Sequence
  Synthetic Oligonucleotide; CTLA4 exon 2; Set C
auacucacacacaaagcuggcgaugccucggcugcug

SEQ ID NO: 2199 - RNA, 39 nt, Artificial Sequence
  Synthetic Oligonucleotide; CTLA4 exon 2; Set C
cauacucacacacaaagcuggcgaugccucggcugcugg

SEQ ID NO: 2200 - RNA, 38 nt, Artificial Sequence
  Synthetic Oligonucleotide; CTLA4 exon 2; Set C
cauacucacacacaaagcuggcgaugccucggcugcug

SEQ ID NO: 2201 - RNA, 40 nt, Artificial Sequence
  Synthetic Oligonucleotide; CTLA4 exon 2; Set C
gcauacucacacacaaagcuggcgaugccucggcugcugg

SEQ ID NO: 2202 - RNA, 39 nt, Artificial Sequence
  Synthetic Oligonucleotide; CTLA4 exon 2; Set C
gcauacucacacacaaagcuggcgaugccucggcugcug

SEQ ID NO: 2203 - RNA, 40 nt, Artificial Sequence
  Synthetic Oligonucleotide; CTLA4 exon 2; Set C
ugcauacucacacacaaagcuggcgaugccucggcugcug

SEQ ID NO: 2204 - RNA, 20 nt, Artificial Sequence
  Synthetic Oligonucleotide; CTLA4 exon 2; Set C
auacucacacacaaagcugg

SEQ ID NO: 2205 - RNA, 21 nt, Artificial Sequence
  Synthetic Oligonucleotide; CTLA4 exon 2; Set C
cauacucacacacaaagcugg

SEQ ID NO: 2206 - RNA, 22 nt, Artificial Sequence
  Synthetic Oligonucleotide; CTLA4 exon 2; Set A
gcauacucacacacaaagcugg

SEQ ID NO: 2207 - RNA, 23 nt, Artificial Sequence
  Synthetic Oligonucleotide; CTLA4 exon 2; Set A
ugcauacucacacacaaagcugg

SEQ ID NO: 2208 - RNA, 19 nt, Artificial Sequence
  Synthetic Oligonucleotide; CTLA4 exon 2; Set C
cuuugccuggagaugcaua

SEQ ID NO: 2209 - RNA, 18 nt, Artificial Sequence
  Synthetic Oligonucleotide; CTLA4 exon 2; Set C
cuuugccuggagaugcau

SEQ ID NO: 2210 - RNA, 17 nt, Artificial Sequence
  Synthetic Oligonucleotide; CTLA4 exon 2; Set C
cuuugccuggagaugca

SEQ ID NO: 2211 - RNA, 38 nt, Artificial Sequence
  Synthetic Oligonucleotide; CTLA4 exon 2; Set C
ugucagccugccgaagcacugucacccggaccucagug

SEQ ID NO: 2212 - RNA, 23 nt, Artificial Sequence
  Synthetic Oligonucleotide; CTLA4 exon 2; Set C
caccuggcugucagccugccgaa

SEQ ID NO: 2213 - RNA, 24 nt, Artificial Sequence
  Synthetic Oligonucleotide; CTLA4 exon 2; Set C
ucaccuggcugucagccugccgaa

SEQ ID NO: 2214 - RNA, 22 nt, Artificial Sequence
  Synthetic Oligonucleotide; CTLA4 exon 2; Set C
caccuggcugucagccugccga

SEQ ID NO: 2215 - RNA, 25 nt, Artificial Sequence
  Synthetic Oligonucleotide; CTLA4 exon 2; Set C
gucaccuggcugucagccugccgaa

SEQ ID NO: 2216 - RNA, 23 nt, Artificial Sequence
  Synthetic Oligonucleotide; CTLA4 exon 2; Set C
ucaccuggcugucagccugccga

SEQ ID NO: 2217 - RNA, 26 nt, Artificial Sequence
  Synthetic Oligonucleotide; CTLA4 exon 2; Set C
agucaccuggcugucagccugccgaa

SEQ ID NO: 2218 - RNA, 24 nt, Artificial Sequence
  Synthetic Oligonucleotide; CTLA4 exon 2; Set C
gucaccuggcugucagccugccga

SEQ ID NO: 2219 - RNA, 27 nt, Artificial Sequence
  Synthetic Oligonucleotide; CTLA4 exon 2; Set C
cagucaccuggcugucagccugccgaa

SEQ ID NO: 2220 - RNA, 25 nt, Artificial Sequence
  Synthetic Oligonucleotide; CTLA4 exon 2; Set C
agucaccuggcugucagccugccga

SEQ ID NO: 2221 - RNA, 28 nt, Artificial Sequence
  Synthetic Oligonucleotide; CTLA4 exon 2; Set C
ucagucaccuggcugucagccugccgaa

SEQ ID NO: 2222 - RNA, 29 nt, Artificial Sequence
  Synthetic Oligonucleotide; CTLA4 exon 2; Set C
uucagucaccuggcugucagccugccgaa

SEQ ID NO: 2223 - RNA, 27 nt, Artificial Sequence
  Synthetic Oligonucleotide; CTLA4 exon 2; Set C
ucagucaccuggcugucagccugccga

SEQ ID NO: 2224 - RNA, 28 nt, Artificial Sequence
  Synthetic Oligonucleotide; CTLA4 exon 2; Set C
uucagucaccuggcugucagccugccga

SEQ ID NO: 2225 - RNA, 32 nt, Artificial Sequence
  Synthetic Oligonucleotide; CTLA4 exon 2; Set C
uugccgcacagacuucagucaccuggcuguca

SEQ ID NO: 2226 - RNA, 31 nt, Artificial Sequence
  Synthetic Oligonucleotide; CTLA4 exon 2; Set C
uugccgcacagacuucagucaccuggcuguc

SEQ ID NO: 2227 - RNA, 33 nt, Artificial Sequence
  Synthetic Oligonucleotide; CTLA4 exon 2; Set C
guugccgcacagacuucagucaccuggcuguca

SEQ ID NO: 2228 - RNA, 37 nt, Artificial Sequence
  Synthetic Oligonucleotide; CTLA4 exon 2; Set C
guagguugccgcacagacuucagucaccuggcuguca

SEQ ID NO: 2229 - RNA, 36 nt, Artificial Sequence
  Synthetic Oligonucleotide; CTLA4 exon 2; Set C
guagguugccgcacagacuucagucaccuggcuguc

SEQ ID NO: 2230 - RNA, 37 nt, Artificial Sequence
  Synthetic Oligonucleotide; CTLA4 exon 2; Set C
uguagguugccgcacagacuucagucaccuggcuguc

SEQ ID NO: 2231 - RNA, 39 nt, Artificial Sequence
  Synthetic Oligonucleotide; CTLA4 exon 2; Set C
auguagguugccgcacagacuucagucaccuggcuguca

SEQ ID NO: 2232 - RNA, 38 nt, Artificial Sequence
  Synthetic Oligonucleotide; CTLA4 exon 2; Set C
auguagguugccgcacagacuucagucaccuggcuguc

SEQ ID NO: 2233 - RNA, 40 nt, Artificial Sequence
  Synthetic Oligonucleotide; CTLA4 exon 2; Set C
cauguagguugccgcacagacuucagucaccuggcuguca

SEQ ID NO: 2234 - RNA, 39 nt, Artificial Sequence
  Synthetic Oligonucleotide; CTLA4 exon 2; Set C
cauguagguugccgcacagacuucagucaccuggcuguc

SEQ ID NO: 2235 - RNA, 40 nt, Artificial Sequence
  Synthetic Oligonucleotide; CTLA4 exon 2; Set C
ucauguagguugccgcacagacuucagucaccuggcuguc

SEQ ID NO: 2236 - RNA, 40 nt, Artificial Sequence
  Synthetic Oligonucleotide; CTLA4 exon 2; Set C
aucauguagguugccgcacagacuucagucaccuggcugu

SEQ ID NO: 2237 - RNA, 39 nt, Artificial Sequence
  Synthetic Oligonucleotide; CTLA4 exon 2; Set C
aucauguagguugccgcacagacuucagucaccuggcug

SEQ ID NO: 2238 - RNA, 38 nt, Artificial Sequence
  Synthetic Oligonucleotide; CTLA4 exon 2; Set C
aucauguagguugccgcacagacuucagucaccuggcu

SEQ ID NO: 2239 - RNA, 29 nt, Artificial Sequence
  Synthetic Oligonucleotide; CTLA4 exon 2; Set C
uguagguugccgcacagacuucagucacc

SEQ ID NO: 2240 - RNA, 16 nt, Artificial Sequence
  Synthetic Oligonucleotide; CTLA4 exon 2; Set C
uugccgcacagacuuc

SEQ ID NO: 2241 - RNA, 30 nt, Artificial Sequence
  Synthetic Oligonucleotide; CTLA4 exon 2; Set C
auguagguugccgcacagacuucagucacc

SEQ ID NO: 2242 - RNA, 23 nt, Artificial Sequence
  Synthetic Oligonucleotide; CTLA4 exon 2; Set A
guagguugccgcacagacuucag

SEQ ID NO: 2243 - RNA, 33 nt, Artificial Sequence
  Synthetic Oligonucleotide; CTLA4 exon 2; Set C
aucauguagguugccgcacagacuucagucacc

SEQ ID NO: 2244 - RNA, 32 nt, Artificial Sequence
  Synthetic Oligonucleotide; CTLA4 exon 2; Set C
aucauguagguugccgcacagacuucagucac

SEQ ID NO: 2245 - RNA, 22 nt, Artificial Sequence
  Synthetic Oligonucleotide; CTLA4 exon 2; Set A
guagguugccgcacagacuuca

SEQ ID NO: 2246 - RNA, 24 nt, Artificial Sequence
  Synthetic Oligonucleotide; CTLA4 exon 2; Set A
uguagguugccgcacagacuucag

SEQ ID NO: 2247 - RNA, 31 nt, Artificial Sequence
  Synthetic Oligonucleotide; CTLA4 exon 2; Set C
aucauguagguugccgcacagacuucaguca

SEQ ID NO: 2248 - RNA, 21 nt, Artificial Sequence
  Synthetic Oligonucleotide; CTLA4 exon 2; Set A
guagguugccgcacagacuuc

SEQ ID NO: 2249 - RNA, 23 nt, Artificial Sequence
  Synthetic Oligonucleotide; CTLA4 exon 2; Set C
uguagguugccgcacagacuuca

SEQ ID NO: 2250 - RNA, 25 nt, Artificial Sequence
  Synthetic Oligonucleotide; CTLA4 exon 2; Set A
auguagguugccgcacagacuucag

SEQ ID NO: 2251 - RNA, 30 nt, Artificial Sequence
  Synthetic Oligonucleotide; CTLA4 exon 2; Set C
aucauguagguugccgcacagacuucaguc

SEQ ID NO: 2252 - RNA, 22 nt, Artificial Sequence
  Synthetic Oligonucleotide; CTLA4 exon 2; Set A
uguagguugccgcacagacuuc

SEQ ID NO: 2253 - RNA, 24 nt, Artificial Sequence
  Synthetic Oligonucleotide; CTLA4 exon 2; Set A
auguagguugccgcacagacuuca

SEQ ID NO: 2254 - RNA, 26 nt, Artificial Sequence
  Synthetic Oligonucleotide; CTLA4 exon 2; Set C
cauguagguugccgcacagacuucag

SEQ ID NO: 2255 - RNA, 29 nt, Artificial Sequence
  Synthetic Oligonucleotide; CTLA4 exon 2; Set C
aucauguagguugccgcacagacuucagu

SEQ ID NO: 2256 - RNA, 23 nt, Artificial Sequence
  Synthetic Oligonucleotide; CTLA4 exon 2; Set A
auguagguugccgcacagacuuc

SEQ ID NO: 2257 - RNA, 25 nt, Artificial Sequence
  Synthetic Oligonucleotide; CTLA4 exon 2; Set C
cauguagguugccgcacagacuuca

SEQ ID NO: 2258 - RNA, 27 nt, Artificial Sequence
  Synthetic Oligonucleotide; CTLA4 exon 2; Set C
ucauguagguugccgcacagacuucag

SEQ ID NO: 2259 - RNA, 24 nt, Artificial Sequence
  Synthetic Oligonucleotide; CTLA4 exon 2; Set A
cauguagguugccgcacagacuuc

SEQ ID NO: 2260 - RNA, 26 nt, Artificial Sequence
  Synthetic Oligonucleotide; CTLA4 exon 2; Set C
ucauguagguugccgcacagacuuca

SEQ ID NO: 2261 - RNA, 25 nt, Artificial Sequence
  Synthetic Oligonucleotide; CTLA4 exon 2; Set C
ucauguagguugccgcacagacuuc

SEQ ID NO: 2262 - RNA, 33 nt, Artificial Sequence
  Synthetic Oligonucleotide; CTLA4 exon 2; Set C
aggaaggucaacucauuccccaucauguagguu

SEQ ID NO: 2263 - RNA, 32 nt, Artificial Sequence
  Synthetic Oligonucleotide; CTLA4 exon 2; Set C
aggaaggucaacucauuccccaucauguaggu

SEQ ID NO: 2264 - RNA, 27 nt, Artificial Sequence
  Synthetic Oligonucleotide; CTLA4 exon 2; Set A
gaaggucaacucauuccccaucaugua

SEQ ID NO: 2265 - RNA, 28 nt, Artificial Sequence
  Synthetic Oligonucleotide; CTLA4 exon 2; Set A
ggaaggucaacucauuccccaucaugua

SEQ ID NO: 2266 - RNA, 26 nt, Artificial Sequence
  Synthetic Oligonucleotide; CTLA4 exon 2; Set A
gaaggucaacucauuccccaucaugu

SEQ ID NO: 2267 - RNA, 25 nt, Artificial Sequence
  Synthetic Oligonucleotide; CTLA4 exon 2; Set A
gaaggucaacucauuccccaucaug

SEQ ID NO: 2268 - RNA, 27 nt, Artificial Sequence
  Synthetic Oligonucleotide; CTLA4 exon 2; Set A
ggaaggucaacucauuccccaucaugu

SEQ ID NO: 2269 - RNA, 24 nt, Artificial Sequence
  Synthetic Oligonucleotide; CTLA4 exon 2; Set A
gaaggucaacucauuccccaucau

SEQ ID NO: 2270 - RNA, 26 nt, Artificial Sequence
  Synthetic Oligonucleotide; CTLA4 exon 2; Set A
ggaaggucaacucauuccccaucaug

SEQ ID NO: 2271 - RNA, 23 nt, Artificial Sequence
  Synthetic Oligonucleotide; CTLA4 exon 2; Set A
gaaggucaacucauuccccauca

SEQ ID NO: 2272 - RNA, 25 nt, Artificial Sequence
  Synthetic Oligonucleotide; CTLA4 exon 2; Set A
ggaaggucaacucauuccccaucau

SEQ ID NO: 2273 - RNA, 24 nt, Artificial Sequence
  Synthetic Oligonucleotide; CTLA4 exon 2; Set A
ggaaggucaacucauuccccauca

SEQ ID NO: 2274 - RNA, 18 nt, Artificial Sequence
  Synthetic Oligonucleotide; CTLA4 exon 2; Set C
aggaaggucaacucauuc

SEQ ID NO: 2275 - RNA, 17 nt, Artificial Sequence
  Synthetic Oligonucleotide; CTLA4 exon 2; Set C
aggaaggucaacucauu

SEQ ID NO: 2276 - RNA, 16 nt, Artificial Sequence
  Synthetic Oligonucleotide; CTLA4 exon 2; Set C
aggaaggucaacucau

SEQ ID NO: 2277 - RNA, 32 nt, Artificial Sequence
  Synthetic Oligonucleotide; CTLA4 exon 2; Set A
aaucaucuaggaaggucaacucauuccccauc

SEQ ID NO: 2278 - RNA, 15 nt, Artificial Sequence
  Synthetic Oligonucleotide; CTLA4 exon 2; Set C
aggaaggucaacuca

SEQ ID NO: 2279 - RNA, 33 nt, Artificial Sequence
  Synthetic Oligonucleotide; CTLA4 exon 2; Set A
gaaucaucuaggaaggucaacucauuccccauc

SEQ ID NO: 2280 - RNA, 34 nt, Artificial Sequence
  Synthetic Oligonucleotide; CTLA4 exon 2; Set C
ggaaucaucuaggaaggucaacucauuccccauc

SEQ ID NO: 2281 - RNA, 35 nt, Artificial Sequence
  Synthetic Oligonucleotide; CTLA4 exon 2; Set C
uggaaucaucuaggaaggucaacucauuccccauc

SEQ ID NO: 2282 - RNA, 36 nt, Artificial Sequence
  Synthetic Oligonucleotide; CTLA4 exon 2; Set C
auggaaucaucuaggaaggucaacucauuccccauc

SEQ ID NO: 2283 - RNA, 30 nt, Artificial Sequence
  Synthetic Oligonucleotide; CTLA4 exon 2; Set A
gauggaaucaucuaggaaggucaacucauu

SEQ ID NO: 2284 - RNA, 29 nt, Artificial Sequence
  Synthetic Oligonucleotide; CTLA4 exon 2; Set A
gauggaaucaucuaggaaggucaacucau

SEQ ID NO: 2285 - RNA, 16 nt, Artificial Sequence
  Synthetic Oligonucleotide; CTLA4 exon 2; Set C
uggaaucaucuaggaa

SEQ ID NO: 2286 - RNA, 17 nt, Artificial Sequence
  Synthetic Oligonucleotide; CTLA4 exon 2; Set C
auggaaucaucuaggaa

SEQ ID NO: 2287 - RNA, 16 nt, Artificial Sequence
  Synthetic Oligonucleotide; CTLA4 exon 2; Set C
auggaaucaucuagga

SEQ ID NO: 2288 - RNA, 40 nt, Artificial Sequence
  Synthetic Oligonucleotide; CTLA4 exon 2; Set C
cuggaggugcccgugcagauggaaucaucuaggaagguca

SEQ ID NO: 2289 - RNA, 30 nt, Artificial Sequence
  Synthetic Oligonucleotide; CTLA4 exon 2; Set C
ggugcccgugcagauggaaucaucuaggaa

SEQ ID NO: 2290 - RNA, 39 nt, Artificial Sequence
  Synthetic Oligonucleotide; CTLA4 exon 2; Set C
cuggaggugcccgugcagauggaaucaucuaggaagguc

SEQ ID NO: 2291 - RNA, 29 nt, Artificial Sequence
  Synthetic Oligonucleotide; CTLA4 exon 2; Set C
ggugcccgugcagauggaaucaucuagga

SEQ ID NO: 2292 - RNA, 38 nt, Artificial Sequence
  Synthetic Oligonucleotide; CTLA4 exon 2; Set C
cuggaggugcccgugcagauggaaucaucuaggaaggu

SEQ ID NO: 2293 - RNA, 37 nt, Artificial Sequence
  Synthetic Oligonucleotide; CTLA4 exon 2; Set C
cuggaggugcccgugcagauggaaucaucuaggaagg

SEQ ID NO: 2294 - RNA, 36 nt, Artificial Sequence
  Synthetic Oligonucleotide; CTLA4 exon 2; Set C
cuggaggugcccgugcagauggaaucaucuaggaag

SEQ ID NO: 2295 - RNA, 40 nt, Artificial Sequence
  Synthetic Oligonucleotide; CTLA4 exon 2; Set C
uuuccacuggaggugcccgugcagauggaaucaucuagga

SEQ ID NO: 2296 - RNA, 23 nt, Artificial Sequence
  Synthetic Oligonucleotide; CTLA4 exon 2; Set C
cuggaggugcccgugcagaugga

SEQ ID NO: 2297 - RNA, 22 nt, Artificial Sequence
  Synthetic Oligonucleotide; CTLA4 exon 2; Set C
cuggaggugcccgugcagaugg

SEQ ID NO: 2298 - RNA, 21 nt, Artificial Sequence
  Synthetic Oligonucleotide; CTLA4 exon 2; Set A
cuggaggugcccgugcagaug

SEQ ID NO: 2299 - RNA, 30 nt, Artificial Sequence
  Synthetic Oligonucleotide; CTLA4 exon 2; Set C
uuccacuggaggugcccgugcagauggaau

SEQ ID NO: 2300 - RNA, 29 nt, Artificial Sequence
  Synthetic Oligonucleotide; CTLA4 exon 2; Set C
uuccacuggaggugcccgugcagauggaa

SEQ ID NO: 2301 - RNA, 28 nt, Artificial Sequence
  Synthetic Oligonucleotide; CTLA4 exon 2; Set C
uuccacuggaggugcccgugcagaugga

SEQ ID NO: 2302 - RNA, 27 nt, Artificial Sequence
  Synthetic Oligonucleotide; CTLA4 exon 2; Set C
uuccacuggaggugcccgugcagaugg

SEQ ID NO: 2303 - RNA, 26 nt, Artificial Sequence
  Synthetic Oligonucleotide; CTLA4 exon 2; Set C
uuccacuggaggugcccgugcagaug

SEQ ID NO: 2304 - RNA, 36 nt, Artificial Sequence
  Synthetic Oligonucleotide; CTLA4 exon 2; Set C
cuugauuuccacuggaggugcccgugcagauggaau

SEQ ID NO: 2305 - RNA, 35 nt, Artificial Sequence
  Synthetic Oligonucleotide; CTLA4 exon 2; Set C
cuugauuuccacuggaggugcccgugcagauggaa

SEQ ID NO: 2306 - RNA, 37 nt, Artificial Sequence
  Synthetic Oligonucleotide; CTLA4 exon 2; Set C
acuugauuuccacuggaggugcccgugcagauggaau

SEQ ID NO: 2307 - RNA, 34 nt, Artificial Sequence
  Synthetic Oligonucleotide; CTLA4 exon 2; Set C
cuugauuuccacuggaggugcccgugcagaugga

SEQ ID NO: 2308 - RNA, 32 nt, Artificial Sequence
  Synthetic Oligonucleotide; CTLA4 exon 2; Set C
uugauuuccacuggaggugcccgugcagaugg

SEQ ID NO: 2309 - RNA, 39 nt, Artificial Sequence
  Synthetic Oligonucleotide; CTLA4 exon 2; Set C
ucacuugauuuccacuggaggugcccgugcagauggaau

SEQ ID NO: 2310 - RNA, 31 nt, Artificial Sequence
  Synthetic Oligonucleotide; CTLA4 exon 2; Set C
uugauuuccacuggaggugcccgugcagaug

SEQ ID NO: 2311 - RNA, 33 nt, Artificial Sequence
  Synthetic Oligonucleotide; CTLA4 exon 2; Set C
cuugauuuccacuggaggugcccgugcagaugg

SEQ ID NO: 2312 - RNA, 38 nt, Artificial Sequence
  Synthetic Oligonucleotide; CTLA4 exon 2; Set C
ucacuugauuuccacuggaggugcccgugcagauggaa

SEQ ID NO: 2313 - RNA, 40 nt, Artificial Sequence
  Synthetic Oligonucleotide; CTLA4 exon 2; Set C
uucacuugauuuccacuggaggugcccgugcagauggaau

SEQ ID NO: 2314 - RNA, 32 nt, Artificial Sequence
  Synthetic Oligonucleotide; CTLA4 exon 2; Set C
cuugauuuccacuggaggugcccgugcagaug

SEQ ID NO: 2315 - RNA, 39 nt, Artificial Sequence
  Synthetic Oligonucleotide; CTLA4 exon 2; Set C
uucacuugauuuccacuggaggugcccgugcagauggaa

SEQ ID NO: 2316 - RNA, 18 nt, Artificial Sequence
  Synthetic Oligonucleotide; CTLA4 exon 2; Set C
ugauuuccacuggaggug

SEQ ID NO: 2317 - RNA, 20 nt, Artificial Sequence
  Synthetic Oligonucleotide; CTLA4 exon 2; Set C
acuugauuuccacuggaggu

SEQ ID NO: 2318 - RNA, 21 nt, Artificial Sequence
  Synthetic Oligonucleotide; CTLA4 exon 2; Set A
cacuugauuuccacuggaggu

SEQ ID NO: 2319 - RNA, 22 nt, Artificial Sequence
  Synthetic Oligonucleotide; CTLA4 exon 2; Set A
ucacuugauuuccacuggaggu

SEQ ID NO: 2320 - RNA, 23 nt, Artificial Sequence
  Synthetic Oligonucleotide; CTLA4 exon 2; Set A
uucacuugauuuccacuggaggu

SEQ ID NO: 2321 - RNA, 20 nt, Artificial Sequence
  Synthetic Oligonucleotide; CTLA4 exon 2; Set C
guucacuugauuuccacugg

SEQ ID NO: 2322 - RNA, 21 nt, Artificial Sequence
  Synthetic Oligonucleotide; CTLA4 exon 2; Set C
gguucacuugauuuccacugg

SEQ ID NO: 2323 - RNA, 22 nt, Artificial Sequence
  Synthetic Oligonucleotide; CTLA4 exon 2; Set C
agguucacuugauuuccacugg

SEQ ID NO: 2324 - RNA, 18 nt, Artificial Sequence
  Synthetic Oligonucleotide; CTLA4 exon 2; Set C
guucacuugauuuccacu

SEQ ID NO: 2325 - RNA, 19 nt, Artificial Sequence
  Synthetic Oligonucleotide; CTLA4 exon 2; Set C
gguucacuugauuuccacu

SEQ ID NO: 2326 - RNA, 32 nt, Artificial Sequence
  Synthetic Oligonucleotide; CTLA4 exon 2; Set C
auagugagguucacuugauuuccacuggaggu

SEQ ID NO: 2327 - RNA, 20 nt, Artificial Sequence
  Synthetic Oligonucleotide; CTLA4 exon 2; Set C
agguucacuugauuuccacu

SEQ ID NO: 2328 - RNA, 15 nt, Artificial Sequence
  Synthetic Oligonucleotide; CTLA4 exon 2; Set C
guucacuugauuucc

SEQ ID NO: 2329 - RNA, 34 nt, Artificial Sequence
  Synthetic Oligonucleotide; CTLA4 exon 2; Set C
ggauagugagguucacuugauuuccacuggaggu

SEQ ID NO: 2330 - RNA, 16 nt, Artificial Sequence
  Synthetic Oligonucleotide; CTLA4 exon 2; Set C
gguucacuugauuucc

SEQ ID NO: 2331 - RNA, 35 nt, Artificial Sequence
  Synthetic Oligonucleotide; CTLA4 exon 2; Set C
uggauagugagguucacuugauuuccacuggaggu

SEQ ID NO: 2332 - RNA, 17 nt, Artificial Sequence
  Synthetic Oligonucleotide; CTLA4 exon 2; Set C
agguucacuugauuucc

SEQ ID NO: 2333 - RNA, 28 nt, Artificial Sequence
  Synthetic Oligonucleotide; CTLA4 exon 2; Set A
gauagugagguucacuugauuuccacug

SEQ ID NO: 2334 - RNA, 32 nt, Artificial Sequence
  Synthetic Oligonucleotide; CTLA4 exon 2; Set A
cuuggauagugagguucacuugauuuccacug

SEQ ID NO: 2335 - RNA, 21 nt, Artificial Sequence
  Synthetic Oligonucleotide; CTLA4 exon 2; Set C
auagugagguucacuugauuu

SEQ ID NO: 2336 - RNA, 23 nt, Artificial Sequence
  Synthetic Oligonucleotide; CTLA4 exon 2; Set C
gauagugagguucacuugauuuc

SEQ ID NO: 2337 - RNA, 20 nt, Artificial Sequence
  Synthetic Oligonucleotide; CTLA4 exon 2; Set C
auagugagguucacuugauu

SEQ ID NO: 2338 - RNA, 19 nt, Artificial Sequence
  Synthetic Oligonucleotide; CTLA4 exon 2; Set C
auagugagguucacuugau

SEQ ID NO: 2339 - RNA, 23 nt, Artificial Sequence
  Synthetic Oligonucleotide; CTLA4 exon 2; Set C
ggauagugagguucacuugauuu

SEQ ID NO: 2340 - RNA, 18 nt, Artificial Sequence
  Synthetic Oligonucleotide; CTLA4 exon 2; Set C
auagugagguucacuuga

SEQ ID NO: 2341 - RNA, 22 nt, Artificial Sequence
  Synthetic Oligonucleotide; CTLA4 exon 2; Set C
ggauagugagguucacuugauu

SEQ ID NO: 2342 - RNA, 24 nt, Artificial Sequence
  Synthetic Oligonucleotide; CTLA4 exon 2; Set C
uggauagugagguucacuugauuu

SEQ ID NO: 2343 - RNA, 21 nt, Artificial Sequence
  Synthetic Oligonucleotide; CTLA4 exon 2; Set C
ggauagugagguucacuugau

SEQ ID NO: 2344 - RNA, 23 nt, Artificial Sequence
  Synthetic Oligonucleotide; CTLA4 exon 2; Set C
uggauagugagguucacuugauu

SEQ ID NO: 2345 - RNA, 37 nt, Artificial Sequence
  Synthetic Oligonucleotide; CTLA4 exon 2; Set C
caguccuuggauagugagguucacuugauuuccacug

SEQ ID NO: 2346 - RNA, 27 nt, Artificial Sequence
  Synthetic Oligonucleotide; CTLA4 exon 2; Set A
cuuggauagugagguucacuugauuuc

SEQ ID NO: 2347 - RNA, 20 nt, Artificial Sequence
  Synthetic Oligonucleotide; CTLA4 exon 2; Set C
ggauagugagguucacuuga

SEQ ID NO: 2348 - RNA, 22 nt, Artificial Sequence
  Synthetic Oligonucleotide; CTLA4 exon 2; Set C
uggauagugagguucacuugau

SEQ ID NO: 2349 - RNA, 18 nt, Artificial Sequence
  Synthetic Oligonucleotide; CTLA4 exon 2; Set C
gauagugagguucacuug

SEQ ID NO: 2350 - RNA, 38 nt, Artificial Sequence
  Synthetic Oligonucleotide; CTLA4 exon 2; Set C
ucaguccuuggauagugagguucacuugauuuccacug

SEQ ID NO: 2351 - RNA, 21 nt, Artificial Sequence
  Synthetic Oligonucleotide; CTLA4 exon 2; Set C
uggauagugagguucacuuga

SEQ ID NO: 2352 - RNA, 39 nt, Artificial Sequence
  Synthetic Oligonucleotide; CTLA4 exon 2; Set C
cucaguccuuggauagugagguucacuugauuuccacug

SEQ ID NO: 2353 - RNA, 31 nt, Artificial Sequence
  Synthetic Oligonucleotide; CTLA4 exon 2; Set A
aguccuuggauagugagguucacuugauuuc

SEQ ID NO: 2354 - RNA, 22 nt, Artificial Sequence
  Synthetic Oligonucleotide; CTLA4 exon 2; Set C
cuuggauagugagguucacuug

SEQ ID NO: 2355 - RNA, 32 nt, Artificial Sequence
  Synthetic Oligonucleotide; CTLA4 exon 2; Set A
caguccuuggauagugagguucacuugauuuc

SEQ ID NO: 2356 - RNA, 33 nt, Artificial Sequence
  Synthetic Oligonucleotide; CTLA4 exon 2; Set C
ucaguccuuggauagugagguucacuugauuuc

SEQ ID NO: 2357 - RNA, 34 nt, Artificial Sequence
  Synthetic Oligonucleotide; CTLA4 exon 2; Set C
cucaguccuuggauagugagguucacuugauuuc

SEQ ID NO: 2358 - RNA, 15 nt, Artificial Sequence
  Synthetic Oligonucleotide; CTLA4 exon 2; Set C
uuggauagugagguu

SEQ ID NO: 2359 - RNA, 27 nt, Artificial Sequence
  Synthetic Oligonucleotide; CTLA4 exon 2; Set A
caguccuuggauagugagguucacuug

SEQ ID NO: 2360 - RNA, 25 nt, Artificial Sequence
  Synthetic Oligonucleotide; CTLA4 exon 2; Set A
aguccuuggauagugagguucacuu

SEQ ID NO: 2361 - RNA, 28 nt, Artificial Sequence
  Synthetic Oligonucleotide; CTLA4 exon 2; Set A
ucaguccuuggauagugagguucacuug

SEQ ID NO: 2362 - RNA, 26 nt, Artificial Sequence
  Synthetic Oligonucleotide; CTLA4 exon 2; Set A
caguccuuggauagugagguucacuu

SEQ ID NO: 2363 - RNA, 29 nt, Artificial Sequence
  Synthetic Oligonucleotide; CTLA4 exon 2; Set A
cucaguccuuggauagugagguucacuug

SEQ ID NO: 2364 - RNA, 27 nt, Artificial Sequence
  Synthetic Oligonucleotide; CTLA4 exon 2; Set A
ucaguccuuggauagugagguucacuu

SEQ ID NO: 2365 - RNA, 38 nt, Artificial Sequence
  Synthetic Oligonucleotide; CTLA4 exon 2; Set C
uggcccucaguccuuggauagugagguucacuugauuu

SEQ ID NO: 2366 - RNA, 28 nt, Artificial Sequence
  Synthetic Oligonucleotide; CTLA4 exon 2; Set A
cucaguccuuggauagugagguucacuu

SEQ ID NO: 2367 - RNA, 37 nt, Artificial Sequence
  Synthetic Oligonucleotide; CTLA4 exon 2; Set C
uggcccucaguccuuggauagugagguucacuugauu

SEQ ID NO: 2368 - RNA, 15 nt, Artificial Sequence
  Synthetic Oligonucleotide; CTLA4 exon 2; Set C
ccuuggauagugagg

SEQ ID NO: 2369 - RNA, 39 nt, Artificial Sequence
  Synthetic Oligonucleotide; CTLA4 exon 2; Set C
auggcccucaguccuuggauagugagguucacuugauuu

SEQ ID NO: 2370 - RNA, 36 nt, Artificial Sequence
  Synthetic Oligonucleotide; CTLA4 exon 2; Set C
uggcccucaguccuuggauagugagguucacuugau

SEQ ID NO: 2371 - RNA, 38 nt, Artificial Sequence
  Synthetic Oligonucleotide; CTLA4 exon 2; Set C
auggcccucaguccuuggauagugagguucacuugauu

SEQ ID NO: 2372 - RNA, 16 nt, Artificial Sequence
  Synthetic Oligonucleotide; CTLA4 exon 2; Set C
uccuuggauagugagg

SEQ ID NO: 2373 - RNA, 35 nt, Artificial Sequence
  Synthetic Oligonucleotide; CTLA4 exon 2; Set C
uggcccucaguccuuggauagugagguucacuuga

SEQ ID NO: 2374 - RNA, 37 nt, Artificial Sequence
  Synthetic Oligonucleotide; CTLA4 exon 2; Set C
auggcccucaguccuuggauagugagguucacuugau

SEQ ID NO: 2375 - RNA, 36 nt, Artificial Sequence
  Synthetic Oligonucleotide; CTLA4 exon 2; Set C
auggcccucaguccuuggauagugagguucacuuga

SEQ ID NO: 2376 - RNA, 28 nt, Artificial Sequence
  Synthetic Oligonucleotide; CTLA4 exon 2; Set C
uggcccucaguccuuggauagugagguu

SEQ ID NO: 2377 - RNA, 29 nt, Artificial Sequence
  Synthetic Oligonucleotide; CTLA4 exon 2; Set C
auggcccucaguccuuggauagugagguu

SEQ ID NO: 2378 - RNA, 27 nt, Artificial Sequence
  Synthetic Oligonucleotide; CTLA4 exon 2; Set C
uggcccucaguccuuggauagugaggu

SEQ ID NO: 2379 - RNA, 26 nt, Artificial Sequence
  Synthetic Oligonucleotide; CTLA4 exon 2; Set C
uggcccucaguccuuggauagugagg

SEQ ID NO: 2380 - RNA, 15 nt, Artificial Sequence
  Synthetic Oligonucleotide; CTLA4 exon 2; Set C
cucaguccuuggaua

SEQ ID NO: 2381 - RNA, 19 nt, Artificial Sequence
  Synthetic Oligonucleotide; CTLA4 exon 2; Set A
uggcccucaguccuuggau

SEQ ID NO: 2382 - RNA, 36 nt, Artificial Sequence
  Synthetic Oligonucleotide; CTLA4 exon 2; Set C
gauguagagucccguguccauggcccucaguccuug

SEQ ID NO: 2383 - RNA, 37 nt, Artificial Sequence
  Synthetic Oligonucleotide; CTLA4 exon 2; Set C
agauguagagucccguguccauggcccucaguccuug

SEQ ID NO: 2384 - RNA, 34 nt, Artificial Sequence
  Synthetic Oligonucleotide; CTLA4 exon 2; Set C
gauguagagucccguguccauggcccucaguccu

SEQ ID NO: 2385 - RNA, 38 nt, Artificial Sequence
  Synthetic Oligonucleotide; CTLA4 exon 2; Set C
cagauguagagucccguguccauggcccucaguccuug

SEQ ID NO: 2386 - RNA, 35 nt, Artificial Sequence
  Synthetic Oligonucleotide; CTLA4 exon 2; Set C
agauguagagucccguguccauggcccucaguccu

SEQ ID NO: 2387 - RNA, 33 nt, Artificial Sequence
  Synthetic Oligonucleotide; CTLA4 exon 2; Set C
gauguagagucccguguccauggcccucagucc

SEQ ID NO: 2388 - RNA, 39 nt, Artificial Sequence
  Synthetic Oligonucleotide; CTLA4 exon 2; Set C
gcagauguagagucccguguccauggcccucaguccuug

SEQ ID NO: 2389 - RNA, 36 nt, Artificial Sequence
  Synthetic Oligonucleotide; CTLA4 exon 2; Set C
cagauguagagucccguguccauggcccucaguccu

SEQ ID NO: 2390 - RNA, 34 nt, Artificial Sequence
  Synthetic Oligonucleotide; CTLA4 exon 2; Set C
agauguagagucccguguccauggcccucagucc

SEQ ID NO: 2391 - RNA, 32 nt, Artificial Sequence
  Synthetic Oligonucleotide; CTLA4 exon 2; Set C
gauguagagucccguguccauggcccucaguc

SEQ ID NO: 2392 - RNA, 40 nt, Artificial Sequence
  Synthetic Oligonucleotide; CTLA4 exon 2; Set C
ugcagauguagagucccguguccauggcccucaguccuug

SEQ ID NO: 2393 - RNA, 37 nt, Artificial Sequence
  Synthetic Oligonucleotide; CTLA4 exon 2; Set C
gcagauguagagucccguguccauggcccucaguccu

SEQ ID NO: 2394 - RNA, 35 nt, Artificial Sequence
  Synthetic Oligonucleotide; CTLA4 exon 2; Set C
cagauguagagucccguguccauggcccucagucc

SEQ ID NO: 2395 - RNA, 33 nt, Artificial Sequence
  Synthetic Oligonucleotide; CTLA4 exon 2; Set C
agauguagagucccguguccauggcccucaguc

SEQ ID NO: 2396 - RNA, 30 nt, Artificial Sequence
  Synthetic Oligonucleotide; CTLA4 exon 2; Set C
gauguagagucccguguccauggcccucag

SEQ ID NO: 2397 - RNA, 38 nt, Artificial Sequence
  Synthetic Oligonucleotide; CTLA4 exon 2; Set C
ugcagauguagagucccguguccauggcccucaguccu

SEQ ID NO: 2398 - RNA, 36 nt, Artificial Sequence
  Synthetic Oligonucleotide; CTLA4 exon 2; Set C
gcagauguagagucccguguccauggcccucagucc

SEQ ID NO: 2399 - RNA, 34 nt, Artificial Sequence
  Synthetic Oligonucleotide; CTLA4 exon 2; Set C
cagauguagagucccguguccauggcccucaguc

SEQ ID NO: 2400 - RNA, 37 nt, Artificial Sequence
  Synthetic Oligonucleotide; CTLA4 exon 2; Set C
ugcagauguagagucccguguccauggcccucagucc

SEQ ID NO: 2401 - RNA, 35 nt, Artificial Sequence
  Synthetic Oligonucleotide; CTLA4 exon 2; Set C
gcagauguagagucccguguccauggcccucaguc

SEQ ID NO: 2402 - RNA, 28 nt, Artificial Sequence
  Synthetic Oligonucleotide; CTLA4 exon 2; Set C
gauguagagucccguguccauggcccuc

SEQ ID NO: 2403 - RNA, 40 nt, Artificial Sequence
  Synthetic Oligonucleotide; CTLA4 exon 2; Set C
cuugcagauguagagucccguguccauggcccucaguccu

SEQ ID NO: 2404 - RNA, 38 nt, Artificial Sequence
  Synthetic Oligonucleotide; CTLA4 exon 2; Set C
uugcagauguagagucccguguccauggcccucagucc

SEQ ID NO: 2405 - RNA, 36 nt, Artificial Sequence
  Synthetic Oligonucleotide; CTLA4 exon 2; Set C
ugcagauguagagucccguguccauggcccucaguc

SEQ ID NO: 2406 - RNA, 39 nt, Artificial Sequence
  Synthetic Oligonucleotide; CTLA4 exon 2; Set C
cuugcagauguagagucccguguccauggcccucagucc

SEQ ID NO: 2407 - RNA, 37 nt, Artificial Sequence
  Synthetic Oligonucleotide; CTLA4 exon 2; Set C
uugcagauguagagucccguguccauggcccucaguc

SEQ ID NO: 2408 - RNA, 38 nt, Artificial Sequence
  Synthetic Oligonucleotide; CTLA4 exon 2; Set C
cuugcagauguagagucccguguccauggcccucaguc

SEQ ID NO: 2409 - RNA, 26 nt, Artificial Sequence
  Synthetic Oligonucleotide; CTLA4 exon 2; Set C
gcagauguagagucccguguccaugg

SEQ ID NO: 2410 - RNA, 27 nt, Artificial Sequence
  Synthetic Oligonucleotide; CTLA4 exon 2; Set C
ugcagauguagagucccguguccaugg

SEQ ID NO: 2411 - RNA, 28 nt, Artificial Sequence
  Synthetic Oligonucleotide; CTLA4 exon 2; Set C
uugcagauguagagucccguguccaugg

SEQ ID NO: 2412 - RNA, 29 nt, Artificial Sequence
  Synthetic Oligonucleotide; CTLA4 exon 2; Set C
cuugcagauguagagucccguguccaugg

SEQ ID NO: 2413 - RNA, 17 nt, Artificial Sequence
  Synthetic Oligonucleotide; CTLA4 exon 2; Set C
gcagauguagagucccg

SEQ ID NO: 2414 - RNA, 18 nt, Artificial Sequence
  Synthetic Oligonucleotide; CTLA4 exon 2; Set C
ugcagauguagagucccg

SEQ ID NO: 2415 - RNA, 19 nt, Artificial Sequence
  Synthetic Oligonucleotide; CTLA4 exon 2; Set C
uugcagauguagagucccg

SEQ ID NO: 2416 - RNA, 20 nt, Artificial Sequence
  Synthetic Oligonucleotide; CTLA4 exon 2; Set C
cuugcagauguagagucccg

SEQ ID NO: 2417 - RNA, 15 nt, Artificial Sequence
  Synthetic Oligonucleotide; CTLA4 exon 2; Set C
uugcagauguagagu

SEQ ID NO: 2418 - RNA, 16 nt, Artificial Sequence
  Synthetic Oligonucleotide; CTLA4 exon 2; Set C
cuugcagauguagagu

SEQ ID NO: 2419 - RNA, 15 nt, Artificial Sequence
  Synthetic Oligonucleotide; CTLA4 exon 2; Set C
cuugcagauguagag

SEQ ID NO: 2420 - RNA, 24 nt, Artificial Sequence
  Synthetic Oligonucleotide; CTLA4 exon 2; Set B
guacaugagcuccaccuugcagau

SEQ ID NO: 2421 - RNA, 23 nt, Artificial Sequence
  Synthetic Oligonucleotide; CTLA4 exon 2; Set B
guacaugagcuccaccuugcaga

SEQ ID NO: 2422 - RNA, 22 nt, Artificial Sequence
  Synthetic Oligonucleotide; CTLA4 exon 2; Set B
guacaugagcuccaccuugcag

SEQ ID NO: 2423 - RNA, 21 nt, Artificial Sequence
  Synthetic Oligonucleotide; CTLA4 exon 2; Set B
guacaugagcuccaccuugca

SEQ ID NO: 2424 - RNA, 20 nt, Artificial Sequence
  Synthetic Oligonucleotide; CTLA4 exon 2; Set B
guacaugagcuccaccuugc

SEQ ID NO: 2425 - RNA, 19 nt, Artificial Sequence
  Synthetic Oligonucleotide; CTLA4 exon 2; Set C
guacaugagcuccaccuug

SEQ ID NO: 2426 - RNA, 29 nt, Artificial Sequence
  Synthetic Oligonucleotide; CTLA4 exon 2; Set C
gguggguacaugagcuccaccuugcagau

SEQ ID NO: 2427 - RNA, 18 nt, Artificial Sequence
  Synthetic Oligonucleotide; CTLA4 exon 2; Set C
guacaugagcuccaccuu

SEQ ID NO: 2428 - RNA, 28 nt, Artificial Sequence
  Synthetic Oligonucleotide; CTLA4 exon 2; Set C
gguggguacaugagcuccaccuugcaga

SEQ ID NO: 2429 - RNA, 27 nt, Artificial Sequence
  Synthetic Oligonucleotide; CTLA4 exon 2; Set C
gguggguacaugagcuccaccuugcag

SEQ ID NO: 2430 - RNA, 26 nt, Artificial Sequence
  Synthetic Oligonucleotide; CTLA4 exon 2; Set C
gguggguacaugagcuccaccuugca

SEQ ID NO: 2431 - RNA, 25 nt, Artificial Sequence
  Synthetic Oligonucleotide; CTLA4 exon 2; Set C
gguggguacaugagcuccaccuugc

SEQ ID NO: 2432 - RNA, 24 nt, Artificial Sequence
  Synthetic Oligonucleotide; CTLA4 exon 2; Set C
gguggguacaugagcuccaccuug

SEQ ID NO: 2433 - RNA, 37 nt, Artificial Sequence
  Synthetic Oligonucleotide; CTLA4 exon 2; Set C
gguaguauggcgguggguacaugagcuccaccuugca

SEQ ID NO: 2434 - RNA, 36 nt, Artificial Sequence
  Synthetic Oligonucleotide; CTLA4 exon 2; Set C
gguaguauggcgguggguacaugagcuccaccuugc

SEQ ID NO: 2435 - RNA, 38 nt, Artificial Sequence
  Synthetic Oligonucleotide; CTLA4 exon 2; Set C
agguaguauggcgguggguacaugagcuccaccuugca

SEQ ID NO: 2436 - RNA, 35 nt, Artificial Sequence
  Synthetic Oligonucleotide; CTLA4 exon 2; Set C
gguaguauggcgguggguacaugagcuccaccuug

SEQ ID NO: 2437 - RNA, 40 nt, Artificial Sequence
  Synthetic Oligonucleotide; CTLA4 exon 2; Set C
cccagguaguauggcgguggguacaugagcuccaccuugc

SEQ ID NO: 2438 - RNA, 39 nt, Artificial Sequence
  Synthetic Oligonucleotide; CTLA4 exon 2; Set C
cccagguaguauggcgguggguacaugagcuccaccuug

SEQ ID NO: 2439 - RNA, 38 nt, Artificial Sequence
  Synthetic Oligonucleotide; CTLA4 exon 2; Set C
cccagguaguauggcgguggguacaugagcuccaccuu

SEQ ID NO: 2440 - RNA, 15 nt, Artificial Sequence
  Synthetic Oligonucleotide; CTLA4 exon 2; Set C
uauggcgguggguac

SEQ ID NO: 2441 - RNA, 16 nt, Artificial Sequence
  Synthetic Oligonucleotide; CTLA4 exon 2; Set C
guauggcgguggguac

SEQ ID NO: 2442 - RNA, 17 nt, Artificial Sequence
  Synthetic Oligonucleotide; CTLA4 exon 2; Set C
aguauggcgguggguac

SEQ ID NO: 2443 - RNA, 18 nt, Artificial Sequence
  Synthetic Oligonucleotide; CTLA4 exon 2; Set C
uaguauggcgguggguac

SEQ ID NO: 2444 - RNA, 19 nt, Artificial Sequence
  Synthetic Oligonucleotide; CTLA4 exon 2; Set B
guaguauggcgguggguac

SEQ ID NO: 2445 - RNA, 19 nt, Artificial Sequence
  Synthetic Oligonucleotide; CTLA4 exon 2; Set B
gguaguauggcggugggua

SEQ ID NO: 2446 - RNA, 23 nt, Artificial Sequence
  Synthetic Oligonucleotide; CTLA4 exon 2; Set C
cccagguaguauggcggugggua

SEQ ID NO: 2447 - RNA, 27 nt, Artificial Sequence
  Synthetic Oligonucleotide; CTLA4 exon 2; Set C
augcccagguaguauggcgguggguac

SEQ ID NO: 2448 - RNA, 18 nt, Artificial Sequence
  Synthetic Oligonucleotide; CTLA4 exon 2; Set B
ccagguaguauggcggug

SEQ ID NO: 2449 - RNA, 28 nt, Artificial Sequence
  Synthetic Oligonucleotide; CTLA4 exon 2; Set C
uaugcccagguaguauggcgguggguac

SEQ ID NO: 2450 - RNA, 15 nt, Artificial Sequence
  Synthetic Oligonucleotide; CTLA4 exon 2; Set C
cagguaguauggcgg

SEQ ID NO: 2451 - RNA, 29 nt, Artificial Sequence
  Synthetic Oligonucleotide; CTLA4 exon 2; Set C
cuaugcccagguaguauggcgguggguac

SEQ ID NO: 2452 - RNA, 18 nt, Artificial Sequence
  Synthetic Oligonucleotide; CTLA4 exon 2; Set B
cccagguaguauggcggu

SEQ ID NO: 2453 - RNA, 20 nt, Artificial Sequence
  Synthetic Oligonucleotide; CTLA4 exon 2; Set B
gcccagguaguauggcggug

SEQ ID NO: 2454 - RNA, 21 nt, Artificial Sequence
  Synthetic Oligonucleotide; CTLA4 exon 2; Set B
ugcccagguaguauggcggug

SEQ ID NO: 2455 - RNA, 34 nt, Artificial Sequence
  Synthetic Oligonucleotide; CTLA4 exon 2; Set C
guugccuaugcccagguaguauggcgguggguac

SEQ ID NO: 2456 - RNA, 25 nt, Artificial Sequence
  Synthetic Oligonucleotide; CTLA4 exon 2; Set C
ccuaugcccagguaguauggcggug

SEQ ID NO: 2457 - RNA, 26 nt, Artificial Sequence
  Synthetic Oligonucleotide; CTLA4 exon 2; Set C
gccuaugcccagguaguauggcggug

SEQ ID NO: 2458 - RNA, 27 nt, Artificial Sequence
  Synthetic Oligonucleotide; CTLA4 exon 2; Set C
ugccuaugcccagguaguauggcggug

SEQ ID NO: 2459 - RNA, 28 nt, Artificial Sequence
  Synthetic Oligonucleotide; CTLA4 exon 2; Set C
uugccuaugcccagguaguauggcggug

SEQ ID NO: 2460 - RNA, 38 nt, Artificial Sequence
  Synthetic Oligonucleotide; CTLA4 exon 2; Set C
uuccguugccuaugcccagguaguauggcgguggguac

SEQ ID NO: 2461 - RNA, 30 nt, Artificial Sequence
  Synthetic Oligonucleotide; CTLA4 exon 2; Set C
cguugccuaugcccagguaguauggcggug

SEQ ID NO: 2462 - RNA, 40 nt, Artificial Sequence
  Synthetic Oligonucleotide; CTLA4 exon 2; Set C
gguuccguugccuaugcccagguaguauggcgguggguac

SEQ ID NO: 2463 - RNA, 31 nt, Artificial Sequence
  Synthetic Oligonucleotide; CTLA4 exon 2; Set C
ccguugccuaugcccagguaguauggcggug

SEQ ID NO: 2464 - RNA, 32 nt, Artificial Sequence
  Synthetic Oligonucleotide; CTLA4 exon 2; Set C
uccguugccuaugcccagguaguauggcggug

SEQ ID NO: 2465 - RNA, 33 nt, Artificial Sequence
  Synthetic Oligonucleotide; CTLA4 exon 2; Set C
uuccguugccuaugcccagguaguauggcggug

SEQ ID NO: 2466 - RNA, 15 nt, Artificial Sequence
  Synthetic Oligonucleotide; CTLA4 exon 2; Set C
ugccuaugcccaggu

SEQ ID NO: 2467 - RNA, 16 nt, Artificial Sequence
  Synthetic Oligonucleotide; CTLA4 exon 2; Set C
uugccuaugcccaggu

SEQ ID NO: 2468 - RNA, 15 nt, Artificial Sequence
  Synthetic Oligonucleotide; CTLA4 exon 2; Set C
uugccuaugcccagg

SEQ ID NO: 2469 - RNA, 18 nt, Artificial Sequence
  Synthetic Oligonucleotide; CTLA4 exon 2; Set B
cguugccuaugcccaggu

SEQ ID NO: 2470 - RNA, 19 nt, Artificial Sequence
  Synthetic Oligonucleotide; CTLA4 exon 2; Set B
ccguugccuaugcccaggu

SEQ ID NO: 2471 - RNA, 17 nt, Artificial Sequence
  Synthetic Oligonucleotide; CTLA4 exon 2; Set B
cguugccuaugcccagg

SEQ ID NO: 2472 - RNA, 20 nt, Artificial Sequence
  Synthetic Oligonucleotide; CTLA4 exon 2; Set B
uccguugccuaugcccaggu

SEQ ID NO: 2473 - RNA, 18 nt, Artificial Sequence
  Synthetic Oligonucleotide; CTLA4 exon 2; Set B
ccguugccuaugcccagg

SEQ ID NO: 2474 - RNA, 16 nt, Artificial Sequence
  Synthetic Oligonucleotide; CTLA4 exon 2; Set C
cguugccuaugcccag

SEQ ID NO: 2475 - RNA, 21 nt, Artificial Sequence
  Synthetic Oligonucleotide; CTLA4 exon 2; Set B
uuccguugccuaugcccaggu

SEQ ID NO: 2476 - RNA, 19 nt, Artificial Sequence
  Synthetic Oligonucleotide; CTLA4 exon 2; Set B
uccguugccuaugcccagg

SEQ ID NO: 2477 - RNA, 17 nt, Artificial Sequence
  Synthetic Oligonucleotide; CTLA4 exon 2; Set B
ccguugccuaugcccag

SEQ ID NO: 2478 - RNA, 20 nt, Artificial Sequence
  Synthetic Oligonucleotide; CTLA4 exon 2; Set B
uuccguugccuaugcccagg

SEQ ID NO: 2479 - RNA, 18 nt, Artificial Sequence
  Synthetic Oligonucleotide; CTLA4 exon 2; Set B
uccguugccuaugcccag

SEQ ID NO: 2480 - RNA, 19 nt, Artificial Sequence
  Synthetic Oligonucleotide; CTLA4 exon 2; Set B
uuccguugccuaugcccag

SEQ ID NO: 2481 - RNA, 39 nt, Artificial Sequence
  Synthetic Oligonucleotide; CTLA4 exon 2; Set C
caauuacauaaaucuggguuccguugccuaugcccaggu

SEQ ID NO: 2482 - RNA, 38 nt, Artificial Sequence
  Synthetic Oligonucleotide; CTLA4 exon 2; Set C
caauuacauaaaucuggguuccguugccuaugcccagg

SEQ ID NO: 2483 - RNA, 15 nt, Artificial Sequence
  Synthetic Oligonucleotide; CTLA4 exon 2; Set C
ggcuuugcucaccaa

SEQ ID NO: 2484 - RNA, 16 nt, Artificial Sequence
  Synthetic Oligonucleotide; CTLA4 exon 2; Set C
uggcuuugcucaccaa

SEQ ID NO: 2485 - RNA, 17 nt, Artificial Sequence
  Synthetic Oligonucleotide; CTLA4 exon 2; Set C
auggcuuugcucaccaa

SEQ ID NO: 2486 - RNA, 25 nt, Artificial Sequence
  Synthetic Oligonucleotide; CTLA4 exon 2; Set B
ucagugaaauggcuuugcucaccaa

SEQ ID NO: 2487 - RNA, 28 nt, Artificial Sequence
  Synthetic Oligonucleotide; CTLA4 exon 2; Set B
gcaacaggugucaacucagugaaauggc

SEQ ID NO: 2488 - RNA, 27 nt, Artificial Sequence
  Synthetic Oligonucleotide; CTLA4 exon 2; Set B
gcaacaggugucaacucagugaaaugg

SEQ ID NO: 2489 - RNA, 26 nt, Artificial Sequence
  Synthetic Oligonucleotide; CTLA4 exon 2; Set B
gcaacaggugucaacucagugaaaug

SEQ ID NO: 2490 - RNA, 32 nt, Artificial Sequence
  Synthetic Oligonucleotide; CTLA4 exon 2; Set B
caaugcaacaggugucaacucagugaaauggc

SEQ ID NO: 2491 - RNA, 31 nt, Artificial Sequence
  Synthetic Oligonucleotide; CTLA4 exon 2; Set B
caaugcaacaggugucaacucagugaaaugg

SEQ ID NO: 2492 - RNA, 33 nt, Artificial Sequence
  Synthetic Oligonucleotide; CTLA4 exon 2; Set C
gcaaugcaacaggugucaacucagugaaauggc

SEQ ID NO: 2493 - RNA, 30 nt, Artificial Sequence
  Synthetic Oligonucleotide; CTLA4 exon 2; Set B
caaugcaacaggugucaacucagugaaaug

SEQ ID NO: 2494 - RNA, 19 nt, Artificial Sequence
  Synthetic Oligonucleotide; CTLA4 exon 2; Set C
gcaacaggugucaacucag

SEQ ID NO: 2495 - RNA, 18 nt, Artificial Sequence
  Synthetic Oligonucleotide; CTLA4 exon 2; Set C
gcaacaggugucaacuca

SEQ ID NO: 2496 - RNA, 17 nt, Artificial Sequence
  Synthetic Oligonucleotide; CTLA4 exon 2; Set C
gcaacaggugucaacuc

SEQ ID NO: 2497 - RNA, 30 nt, Artificial Sequence
  Synthetic Oligonucleotide; CTLA4 exon 2; Set B
cugcaaugcaacaggugucaacucagugaa

SEQ ID NO: 2498 - RNA, 16 nt, Artificial Sequence
  Synthetic Oligonucleotide; CTLA4 exon 2; Set C
gcaacaggugucaacu

SEQ ID NO: 2499 - RNA, 29 nt, Artificial Sequence
  Synthetic Oligonucleotide; CTLA4 exon 2; Set C
cugcaaugcaacaggugucaacucaguga

SEQ ID NO: 2500 - RNA, 15 nt, Artificial Sequence
  Synthetic Oligonucleotide; CTLA4 exon 2; Set C
gcaacaggugucaac

SEQ ID NO: 2501 - RNA, 25 nt, Artificial Sequence
  Synthetic Oligonucleotide; CTLA4 exon 2; Set B
gcaaugcaacaggugucaacucagu

SEQ ID NO: 2502 - RNA, 28 nt, Artificial Sequence
  Synthetic Oligonucleotide; CTLA4 exon 2; Set B
cugcaaugcaacaggugucaacucagug

SEQ ID NO: 2503 - RNA, 26 nt, Artificial Sequence
  Synthetic Oligonucleotide; CTLA4 exon 2; Set B
ugcaaugcaacaggugucaacucagu

SEQ ID NO: 2504 - RNA, 24 nt, Artificial Sequence
  Synthetic Oligonucleotide; CTLA4 exon 2; Set B
gcaaugcaacaggugucaacucag

SEQ ID NO: 2505 - RNA, 22 nt, Artificial Sequence
  Synthetic Oligonucleotide; CTLA4 exon 2; Set C
caaugcaacaggugucaacuca

SEQ ID NO: 2506 - RNA, 27 nt, Artificial Sequence
  Synthetic Oligonucleotide; CTLA4 exon 2; Set B
cugcaaugcaacaggugucaacucagu

SEQ ID NO: 2507 - RNA, 25 nt, Artificial Sequence
  Synthetic Oligonucleotide; CTLA4 exon 2; Set B
ugcaaugcaacaggugucaacucag

SEQ ID NO: 2508 - RNA, 26 nt, Artificial Sequence
  Synthetic Oligonucleotide; CTLA4 exon 2; Set B
cugcaaugcaacaggugucaacucag

SEQ ID NO: 2509 - RNA, 22 nt, Artificial Sequence
  Synthetic Oligonucleotide; CTLA4 exon 2; Set B
gcaaugcaacaggugucaacuc

SEQ ID NO: 2510 - RNA, 21 nt, Artificial Sequence
  Synthetic Oligonucleotide; CTLA4 exon 2; Set C
gcaaugcaacaggugucaacu

SEQ ID NO: 2511 - RNA, 23 nt, Artificial Sequence
  Synthetic Oligonucleotide; CTLA4 exon 2; Set B
ugcaaugcaacaggugucaacuc

SEQ ID NO: 2512 - RNA, 20 nt, Artificial Sequence
  Synthetic Oligonucleotide; CTLA4 exon 2; Set C
gcaaugcaacaggugucaac

SEQ ID NO: 2513 - RNA, 22 nt, Artificial Sequence
  Synthetic Oligonucleotide; CTLA4 exon 2; Set B
ugcaaugcaacaggugucaacu

SEQ ID NO: 2514 - RNA, 24 nt, Artificial Sequence
  Synthetic Oligonucleotide; CTLA4 exon 2; Set B
cugcaaugcaacaggugucaacuc

SEQ ID NO: 2515 - RNA, 26 nt, Artificial Sequence
  Synthetic Oligonucleotide; CTLA4 exon 2; Set B
acugcaaugcaacaggugucaacuca

SEQ ID NO: 2516 - RNA, 19 nt, Artificial Sequence
  Synthetic Oligonucleotide; CTLA4 exon 2; Set C
gcaaugcaacaggugucaa

SEQ ID NO: 2517 - RNA, 21 nt, Artificial Sequence
  Synthetic Oligonucleotide; CTLA4 exon 2; Set C
ugcaaugcaacaggugucaac

SEQ ID NO: 2518 - RNA, 23 nt, Artificial Sequence
  Synthetic Oligonucleotide; CTLA4 exon 2; Set B
cugcaaugcaacaggugucaacu

SEQ ID NO: 2519 - RNA, 18 nt, Artificial Sequence
  Synthetic Oligonucleotide; CTLA4 exon 2; Set C
gcaaugcaacagguguca

SEQ ID NO: 2520 - RNA, 20 nt, Artificial Sequence
  Synthetic Oligonucleotide; CTLA4 exon 2; Set C
ugcaaugcaacaggugucaa

SEQ ID NO: 2521 - RNA, 22 nt, Artificial Sequence
  Synthetic Oligonucleotide; CTLA4 exon 2; Set B
cugcaaugcaacaggugucaac

SEQ ID NO: 2522 - RNA, 19 nt, Artificial Sequence
  Synthetic Oligonucleotide; CTLA4 exon 2; Set C
ugcaaugcaacagguguca

SEQ ID NO: 2523 - RNA, 21 nt, Artificial Sequence
  Synthetic Oligonucleotide; CTLA4 exon 2; Set C
cugcaaugcaacaggugucaa

SEQ ID NO: 2524 - RNA, 16 nt, Artificial Sequence
  Synthetic Oligonucleotide; CTLA4 exon 2; Set C
gcaaugcaacaggugu

SEQ ID NO: 2525 - RNA, 18 nt, Artificial Sequence
  Synthetic Oligonucleotide; CTLA4 exon 2; Set C
ugcaaugcaacagguguc

SEQ ID NO: 2526 - RNA, 20 nt, Artificial Sequence
  Synthetic Oligonucleotide; CTLA4 exon 2; Set C
cugcaaugcaacagguguca

SEQ ID NO: 2527 - RNA, 17 nt, Artificial Sequence
  Synthetic Oligonucleotide; CTLA4 exon 2; Set C
ugcaaugcaacaggugu

SEQ ID NO: 2528 - RNA, 19 nt, Artificial Sequence
  Synthetic Oligonucleotide; CTLA4 exon 2; Set C
cugcaaugcaacagguguc

SEQ ID NO: 2529 - RNA, 15 nt, Artificial Sequence
  Synthetic Oligonucleotide; CTLA4 exon 2; Set C
gcaaugcaacaggug

SEQ ID NO: 2530 - RNA, 18 nt, Artificial Sequence
  Synthetic Oligonucleotide; CTLA4 exon 2; Set C
cugcaaugcaacaggugu

SEQ ID NO: 2531 - RNA, 16 nt, Artificial Sequence
  Synthetic Oligonucleotide; CTLA4 exon 2; Set C
ugcaaugcaacaggug

SEQ ID NO: 2532 - RNA, 17 nt, Artificial Sequence
  Synthetic Oligonucleotide; CTLA4 exon 2; Set C
cugcaaugcaacaggug

SEQ ID NO: 2533 - RNA, 15 nt, Artificial Sequence
  Synthetic Oligonucleotide; CTLA4 exon 3; Set C
ggaggaagucagaau

SEQ ID NO: 2534 - RNA, 32 nt, Artificial Sequence
  Synthetic Oligonucleotide; CTLA4 exon 3; Set A
acaaagcagagccucccugagacaguuuuaaa

SEQ ID NO: 2535 - RNA, 33 nt, Artificial Sequence
  Synthetic Oligonucleotide; CTLA4 exon 3; Set A
aacaaagcagagccucccugagacaguuuuaaa

SEQ ID NO: 2536 - RNA, 31 nt, Artificial Sequence
  Synthetic Oligonucleotide; CTLA4 exon 3; Set A
acaaagcagagccucccugagacaguuuuaa

SEQ ID NO: 2537 - RNA, 34 nt, Artificial Sequence
  Synthetic Oligonucleotide; CTLA4 exon 3; Set A
aaacaaagcagagccucccugagacaguuuuaaa

SEQ ID NO: 2538 - RNA, 32 nt, Artificial Sequence
  Synthetic Oligonucleotide; CTLA4 exon 3; Set A
aacaaagcagagccucccugagacaguuuuaa

SEQ ID NO: 2539 - RNA, 29 nt, Artificial Sequence
  Synthetic Oligonucleotide; CTLA4 exon 3; Set C
acaaagcagagccucccugagacaguuuu

SEQ ID NO: 2540 - RNA, 35 nt, Artificial Sequence
  Synthetic Oligonucleotide; CTLA4 exon 3; Set A
aaaacaaagcagagccucccugagacaguuuuaaa

SEQ ID NO: 2541 - RNA, 33 nt, Artificial Sequence
  Synthetic Oligonucleotide; CTLA4 exon 3; Set A
aaacaaagcagagccucccugagacaguuuuaa

SEQ ID NO: 2542 - RNA, 31 nt, Artificial Sequence
  Synthetic Oligonucleotide; CTLA4 exon 3; Set A
aacaaagcagagccucccugagacaguuuua

SEQ ID NO: 2543 - RNA, 30 nt, Artificial Sequence
  Synthetic Oligonucleotide; CTLA4 exon 3; Set A
aacaaagcagagccucccugagacaguuuu

SEQ ID NO: 2544 - RNA, 34 nt, Artificial Sequence
  Synthetic Oligonucleotide; CTLA4 exon 3; Set A
aaaacaaagcagagccucccugagacaguuuuaa

SEQ ID NO: 2545 - RNA, 32 nt, Artificial Sequence
  Synthetic Oligonucleotide; CTLA4 exon 3; Set A
aaacaaagcagagccucccugagacaguuuua

SEQ ID NO: 2546 - RNA, 31 nt, Artificial Sequence
  Synthetic Oligonucleotide; CTLA4 exon 3; Set A
aaacaaagcagagccucccugagacaguuuu

SEQ ID NO: 2547 - RNA, 29 nt, Artificial Sequence
  Synthetic Oligonucleotide; CTLA4 exon 3; Set A
aacaaagcagagccucccugagacaguuu

SEQ ID NO: 2548 - RNA, 33 nt, Artificial Sequence
  Synthetic Oligonucleotide; CTLA4 exon 3; Set A
aaaacaaagcagagccucccugagacaguuuua

SEQ ID NO: 2549 - RNA, 32 nt, Artificial Sequence
  Synthetic Oligonucleotide; CTLA4 exon 3; Set A
aaaacaaagcagagccucccugagacaguuuu

SEQ ID NO: 2550 - RNA, 30 nt, Artificial Sequence
  Synthetic Oligonucleotide; CTLA4 exon 3; Set A
aaacaaagcagagccucccugagacaguuu

SEQ ID NO: 2551 - RNA, 31 nt, Artificial Sequence
  Synthetic Oligonucleotide; CTLA4 exon 3; Set A
aaaacaaagcagagccucccugagacaguuu

SEQ ID NO: 2552 - RNA, 29 nt, Artificial Sequence
  Synthetic Oligonucleotide; CTLA4 exon 3; Set A
aaacaaagcagagccucccugagacaguu

SEQ ID NO: 2553 - RNA, 30 nt, Artificial Sequence
  Synthetic Oligonucleotide; CTLA4 exon 3; Set A
aaaacaaagcagagccucccugagacaguu

SEQ ID NO: 2554 - RNA, 28 nt, Artificial Sequence
  Synthetic Oligonucleotide; CTLA4 exon 3; Set A
aaacaaagcagagccucccugagacagu

SEQ ID NO: 2555 - RNA, 29 nt, Artificial Sequence
  Synthetic Oligonucleotide; CTLA4 exon 3; Set A
aaaacaaagcagagccucccugagacagu

SEQ ID NO: 2556 - RNA, 28 nt, Artificial Sequence
  Synthetic Oligonucleotide; CTLA4 exon 3; Set A
aaaacaaagcagagccucccugagacag

SEQ ID NO: 2557 - RNA, 20 nt, Artificial Sequence
  Synthetic Oligonucleotide; CTLA4 exon 3; Set A
agucagaaucugggcacggu

SEQ ID NO: 2558 - RNA, 19 nt, Artificial Sequence
  Synthetic Oligonucleotide; CTLA4 exon 3; Set C
agucagaaucugggcacgg

SEQ ID NO: 2559 - RNA, 21 nt, Artificial Sequence
  Synthetic Oligonucleotide; CTLA4 exon 3; Set A
aagucagaaucugggcacggu

SEQ ID NO: 2560 - RNA, 20 nt, Artificial Sequence
  Synthetic Oligonucleotide; CTLA4 exon 3; Set C
aagucagaaucugggcacgg

SEQ ID NO: 2561 - RNA, 18 nt, Artificial Sequence
  Synthetic Oligonucleotide; CTLA4 exon 3; Set C
agucagaaucugggcacg

SEQ ID NO: 2562 - RNA, 22 nt, Artificial Sequence
  Synthetic Oligonucleotide; CTLA4 exon 3; Set A
gaagucagaaucugggcacggu

SEQ ID NO: 2563 - RNA, 21 nt, Artificial Sequence
  Synthetic Oligonucleotide; CTLA4 exon 3; Set A
gaagucagaaucugggcacgg

SEQ ID NO: 2564 - RNA, 19 nt, Artificial Sequence
  Synthetic Oligonucleotide; CTLA4 exon 3; Set C
aagucagaaucugggcacg

SEQ ID NO: 2565 - RNA, 23 nt, Artificial Sequence
  Synthetic Oligonucleotide; CTLA4 exon 3; Set A
ggaagucagaaucugggcacggu

SEQ ID NO: 2566 - RNA, 17 nt, Artificial Sequence
  Synthetic Oligonucleotide; CTLA4 exon 3; Set C
agucagaaucugggcac

SEQ ID NO: 2567 - RNA, 22 nt, Artificial Sequence
  Synthetic Oligonucleotide; CTLA4 exon 3; Set A
ggaagucagaaucugggcacgg

SEQ ID NO: 2568 - RNA, 20 nt, Artificial Sequence
  Synthetic Oligonucleotide; CTLA4 exon 3; Set C
gaagucagaaucugggcacg

SEQ ID NO: 2569 - RNA, 24 nt, Artificial Sequence
  Synthetic Oligonucleotide; CTLA4 exon 3; Set A
aggaagucagaaucugggcacggu

SEQ ID NO: 2570 - RNA, 18 nt, Artificial Sequence
  Synthetic Oligonucleotide; CTLA4 exon 3; Set C
aagucagaaucugggcac

SEQ ID NO: 2571 - RNA, 23 nt, Artificial Sequence
  Synthetic Oligonucleotide; CTLA4 exon 3; Set A
aggaagucagaaucugggcacgg

SEQ ID NO: 2572 - RNA, 21 nt, Artificial Sequence
  Synthetic Oligonucleotide; CTLA4 exon 3; Set A
ggaagucagaaucugggcacg

SEQ ID NO: 2573 - RNA, 25 nt, Artificial Sequence
  Synthetic Oligonucleotide; CTLA4 exon 3; Set A
gaggaagucagaaucugggcacggu

SEQ ID NO: 2574 - RNA, 19 nt, Artificial Sequence
  Synthetic Oligonucleotide; CTLA4 exon 3; Set C
gaagucagaaucugggcac

SEQ ID NO: 2575 - RNA, 24 nt, Artificial Sequence
  Synthetic Oligonucleotide; CTLA4 exon 3; Set A
gaggaagucagaaucugggcacgg

SEQ ID NO: 2576 - RNA, 22 nt, Artificial Sequence
  Synthetic Oligonucleotide; CTLA4 exon 3; Set A
aggaagucagaaucugggcacg

SEQ ID NO: 2577 - RNA, 26 nt, Artificial Sequence
  Synthetic Oligonucleotide; CTLA4 exon 3; Set C
ggaggaagucagaaucugggcacggu

SEQ ID NO: 2578 - RNA, 20 nt, Artificial Sequence
  Synthetic Oligonucleotide; CTLA4 exon 3; Set C
ggaagucagaaucugggcac

SEQ ID NO: 2579 - RNA, 18 nt, Artificial Sequence
  Synthetic Oligonucleotide; CTLA4 exon 3; Set C
gaagucagaaucugggca

SEQ ID NO: 2580 - RNA, 25 nt, Artificial Sequence
  Synthetic Oligonucleotide; CTLA4 exon 3; Set A
ggaggaagucagaaucugggcacgg

SEQ ID NO: 2581 - RNA, 23 nt, Artificial Sequence
  Synthetic Oligonucleotide; CTLA4 exon 3; Set A
gaggaagucagaaucugggcacg

SEQ ID NO: 2582 - RNA, 21 nt, Artificial Sequence
  Synthetic Oligonucleotide; CTLA4 exon 3; Set C
aggaagucagaaucugggcac

SEQ ID NO: 2583 - RNA, 19 nt, Artificial Sequence
  Synthetic Oligonucleotide; CTLA4 exon 3; Set C
ggaagucagaaucugggca

SEQ ID NO: 2584 - RNA, 24 nt, Artificial Sequence
  Synthetic Oligonucleotide; CTLA4 exon 3; Set A
ggaggaagucagaaucugggcacg

SEQ ID NO: 2585 - RNA, 22 nt, Artificial Sequence
  Synthetic Oligonucleotide; CTLA4 exon 3; Set A
gaggaagucagaaucugggcac

SEQ ID NO: 2586 - RNA, 20 nt, Artificial Sequence
  Synthetic Oligonucleotide; CTLA4 exon 3; Set C
aggaagucagaaucugggca

SEQ ID NO: 2587 - RNA, 23 nt, Artificial Sequence
  Synthetic Oligonucleotide; CTLA4 exon 3; Set A
ggaggaagucagaaucugggcac

SEQ ID NO: 2588 - RNA, 21 nt, Artificial Sequence
  Synthetic Oligonucleotide; CTLA4 exon 3; Set A
gaggaagucagaaucugggca

SEQ ID NO: 2589 - RNA, 19 nt, Artificial Sequence
  Synthetic Oligonucleotide; CTLA4 exon 3; Set C
aggaagucagaaucugggc

SEQ ID NO: 2590 - RNA, 22 nt, Artificial Sequence
  Synthetic Oligonucleotide; CTLA4 exon 3; Set A
ggaggaagucagaaucugggca

SEQ ID NO: 2591 - RNA, 20 nt, Artificial Sequence
  Synthetic Oligonucleotide; CTLA4 exon 3; Set C
gaggaagucagaaucugggc

SEQ ID NO: 2592 - RNA, 21 nt, Artificial Sequence
  Synthetic Oligonucleotide; CTLA4 exon 3; Set A
ggaggaagucagaaucugggc

SEQ ID NO: 2593 - RNA, 19 nt, Artificial Sequence
  Synthetic Oligonucleotide; CTLA4 exon 3; Set C
aaaaacaaccccgaacuaa

SEQ ID NO: 2594 - RNA, 20 nt, Artificial Sequence
  Synthetic Oligonucleotide; CTLA4 exon 3; Set C
aaaaaacaaccccgaacuaa

SEQ ID NO: 2595 - RNA, 21 nt, Artificial Sequence
  Synthetic Oligonucleotide; CTLA4 exon 3; Set C
aaaaaaacaaccccgaacuaa

SEQ ID NO: 2596 - RNA, 30 nt, Artificial Sequence
  Synthetic Oligonucleotide; CTLA4 exon 3; Set C
gaaagcuauaaaaaaacaaccccgaacuaa

SEQ ID NO: 2597 - RNA, 36 nt, Artificial Sequence
  Synthetic Oligonucleotide; CTLA4 exon 3; Set A
ugaggagaaagcuauaaaaaaacaaccccgaacuaa

SEQ ID NO: 2598 - RNA, 37 nt, Artificial Sequence
  Synthetic Oligonucleotide; CTLA4 exon 3; Set A
gugaggagaaagcuauaaaaaaacaaccccgaacuaa

SEQ ID NO: 2599 - RNA, 19 nt, Artificial Sequence
  Synthetic Oligonucleotide; CTLA4 exon 3; Set C
ugaggagaaagcuauaaaa

SEQ ID NO: 2600 - RNA, 20 nt, Artificial Sequence
  Synthetic Oligonucleotide; CTLA4 exon 3; Set C
gugaggagaaagcuauaaaa

SEQ ID NO: 2601 - RNA, 34 nt, Artificial Sequence
  Synthetic Oligonucleotide; CTLA4 exon 3; Set C
caaagaaacagcugugaggagaaagcuauaaaaa

SEQ ID NO: 2602 - RNA, 33 nt, Artificial Sequence
  Synthetic Oligonucleotide; CTLA4 exon 3; Set C
caaagaaacagcugugaggagaaagcuauaaaa

SEQ ID NO: 2603 - RNA, 32 nt, Artificial Sequence
  Synthetic Oligonucleotide; CTLA4 exon 3; Set C
caaagaaacagcugugaggagaaagcuauaaa

SEQ ID NO: 2604 - RNA, 18 nt, Artificial Sequence
  Synthetic Oligonucleotide; CTLA4 exon 3; Set C
aaacagcugugaggagaa

SEQ ID NO: 2605 - RNA, 23 nt, Artificial Sequence
  Synthetic Oligonucleotide; CTLA4 exon 3; Set C
caaagaaacagcugugaggagaa

SEQ ID NO: 2606 - RNA, 32 nt, Artificial Sequence
  Synthetic Oligonucleotide; CTLA4 exon 3; Set A
caaagcagagccucccugagacaguuuuaaac

SEQ ID NO: 2607 - RNA, 31 nt, Artificial Sequence
  Synthetic Oligonucleotide; CTLA4 exon 3; Set A
caaagcagagccucccugagacaguuuuaaa

SEQ ID NO: 2608 - RNA, 33 nt, Artificial Sequence
  Synthetic Oligonucleotide; CTLA4 exon 3; Set A
acaaagcagagccucccugagacaguuuuaaac

SEQ ID NO: 2609 - RNA, 30 nt, Artificial Sequence
  Synthetic Oligonucleotide; CTLA4 exon 3; Set A
caaagcagagccucccugagacaguuuuaa

SEQ ID NO: 2610 - RNA, 34 nt, Artificial Sequence
  Synthetic Oligonucleotide; CTLA4 exon 3; Set A
aacaaagcagagccucccugagacaguuuuaaac

SEQ ID NO: 2611 - RNA, 36 nt, Artificial Sequence
  Synthetic Oligonucleotide; CTLA4 exon 3; Set A
aaacaaagcagagccucccugagacaguuuuaaacu

SEQ ID NO: 2612 - RNA, 29 nt, Artificial Sequence
  Synthetic Oligonucleotide; CTLA4 exon 3; Set A
caaagcagagccucccugagacaguuuua

SEQ ID NO: 2613 - RNA, 35 nt, Artificial Sequence
  Synthetic Oligonucleotide; CTLA4 exon 3; Set A
aaacaaagcagagccucccugagacaguuuuaaac

SEQ ID NO: 2614 - RNA, 37 nt, Artificial Sequence
  Synthetic Oligonucleotide; CTLA4 exon 3; Set A
aaaacaaagcagagccucccugagacaguuuuaaacu

SEQ ID NO: 2615 - RNA, 28 nt, Artificial Sequence
  Synthetic Oligonucleotide; CTLA4 exon 3; Set A
caaagcagagccucccugagacaguuuu

SEQ ID NO: 2616 - RNA, 30 nt, Artificial Sequence
  Synthetic Oligonucleotide; CTLA4 exon 3; Set C
acaaagcagagccucccugagacaguuuua

SEQ ID NO: 2617 - RNA, 36 nt, Artificial Sequence
  Synthetic Oligonucleotide; CTLA4 exon 3; Set A
aaaacaaagcagagccucccugagacaguuuuaaac

SEQ ID NO: 2618 - RNA, 27 nt, Artificial Sequence
  Synthetic Oligonucleotide; CTLA4 exon 3; Set A
caaagcagagccucccugagacaguuu

SEQ ID NO: 2619 - RNA, 28 nt, Artificial Sequence
  Synthetic Oligonucleotide; CTLA4 exon 3; Set C
acaaagcagagccucccugagacaguuu

SEQ ID NO: 2620 - RNA, 26 nt, Artificial Sequence
  Synthetic Oligonucleotide; CTLA4 exon 3; Set A
caaagcagagccucccugagacaguu

SEQ ID NO: 2621 - RNA, 27 nt, Artificial Sequence
  Synthetic Oligonucleotide; CTLA4 exon 3; Set C
acaaagcagagccucccugagacaguu

SEQ ID NO: 2622 - RNA, 25 nt, Artificial Sequence
  Synthetic Oligonucleotide; CTLA4 exon 3; Set A
caaagcagagccucccugagacagu

SEQ ID NO: 2623 - RNA, 28 nt, Artificial Sequence
  Synthetic Oligonucleotide; CTLA4 exon 3; Set A
aacaaagcagagccucccugagacaguu

SEQ ID NO: 2624 - RNA, 26 nt, Artificial Sequence
  Synthetic Oligonucleotide; CTLA4 exon 3; Set C
acaaagcagagccucccugagacagu

SEQ ID NO: 2625 - RNA, 24 nt, Artificial Sequence
  Synthetic Oligonucleotide; CTLA4 exon 3; Set A
caaagcagagccucccugagacag

SEQ ID NO: 2626 - RNA, 27 nt, Artificial Sequence
  Synthetic Oligonucleotide; CTLA4 exon 3; Set A
aacaaagcagagccucccugagacagu

SEQ ID NO: 2627 - RNA, 25 nt, Artificial Sequence
  Synthetic Oligonucleotide; CTLA4 exon 3; Set A
acaaagcagagccucccugagacag

SEQ ID NO: 2628 - RNA, 23 nt, Artificial Sequence
  Synthetic Oligonucleotide; CTLA4 exon 3; Set A
caaagcagagccucccugagaca

SEQ ID NO: 2629 - RNA, 26 nt, Artificial Sequence
  Synthetic Oligonucleotide; CTLA4 exon 3; Set A
aacaaagcagagccucccugagacag

SEQ ID NO: 2630 - RNA, 24 nt, Artificial Sequence
  Synthetic Oligonucleotide; CTLA4 exon 3; Set A
acaaagcagagccucccugagaca

SEQ ID NO: 2631 - RNA, 27 nt, Artificial Sequence
  Synthetic Oligonucleotide; CTLA4 exon 3; Set A
aaacaaagcagagccucccugagacag

SEQ ID NO: 2632 - RNA, 25 nt, Artificial Sequence
  Synthetic Oligonucleotide; CTLA4 exon 3; Set A
aacaaagcagagccucccugagaca

SEQ ID NO: 2633 - RNA, 26 nt, Artificial Sequence
  Synthetic Oligonucleotide; CTLA4 exon 3; Set A
aaacaaagcagagccucccugagaca

SEQ ID NO: 2634 - RNA, 27 nt, Artificial Sequence
  Synthetic Oligonucleotide; CTLA4 exon 3; Set A
aaaacaaagcagagccucccugagaca

SEQ ID NO: 2635 - RNA, 26 nt, Artificial Sequence
  Synthetic Oligonucleotide; CTLA4 exon 3; Set A
gguucuggaucugcaacagaaaacaa

SEQ ID NO: 2636 - RNA, 25 nt, Artificial Sequence
  Synthetic Oligonucleotide; CTLA4 exon 3; Set A
gguucuggaucugcaacagaaaaca

SEQ ID NO: 2637 - RNA, 27 nt, Artificial Sequence
  Synthetic Oligonucleotide; CTLA4 exon 3; Set A
cgguucuggaucugcaacagaaaacaa

SEQ ID NO: 2638 - RNA, 24 nt, Artificial Sequence
  Synthetic Oligonucleotide; CTLA4 exon 3; Set C
gguucuggaucugcaacagaaaac

SEQ ID NO: 2639 - RNA, 26 nt, Artificial Sequence
  Synthetic Oligonucleotide; CTLA4 exon 3; Set A
cgguucuggaucugcaacagaaaaca

SEQ ID NO: 2640 - RNA, 28 nt, Artificial Sequence
  Synthetic Oligonucleotide; CTLA4 exon 3; Set A
acgguucuggaucugcaacagaaaacaa

SEQ ID NO: 2641 - RNA, 23 nt, Artificial Sequence
  Synthetic Oligonucleotide; CTLA4 exon 3; Set C
gguucuggaucugcaacagaaaa

SEQ ID NO: 2642 - RNA, 25 nt, Artificial Sequence
  Synthetic Oligonucleotide; CTLA4 exon 3; Set A
cgguucuggaucugcaacagaaaac

SEQ ID NO: 2643 - RNA, 27 nt, Artificial Sequence
  Synthetic Oligonucleotide; CTLA4 exon 3; Set A
acgguucuggaucugcaacagaaaaca

SEQ ID NO: 2644 - RNA, 29 nt, Artificial Sequence
  Synthetic Oligonucleotide; CTLA4 exon 3; Set A
cacgguucuggaucugcaacagaaaacaa

SEQ ID NO: 2645 - RNA, 22 nt, Artificial Sequence
  Synthetic Oligonucleotide; CTLA4 exon 3; Set C
gguucuggaucugcaacagaaa

SEQ ID NO: 2646 - RNA, 24 nt, Artificial Sequence
  Synthetic Oligonucleotide; CTLA4 exon 3; Set C
cgguucuggaucugcaacagaaaa

SEQ ID NO: 2647 - RNA, 26 nt, Artificial Sequence
  Synthetic Oligonucleotide; CTLA4 exon 3; Set A
acgguucuggaucugcaacagaaaac

SEQ ID NO: 2648 - RNA, 28 nt, Artificial Sequence
  Synthetic Oligonucleotide; CTLA4 exon 3; Set A
cacgguucuggaucugcaacagaaaaca

SEQ ID NO: 2649 - RNA, 30 nt, Artificial Sequence
  Synthetic Oligonucleotide; CTLA4 exon 3; Set A
gcacgguucuggaucugcaacagaaaacaa

SEQ ID NO: 2650 - RNA, 23 nt, Artificial Sequence
  Synthetic Oligonucleotide; CTLA4 exon 3; Set A
cgguucuggaucugcaacagaaa

SEQ ID NO: 2651 - RNA, 25 nt, Artificial Sequence
  Synthetic Oligonucleotide; CTLA4 exon 3; Set A
acgguucuggaucugcaacagaaaa

SEQ ID NO: 2652 - RNA, 27 nt, Artificial Sequence
  Synthetic Oligonucleotide; CTLA4 exon 3; Set A
cacgguucuggaucugcaacagaaaac

SEQ ID NO: 2653 - RNA, 29 nt, Artificial Sequence
  Synthetic Oligonucleotide; CTLA4 exon 3; Set C
gcacgguucuggaucugcaacagaaaaca

SEQ ID NO: 2654 - RNA, 31 nt, Artificial Sequence
  Synthetic Oligonucleotide; CTLA4 exon 3; Set C
ggcacgguucuggaucugcaacagaaaacaa

SEQ ID NO: 2655 - RNA, 24 nt, Artificial Sequence
  Synthetic Oligonucleotide; CTLA4 exon 3; Set A
acgguucuggaucugcaacagaaa

SEQ ID NO: 2656 - RNA, 26 nt, Artificial Sequence
  Synthetic Oligonucleotide; CTLA4 exon 3; Set A
cacgguucuggaucugcaacagaaaa

SEQ ID NO: 2657 - RNA, 28 nt, Artificial Sequence
  Synthetic Oligonucleotide; CTLA4 exon 3; Set A
gcacgguucuggaucugcaacagaaaac

SEQ ID NO: 2658 - RNA, 30 nt, Artificial Sequence
  Synthetic Oligonucleotide; CTLA4 exon 3; Set C
ggcacgguucuggaucugcaacagaaaaca

SEQ ID NO: 2659 - RNA, 25 nt, Artificial Sequence
  Synthetic Oligonucleotide; CTLA4 exon 3; Set A
cacgguucuggaucugcaacagaaa

SEQ ID NO: 2660 - RNA, 27 nt, Artificial Sequence
  Synthetic Oligonucleotide; CTLA4 exon 3; Set A
gcacgguucuggaucugcaacagaaaa

SEQ ID NO: 2661 - RNA, 29 nt, Artificial Sequence
  Synthetic Oligonucleotide; CTLA4 exon 3; Set C
ggcacgguucuggaucugcaacagaaaac

SEQ ID NO: 2662 - RNA, 26 nt, Artificial Sequence
  Synthetic Oligonucleotide; CTLA4 exon 3; Set A
gcacgguucuggaucugcaacagaaa

SEQ ID NO: 2663 - RNA, 28 nt, Artificial Sequence
  Synthetic Oligonucleotide; CTLA4 exon 3; Set A
ggcacgguucuggaucugcaacagaaaa

SEQ ID NO: 2664 - RNA, 27 nt, Artificial Sequence
  Synthetic Oligonucleotide; CTLA4 exon 3; Set C
ggcacgguucuggaucugcaacagaaa

SEQ ID NO: 2665 - RNA, 37 nt, Artificial Sequence
  Synthetic Oligonucleotide; CTLA4 exon 3; Set C
aaucugggcacgguucuggaucugcaacagaaaacaa

SEQ ID NO: 2666 - RNA, 36 nt, Artificial Sequence
  Synthetic Oligonucleotide; CTLA4 exon 3; Set C
aaucugggcacgguucuggaucugcaacagaaaaca

SEQ ID NO: 2667 - RNA, 35 nt, Artificial Sequence
  Synthetic Oligonucleotide; CTLA4 exon 3; Set C
aaucugggcacgguucuggaucugcaacagaaaac

SEQ ID NO: 2668 - RNA, 34 nt, Artificial Sequence
  Synthetic Oligonucleotide; CTLA4 exon 3; Set C
aaucugggcacgguucuggaucugcaacagaaaa

SEQ ID NO: 2669 - RNA, 33 nt, Artificial Sequence
  Synthetic Oligonucleotide; CTLA4 exon 3; Set C
aaucugggcacgguucuggaucugcaacagaaa

SEQ ID NO: 2670 - RNA, 40 nt, Artificial Sequence
  Synthetic Oligonucleotide; CTLA4 exon 3; Set C
agucagaaucugggcacgguucuggaucugcaacagaaaa

SEQ ID NO: 2671 - RNA, 39 nt, Artificial Sequence
  Synthetic Oligonucleotide; CTLA4 exon 3; Set C
agucagaaucugggcacgguucuggaucugcaacagaaa

SEQ ID NO: 2672 - RNA, 40 nt, Artificial Sequence
  Synthetic Oligonucleotide; CTLA4 exon 3; Set C
aagucagaaucugggcacgguucuggaucugcaacagaaa

SEQ ID NO: 2673 - RNA, 16 nt, Artificial Sequence
  Synthetic Oligonucleotide; CTLA4 exon 3; Set C
agucagaaucugggca

SEQ ID NO: 2674 - RNA, 17 nt, Artificial Sequence
  Synthetic Oligonucleotide; CTLA4 exon 3; Set C
aagucagaaucugggca

SEQ ID NO: 2675 - RNA, 15 nt, Artificial Sequence
  Synthetic Oligonucleotide; CTLA4 exon 3; Set C
agucagaaucugggc

SEQ ID NO: 2676 - RNA, 16 nt, Artificial Sequence
  Synthetic Oligonucleotide; CTLA4 exon 3; Set C
aagucagaaucugggc

SEQ ID NO: 2677 - RNA, 17 nt, Artificial Sequence
  Synthetic Oligonucleotide; CTLA4 exon 3; Set C
gaagucagaaucugggc

SEQ ID NO: 2678 - RNA, 18 nt, Artificial Sequence
  Synthetic Oligonucleotide; CTLA4 exon 3; Set C
ggaagucagaaucugggc

SEQ ID NO: 2679 - RNA, 36 nt, Artificial Sequence
  Synthetic Oligonucleotide; CTLA4 exon 3; Set C
uaacugcugcaaggauccagaggaggaagucagaau

SEQ ID NO: 2680 - RNA, 18 nt, Artificial Sequence
  Synthetic Oligonucleotide; CTLA4 exon 3; Set C
aaaacaaccccgaacuaa

SEQ ID NO: 2681 - RNA, 17 nt, Artificial Sequence
  Synthetic Oligonucleotide; CTLA4 exon 3; Set C
aaaacaaccccgaacua

SEQ ID NO: 2682 - RNA, 18 nt, Artificial Sequence
  Synthetic Oligonucleotide; CTLA4 exon 3; Set C
aaaaacaaccccgaacua

SEQ ID NO: 2683 - RNA, 19 nt, Artificial Sequence
  Synthetic Oligonucleotide; CTLA4 exon 3; Set C
aaaaaacaaccccgaacua

SEQ ID NO: 2684 - RNA, 17 nt, Artificial Sequence
  Synthetic Oligonucleotide; CTLA4 exon 3; Set C
aaaaacaaccccgaacu

SEQ ID NO: 2685 - RNA, 22 nt, Artificial Sequence
  Synthetic Oligonucleotide; CTLA4 exon 3; Set C
uaaaaaaacaaccccgaacuaa

SEQ ID NO: 2686 - RNA, 20 nt, Artificial Sequence
  Synthetic Oligonucleotide; CTLA4 exon 3; Set C
aaaaaaacaaccccgaacua

SEQ ID NO: 2687 - RNA, 18 nt, Artificial Sequence
  Synthetic Oligonucleotide; CTLA4 exon 3; Set C
aaaaaacaaccccgaacu

SEQ ID NO: 2688 - RNA, 23 nt, Artificial Sequence
  Synthetic Oligonucleotide; CTLA4 exon 3; Set C
auaaaaaaacaaccccgaacuaa

SEQ ID NO: 2689 - RNA, 19 nt, Artificial Sequence
  Synthetic Oligonucleotide; CTLA4 exon 3; Set C
aaaaaaacaaccccgaacu

SEQ ID NO: 2690 - RNA, 17 nt, Artificial Sequence
  Synthetic Oligonucleotide; CTLA4 exon 3; Set C
aaaaaacaaccccgaac

SEQ ID NO: 2691 - RNA, 18 nt, Artificial Sequence
  Synthetic Oligonucleotide; CTLA4 exon 3; Set C
aaaaaaacaaccccgaac

SEQ ID NO: 2692 - RNA, 16 nt, Artificial Sequence
  Synthetic Oligonucleotide; CTLA4 exon 3; Set C
aaaaaacaaccccgaa

SEQ ID NO: 2693 - RNA, 17 nt, Artificial Sequence
  Synthetic Oligonucleotide; CTLA4 exon 3; Set C
aaaaaaacaaccccgaa

SEQ ID NO: 2694 - RNA, 31 nt, Artificial Sequence
  Synthetic Oligonucleotide; CTLA4 exon 3; Set C
agaaagcuauaaaaaaacaaccccgaacuaa

SEQ ID NO: 2695 - RNA, 29 nt, Artificial Sequence
  Synthetic Oligonucleotide; CTLA4 exon 3; Set C
gaaagcuauaaaaaaacaaccccgaacua

SEQ ID NO: 2696 - RNA, 32 nt, Artificial Sequence
  Synthetic Oligonucleotide; CTLA4 exon 3; Set C
gagaaagcuauaaaaaaacaaccccgaacuaa

SEQ ID NO: 2697 - RNA, 30 nt, Artificial Sequence
  Synthetic Oligonucleotide; CTLA4 exon 3; Set C
agaaagcuauaaaaaaacaaccccgaacua

SEQ ID NO: 2698 - RNA, 28 nt, Artificial Sequence
  Synthetic Oligonucleotide; CTLA4 exon 3; Set C
gaaagcuauaaaaaaacaaccccgaacu

SEQ ID NO: 2699 - RNA, 33 nt, Artificial Sequence
  Synthetic Oligonucleotide; CTLA4 exon 3; Set C
ggagaaagcuauaaaaaaacaaccccgaacuaa

SEQ ID NO: 2700 - RNA, 27 nt, Artificial Sequence
  Synthetic Oligonucleotide; CTLA4 exon 3; Set C
gaaagcuauaaaaaaacaaccccgaac

SEQ ID NO: 2701 - RNA, 34 nt, Artificial Sequence
  Synthetic Oligonucleotide; CTLA4 exon 3; Set C
aggagaaagcuauaaaaaaacaaccccgaacuaa

SEQ ID NO: 2702 - RNA, 26 nt, Artificial Sequence
  Synthetic Oligonucleotide; CTLA4 exon 3; Set C
gaaagcuauaaaaaaacaaccccgaa

SEQ ID NO: 2703 - RNA, 35 nt, Artificial Sequence
  Synthetic Oligonucleotide; CTLA4 exon 3; Set A
gaggagaaagcuauaaaaaaacaaccccgaacuaa

SEQ ID NO: 2704 - RNA, 33 nt, Artificial Sequence
  Synthetic Oligonucleotide; CTLA4 exon 3; Set C
aggagaaagcuauaaaaaaacaaccccgaacua

SEQ ID NO: 2705 - RNA, 34 nt, Artificial Sequence
  Synthetic Oligonucleotide; CTLA4 exon 3; Set A
gaggagaaagcuauaaaaaaacaaccccgaacua

SEQ ID NO: 2706 - RNA, 32 nt, Artificial Sequence
  Synthetic Oligonucleotide; CTLA4 exon 3; Set C
aggagaaagcuauaaaaaaacaaccccgaacu

SEQ ID NO: 2707 - RNA, 35 nt, Artificial Sequence
  Synthetic Oligonucleotide; CTLA4 exon 3; Set A
ugaggagaaagcuauaaaaaaacaaccccgaacua

SEQ ID NO: 2708 - RNA, 33 nt, Artificial Sequence
  Synthetic Oligonucleotide; CTLA4 exon 3; Set A
gaggagaaagcuauaaaaaaacaaccccgaacu

SEQ ID NO: 2709 - RNA, 36 nt, Artificial Sequence
  Synthetic Oligonucleotide; CTLA4 exon 3; Set A
gugaggagaaagcuauaaaaaaacaaccccgaacua

SEQ ID NO: 2710 - RNA, 34 nt, Artificial Sequence
  Synthetic Oligonucleotide; CTLA4 exon 3; Set A
ugaggagaaagcuauaaaaaaacaaccccgaacu

SEQ ID NO: 2711 - RNA, 35 nt, Artificial Sequence
  Synthetic Oligonucleotide; CTLA4 exon 3; Set A
gugaggagaaagcuauaaaaaaacaaccccgaacu

SEQ ID NO: 2712 - RNA, 33 nt, Artificial Sequence
  Synthetic Oligonucleotide; CTLA4 exon 3; Set A
ugaggagaaagcuauaaaaaaacaaccccgaac

SEQ ID NO: 2713 - RNA, 15 nt, Artificial Sequence
  Synthetic Oligonucleotide; CTLA4 exon 3; Set C
gaaagcuauaaaaaa

SEQ ID NO: 2714 - RNA, 16 nt, Artificial Sequence
  Synthetic Oligonucleotide; CTLA4 exon 3; Set C
agaaagcuauaaaaaa

SEQ ID NO: 2715 - RNA, 15 nt, Artificial Sequence
  Synthetic Oligonucleotide; CTLA4 exon 3; Set C
agaaagcuauaaaaa

SEQ ID NO: 2716 - RNA, 16 nt, Artificial Sequence
  Synthetic Oligonucleotide; CTLA4 exon 3; Set C
gagaaagcuauaaaaa

SEQ ID NO: 2717 - RNA, 15 nt, Artificial Sequence
  Synthetic Oligonucleotide; CTLA4 exon 3; Set C
gagaaagcuauaaaa

SEQ ID NO: 2718 - RNA, 17 nt, Artificial Sequence
  Synthetic Oligonucleotide; CTLA4 exon 3; Set C
ggagaaagcuauaaaaa

SEQ ID NO: 2719 - RNA, 19 nt, Artificial Sequence
  Synthetic Oligonucleotide; CTLA4 exon 3; Set C
aggagaaagcuauaaaaaa

SEQ ID NO: 2720 - RNA, 16 nt, Artificial Sequence
  Synthetic Oligonucleotide; CTLA4 exon 3; Set C
ggagaaagcuauaaaa

SEQ ID NO: 2721 - RNA, 18 nt, Artificial Sequence
  Synthetic Oligonucleotide; CTLA4 exon 3; Set C
aggagaaagcuauaaaaa

SEQ ID NO: 2722 - RNA, 20 nt, Artificial Sequence
  Synthetic Oligonucleotide; CTLA4 exon 3; Set C
gaggagaaagcuauaaaaaa

SEQ ID NO: 2723 - RNA, 17 nt, Artificial Sequence
  Synthetic Oligonucleotide; CTLA4 exon 3; Set C
aggagaaagcuauaaaa

SEQ ID NO: 2724 - RNA, 15 nt, Artificial Sequence
  Synthetic Oligonucleotide; CTLA4 exon 3; Set C
ggagaaagcuauaaa

SEQ ID NO: 2725 - RNA, 19 nt, Artificial Sequence
  Synthetic Oligonucleotide; CTLA4 exon 3; Set C
gaggagaaagcuauaaaaa

SEQ ID NO: 2726 - RNA, 21 nt, Artificial Sequence
  Synthetic Oligonucleotide; CTLA4 exon 3; Set C
ugaggagaaagcuauaaaaaa

SEQ ID NO: 2727 - RNA, 18 nt, Artificial Sequence
  Synthetic Oligonucleotide; CTLA4 exon 3; Set C
gaggagaaagcuauaaaa

SEQ ID NO: 2728 - RNA, 16 nt, Artificial Sequence
  Synthetic Oligonucleotide; CTLA4 exon 3; Set C
aggagaaagcuauaaa

SEQ ID NO: 2729 - RNA, 20 nt, Artificial Sequence
  Synthetic Oligonucleotide; CTLA4 exon 3; Set C
ugaggagaaagcuauaaaaa

SEQ ID NO: 2730 - RNA, 22 nt, Artificial Sequence
  Synthetic Oligonucleotide; CTLA4 exon 3; Set C
gugaggagaaagcuauaaaaaa

SEQ ID NO: 2731 - RNA, 17 nt, Artificial Sequence
  Synthetic Oligonucleotide; CTLA4 exon 3; Set C
gaggagaaagcuauaaa

SEQ ID NO: 2732 - RNA, 21 nt, Artificial Sequence
  Synthetic Oligonucleotide; CTLA4 exon 3; Set C
gugaggagaaagcuauaaaaa

SEQ ID NO: 2733 - RNA, 18 nt, Artificial Sequence
  Synthetic Oligonucleotide; CTLA4 exon 3; Set C
ugaggagaaagcuauaaa

SEQ ID NO: 2734 - RNA, 19 nt, Artificial Sequence
  Synthetic Oligonucleotide; CTLA4 exon 3; Set C
gugaggagaaagcuauaaa

SEQ ID NO: 2735 - RNA, 30 nt, Artificial Sequence
  Synthetic Oligonucleotide; CTLA4 exon 3; Set C
aaacagcugugaggagaaagcuauaaaaaa

SEQ ID NO: 2736 - RNA, 29 nt, Artificial Sequence
  Synthetic Oligonucleotide; CTLA4 exon 3; Set C
aaacagcugugaggagaaagcuauaaaaa

SEQ ID NO: 2737 - RNA, 28 nt, Artificial Sequence
  Synthetic Oligonucleotide; CTLA4 exon 3; Set C
aaacagcugugaggagaaagcuauaaaa

SEQ ID NO: 2738 - RNA, 29 nt, Artificial Sequence
  Synthetic Oligonucleotide; CTLA4 exon 3; Set C
gaaacagcugugaggagaaagcuauaaaa

SEQ ID NO: 2739 - RNA, 27 nt, Artificial Sequence
  Synthetic Oligonucleotide; CTLA4 exon 3; Set C
aaacagcugugaggagaaagcuauaaa

SEQ ID NO: 2740 - RNA, 34 nt, Artificial Sequence
  Synthetic Oligonucleotide; CTLA4 exon 3; Set C
aaagaaacagcugugaggagaaagcuauaaaaaa

SEQ ID NO: 2741 - RNA, 33 nt, Artificial Sequence
  Synthetic Oligonucleotide; CTLA4 exon 3; Set C
aaagaaacagcugugaggagaaagcuauaaaaa

SEQ ID NO: 2742 - RNA, 35 nt, Artificial Sequence
  Synthetic Oligonucleotide; CTLA4 exon 3; Set C
caaagaaacagcugugaggagaaagcuauaaaaaa

SEQ ID NO: 2743 - RNA, 32 nt, Artificial Sequence
  Synthetic Oligonucleotide; CTLA4 exon 3; Set C
aaagaaacagcugugaggagaaagcuauaaaa

SEQ ID NO: 2744 - RNA, 31 nt, Artificial Sequence
  Synthetic Oligonucleotide; CTLA4 exon 3; Set C
aaagaaacagcugugaggagaaagcuauaaa

SEQ ID NO: 2745 - RNA, 31 nt, Artificial Sequence
  Synthetic Oligonucleotide; CTLA4 exon 3; Set A
caaagaaacagcugugaggagaaagcuauaa

SEQ ID NO: 2746 - RNA, 19 nt, Artificial Sequence
  Synthetic Oligonucleotide; CTLA4 exon 3; Set C
gaaacagcugugaggagaa

SEQ ID NO: 2747 - RNA, 17 nt, Artificial Sequence
  Synthetic Oligonucleotide; CTLA4 exon 3; Set C
aaacagcugugaggaga

SEQ ID NO: 2748 - RNA, 21 nt, Artificial Sequence
  Synthetic Oligonucleotide; CTLA4 exon 3; Set C
aagaaacagcugugaggagaa

SEQ ID NO: 2749 - RNA, 22 nt, Artificial Sequence
  Synthetic Oligonucleotide; CTLA4 exon 3; Set C
aaagaaacagcugugaggagaa

SEQ ID NO: 2750 - RNA, 21 nt, Artificial Sequence
  Synthetic Oligonucleotide; CTLA4 exon 3; Set C
aaagaaacagcugugaggaga

SEQ ID NO: 2751 - RNA, 22 nt, Artificial Sequence
  Synthetic Oligonucleotide; CTLA4 exon 3; Set C
caaagaaacagcugugaggaga

SEQ ID NO: 2752 - RNA, 21 nt, Artificial Sequence
  Synthetic Oligonucleotide; CTLA4 exon 3; Set C
caaagaaacagcugugaggag

SEQ ID NO: 2753 - RNA, 18 nt, Artificial Sequence
  Synthetic Oligonucleotide; CTLA4 exon 3; Set C
aaagaaacagcugugagg

SEQ ID NO: 2754 - RNA, 20 nt, Artificial Sequence
  Synthetic Oligonucleotide; CTLA4 exon 3; Set C
caaagaaacagcugugagga

SEQ ID NO: 2755 - RNA, 19 nt, Artificial Sequence
  Synthetic Oligonucleotide; CTLA4 exon 3; Set C
caaagaaacagcugugagg

SEQ ID NO: 2756 - RNA, 17 nt, Artificial Sequence
  Synthetic Oligonucleotide; CTLA4 exon 3; Set C
aaagaaacagcugugag

SEQ ID NO: 2757 - RNA, 16 nt, Artificial Sequence
  Synthetic Oligonucleotide; CTLA4 exon 3; Set C
aaagaaacagcuguga

SEQ ID NO: 2758 - RNA, 18 nt, Artificial Sequence
  Synthetic Oligonucleotide; CTLA4 exon 3; Set C
caaagaaacagcugugag

SEQ ID NO: 2759 - RNA, 17 nt, Artificial Sequence
  Synthetic Oligonucleotide; CTLA4 exon 3; Set C
caaagaaacagcuguga

SEQ ID NO: 2760 - RNA, 16 nt, Artificial Sequence
  Synthetic Oligonucleotide; CTLA4 exon 3; Set C
caaagaaacagcugug

SEQ ID NO: 2761 - RNA, 36 nt, Artificial Sequence
  Synthetic Oligonucleotide; CTLA4 exon 3; Set C
ucaccauuuugcucaaagaaacagcugugaggagaa

SEQ ID NO: 2762 - RNA, 36 nt, Artificial Sequence
  Synthetic Oligonucleotide; CTLA4 exon 3; Set C
ccaucagcaccacacucaccauuuugcucaaagaaa

SEQ ID NO: 2763 - RNA, 37 nt, Artificial Sequence
  Synthetic Oligonucleotide; CTLA4 exon 3; Set C
accaucagcaccacacucaccauuuugcucaaagaaa

SEQ ID NO: 2764 - RNA, 30 nt, Artificial Sequence
  Synthetic Oligonucleotide; CTLA4 exon 3; Set C
caucagcaccacacucaccauuuugcucaa

SEQ ID NO: 2765 - RNA, 31 nt, Artificial Sequence
  Synthetic Oligonucleotide; CTLA4 exon 3; Set C
ccaucagcaccacacucaccauuuugcucaa

SEQ ID NO: 2766 - RNA, 32 nt, Artificial Sequence
  Synthetic Oligonucleotide; CTLA4 exon 3; Set C
accaucagcaccacacucaccauuuugcucaa

SEQ ID NO: 2767 - RNA, 19 nt, Artificial Sequence
  Synthetic Oligonucleotide; CTLA4 exon 3; Set B
cagacauggugcaccauca

SEQ ID NO: 2768 - RNA, 20 nt, Artificial Sequence
  Synthetic Oligonucleotide; CTLA4 exon 3; Set B
ucagacauggugcaccauca

SEQ ID NO: 2769 - RNA, 18 nt, Artificial Sequence
  Synthetic Oligonucleotide; CTLA4 exon 3; Set C
cagacauggugcaccauc

SEQ ID NO: 2770 - RNA, 19 nt, Artificial Sequence
  Synthetic Oligonucleotide; CTLA4 exon 3; Set B
ucagacauggugcaccauc

SEQ ID NO: 2771 - RNA, 18 nt, Artificial Sequence
  Synthetic Oligonucleotide; CTLA4 exon 3; Set C
ucagacauggugcaccau

SEQ ID NO: 2772 - RNA, 17 nt, Artificial Sequence
  Synthetic Oligonucleotide; CTLA4 exon 3; Set C
ucagacauggugcacca

SEQ ID NO: 2773 - RNA, 36 nt, Artificial Sequence
  Synthetic Oligonucleotide; CTLA4 exon 3; Set C
acuaaagguauccccaucagacauggugcaccauca

SEQ ID NO: 2774 - RNA, 17 nt, Artificial Sequence
  Synthetic Oligonucleotide; CTLA4 exon 3; Set C
ccugagacaguuuuaaa

SEQ ID NO: 2775 - RNA, 16 nt, Artificial Sequence
  Synthetic Oligonucleotide; CTLA4 exon 3; Set C
ccugagacaguuuuaa

SEQ ID NO: 2776 - RNA, 15 nt, Artificial Sequence
  Synthetic Oligonucleotide; CTLA4 exon 3; Set C
ccugagacaguuuua

SEQ ID NO: 2777 - RNA, 33 nt, Artificial Sequence
  Synthetic Oligonucleotide; CTLA4 exon 3; Set A
caaagcagagccucccugagacaguuuuaaacu

SEQ ID NO: 2778 - RNA, 34 nt, Artificial Sequence
  Synthetic Oligonucleotide; CTLA4 exon 3; Set C
acaaagcagagccucccugagacaguuuuaaacu

SEQ ID NO: 2779 - RNA, 35 nt, Artificial Sequence
  Synthetic Oligonucleotide; CTLA4 exon 3; Set C
aacaaagcagagccucccugagacaguuuuaaacu

SEQ ID NO: 2780 - RNA, 20 nt, Artificial Sequence
  Synthetic Oligonucleotide; CTLA4 exon 3; Set A
aaucugggcacgguucugga

SEQ ID NO: 2781 - RNA, 26 nt, Artificial Sequence
  Synthetic Oligonucleotide; CTLA4 exon 3; Set C
agucagaaucugggcacgguucugga

SEQ ID NO: 2782 - RNA, 27 nt, Artificial Sequence
  Synthetic Oligonucleotide; CTLA4 exon 3; Set C
aagucagaaucugggcacgguucugga

SEQ ID NO: 2783 - RNA, 28 nt, Artificial Sequence
  Synthetic Oligonucleotide; CTLA4 exon 3; Set C
gaagucagaaucugggcacgguucugga

SEQ ID NO: 2784 - RNA, 29 nt, Artificial Sequence
  Synthetic Oligonucleotide; CTLA4 exon 3; Set C
ggaagucagaaucugggcacgguucugga

SEQ ID NO: 2785 - RNA, 30 nt, Artificial Sequence
  Synthetic Oligonucleotide; CTLA4 exon 3; Set C
aggaagucagaaucugggcacgguucugga

SEQ ID NO: 2786 - RNA, 31 nt, Artificial Sequence
  Synthetic Oligonucleotide; CTLA4 exon 3; Set C
gaggaagucagaaucugggcacgguucugga

SEQ ID NO: 2787 - RNA, 32 nt, Artificial Sequence
  Synthetic Oligonucleotide; CTLA4 exon 3; Set C
ggaggaagucagaaucugggcacgguucugga

SEQ ID NO: 2788 - RNA, 37 nt, Artificial Sequence
  Synthetic Oligonucleotide; CTLA4 exon 3; Set C
cuaacugcugcaaggauccagaggaggaagucagaau

SEQ ID NO: 2789 - RNA, 38 nt, Artificial Sequence
  Synthetic Oligonucleotide; CTLA4 exon 3; Set C
acuaacugcugcaaggauccagaggaggaagucagaau

SEQ ID NO: 2790 - RNA, 39 nt, Artificial Sequence
  Synthetic Oligonucleotide; CTLA4 exon 3; Set C
aacuaacugcugcaaggauccagaggaggaagucagaau

SEQ ID NO: 2791 - RNA, 40 nt, Artificial Sequence
  Synthetic Oligonucleotide; CTLA4 exon 3; Set C
gaacuaacugcugcaaggauccagaggaggaagucagaau

SEQ ID NO: 2792 - RNA, 30 nt, Artificial Sequence
  Synthetic Oligonucleotide; CTLA4 exon 3; Set C
uaacugcugcaaggauccagaggaggaagu

SEQ ID NO: 2793 - RNA, 29 nt, Artificial Sequence
  Synthetic Oligonucleotide; CTLA4 exon 3; Set A
uaacugcugcaaggauccagaggaggaag

SEQ ID NO: 2794 - RNA, 31 nt, Artificial Sequence
  Synthetic Oligonucleotide; CTLA4 exon 3; Set C
cuaacugcugcaaggauccagaggaggaagu

SEQ ID NO: 2795 - RNA, 28 nt, Artificial Sequence
  Synthetic Oligonucleotide; CTLA4 exon 3; Set A
uaacugcugcaaggauccagaggaggaa

SEQ ID NO: 2796 - RNA, 30 nt, Artificial Sequence
  Synthetic Oligonucleotide; CTLA4 exon 3; Set A
cuaacugcugcaaggauccagaggaggaag

SEQ ID NO: 2797 - RNA, 32 nt, Artificial Sequence
  Synthetic Oligonucleotide; CTLA4 exon 3; Set C
acuaacugcugcaaggauccagaggaggaagu

SEQ ID NO: 2798 - RNA, 27 nt, Artificial Sequence
  Synthetic Oligonucleotide; CTLA4 exon 3; Set C
uaacugcugcaaggauccagaggagga

SEQ ID NO: 2799 - RNA, 29 nt, Artificial Sequence
  Synthetic Oligonucleotide; CTLA4 exon 3; Set C
cuaacugcugcaaggauccagaggaggaa

SEQ ID NO: 2800 - RNA, 31 nt, Artificial Sequence
  Synthetic Oligonucleotide; CTLA4 exon 3; Set C
acuaacugcugcaaggauccagaggaggaag

SEQ ID NO: 2801 - RNA, 33 nt, Artificial Sequence
  Synthetic Oligonucleotide; CTLA4 exon 3; Set C
aacuaacugcugcaaggauccagaggaggaagu

SEQ ID NO: 2802 - RNA, 26 nt, Artificial Sequence
  Synthetic Oligonucleotide; CTLA4 exon 3; Set A
uaacugcugcaaggauccagaggagg

SEQ ID NO: 2803 - RNA, 30 nt, Artificial Sequence
  Synthetic Oligonucleotide; CTLA4 exon 3; Set C
acuaacugcugcaaggauccagaggaggaa

SEQ ID NO: 2804 - RNA, 32 nt, Artificial Sequence
  Synthetic Oligonucleotide; CTLA4 exon 3; Set A
aacuaacugcugcaaggauccagaggaggaag

SEQ ID NO: 2805 - RNA, 34 nt, Artificial Sequence
  Synthetic Oligonucleotide; CTLA4 exon 3; Set C
gaacuaacugcugcaaggauccagaggaggaagu

SEQ ID NO: 2806 - RNA, 25 nt, Artificial Sequence
  Synthetic Oligonucleotide; CTLA4 exon 3; Set A
uaacugcugcaaggauccagaggag

SEQ ID NO: 2807 - RNA, 31 nt, Artificial Sequence
  Synthetic Oligonucleotide; CTLA4 exon 3; Set C
aacuaacugcugcaaggauccagaggaggaa

SEQ ID NO: 2808 - RNA, 33 nt, Artificial Sequence
  Synthetic Oligonucleotide; CTLA4 exon 3; Set C
gaacuaacugcugcaaggauccagaggaggaag

SEQ ID NO: 2809 - RNA, 24 nt, Artificial Sequence
  Synthetic Oligonucleotide; CTLA4 exon 3; Set A
uaacugcugcaaggauccagagga

SEQ ID NO: 2810 - RNA, 40 nt, Artificial Sequence
  Synthetic Oligonucleotide; CTLA4 exon 3; Set C
aaaacaaccccgaacuaacugcugcaaggauccagaggag

SEQ ID NO: 2811 - RNA, 39 nt, Artificial Sequence
  Synthetic Oligonucleotide; CTLA4 exon 3; Set C
aaaacaaccccgaacuaacugcugcaaggauccagagga

SEQ ID NO: 2812 - RNA, 40 nt, Artificial Sequence
  Synthetic Oligonucleotide; CTLA4 exon 3; Set C
aaaaacaaccccgaacuaacugcugcaaggauccagagga

SEQ ID NO: 2813 - RNA, 16 nt, Artificial Sequence
  Synthetic Oligonucleotide; CTLA4 exon 3; Set C
aacaaccccgaacuaa

SEQ ID NO: 2814 - RNA, 17 nt, Artificial Sequence
  Synthetic Oligonucleotide; CTLA4 exon 3; Set C
aaacaaccccgaacuaa

SEQ ID NO: 2815 - RNA, 16 nt, Artificial Sequence
  Synthetic Oligonucleotide; CTLA4 exon 3; Set C
aaaacaaccccgaacu

SEQ ID NO: 2816 - RNA, 15 nt, Artificial Sequence
  Synthetic Oligonucleotide; CTLA4 exon 3; Set C
aaaacaaccccgaac

SEQ ID NO: 2817 - RNA, 16 nt, Artificial Sequence
  Synthetic Oligonucleotide; CTLA4 exon 3; Set C
aaaaacaaccccgaac

SEQ ID NO: 2818 - RNA, 21 nt, Artificial Sequence
  Synthetic Oligonucleotide; CTLA4 exon 3; Set C
uaaaaaaacaaccccgaacua

SEQ ID NO: 2819 - RNA, 15 nt, Artificial Sequence
  Synthetic Oligonucleotide; CTLA4 exon 3; Set C
aaaaacaaccccgaa

SEQ ID NO: 2820 - RNA, 24 nt, Artificial Sequence
  Synthetic Oligonucleotide; CTLA4 exon 3; Set C
uauaaaaaaacaaccccgaacuaa

SEQ ID NO: 2821 - RNA, 22 nt, Artificial Sequence
  Synthetic Oligonucleotide; CTLA4 exon 3; Set C
auaaaaaaacaaccccgaacua

SEQ ID NO: 2822 - RNA, 20 nt, Artificial Sequence
  Synthetic Oligonucleotide; CTLA4 exon 3; Set C
uaaaaaaacaaccccgaacu

SEQ ID NO: 2823 - RNA, 21 nt, Artificial Sequence
  Synthetic Oligonucleotide; CTLA4 exon 3; Set C
auaaaaaaacaaccccgaacu

SEQ ID NO: 2824 - RNA, 19 nt, Artificial Sequence
  Synthetic Oligonucleotide; CTLA4 exon 3; Set C
uaaaaaaacaaccccgaac

SEQ ID NO: 2825 - RNA, 20 nt, Artificial Sequence
  Synthetic Oligonucleotide; CTLA4 exon 3; Set C
auaaaaaaacaaccccgaac

SEQ ID NO: 2826 - RNA, 18 nt, Artificial Sequence
  Synthetic Oligonucleotide; CTLA4 exon 3; Set C
uaaaaaaacaaccccgaa

SEQ ID NO: 2827 - RNA, 31 nt, Artificial Sequence
  Synthetic Oligonucleotide; CTLA4 exon 3; Set C
gagaaagcuauaaaaaaacaaccccgaacua

SEQ ID NO: 2828 - RNA, 29 nt, Artificial Sequence
  Synthetic Oligonucleotide; CTLA4 exon 3; Set C
agaaagcuauaaaaaaacaaccccgaacu

SEQ ID NO: 2829 - RNA, 32 nt, Artificial Sequence
  Synthetic Oligonucleotide; CTLA4 exon 3; Set C
ggagaaagcuauaaaaaaacaaccccgaacua

SEQ ID NO: 2830 - RNA, 30 nt, Artificial Sequence
  Synthetic Oligonucleotide; CTLA4 exon 3; Set C
gagaaagcuauaaaaaaacaaccccgaacu

SEQ ID NO: 2831 - RNA, 28 nt, Artificial Sequence
  Synthetic Oligonucleotide; CTLA4 exon 3; Set C
agaaagcuauaaaaaaacaaccccgaac

SEQ ID NO: 2832 - RNA, 31 nt, Artificial Sequence
  Synthetic Oligonucleotide; CTLA4 exon 3; Set C
ggagaaagcuauaaaaaaacaaccccgaacu

SEQ ID NO: 2833 - RNA, 29 nt, Artificial Sequence
  Synthetic Oligonucleotide; CTLA4 exon 3; Set C
gagaaagcuauaaaaaaacaaccccgaac

SEQ ID NO: 2834 - RNA, 27 nt, Artificial Sequence
  Synthetic Oligonucleotide; CTLA4 exon 3; Set C
agaaagcuauaaaaaaacaaccccgaa

SEQ ID NO: 2835 - RNA, 30 nt, Artificial Sequence
  Synthetic Oligonucleotide; CTLA4 exon 3; Set C
ggagaaagcuauaaaaaaacaaccccgaac

SEQ ID NO: 2836 - RNA, 28 nt, Artificial Sequence
  Synthetic Oligonucleotide; CTLA4 exon 3; Set C
gagaaagcuauaaaaaaacaaccccgaa

SEQ ID NO: 2837 - RNA, 31 nt, Artificial Sequence
  Synthetic Oligonucleotide; CTLA4 exon 3; Set C
aggagaaagcuauaaaaaaacaaccccgaac

SEQ ID NO: 2838 - RNA, 29 nt, Artificial Sequence
  Synthetic Oligonucleotide; CTLA4 exon 3; Set C
ggagaaagcuauaaaaaaacaaccccgaa

SEQ ID NO: 2839 - RNA, 32 nt, Artificial Sequence
  Synthetic Oligonucleotide; CTLA4 exon 3; Set C
gaggagaaagcuauaaaaaaacaaccccgaac

SEQ ID NO: 2840 - RNA, 30 nt, Artificial Sequence
  Synthetic Oligonucleotide; CTLA4 exon 3; Set C
aggagaaagcuauaaaaaaacaaccccgaa

SEQ ID NO: 2841 - RNA, 31 nt, Artificial Sequence
  Synthetic Oligonucleotide; CTLA4 exon 3; Set C
gaggagaaagcuauaaaaaaacaaccccgaa

SEQ ID NO: 2842 - RNA, 34 nt, Artificial Sequence
  Synthetic Oligonucleotide; CTLA4 exon 3; Set A
gugaggagaaagcuauaaaaaaacaaccccgaac

SEQ ID NO: 2843 - RNA, 32 nt, Artificial Sequence
  Synthetic Oligonucleotide; CTLA4 exon 3; Set C
ugaggagaaagcuauaaaaaaacaaccccgaa

SEQ ID NO: 2844 - RNA, 33 nt, Artificial Sequence
  Synthetic Oligonucleotide; CTLA4 exon 3; Set A
gugaggagaaagcuauaaaaaaacaaccccgaa

SEQ ID NO: 2845 - RNA, 17 nt, Artificial Sequence
  Synthetic Oligonucleotide; CTLA4 exon 3; Set C
gaaagcuauaaaaaaac

SEQ ID NO: 2846 - RNA, 16 nt, Artificial Sequence
  Synthetic Oligonucleotide; CTLA4 exon 3; Set C
gaaagcuauaaaaaaa

SEQ ID NO: 2847 - RNA, 17 nt, Artificial Sequence
  Synthetic Oligonucleotide; CTLA4 exon 3; Set C
gagaaagcuauaaaaaa

SEQ ID NO: 2848 - RNA, 18 nt, Artificial Sequence
  Synthetic Oligonucleotide; CTLA4 exon 3; Set C
ggagaaagcuauaaaaaa

SEQ ID NO: 2849 - RNA, 20 nt, Artificial Sequence
  Synthetic Oligonucleotide; CTLA4 exon 3; Set C
aggagaaagcuauaaaaaaa

SEQ ID NO: 2850 - RNA, 21 nt, Artificial Sequence
  Synthetic Oligonucleotide; CTLA4 exon 3; Set C
gaggagaaagcuauaaaaaaa

SEQ ID NO: 2851 - RNA, 22 nt, Artificial Sequence
  Synthetic Oligonucleotide; CTLA4 exon 3; Set C
ugaggagaaagcuauaaaaaaa

SEQ ID NO: 2852 - RNA, 23 nt, Artificial Sequence
  Synthetic Oligonucleotide; CTLA4 exon 3; Set C
gugaggagaaagcuauaaaaaaa

SEQ ID NO: 2853 - RNA, 15 nt, Artificial Sequence
  Synthetic Oligonucleotide; CTLA4 exon 3; Set C
aggagaaagcuauaa

SEQ ID NO: 2854 - RNA, 16 nt, Artificial Sequence
  Synthetic Oligonucleotide; CTLA4 exon 3; Set C
gaggagaaagcuauaa

SEQ ID NO: 2855 - RNA, 17 nt, Artificial Sequence
  Synthetic Oligonucleotide; CTLA4 exon 3; Set C
ugaggagaaagcuauaa

SEQ ID NO: 2856 - RNA, 15 nt, Artificial Sequence
  Synthetic Oligonucleotide; CTLA4 exon 3; Set C
gaggagaaagcuaua

SEQ ID NO: 2857 - RNA, 18 nt, Artificial Sequence
  Synthetic Oligonucleotide; CTLA4 exon 3; Set C
gugaggagaaagcuauaa

SEQ ID NO: 2858 - RNA, 16 nt, Artificial Sequence
  Synthetic Oligonucleotide; CTLA4 exon 3; Set C
ugaggagaaagcuaua

SEQ ID NO: 2859 - RNA, 17 nt, Artificial Sequence
  Synthetic Oligonucleotide; CTLA4 exon 3; Set C
gugaggagaaagcuaua

SEQ ID NO: 2860 - RNA, 31 nt, Artificial Sequence
  Synthetic Oligonucleotide; CTLA4 exon 3; Set C
aaacagcugugaggagaaagcuauaaaaaaa

SEQ ID NO: 2861 - RNA, 31 nt, Artificial Sequence
  Synthetic Oligonucleotide; CTLA4 exon 3; Set C
gaaacagcugugaggagaaagcuauaaaaaa

SEQ ID NO: 2862 - RNA, 30 nt, Artificial Sequence
  Synthetic Oligonucleotide; CTLA4 exon 3; Set C
gaaacagcugugaggagaaagcuauaaaaa

SEQ ID NO: 2863 - RNA, 32 nt, Artificial Sequence
  Synthetic Oligonucleotide; CTLA4 exon 3; Set C
agaaacagcugugaggagaaagcuauaaaaaa

SEQ ID NO: 2864 - RNA, 38 nt, Artificial Sequence
  Synthetic Oligonucleotide; CTLA4 exon 3; Set A
caaagaaacagcugugaggagaaagcuauaaaaaaaca

SEQ ID NO: 2865 - RNA, 31 nt, Artificial Sequence
  Synthetic Oligonucleotide; CTLA4 exon 3; Set C
agaaacagcugugaggagaaagcuauaaaaa

SEQ ID NO: 2866 - RNA, 33 nt, Artificial Sequence
  Synthetic Oligonucleotide; CTLA4 exon 3; Set C
aagaaacagcugugaggagaaagcuauaaaaaa

SEQ ID NO: 2867 - RNA, 37 nt, Artificial Sequence
  Synthetic Oligonucleotide; CTLA4 exon 3; Set C
caaagaaacagcugugaggagaaagcuauaaaaaaac

SEQ ID NO: 2868 - RNA, 30 nt, Artificial Sequence
  Synthetic Oligonucleotide; CTLA4 exon 3; Set C
agaaacagcugugaggagaaagcuauaaaa

SEQ ID NO: 2869 - RNA, 28 nt, Artificial Sequence
  Synthetic Oligonucleotide; CTLA4 exon 3; Set C
gaaacagcugugaggagaaagcuauaaa

SEQ ID NO: 2870 - RNA, 32 nt, Artificial Sequence
  Synthetic Oligonucleotide; CTLA4 exon 3; Set C
aagaaacagcugugaggagaaagcuauaaaaa

SEQ ID NO: 2871 - RNA, 26 nt, Artificial Sequence
  Synthetic Oligonucleotide; CTLA4 exon 3; Set C
aaacagcugugaggagaaagcuauaa

SEQ ID NO: 2872 - RNA, 36 nt, Artificial Sequence
  Synthetic Oligonucleotide; CTLA4 exon 3; Set C
caaagaaacagcugugaggagaaagcuauaaaaaaa

SEQ ID NO: 2873 - RNA, 31 nt, Artificial Sequence
  Synthetic Oligonucleotide; CTLA4 exon 3; Set C
aagaaacagcugugaggagaaagcuauaaaa

SEQ ID NO: 2874 - RNA, 29 nt, Artificial Sequence
  Synthetic Oligonucleotide; CTLA4 exon 3; Set C
agaaacagcugugaggagaaagcuauaaa

SEQ ID NO: 2875 - RNA, 25 nt, Artificial Sequence
  Synthetic Oligonucleotide; CTLA4 exon 3; Set C
aaacagcugugaggagaaagcuaua

SEQ ID NO: 2876 - RNA, 30 nt, Artificial Sequence
  Synthetic Oligonucleotide; CTLA4 exon 3; Set C
aagaaacagcugugaggagaaagcuauaaa

SEQ ID NO: 2877 - RNA, 30 nt, Artificial Sequence
  Synthetic Oligonucleotide; CTLA4 exon 3; Set C
aaagaaacagcugugaggagaaagcuauaa

SEQ ID NO: 2878 - RNA, 29 nt, Artificial Sequence
  Synthetic Oligonucleotide; CTLA4 exon 3; Set C
aaagaaacagcugugaggagaaagcuaua

SEQ ID NO: 2879 - RNA, 30 nt, Artificial Sequence
  Synthetic Oligonucleotide; CTLA4 exon 3; Set A
caaagaaacagcugugaggagaaagcuaua

SEQ ID NO: 2880 - RNA, 40 nt, Artificial Sequence
  Synthetic Oligonucleotide; CTLA4 exon 3; Set A
uuugcucaaagaaacagcugugaggagaaagcuauaaaaa

SEQ ID NO: 2881 - RNA, 39 nt, Artificial Sequence
  Synthetic Oligonucleotide; CTLA4 exon 3; Set A
uuugcucaaagaaacagcugugaggagaaagcuauaaaa

SEQ ID NO: 2882 - RNA, 20 nt, Artificial Sequence
  Synthetic Oligonucleotide; CTLA4 exon 3; Set C
agaaacagcugugaggagaa

SEQ ID NO: 2883 - RNA, 40 nt, Artificial Sequence
  Synthetic Oligonucleotide; CTLA4 exon 3; Set A
uuuugcucaaagaaacagcugugaggagaaagcuauaaaa

SEQ ID NO: 2884 - RNA, 38 nt, Artificial Sequence
  Synthetic Oligonucleotide; CTLA4 exon 3; Set A
uuugcucaaagaaacagcugugaggagaaagcuauaaa

SEQ ID NO: 2885 - RNA, 18 nt, Artificial Sequence
  Synthetic Oligonucleotide; CTLA4 exon 3; Set C
gaaacagcugugaggaga

SEQ ID NO: 2886 - RNA, 16 nt, Artificial Sequence
  Synthetic Oligonucleotide; CTLA4 exon 3; Set C
aaacagcugugaggag

SEQ ID NO: 2887 - RNA, 39 nt, Artificial Sequence
  Synthetic Oligonucleotide; CTLA4 exon 3; Set A
uuuugcucaaagaaacagcugugaggagaaagcuauaaa

SEQ ID NO: 2888 - RNA, 19 nt, Artificial Sequence
  Synthetic Oligonucleotide; CTLA4 exon 3; Set C
agaaacagcugugaggaga

SEQ ID NO: 2889 - RNA, 17 nt, Artificial Sequence
  Synthetic Oligonucleotide; CTLA4 exon 3; Set C
gaaacagcugugaggag

SEQ ID NO: 2890 - RNA, 15 nt, Artificial Sequence
  Synthetic Oligonucleotide; CTLA4 exon 3; Set C
aaacagcugugagga

SEQ ID NO: 2891 - RNA, 40 nt, Artificial Sequence
  Synthetic Oligonucleotide; CTLA4 exon 3; Set A
auuuugcucaaagaaacagcugugaggagaaagcuauaaa

SEQ ID NO: 2892 - RNA, 20 nt, Artificial Sequence
  Synthetic Oligonucleotide; CTLA4 exon 3; Set C
aagaaacagcugugaggaga

SEQ ID NO: 2893 - RNA, 16 nt, Artificial Sequence
  Synthetic Oligonucleotide; CTLA4 exon 3; Set C
gaaacagcugugagga

SEQ ID NO: 2894 - RNA, 15 nt, Artificial Sequence
  Synthetic Oligonucleotide; CTLA4 exon 3; Set C
gaaacagcugugagg

SEQ ID NO: 2895 - RNA, 20 nt, Artificial Sequence
  Synthetic Oligonucleotide; CTLA4 exon 3; Set C
aaagaaacagcugugaggag

SEQ ID NO: 2896 - RNA, 17 nt, Artificial Sequence
  Synthetic Oligonucleotide; CTLA4 exon 3; Set C
aagaaacagcugugagg

SEQ ID NO: 2897 - RNA, 19 nt, Artificial Sequence
  Synthetic Oligonucleotide; CTLA4 exon 3; Set C
aaagaaacagcugugagga

SEQ ID NO: 2898 - RNA, 16 nt, Artificial Sequence
  Synthetic Oligonucleotide; CTLA4 exon 3; Set C
aagaaacagcugugag

SEQ ID NO: 2899 - RNA, 15 nt, Artificial Sequence
  Synthetic Oligonucleotide; CTLA4 exon 3; Set C
aagaaacagcuguga

SEQ ID NO: 2900 - RNA, 29 nt, Artificial Sequence
  Synthetic Oligonucleotide; CTLA4 exon 3; Set A
uuugcucaaagaaacagcugugaggagaa

SEQ ID NO: 2901 - RNA, 15 nt, Artificial Sequence
  Synthetic Oligonucleotide; CTLA4 exon 3; Set C
aaagaaacagcugug

SEQ ID NO: 2902 - RNA, 30 nt, Artificial Sequence
  Synthetic Oligonucleotide; CTLA4 exon 3; Set A
uuuugcucaaagaaacagcugugaggagaa

SEQ ID NO: 2903 - RNA, 28 nt, Artificial Sequence
  Synthetic Oligonucleotide; CTLA4 exon 3; Set A
uuugcucaaagaaacagcugugaggaga

SEQ ID NO: 2904 - RNA, 31 nt, Artificial Sequence
  Synthetic Oligonucleotide; CTLA4 exon 3; Set A
auuuugcucaaagaaacagcugugaggagaa

SEQ ID NO: 2905 - RNA, 29 nt, Artificial Sequence
  Synthetic Oligonucleotide; CTLA4 exon 3; Set A
uuuugcucaaagaaacagcugugaggaga

SEQ ID NO: 2906 - RNA, 26 nt, Artificial Sequence
  Synthetic Oligonucleotide; CTLA4 exon 3; Set C
uuuugcucaaagaaacagcugugagg

SEQ ID NO: 2907 - RNA, 23 nt, Artificial Sequence
  Synthetic Oligonucleotide; CTLA4 exon 3; Set C
uuugcucaaagaaacagcuguga

SEQ ID NO: 2908 - RNA, 25 nt, Artificial Sequence
  Synthetic Oligonucleotide; CTLA4 exon 3; Set C
uuuugcucaaagaaacagcugugag

SEQ ID NO: 2909 - RNA, 24 nt, Artificial Sequence
  Synthetic Oligonucleotide; CTLA4 exon 3; Set C
uuuugcucaaagaaacagcuguga

SEQ ID NO: 2910 - RNA, 23 nt, Artificial Sequence
  Synthetic Oligonucleotide; CTLA4 exon 3; Set C
uuuugcucaaagaaacagcugug

SEQ ID NO: 2911 - RNA, 35 nt, Artificial Sequence
  Synthetic Oligonucleotide; CTLA4 exon 3; Set C
ucaccauuuugcucaaagaaacagcugugaggaga

SEQ ID NO: 2912 - RNA, 34 nt, Artificial Sequence
  Synthetic Oligonucleotide; CTLA4 exon 3; Set A
ucaccauuuugcucaaagaaacagcugugaggag

SEQ ID NO: 2913 - RNA, 33 nt, Artificial Sequence
  Synthetic Oligonucleotide; CTLA4 exon 3; Set A
ucaccauuuugcucaaagaaacagcugugagga

SEQ ID NO: 2914 - RNA, 32 nt, Artificial Sequence
  Synthetic Oligonucleotide; CTLA4 exon 3; Set A
ucaccauuuugcucaaagaaacagcugugagg

SEQ ID NO: 2915 - RNA, 31 nt, Artificial Sequence
  Synthetic Oligonucleotide; CTLA4 exon 3; Set A
ucaccauuuugcucaaagaaacagcugugag

SEQ ID NO: 2916 - RNA, 30 nt, Artificial Sequence
  Synthetic Oligonucleotide; CTLA4 exon 3; Set A
ucaccauuuugcucaaagaaacagcuguga

SEQ ID NO: 2917 - RNA, 29 nt, Artificial Sequence
  Synthetic Oligonucleotide; CTLA4 exon 3; Set A
ucaccauuuugcucaaagaaacagcugug

SEQ ID NO: 2918 - RNA, 15 nt, Artificial Sequence
  Synthetic Oligonucleotide; CTLA4 exon 3; Set C
uuuugcucaaagaaa

SEQ ID NO: 2919 - RNA, 16 nt, Artificial Sequence
  Synthetic Oligonucleotide; CTLA4 exon 3; Set C
auuuugcucaaagaaa

SEQ ID NO: 2920 - RNA, 21 nt, Artificial Sequence
  Synthetic Oligonucleotide; CTLA4 exon 3; Set C
ucaccauuuugcucaaagaaa

SEQ ID NO: 2921 - RNA, 20 nt, Artificial Sequence
  Synthetic Oligonucleotide; CTLA4 exon 3; Set C
ucaccauuuugcucaaagaa

SEQ ID NO: 2922 - RNA, 17 nt, Artificial Sequence
  Synthetic Oligonucleotide; CTLA4 exon 3; Set C
ucaccauuuugcucaaa

SEQ ID NO: 2923 - RNA, 16 nt, Artificial Sequence
  Synthetic Oligonucleotide; CTLA4 exon 3; Set C
ucaccauuuugcucaa

SEQ ID NO: 2924 - RNA, 33 nt, Artificial Sequence
  Synthetic Oligonucleotide; CTLA4 exon 3; Set C
ucagcaccacacucaccauuuugcucaaagaaa

SEQ ID NO: 2925 - RNA, 34 nt, Artificial Sequence
  Synthetic Oligonucleotide; CTLA4 exon 3; Set C
aucagcaccacacucaccauuuugcucaaagaaa

SEQ ID NO: 2926 - RNA, 35 nt, Artificial Sequence
  Synthetic Oligonucleotide; CTLA4 exon 3; Set C
caucagcaccacacucaccauuuugcucaaagaaa

SEQ ID NO: 2927 - RNA, 33 nt, Artificial Sequence
  Synthetic Oligonucleotide; CTLA4 exon 3; Set C
aucagcaccacacucaccauuuugcucaaagaa

SEQ ID NO: 2928 - RNA, 34 nt, Artificial Sequence
  Synthetic Oligonucleotide; CTLA4 exon 3; Set C
caucagcaccacacucaccauuuugcucaaagaa

SEQ ID NO: 2929 - RNA, 29 nt, Artificial Sequence
  Synthetic Oligonucleotide; CTLA4 exon 3; Set C
ucagcaccacacucaccauuuugcucaaa

SEQ ID NO: 2930 - RNA, 35 nt, Artificial Sequence
  Synthetic Oligonucleotide; CTLA4 exon 3; Set C
ccaucagcaccacacucaccauuuugcucaaagaa

SEQ ID NO: 2931 - RNA, 28 nt, Artificial Sequence
  Synthetic Oligonucleotide; CTLA4 exon 3; Set C
ucagcaccacacucaccauuuugcucaa

SEQ ID NO: 2932 - RNA, 30 nt, Artificial Sequence
  Synthetic Oligonucleotide; CTLA4 exon 3; Set C
aucagcaccacacucaccauuuugcucaaa

SEQ ID NO: 2933 - RNA, 36 nt, Artificial Sequence
  Synthetic Oligonucleotide; CTLA4 exon 3; Set C
accaucagcaccacacucaccauuuugcucaaagaa

SEQ ID NO: 2934 - RNA, 29 nt, Artificial Sequence
  Synthetic Oligonucleotide; CTLA4 exon 3; Set C
aucagcaccacacucaccauuuugcucaa

SEQ ID NO: 2935 - RNA, 31 nt, Artificial Sequence
  Synthetic Oligonucleotide; CTLA4 exon 3; Set C
caucagcaccacacucaccauuuugcucaaa

SEQ ID NO: 2936 - RNA, 32 nt, Artificial Sequence
  Synthetic Oligonucleotide; CTLA4 exon 3; Set C
ccaucagcaccacacucaccauuuugcucaaa

SEQ ID NO: 2937 - RNA, 33 nt, Artificial Sequence
  Synthetic Oligonucleotide; CTLA4 exon 3; Set C
accaucagcaccacacucaccauuuugcucaaa

SEQ ID NO: 2938 - RNA, 17 nt, Artificial Sequence
  Synthetic Oligonucleotide; CTLA4 exon 3; Set C
cagacauggugcaccau

SEQ ID NO: 2939 - RNA, 21 nt, Artificial Sequence
  Synthetic Oligonucleotide; CTLA4 exon 3; Set B
aucagacauggugcaccauca

SEQ ID NO: 2940 - RNA, 16 nt, Artificial Sequence
  Synthetic Oligonucleotide; CTLA4 exon 3; Set C
cagacauggugcacca

SEQ ID NO: 2941 - RNA, 20 nt, Artificial Sequence
  Synthetic Oligonucleotide; CTLA4 exon 3; Set B
aucagacauggugcaccauc

SEQ ID NO: 2942 - RNA, 22 nt, Artificial Sequence
  Synthetic Oligonucleotide; CTLA4 exon 3; Set B
caucagacauggugcaccauca

SEQ ID NO: 2943 - RNA, 15 nt, Artificial Sequence
  Synthetic Oligonucleotide; CTLA4 exon 3; Set C
cagacauggugcacc

SEQ ID NO: 2944 - RNA, 19 nt, Artificial Sequence
  Synthetic Oligonucleotide; CTLA4 exon 3; Set C
aucagacauggugcaccau

SEQ ID NO: 2945 - RNA, 21 nt, Artificial Sequence
  Synthetic Oligonucleotide; CTLA4 exon 3; Set B
caucagacauggugcaccauc

SEQ ID NO: 2946 - RNA, 16 nt, Artificial Sequence
  Synthetic Oligonucleotide; CTLA4 exon 3; Set C
ucagacauggugcacc

SEQ ID NO: 2947 - RNA, 18 nt, Artificial Sequence
  Synthetic Oligonucleotide; CTLA4 exon 3; Set C
aucagacauggugcacca

SEQ ID NO: 2948 - RNA, 33 nt, Artificial Sequence
  Synthetic Oligonucleotide; CTLA4 exon 3; Set C
aaagguauccccaucagacauggugcaccauca

SEQ ID NO: 2949 - RNA, 34 nt, Artificial Sequence
  Synthetic Oligonucleotide; CTLA4 exon 3; Set C
uaaagguauccccaucagacauggugcaccauca

SEQ ID NO: 2950 - RNA, 32 nt, Artificial Sequence
  Synthetic Oligonucleotide; CTLA4 exon 3; Set C
aaagguauccccaucagacauggugcaccauc

SEQ ID NO: 2951 - RNA, 33 nt, Artificial Sequence
  Synthetic Oligonucleotide; CTLA4 exon 3; Set C
uaaagguauccccaucagacauggugcaccauc

SEQ ID NO: 2952 - RNA, 35 nt, Artificial Sequence
  Synthetic Oligonucleotide; CTLA4 exon 3; Set C
cuaaagguauccccaucagacauggugcaccauca

SEQ ID NO: 2953 - RNA, 31 nt, Artificial Sequence
  Synthetic Oligonucleotide; CTLA4 exon 3; Set C
aaagguauccccaucagacauggugcaccau

SEQ ID NO: 2954 - RNA, 32 nt, Artificial Sequence
  Synthetic Oligonucleotide; CTLA4 exon 3; Set C
uaaagguauccccaucagacauggugcaccau

SEQ ID NO: 2955 - RNA, 34 nt, Artificial Sequence
  Synthetic Oligonucleotide; CTLA4 exon 3; Set C
cuaaagguauccccaucagacauggugcaccauc

SEQ ID NO: 2956 - RNA, 30 nt, Artificial Sequence
  Synthetic Oligonucleotide; CTLA4 exon 3; Set C
aaagguauccccaucagacauggugcacca

SEQ ID NO: 2957 - RNA, 31 nt, Artificial Sequence
  Synthetic Oligonucleotide; CTLA4 exon 3; Set C
uaaagguauccccaucagacauggugcacca

SEQ ID NO: 2958 - RNA, 33 nt, Artificial Sequence
  Synthetic Oligonucleotide; CTLA4 exon 3; Set C
cuaaagguauccccaucagacauggugcaccau

SEQ ID NO: 2959 - RNA, 29 nt, Artificial Sequence
  Synthetic Oligonucleotide; CTLA4 exon 3; Set C
aaagguauccccaucagacauggugcacc

SEQ ID NO: 2960 - RNA, 35 nt, Artificial Sequence
  Synthetic Oligonucleotide; CTLA4 exon 3; Set C
acuaaagguauccccaucagacauggugcaccauc

SEQ ID NO: 2961 - RNA, 30 nt, Artificial Sequence
  Synthetic Oligonucleotide; CTLA4 exon 3; Set C
uaaagguauccccaucagacauggugcacc

SEQ ID NO: 2962 - RNA, 32 nt, Artificial Sequence
  Synthetic Oligonucleotide; CTLA4 exon 3; Set C
cuaaagguauccccaucagacauggugcacca

SEQ ID NO: 2963 - RNA, 34 nt, Artificial Sequence
  Synthetic Oligonucleotide; CTLA4 exon 3; Set C
acuaaagguauccccaucagacauggugcaccau

SEQ ID NO: 2964 - RNA, 31 nt, Artificial Sequence
  Synthetic Oligonucleotide; CTLA4 exon 3; Set C
cuaaagguauccccaucagacauggugcacc

SEQ ID NO: 2965 - RNA, 33 nt, Artificial Sequence
  Synthetic Oligonucleotide; CTLA4 exon 3; Set C
acuaaagguauccccaucagacauggugcacca

SEQ ID NO: 2966 - RNA, 32 nt, Artificial Sequence
  Synthetic Oligonucleotide; CTLA4 exon 3; Set C
acuaaagguauccccaucagacauggugcacc

SEQ ID NO: 2967 - RNA, 17 nt, Artificial Sequence
  Synthetic Oligonucleotide; CTLA4 exon 3; Set C
aaagguauccccaucag

SEQ ID NO: 2968 - RNA, 16 nt, Artificial Sequence
  Synthetic Oligonucleotide; CTLA4 exon 3; Set C
aaagguauccccauca

SEQ ID NO: 2969 - RNA, 18 nt, Artificial Sequence
  Synthetic Oligonucleotide; CTLA4 exon 3; Set C
uaaagguauccccaucag

SEQ ID NO: 2970 - RNA, 17 nt, Artificial Sequence
  Synthetic Oligonucleotide; CTLA4 exon 3; Set C
uaaagguauccccauca

SEQ ID NO: 2971 - RNA, 19 nt, Artificial Sequence
  Synthetic Oligonucleotide; CTLA4 exon 3; Set C
cuaaagguauccccaucag

SEQ ID NO: 2972 - RNA, 18 nt, Artificial Sequence
  Synthetic Oligonucleotide; CTLA4 exon 3; Set C
cuaaagguauccccauca

SEQ ID NO: 2973 - RNA, 20 nt, Artificial Sequence
  Synthetic Oligonucleotide; CTLA4 exon 3; Set C
acuaaagguauccccaucag

SEQ ID NO: 2974 - RNA, 19 nt, Artificial Sequence
  Synthetic Oligonucleotide; CTLA4 exon 3; Set C
acuaaagguauccccauca

SEQ ID NO: 2975 - RNA, 15 nt, Artificial Sequence
  Synthetic Oligonucleotide; CTLA4 exon 3; Set C
agacaguuuuaaacu

SEQ ID NO: 2976 - RNA, 18 nt, Artificial Sequence
  Synthetic Oligonucleotide; CTLA4 exon 3; Set C
ccugagacaguuuuaaac

SEQ ID NO: 2977 - RNA, 23 nt, Artificial Sequence
  Synthetic Oligonucleotide; CTLA4 exon 3; Set A
acaaagcagagccucccugagac

SEQ ID NO: 2978 - RNA, 24 nt, Artificial Sequence
  Synthetic Oligonucleotide; CTLA4 exon 3; Set A
aacaaagcagagccucccugagac

SEQ ID NO: 2979 - RNA, 25 nt, Artificial Sequence
  Synthetic Oligonucleotide; CTLA4 exon 3; Set A
aaacaaagcagagccucccugagac

SEQ ID NO: 2980 - RNA, 26 nt, Artificial Sequence
  Synthetic Oligonucleotide; CTLA4 exon 3; Set A
aaaacaaagcagagccucccugagac

SEQ ID NO: 2981 - RNA, 24 nt, Artificial Sequence
  Synthetic Oligonucleotide; CTLA4 exon 3; Set A
aaacaaagcagagccucccugaga

SEQ ID NO: 2982 - RNA, 25 nt, Artificial Sequence
  Synthetic Oligonucleotide; CTLA4 exon 3; Set A
aaaacaaagcagagccucccugaga

SEQ ID NO: 2983 - RNA, 20 nt, Artificial Sequence
  Synthetic Oligonucleotide; CTLA4 exon 3; Set C
aaacaaagcagagccucccu

SEQ ID NO: 2984 - RNA, 21 nt, Artificial Sequence
  Synthetic Oligonucleotide; CTLA4 exon 3; Set C
aaaacaaagcagagccucccu

SEQ ID NO: 2985 - RNA, 40 nt, Artificial Sequence
  Synthetic Oligonucleotide; CTLA4 exon 3; Set C
ggaucugcaacagaaaacaaagcagagccucccugagaca

SEQ ID NO: 2986 - RNA, 20 nt, Artificial Sequence
  Synthetic Oligonucleotide; CTLA4 exon 3; Set C
ggaucugcaacagaaaacaa

SEQ ID NO: 2987 - RNA, 19 nt, Artificial Sequence
  Synthetic Oligonucleotide; CTLA4 exon 3; Set C
ggaucugcaacagaaaaca

SEQ ID NO: 2988 - RNA, 18 nt, Artificial Sequence
  Synthetic Oligonucleotide; CTLA4 exon 3; Set C
ggaucugcaacagaaaac

SEQ ID NO: 2989 - RNA, 17 nt, Artificial Sequence
  Synthetic Oligonucleotide; CTLA4 exon 3; Set C
ggaucugcaacagaaaa

SEQ ID NO: 2990 - RNA, 16 nt, Artificial Sequence
  Synthetic Oligonucleotide; CTLA4 exon 3; Set C
ggaucugcaacagaaa

SEQ ID NO: 2991 - RNA, 15 nt, Artificial Sequence
  Synthetic Oligonucleotide; CTLA4 exon 3; Set C
ggcacgguucuggau

SEQ ID NO: 2992 - RNA, 15 nt, Artificial Sequence
  Synthetic Oligonucleotide; CTLA4 exon 3; Set C
gaaucugggcacggu

SEQ ID NO: 2993 - RNA, 19 nt, Artificial Sequence
  Synthetic Oligonucleotide; CTLA4 exon 3; Set A
gucagaaucugggcacggu

SEQ ID NO: 2994 - RNA, 18 nt, Artificial Sequence
  Synthetic Oligonucleotide; CTLA4 exon 3; Set C
gucagaaucugggcacgg

SEQ ID NO: 2995 - RNA, 31 nt, Artificial Sequence
  Synthetic Oligonucleotide; CTLA4 exon 3; Set C
ggaggaagucagaaucugggcacgguucugg

SEQ ID NO: 2996 - RNA, 26 nt, Artificial Sequence
  Synthetic Oligonucleotide; CTLA4 exon 3; Set A
gaggaagucagaaucugggcacgguu

SEQ ID NO: 2997 - RNA, 27 nt, Artificial Sequence
  Synthetic Oligonucleotide; CTLA4 exon 3; Set C
ggaggaagucagaaucugggcacgguu

SEQ ID NO: 2998 - RNA, 28 nt, Artificial Sequence
  Synthetic Oligonucleotide; CTLA4 exon 3; Set C
cuaacugcugcaaggauccagaggagga

SEQ ID NO: 2999 - RNA, 27 nt, Artificial Sequence
  Synthetic Oligonucleotide; CTLA4 exon 3; Set A
cuaacugcugcaaggauccagaggagg

SEQ ID NO: 3000 - RNA, 29 nt, Artificial Sequence
  Synthetic Oligonucleotide; CTLA4 exon 3; Set C
acuaacugcugcaaggauccagaggagga

SEQ ID NO: 3001 - RNA, 26 nt, Artificial Sequence
  Synthetic Oligonucleotide; CTLA4 exon 3; Set A
cuaacugcugcaaggauccagaggag

SEQ ID NO: 3002 - RNA, 28 nt, Artificial Sequence
  Synthetic Oligonucleotide; CTLA4 exon 3; Set C
acuaacugcugcaaggauccagaggagg

SEQ ID NO: 3003 - RNA, 30 nt, Artificial Sequence
  Synthetic Oligonucleotide; CTLA4 exon 3; Set C
aacuaacugcugcaaggauccagaggagga

SEQ ID NO: 3004 - RNA, 32 nt, Artificial Sequence
  Synthetic Oligonucleotide; CTLA4 exon 3; Set C
gaacuaacugcugcaaggauccagaggaggaa

SEQ ID NO: 3005 - RNA, 25 nt, Artificial Sequence
  Synthetic Oligonucleotide; CTLA4 exon 3; Set A
cuaacugcugcaaggauccagagga

SEQ ID NO: 3006 - RNA, 27 nt, Artificial Sequence
  Synthetic Oligonucleotide; CTLA4 exon 3; Set A
acuaacugcugcaaggauccagaggag

SEQ ID NO: 3007 - RNA, 29 nt, Artificial Sequence
  Synthetic Oligonucleotide; CTLA4 exon 3; Set A
aacuaacugcugcaaggauccagaggagg

SEQ ID NO: 3008 - RNA, 31 nt, Artificial Sequence
  Synthetic Oligonucleotide; CTLA4 exon 3; Set C
gaacuaacugcugcaaggauccagaggagga

SEQ ID NO: 3009 - RNA, 26 nt, Artificial Sequence
  Synthetic Oligonucleotide; CTLA4 exon 3; Set A
acuaacugcugcaaggauccagagga

SEQ ID NO: 3010 - RNA, 28 nt, Artificial Sequence
  Synthetic Oligonucleotide; CTLA4 exon 3; Set A
aacuaacugcugcaaggauccagaggag

SEQ ID NO: 3011 - RNA, 30 nt, Artificial Sequence
  Synthetic Oligonucleotide; CTLA4 exon 3; Set C
gaacuaacugcugcaaggauccagaggagg

SEQ ID NO: 3012 - RNA, 27 nt, Artificial Sequence
  Synthetic Oligonucleotide; CTLA4 exon 3; Set A
aacuaacugcugcaaggauccagagga

SEQ ID NO: 3013 - RNA, 29 nt, Artificial Sequence
  Synthetic Oligonucleotide; CTLA4 exon 3; Set A
gaacuaacugcugcaaggauccagaggag

SEQ ID NO: 3014 - RNA, 28 nt, Artificial Sequence
  Synthetic Oligonucleotide; CTLA4 exon 3; Set A
gaacuaacugcugcaaggauccagagga

SEQ ID NO: 3015 - RNA, 40 nt, Artificial Sequence
  Synthetic Oligonucleotide; CTLA4 exon 3; Set C
aaacaaccccgaacuaacugcugcaaggauccagaggagg

SEQ ID NO: 3016 - RNA, 39 nt, Artificial Sequence
  Synthetic Oligonucleotide; CTLA4 exon 3; Set C
aaacaaccccgaacuaacugcugcaaggauccagaggag

SEQ ID NO: 3017 - RNA, 15 nt, Artificial Sequence
  Synthetic Oligonucleotide; CTLA4 exon 3; Set C
acaaccccgaacuaa

SEQ ID NO: 3018 - RNA, 15 nt, Artificial Sequence
  Synthetic Oligonucleotide; CTLA4 exon 3; Set C
aacaaccccgaacua

SEQ ID NO: 3019 - RNA, 16 nt, Artificial Sequence
  Synthetic Oligonucleotide; CTLA4 exon 3; Set C
aaacaaccccgaacua

SEQ ID NO: 3020 - RNA, 15 nt, Artificial Sequence
  Synthetic Oligonucleotide; CTLA4 exon 3; Set C
aaacaaccccgaacu

SEQ ID NO: 3021 - RNA, 23 nt, Artificial Sequence
  Synthetic Oligonucleotide; CTLA4 exon 3; Set C
uauaaaaaaacaaccccgaacua

SEQ ID NO: 3022 - RNA, 15 nt, Artificial Sequence
  Synthetic Oligonucleotide; CTLA4 exon 3; Set C
aaaaaacaaccccga

SEQ ID NO: 3023 - RNA, 22 nt, Artificial Sequence
  Synthetic Oligonucleotide; CTLA4 exon 3; Set C
uauaaaaaaacaaccccgaacu

SEQ ID NO: 3024 - RNA, 16 nt, Artificial Sequence
  Synthetic Oligonucleotide; CTLA4 exon 3; Set C
aaaaaaacaaccccga

SEQ ID NO: 3025 - RNA, 19 nt, Artificial Sequence
  Synthetic Oligonucleotide; CTLA4 exon 3; Set C
auaaaaaaacaaccccgaa

SEQ ID NO: 3026 - RNA, 15 nt, Artificial Sequence
  Synthetic Oligonucleotide; CTLA4 exon 3; Set C
aaaaaaacaaccccg

SEQ ID NO: 3027 - RNA, 29 nt, Artificial Sequence
  Synthetic Oligonucleotide; CTLA4 exon 3; Set C
aaagcuauaaaaaaacaaccccgaacuaa

SEQ ID NO: 3028 - RNA, 25 nt, Artificial Sequence
  Synthetic Oligonucleotide; CTLA4 exon 3; Set C
gaaagcuauaaaaaaacaaccccga

SEQ ID NO: 3029 - RNA, 24 nt, Artificial Sequence
  Synthetic Oligonucleotide; CTLA4 exon 3; Set C
gaaagcuauaaaaaaacaaccccg

SEQ ID NO: 3030 - RNA, 26 nt, Artificial Sequence
  Synthetic Oligonucleotide; CTLA4 exon 3; Set C
agaaagcuauaaaaaaacaaccccga

SEQ ID NO: 3031 - RNA, 25 nt, Artificial Sequence
  Synthetic Oligonucleotide; CTLA4 exon 3; Set C
agaaagcuauaaaaaaacaaccccg

SEQ ID NO: 3032 - RNA, 38 nt, Artificial Sequence
  Synthetic Oligonucleotide; CTLA4 exon 3; Set A
ugugaggagaaagcuauaaaaaaacaaccccgaacuaa

SEQ ID NO: 3033 - RNA, 29 nt, Artificial Sequence
  Synthetic Oligonucleotide; CTLA4 exon 3; Set C
aggagaaagcuauaaaaaaacaaccccga

SEQ ID NO: 3034 - RNA, 30 nt, Artificial Sequence
  Synthetic Oligonucleotide; CTLA4 exon 3; Set C
gaggagaaagcuauaaaaaaacaaccccga

SEQ ID NO: 3035 - RNA, 28 nt, Artificial Sequence
  Synthetic Oligonucleotide; CTLA4 exon 3; Set C
aggagaaagcuauaaaaaaacaaccccg

SEQ ID NO: 3036 - RNA, 31 nt, Artificial Sequence
  Synthetic Oligonucleotide; CTLA4 exon 3; Set C
ugaggagaaagcuauaaaaaaacaaccccga

SEQ ID NO: 3037 - RNA, 29 nt, Artificial Sequence
  Synthetic Oligonucleotide; CTLA4 exon 3; Set C
gaggagaaagcuauaaaaaaacaaccccg

SEQ ID NO: 3038 - RNA, 19 nt, Artificial Sequence
  Synthetic Oligonucleotide; CTLA4 exon 3; Set C
gaaagcuauaaaaaaacaa

SEQ ID NO: 3039 - RNA, 30 nt, Artificial Sequence
  Synthetic Oligonucleotide; CTLA4 exon 3; Set C
ugaggagaaagcuauaaaaaaacaaccccg

SEQ ID NO: 3040 - RNA, 32 nt, Artificial Sequence
  Synthetic Oligonucleotide; CTLA4 exon 3; Set A
gugaggagaaagcuauaaaaaaacaaccccga

SEQ ID NO: 3041 - RNA, 18 nt, Artificial Sequence
  Synthetic Oligonucleotide; CTLA4 exon 3; Set C
gaaagcuauaaaaaaaca

SEQ ID NO: 3042 - RNA, 20 nt, Artificial Sequence
  Synthetic Oligonucleotide; CTLA4 exon 3; Set C
agaaagcuauaaaaaaacaa

SEQ ID NO: 3043 - RNA, 31 nt, Artificial Sequence
  Synthetic Oligonucleotide; CTLA4 exon 3; Set C
gugaggagaaagcuauaaaaaaacaaccccg

SEQ ID NO: 3044 - RNA, 19 nt, Artificial Sequence
  Synthetic Oligonucleotide; CTLA4 exon 3; Set C
agaaagcuauaaaaaaaca

SEQ ID NO: 3045 - RNA, 18 nt, Artificial Sequence
  Synthetic Oligonucleotide; CTLA4 exon 3; Set C
agaaagcuauaaaaaaac

SEQ ID NO: 3046 - RNA, 17 nt, Artificial Sequence
  Synthetic Oligonucleotide; CTLA4 exon 3; Set C
agaaagcuauaaaaaaa

SEQ ID NO: 3047 - RNA, 19 nt, Artificial Sequence
  Synthetic Oligonucleotide; CTLA4 exon 3; Set C
gagaaagcuauaaaaaaac

SEQ ID NO: 3048 - RNA, 23 nt, Artificial Sequence
  Synthetic Oligonucleotide; CTLA4 exon 3; Set C
aggagaaagcuauaaaaaaacaa

SEQ ID NO: 3049 - RNA, 18 nt, Artificial Sequence
  Synthetic Oligonucleotide; CTLA4 exon 3; Set C
gagaaagcuauaaaaaaa

SEQ ID NO: 3050 - RNA, 20 nt, Artificial Sequence
  Synthetic Oligonucleotide; CTLA4 exon 3; Set C
ggagaaagcuauaaaaaaac

SEQ ID NO: 3051 - RNA, 22 nt, Artificial Sequence
  Synthetic Oligonucleotide; CTLA4 exon 3; Set C
aggagaaagcuauaaaaaaaca

SEQ ID NO: 3052 - RNA, 24 nt, Artificial Sequence
  Synthetic Oligonucleotide; CTLA4 exon 3; Set C
gaggagaaagcuauaaaaaaacaa

SEQ ID NO: 3053 - RNA, 19 nt, Artificial Sequence
  Synthetic Oligonucleotide; CTLA4 exon 3; Set C
ggagaaagcuauaaaaaaa

SEQ ID NO: 3054 - RNA, 21 nt, Artificial Sequence
  Synthetic Oligonucleotide; CTLA4 exon 3; Set C
aggagaaagcuauaaaaaaac

SEQ ID NO: 3055 - RNA, 23 nt, Artificial Sequence
  Synthetic Oligonucleotide; CTLA4 exon 3; Set C
gaggagaaagcuauaaaaaaaca

SEQ ID NO: 3056 - RNA, 25 nt, Artificial Sequence
  Synthetic Oligonucleotide; CTLA4 exon 3; Set C
ugaggagaaagcuauaaaaaaacaa

SEQ ID NO: 3057 - RNA, 22 nt, Artificial Sequence
  Synthetic Oligonucleotide; CTLA4 exon 3; Set C
gaggagaaagcuauaaaaaaac

SEQ ID NO: 3058 - RNA, 24 nt, Artificial Sequence
  Synthetic Oligonucleotide; CTLA4 exon 3; Set C
ugaggagaaagcuauaaaaaaaca

SEQ ID NO: 3059 - RNA, 26 nt, Artificial Sequence
  Synthetic Oligonucleotide; CTLA4 exon 3; Set C
gugaggagaaagcuauaaaaaaacaa

SEQ ID NO: 3060 - RNA, 23 nt, Artificial Sequence
  Synthetic Oligonucleotide; CTLA4 exon 3; Set C
ugaggagaaagcuauaaaaaaac

SEQ ID NO: 3061 - RNA, 25 nt, Artificial Sequence
  Synthetic Oligonucleotide; CTLA4 exon 3; Set C
gugaggagaaagcuauaaaaaaaca

SEQ ID NO: 3062 - RNA, 40 nt, Artificial Sequence
  Synthetic Oligonucleotide; CTLA4 exon 3; Set A
aaacagcugugaggagaaagcuauaaaaaaacaaccccga

SEQ ID NO: 3063 - RNA, 24 nt, Artificial Sequence
  Synthetic Oligonucleotide; CTLA4 exon 3; Set C
gugaggagaaagcuauaaaaaaac

SEQ ID NO: 3064 - RNA, 39 nt, Artificial Sequence
  Synthetic Oligonucleotide; CTLA4 exon 3; Set A
aaacagcugugaggagaaagcuauaaaaaaacaaccccg

SEQ ID NO: 3065 - RNA, 21 nt, Artificial Sequence
  Synthetic Oligonucleotide; CTLA4 exon 3; Set C
ugugaggagaaagcuauaaaa

SEQ ID NO: 3066 - RNA, 20 nt, Artificial Sequence
  Synthetic Oligonucleotide; CTLA4 exon 3; Set C
ugugaggagaaagcuauaaa

SEQ ID NO: 3067 - RNA, 34 nt, Artificial Sequence
  Synthetic Oligonucleotide; CTLA4 exon 3; Set C
aaacagcugugaggagaaagcuauaaaaaaacaa

SEQ ID NO: 3068 - RNA, 33 nt, Artificial Sequence
  Synthetic Oligonucleotide; CTLA4 exon 3; Set C
aaacagcugugaggagaaagcuauaaaaaaaca

SEQ ID NO: 3069 - RNA, 15 nt, Artificial Sequence
  Synthetic Oligonucleotide; CTLA4 exon 3; Set C
ugaggagaaagcuau

SEQ ID NO: 3070 - RNA, 32 nt, Artificial Sequence
  Synthetic Oligonucleotide; CTLA4 exon 3; Set C
aaacagcugugaggagaaagcuauaaaaaaac

SEQ ID NO: 3071 - RNA, 16 nt, Artificial Sequence
  Synthetic Oligonucleotide; CTLA4 exon 3; Set C
gugaggagaaagcuau

SEQ ID NO: 3072 - RNA, 32 nt, Artificial Sequence
  Synthetic Oligonucleotide; CTLA4 exon 3; Set C
gaaacagcugugaggagaaagcuauaaaaaaa

SEQ ID NO: 3073 - RNA, 38 nt, Artificial Sequence
  Synthetic Oligonucleotide; CTLA4 exon 3; Set C
aaagaaacagcugugaggagaaagcuauaaaaaaacaa

SEQ ID NO: 3074 - RNA, 40 nt, Artificial Sequence
  Synthetic Oligonucleotide; CTLA4 exon 3; Set A
caaagaaacagcugugaggagaaagcuauaaaaaaacaac

SEQ ID NO: 3075 - RNA, 37 nt, Artificial Sequence
  Synthetic Oligonucleotide; CTLA4 exon 3; Set C
aaagaaacagcugugaggagaaagcuauaaaaaaaca

SEQ ID NO: 3076 - RNA, 39 nt, Artificial Sequence
  Synthetic Oligonucleotide; CTLA4 exon 3; Set C
caaagaaacagcugugaggagaaagcuauaaaaaaacaa

SEQ ID NO: 3077 - RNA, 34 nt, Artificial Sequence
  Synthetic Oligonucleotide; CTLA4 exon 3; Set C
aagaaacagcugugaggagaaagcuauaaaaaaa

SEQ ID NO: 3078 - RNA, 36 nt, Artificial Sequence
  Synthetic Oligonucleotide; CTLA4 exon 3; Set C
aaagaaacagcugugaggagaaagcuauaaaaaaac

SEQ ID NO: 3079 - RNA, 35 nt, Artificial Sequence
  Synthetic Oligonucleotide; CTLA4 exon 3; Set C
aaagaaacagcugugaggagaaagcuauaaaaaaa

SEQ ID NO: 3080 - RNA, 27 nt, Artificial Sequence
  Synthetic Oligonucleotide; CTLA4 exon 3; Set C
gaaacagcugugaggagaaagcuauaa

SEQ ID NO: 3081 - RNA, 28 nt, Artificial Sequence
  Synthetic Oligonucleotide; CTLA4 exon 3; Set C
agaaacagcugugaggagaaagcuauaa

SEQ ID NO: 3082 - RNA, 26 nt, Artificial Sequence
  Synthetic Oligonucleotide; CTLA4 exon 3; Set A
gaaacagcugugaggagaaagcuaua

SEQ ID NO: 3083 - RNA, 24 nt, Artificial Sequence
  Synthetic Oligonucleotide; CTLA4 exon 3; Set C
aaacagcugugaggagaaagcuau

SEQ ID NO: 3084 - RNA, 29 nt, Artificial Sequence
  Synthetic Oligonucleotide; CTLA4 exon 3; Set C
aagaaacagcugugaggagaaagcuauaa

SEQ ID NO: 3085 - RNA, 27 nt, Artificial Sequence
  Synthetic Oligonucleotide; CTLA4 exon 3; Set A
agaaacagcugugaggagaaagcuaua

SEQ ID NO: 3086 - RNA, 28 nt, Artificial Sequence
  Synthetic Oligonucleotide; CTLA4 exon 3; Set C
aagaaacagcugugaggagaaagcuaua

SEQ ID NO: 3087 - RNA, 29 nt, Artificial Sequence
  Synthetic Oligonucleotide; CTLA4 exon 3; Set A
caaagaaacagcugugaggagaaagcuau

SEQ ID NO: 3088 - RNA, 19 nt, Artificial Sequence
  Synthetic Oligonucleotide; CTLA4 exon 3; Set C
aaacagcugugaggagaaa

SEQ ID NO: 3089 - RNA, 37 nt, Artificial Sequence
  Synthetic Oligonucleotide; CTLA4 exon 3; Set A
uuugcucaaagaaacagcugugaggagaaagcuauaa

SEQ ID NO: 3090 - RNA, 23 nt, Artificial Sequence
  Synthetic Oligonucleotide; CTLA4 exon 3; Set C
aaagaaacagcugugaggagaaa

SEQ ID NO: 3091 - RNA, 18 nt, Artificial Sequence
  Synthetic Oligonucleotide; CTLA4 exon 3; Set C
agaaacagcugugaggag

SEQ ID NO: 3092 - RNA, 38 nt, Artificial Sequence
  Synthetic Oligonucleotide; CTLA4 exon 3; Set A
uuuugcucaaagaaacagcugugaggagaaagcuauaa

SEQ ID NO: 3093 - RNA, 36 nt, Artificial Sequence
  Synthetic Oligonucleotide; CTLA4 exon 3; Set A
uuugcucaaagaaacagcugugaggagaaagcuaua

SEQ ID NO: 3094 - RNA, 24 nt, Artificial Sequence
  Synthetic Oligonucleotide; CTLA4 exon 3; Set C
caaagaaacagcugugaggagaaa

SEQ ID NO: 3095 - RNA, 19 nt, Artificial Sequence
  Synthetic Oligonucleotide; CTLA4 exon 3; Set C
aagaaacagcugugaggag

SEQ ID NO: 3096 - RNA, 17 nt, Artificial Sequence
  Synthetic Oligonucleotide; CTLA4 exon 3; Set C
agaaacagcugugagga

SEQ ID NO: 3097 - RNA, 39 nt, Artificial Sequence
  Synthetic Oligonucleotide; CTLA4 exon 3; Set A
auuuugcucaaagaaacagcugugaggagaaagcuauaa

SEQ ID NO: 3098 - RNA, 37 nt, Artificial Sequence
  Synthetic Oligonucleotide; CTLA4 exon 3; Set A
uuuugcucaaagaaacagcugugaggagaaagcuaua

SEQ ID NO: 3099 - RNA, 16 nt, Artificial Sequence
  Synthetic Oligonucleotide; CTLA4 exon 3; Set C
agaaacagcugugagg

SEQ ID NO: 3100 - RNA, 18 nt, Artificial Sequence
  Synthetic Oligonucleotide; CTLA4 exon 3; Set C
aagaaacagcugugagga

SEQ ID NO: 3101 - RNA, 15 nt, Artificial Sequence
  Synthetic Oligonucleotide; CTLA4 exon 3; Set C
agaaacagcugugag

SEQ ID NO: 3102 - RNA, 27 nt, Artificial Sequence
  Synthetic Oligonucleotide; CTLA4 exon 3; Set A
uuugcucaaagaaacagcugugaggag

SEQ ID NO: 3103 - RNA, 15 nt, Artificial Sequence
  Synthetic Oligonucleotide; CTLA4 exon 3; Set C
caaagaaacagcugu

SEQ ID NO: 3104 - RNA, 30 nt, Artificial Sequence
  Synthetic Oligonucleotide; CTLA4 exon 3; Set A
auuuugcucaaagaaacagcugugaggaga

SEQ ID NO: 3105 - RNA, 28 nt, Artificial Sequence
  Synthetic Oligonucleotide; CTLA4 exon 3; Set A
uuuugcucaaagaaacagcugugaggag

SEQ ID NO: 3106 - RNA, 26 nt, Artificial Sequence
  Synthetic Oligonucleotide; CTLA4 exon 3; Set A
uuugcucaaagaaacagcugugagga

SEQ ID NO: 3107 - RNA, 25 nt, Artificial Sequence
  Synthetic Oligonucleotide; CTLA4 exon 3; Set C
uuugcucaaagaaacagcugugagg

SEQ ID NO: 3108 - RNA, 29 nt, Artificial Sequence
  Synthetic Oligonucleotide; CTLA4 exon 3; Set A
auuuugcucaaagaaacagcugugaggag

SEQ ID NO: 3109 - RNA, 27 nt, Artificial Sequence
  Synthetic Oligonucleotide; CTLA4 exon 3; Set A
uuuugcucaaagaaacagcugugagga

SEQ ID NO: 3110 - RNA, 24 nt, Artificial Sequence
  Synthetic Oligonucleotide; CTLA4 exon 3; Set C
uuugcucaaagaaacagcugugag

SEQ ID NO: 3111 - RNA, 28 nt, Artificial Sequence
  Synthetic Oligonucleotide; CTLA4 exon 3; Set A
auuuugcucaaagaaacagcugugagga

SEQ ID NO: 3112 - RNA, 27 nt, Artificial Sequence
  Synthetic Oligonucleotide; CTLA4 exon 3; Set C
auuuugcucaaagaaacagcugugagg

SEQ ID NO: 3113 - RNA, 22 nt, Artificial Sequence
  Synthetic Oligonucleotide; CTLA4 exon 3; Set C
uuugcucaaagaaacagcugug

SEQ ID NO: 3114 - RNA, 26 nt, Artificial Sequence
  Synthetic Oligonucleotide; CTLA4 exon 3; Set C
auuuugcucaaagaaacagcugugag

SEQ ID NO: 3115 - RNA, 25 nt, Artificial Sequence
  Synthetic Oligonucleotide; CTLA4 exon 3; Set C
auuuugcucaaagaaacagcuguga

SEQ ID NO: 3116 - RNA, 24 nt, Artificial Sequence
  Synthetic Oligonucleotide; CTLA4 exon 3; Set C
auuuugcucaaagaaacagcugug

SEQ ID NO: 3117 - RNA, 15 nt, Artificial Sequence
  Synthetic Oligonucleotide; CTLA4 exon 3; Set C
auuuugcucaaagaa

SEQ ID NO: 3118 - RNA, 19 nt, Artificial Sequence
  Synthetic Oligonucleotide; CTLA4 exon 3; Set C
ucaccauuuugcucaaaga

SEQ ID NO: 3119 - RNA, 18 nt, Artificial Sequence
  Synthetic Oligonucleotide; CTLA4 exon 3; Set C
ucaccauuuugcucaaag

SEQ ID NO: 3120 - RNA, 32 nt, Artificial Sequence
  Synthetic Oligonucleotide; CTLA4 exon 3; Set C
ucagcaccacacucaccauuuugcucaaagaa

SEQ ID NO: 3121 - RNA, 31 nt, Artificial Sequence
  Synthetic Oligonucleotide; CTLA4 exon 3; Set C
ucagcaccacacucaccauuuugcucaaaga

SEQ ID NO: 3122 - RNA, 30 nt, Artificial Sequence
  Synthetic Oligonucleotide; CTLA4 exon 3; Set C
ucagcaccacacucaccauuuugcucaaag

SEQ ID NO: 3123 - RNA, 32 nt, Artificial Sequence
  Synthetic Oligonucleotide; CTLA4 exon 3; Set C
aucagcaccacacucaccauuuugcucaaaga

SEQ ID NO: 3124 - RNA, 31 nt, Artificial Sequence
  Synthetic Oligonucleotide; CTLA4 exon 3; Set C
aucagcaccacacucaccauuuugcucaaag

SEQ ID NO: 3125 - RNA, 33 nt, Artificial Sequence
  Synthetic Oligonucleotide; CTLA4 exon 3; Set C
caucagcaccacacucaccauuuugcucaaaga

SEQ ID NO: 3126 - RNA, 32 nt, Artificial Sequence
  Synthetic Oligonucleotide; CTLA4 exon 3; Set C
caucagcaccacacucaccauuuugcucaaag

SEQ ID NO: 3127 - RNA, 34 nt, Artificial Sequence
  Synthetic Oligonucleotide; CTLA4 exon 3; Set C
ccaucagcaccacacucaccauuuugcucaaaga

SEQ ID NO: 3128 - RNA, 33 nt, Artificial Sequence
  Synthetic Oligonucleotide; CTLA4 exon 3; Set C
ccaucagcaccacacucaccauuuugcucaaag

SEQ ID NO: 3129 - RNA, 35 nt, Artificial Sequence
  Synthetic Oligonucleotide; CTLA4 exon 3; Set C
accaucagcaccacacucaccauuuugcucaaaga

SEQ ID NO: 3130 - RNA, 34 nt, Artificial Sequence
  Synthetic Oligonucleotide; CTLA4 exon 3; Set C
accaucagcaccacacucaccauuuugcucaaag

SEQ ID NO: 3131 - RNA, 22 nt, Artificial Sequence
  Synthetic Oligonucleotide; CTLA4 exon 3; Set B
ucagcaccacacucaccauuuu

SEQ ID NO: 3132 - RNA, 21 nt, Artificial Sequence
  Synthetic Oligonucleotide; CTLA4 exon 3; Set B
ucagcaccacacucaccauuu

SEQ ID NO: 3133 - RNA, 23 nt, Artificial Sequence
  Synthetic Oligonucleotide; CTLA4 exon 3; Set B
aucagcaccacacucaccauuuu

SEQ ID NO: 3134 - RNA, 22 nt, Artificial Sequence
  Synthetic Oligonucleotide; CTLA4 exon 3; Set B
aucagcaccacacucaccauuu

SEQ ID NO: 3135 - RNA, 24 nt, Artificial Sequence
  Synthetic Oligonucleotide; CTLA4 exon 3; Set B
caucagcaccacacucaccauuuu

SEQ ID NO: 3136 - RNA, 23 nt, Artificial Sequence
  Synthetic Oligonucleotide; CTLA4 exon 3; Set B
caucagcaccacacucaccauuu

SEQ ID NO: 3137 - RNA, 25 nt, Artificial Sequence
  Synthetic Oligonucleotide; CTLA4 exon 3; Set C
ccaucagcaccacacucaccauuuu

SEQ ID NO: 3138 - RNA, 24 nt, Artificial Sequence
  Synthetic Oligonucleotide; CTLA4 exon 3; Set C
ccaucagcaccacacucaccauuu

SEQ ID NO: 3139 - RNA, 26 nt, Artificial Sequence
  Synthetic Oligonucleotide; CTLA4 exon 3; Set C
accaucagcaccacacucaccauuuu

SEQ ID NO: 3140 - RNA, 25 nt, Artificial Sequence
  Synthetic Oligonucleotide; CTLA4 exon 3; Set C
accaucagcaccacacucaccauuu

SEQ ID NO: 3141 - RNA, 23 nt, Artificial Sequence
  Synthetic Oligonucleotide; CTLA4 exon 3; Set C
ccaucagcaccacacucaccauu

SEQ ID NO: 3142 - RNA, 24 nt, Artificial Sequence
  Synthetic Oligonucleotide; CTLA4 exon 3; Set C
accaucagcaccacacucaccauu

SEQ ID NO: 3143 - RNA, 15 nt, Artificial Sequence
  Synthetic Oligonucleotide; CTLA4 exon 3; Set C
ucagcaccacacuca

SEQ ID NO: 3144 - RNA, 16 nt, Artificial Sequence
  Synthetic Oligonucleotide; CTLA4 exon 3; Set C
aucagcaccacacuca

SEQ ID NO: 3145 - RNA, 17 nt, Artificial Sequence
  Synthetic Oligonucleotide; CTLA4 exon 3; Set C
caucagcaccacacuca

SEQ ID NO: 3146 - RNA, 18 nt, Artificial Sequence
  Synthetic Oligonucleotide; CTLA4 exon 3; Set B
ccaucagcaccacacuca

SEQ ID NO: 3147 - RNA, 19 nt, Artificial Sequence
  Synthetic Oligonucleotide; CTLA4 exon 3; Set B
accaucagcaccacacuca

SEQ ID NO: 3148 - RNA, 38 nt, Artificial Sequence
  Synthetic Oligonucleotide; CTLA4 exon 3; Set C
cagacauggugcaccaucagcaccacacucaccauuuu

SEQ ID NO: 3149 - RNA, 37 nt, Artificial Sequence
  Synthetic Oligonucleotide; CTLA4 exon 3; Set C
cagacauggugcaccaucagcaccacacucaccauuu

SEQ ID NO: 3150 - RNA, 39 nt, Artificial Sequence
  Synthetic Oligonucleotide; CTLA4 exon 3; Set C
ucagacauggugcaccaucagcaccacacucaccauuuu

SEQ ID NO: 3151 - RNA, 38 nt, Artificial Sequence
  Synthetic Oligonucleotide; CTLA4 exon 3; Set C
ucagacauggugcaccaucagcaccacacucaccauuu

SEQ ID NO: 3152 - RNA, 31 nt, Artificial Sequence
  Synthetic Oligonucleotide; CTLA4 exon 3; Set C
cagacauggugcaccaucagcaccacacuca

SEQ ID NO: 3153 - RNA, 32 nt, Artificial Sequence
  Synthetic Oligonucleotide; CTLA4 exon 3; Set C
ucagacauggugcaccaucagcaccacacuca

SEQ ID NO: 3154 - RNA, 17 nt, Artificial Sequence
  Synthetic Oligonucleotide; CTLA4 exon 3; Set C
gacauggugcaccauca

SEQ ID NO: 3155 - RNA, 18 nt, Artificial Sequence
  Synthetic Oligonucleotide; CTLA4 exon 3; Set C
agacauggugcaccauca

SEQ ID NO: 3156 - RNA, 17 nt, Artificial Sequence
  Synthetic Oligonucleotide; CTLA4 exon 3; Set C
agacauggugcaccauc

SEQ ID NO: 3157 - RNA, 23 nt, Artificial Sequence
  Synthetic Oligonucleotide; CTLA4 exon 3; Set B
ccaucagacauggugcaccauca

SEQ ID NO: 3158 - RNA, 20 nt, Artificial Sequence
  Synthetic Oligonucleotide; CTLA4 exon 3; Set B
caucagacauggugcaccau

SEQ ID NO: 3159 - RNA, 22 nt, Artificial Sequence
  Synthetic Oligonucleotide; CTLA4 exon 3; Set B
ccaucagacauggugcaccauc

SEQ ID NO: 3160 - RNA, 24 nt, Artificial Sequence
  Synthetic Oligonucleotide; CTLA4 exon 3; Set C
cccaucagacauggugcaccauca

SEQ ID NO: 3161 - RNA, 17 nt, Artificial Sequence
  Synthetic Oligonucleotide; CTLA4 exon 3; Set C
aucagacauggugcacc

SEQ ID NO: 3162 - RNA, 19 nt, Artificial Sequence
  Synthetic Oligonucleotide; CTLA4 exon 3; Set B
caucagacauggugcacca

SEQ ID NO: 3163 - RNA, 21 nt, Artificial Sequence
  Synthetic Oligonucleotide; CTLA4 exon 3; Set B
ccaucagacauggugcaccau

SEQ ID NO: 3164 - RNA, 23 nt, Artificial Sequence
  Synthetic Oligonucleotide; CTLA4 exon 3; Set C
cccaucagacauggugcaccauc

SEQ ID NO: 3165 - RNA, 18 nt, Artificial Sequence
  Synthetic Oligonucleotide; CTLA4 exon 3; Set C
caucagacauggugcacc

SEQ ID NO: 3166 - RNA, 20 nt, Artificial Sequence
  Synthetic Oligonucleotide; CTLA4 exon 3; Set B
ccaucagacauggugcacca

SEQ ID NO: 3167 - RNA, 22 nt, Artificial Sequence
  Synthetic Oligonucleotide; CTLA4 exon 3; Set B
cccaucagacauggugcaccau

SEQ ID NO: 3168 - RNA, 19 nt, Artificial Sequence
  Synthetic Oligonucleotide; CTLA4 exon 3; Set B
ccaucagacauggugcacc

SEQ ID NO: 3169 - RNA, 21 nt, Artificial Sequence
  Synthetic Oligonucleotide; CTLA4 exon 3; Set B
cccaucagacauggugcacca

SEQ ID NO: 3170 - RNA, 20 nt, Artificial Sequence
  Synthetic Oligonucleotide; CTLA4 exon 3; Set B
cccaucagacauggugcacc

SEQ ID NO: 3171 - RNA, 22 nt, Artificial Sequence
  Synthetic Oligonucleotide; CTLA4 exon 3; Set C
cuaaagguauccccaucagaca

SEQ ID NO: 3172 - RNA, 21 nt, Artificial Sequence
  Synthetic Oligonucleotide; CTLA4 exon 3; Set C
cuaaagguauccccaucagac

SEQ ID NO: 3173 - RNA, 23 nt, Artificial Sequence
  Synthetic Oligonucleotide; CTLA4 exon 3; Set B
acuaaagguauccccaucagaca

SEQ ID NO: 3174 - RNA, 22 nt, Artificial Sequence
  Synthetic Oligonucleotide; CTLA4 exon 3; Set C
acuaaagguauccccaucagac

SEQ ID NO: 3175 - RNA, 16 nt, Artificial Sequence
  Synthetic Oligonucleotide; CTLA4 exon 3; Set C
uaaagguauccccauc

SEQ ID NO: 3176 - RNA, 17 nt, Artificial Sequence
  Synthetic Oligonucleotide; CTLA4 exon 3; Set C
cuaaagguauccccauc

SEQ ID NO: 3177 - RNA, 18 nt, Artificial Sequence
  Synthetic Oligonucleotide; CTLA4 exon 3; Set C
acuaaagguauccccauc

SEQ ID NO: 3178 - RNA, 17 nt, Artificial Sequence
  Synthetic Oligonucleotide; CTLA4 exon 3; Set C
acuaaagguauccccau

SEQ ID NO: 3179 - RNA, 17 nt, Artificial Sequence
  Synthetic Oligonucleotide; ADORA2A exon 2; Set C
ucuccaagggcuuuuuc

SEQ ID NO: 3180 - RNA, 18 nt, Artificial Sequence
  Synthetic Oligonucleotide; ADORA2A exon 2; Set C
cucuccaagggcuuuuuc

SEQ ID NO: 3181 - RNA, 19 nt, Artificial Sequence
  Synthetic Oligonucleotide; ADORA2A exon 2; Set C
gcucuccaagggcuuuuuc

SEQ ID NO: 3182 - RNA, 18 nt, Artificial Sequence
  Synthetic Oligonucleotide; ADORA2A exon 2; Set C
gcucuccaagggcuuuuu

SEQ ID NO: 3183 - RNA, 20 nt, Artificial Sequence
  Synthetic Oligonucleotide; ADORA2A exon 2; Set A
cgcucuccaagggcuuuuuc

SEQ ID NO: 3184 - RNA, 19 nt, Artificial Sequence
  Synthetic Oligonucleotide; ADORA2A exon 2; Set C
cgcucuccaagggcuuuuu

SEQ ID NO: 3185 - RNA, 21 nt, Artificial Sequence
  Synthetic Oligonucleotide; ADORA2A exon 2; Set A
gcgcucuccaagggcuuuuuc

SEQ ID NO: 3186 - RNA, 22 nt, Artificial Sequence
  Synthetic Oligonucleotide; ADORA2A exon 2; Set A
ggcgcucuccaagggcuuuuuc

SEQ ID NO: 3187 - RNA, 18 nt, Artificial Sequence
  Synthetic Oligonucleotide; ADORA2A exon 2; Set C
cgcucuccaagggcuuuu

SEQ ID NO: 3188 - RNA, 20 nt, Artificial Sequence
  Synthetic Oligonucleotide; ADORA2A exon 2; Set A
gcgcucuccaagggcuuuuu

SEQ ID NO: 3189 - RNA, 21 nt, Artificial Sequence
  Synthetic Oligonucleotide; ADORA2A exon 2; Set A
ggcgcucuccaagggcuuuuu

SEQ ID NO: 3190 - RNA, 19 nt, Artificial Sequence
  Synthetic Oligonucleotide; ADORA2A exon 2; Set A
gcgcucuccaagggcuuuu

SEQ ID NO: 3191 - RNA, 20 nt, Artificial Sequence
  Synthetic Oligonucleotide; ADORA2A exon 2; Set A
ggcgcucuccaagggcuuuu

SEQ ID NO: 3192 - RNA, 16 nt, Artificial Sequence
  Synthetic Oligonucleotide; ADORA2A exon 2; Set C
ucuccaagggcuuuuu

SEQ ID NO: 3193 - RNA, 15 nt, Artificial Sequence
  Synthetic Oligonucleotide; ADORA2A exon 2; Set C
ucuccaagggcuuuu

SEQ ID NO: 3194 - RNA, 17 nt, Artificial Sequence
  Synthetic Oligonucleotide; ADORA2A exon 2; Set C
cucuccaagggcuuuuu

SEQ ID NO: 3195 - RNA, 16 nt, Artificial Sequence
  Synthetic Oligonucleotide; ADORA2A exon 2; Set C
cucuccaagggcuuuu

SEQ ID NO: 3196 - RNA, 17 nt, Artificial Sequence
  Synthetic Oligonucleotide; ADORA2A exon 2; Set C
gcucuccaagggcuuuu

SEQ ID NO: 3197 - RNA, 39 nt, Artificial Sequence
  Synthetic Oligonucleotide; ADORA2A exon 2; Set C
ucuggcagcagcaucauggcucagcccagcuucaggguu

SEQ ID NO: 3198 - RNA, 19 nt, Artificial Sequence
  Synthetic Oligonucleotide; ADORA2A exon 2; Set A
ggcgcucuccaagggcuuu

SEQ ID NO: 3199 - RNA, 32 nt, Artificial Sequence
  Synthetic Oligonucleotide; ADORA2A exon 2; Set C
ccagcccggcccaggcggaggggcccagaccc

SEQ ID NO: 3200 - RNA, 33 nt, Artificial Sequence
  Synthetic Oligonucleotide; ADORA2A exon 2; Set C
cccagcccggcccaggcggaggggcccagaccc

SEQ ID NO: 3201 - RNA, 31 nt, Artificial Sequence
  Synthetic Oligonucleotide; ADORA2A exon 2; Set C
ccagcccggcccaggcggaggggcccagacc

SEQ ID NO: 3202 - RNA, 34 nt, Artificial Sequence
  Synthetic Oligonucleotide; ADORA2A exon 2; Set C
ucccagcccggcccaggcggaggggcccagaccc

SEQ ID NO: 3203 - RNA, 32 nt, Artificial Sequence
  Synthetic Oligonucleotide; ADORA2A exon 2; Set C
cccagcccggcccaggcggaggggcccagacc

SEQ ID NO: 3204 - RNA, 33 nt, Artificial Sequence
  Synthetic Oligonucleotide; ADORA2A exon 2; Set C
ucccagcccggcccaggcggaggggcccagacc

SEQ ID NO: 3205 - RNA, 36 nt, Artificial Sequence
  Synthetic Oligonucleotide; ADORA2A exon 2; Set C
guuccugaggcaccugcaaagggacagccgaugaga

SEQ ID NO: 3206 - RNA, 35 nt, Artificial Sequence
  Synthetic Oligonucleotide; ADORA2A exon 2; Set C
guuccugaggcaccugcaaagggacagccgaugag

SEQ ID NO: 3207 - RNA, 34 nt, Artificial Sequence
  Synthetic Oligonucleotide; ADORA2A exon 2; Set C
guuccugaggcaccugcaaagggacagccgauga

SEQ ID NO: 3208 - RNA, 28 nt, Artificial Sequence
  Synthetic Oligonucleotide; ADORA2A exon 2; Set C
caucauggcucagcccagcuucaggguu

SEQ ID NO: 3209 - RNA, 29 nt, Artificial Sequence
  Synthetic Oligonucleotide; ADORA2A exon 2; Set C
gcaucauggcucagcccagcuucaggguu

SEQ ID NO: 3210 - RNA, 17 nt, Artificial Sequence
  Synthetic Oligonucleotide; ADORA2A exon 2; Set C
ucuggcagcagcaucau

SEQ ID NO: 3211 - RNA, 16 nt, Artificial Sequence
  Synthetic Oligonucleotide; ADORA2A exon 2; Set C
ucuggcagcagcauca

SEQ ID NO: 3212 - RNA, 15 nt, Artificial Sequence
  Synthetic Oligonucleotide; ADORA2A exon 2; Set C
ucuggcagcagcauc

SEQ ID NO: 3213 - RNA, 39 nt, Artificial Sequence
  Synthetic Oligonucleotide; ADORA2A exon 2; Set C
cugaaaccaggcccucugcagggguucuggcagcagcau

SEQ ID NO: 3214 - RNA, 40 nt, Artificial Sequence
  Synthetic Oligonucleotide; ADORA2A exon 2; Set C
ccugaaaccaggcccucugcagggguucuggcagcagcau

SEQ ID NO: 3215 - RNA, 25 nt, Artificial Sequence
  Synthetic Oligonucleotide; ADORA2A exon 2; Set A
uucacagaggacucugagucuccug

SEQ ID NO: 3216 - RNA, 26 nt, Artificial Sequence
  Synthetic Oligonucleotide; ADORA2A exon 2; Set A
uuucacagaggacucugagucuccug

SEQ ID NO: 3217 - RNA, 24 nt, Artificial Sequence
  Synthetic Oligonucleotide; ADORA2A exon 2; Set A
uucacagaggacucugagucuccu

SEQ ID NO: 3218 - RNA, 27 nt, Artificial Sequence
  Synthetic Oligonucleotide; ADORA2A exon 2; Set A
uuuucacagaggacucugagucuccug

SEQ ID NO: 3219 - RNA, 25 nt, Artificial Sequence
  Synthetic Oligonucleotide; ADORA2A exon 2; Set A
uuucacagaggacucugagucuccu

SEQ ID NO: 3220 - RNA, 26 nt, Artificial Sequence
  Synthetic Oligonucleotide; ADORA2A exon 2; Set A
uuuucacagaggacucugagucuccu

SEQ ID NO: 3221 - RNA, 39 nt, Artificial Sequence
  Synthetic Oligonucleotide; ADORA2A exon 2; Set C
ucuccaagggcuuuuucacagaggacucugagucuccug

SEQ ID NO: 3222 - RNA, 40 nt, Artificial Sequence
  Synthetic Oligonucleotide; ADORA2A exon 2; Set C
cucuccaagggcuuuuucacagaggacucugagucuccug

SEQ ID NO: 3223 - RNA, 38 nt, Artificial Sequence
  Synthetic Oligonucleotide; ADORA2A exon 2; Set C
ucuccaagggcuuuuucacagaggacucugagucuccu

SEQ ID NO: 3224 - RNA, 39 nt, Artificial Sequence
  Synthetic Oligonucleotide; ADORA2A exon 2; Set C
cucuccaagggcuuuuucacagaggacucugagucuccu

SEQ ID NO: 3225 - RNA, 40 nt, Artificial Sequence
  Synthetic Oligonucleotide; ADORA2A exon 2; Set C
gcucuccaagggcuuuuucacagaggacucugagucuccu

SEQ ID NO: 3226 - RNA, 15 nt, Artificial Sequence
  Synthetic Oligonucleotide; ADORA2A exon 2; Set C
cucuccaagggcuuu

SEQ ID NO: 3227 - RNA, 16 nt, Artificial Sequence
  Synthetic Oligonucleotide; ADORA2A exon 2; Set C
gcucuccaagggcuuu

SEQ ID NO: 3228 - RNA, 17 nt, Artificial Sequence
  Synthetic Oligonucleotide; ADORA2A exon 2; Set C
cgcucuccaagggcuuu

SEQ ID NO: 3229 - RNA, 18 nt, Artificial Sequence
  Synthetic Oligonucleotide; ADORA2A exon 2; Set A
gcgcucuccaagggcuuu

SEQ ID NO: 3230 - RNA, 31 nt, Artificial Sequence
  Synthetic Oligonucleotide; ADORA2A exon 2; Set C
cagcccggcccaggcggaggggcccagaccc

SEQ ID NO: 3231 - RNA, 30 nt, Artificial Sequence
  Synthetic Oligonucleotide; ADORA2A exon 2; Set C
cagcccggcccaggcggaggggcccagacc

SEQ ID NO: 3232 - RNA, 23 nt, Artificial Sequence
  Synthetic Oligonucleotide; ADORA2A exon 2; Set C
ccagccgcccgccuggcucccag

SEQ ID NO: 3233 - RNA, 29 nt, Artificial Sequence
  Synthetic Oligonucleotide; ADORA2A exon 2; Set C
ugcagcccagccgcccgccuggcucccag

SEQ ID NO: 3234 - RNA, 34 nt, Artificial Sequence
  Synthetic Oligonucleotide; ADORA2A exon 2; Set C
auugcugcagcccagccgcccgccuggcucccag

SEQ ID NO: 3235 - RNA, 33 nt, Artificial Sequence
  Synthetic Oligonucleotide; ADORA2A exon 2; Set C
guuccugaggcaccugcaaagggacagccgaug

SEQ ID NO: 3236 - RNA, 32 nt, Artificial Sequence
  Synthetic Oligonucleotide; ADORA2A exon 2; Set C
guuccugaggcaccugcaaagggacagccgau

SEQ ID NO: 3237 - RNA, 38 nt, Artificial Sequence
  Synthetic Oligonucleotide; ADORA2A exon 2; Set C
cugaaaccaggcccucugcagggguucuggcagcagca

SEQ ID NO: 3238 - RNA, 39 nt, Artificial Sequence
  Synthetic Oligonucleotide; ADORA2A exon 2; Set C
ccugaaaccaggcccucugcagggguucuggcagcagca

SEQ ID NO: 3239 - RNA, 28 nt, Artificial Sequence
  Synthetic Oligonucleotide; ADORA2A exon 2; Set C
cugaaaccaggcccucugcagggguucu

SEQ ID NO: 3240 - RNA, 29 nt, Artificial Sequence
  Synthetic Oligonucleotide; ADORA2A exon 2; Set C
ccugaaaccaggcccucugcagggguucu

SEQ ID NO: 3241 - RNA, 16 nt, Artificial Sequence
  Synthetic Oligonucleotide; ADORA2A exon 2; Set C
cuccaagggcuuuuuc

SEQ ID NO: 3242 - RNA, 15 nt, Artificial Sequence
  Synthetic Oligonucleotide; ADORA2A exon 2; Set C
gcucuccaagggcuu

SEQ ID NO: 3243 - RNA, 16 nt, Artificial Sequence
  Synthetic Oligonucleotide; ADORA2A exon 2; Set C
cgcucuccaagggcuu

SEQ ID NO: 3244 - RNA, 17 nt, Artificial Sequence
  Synthetic Oligonucleotide; ADORA2A exon 2; Set A
gcgcucuccaagggcuu

SEQ ID NO: 3245 - RNA, 18 nt, Artificial Sequence
  Synthetic Oligonucleotide; ADORA2A exon 2; Set A
ggcgcucuccaagggcuu

SEQ ID NO: 3246 - RNA, 27 nt, Artificial Sequence
  Synthetic Oligonucleotide; ADORA2A exon 2; Set C
gcuggggcgcucuccaagggcuuuuuc

SEQ ID NO: 3247 - RNA, 26 nt, Artificial Sequence
  Synthetic Oligonucleotide; ADORA2A exon 2; Set C
gcuggggcgcucuccaagggcuuuuu

SEQ ID NO: 3248 - RNA, 25 nt, Artificial Sequence
  Synthetic Oligonucleotide; ADORA2A exon 2; Set C
gcuggggcgcucuccaagggcuuuu

SEQ ID NO: 3249 - RNA, 35 nt, Artificial Sequence
  Synthetic Oligonucleotide; ADORA2A exon 2; Set C
cacaggagccaagugcagcccugcuggggcgcucu

SEQ ID NO: 3250 - RNA, 36 nt, Artificial Sequence
  Synthetic Oligonucleotide; ADORA2A exon 2; Set C
ucacaggagccaagugcagcccugcuggggcgcucu

SEQ ID NO: 3251 - RNA, 34 nt, Artificial Sequence
  Synthetic Oligonucleotide; ADORA2A exon 2; Set C
cacaggagccaagugcagcccugcuggggcgcuc

SEQ ID NO: 3252 - RNA, 33 nt, Artificial Sequence
  Synthetic Oligonucleotide; ADORA2A exon 2; Set C
cacaggagccaagugcagcccugcuggggcgcu

SEQ ID NO: 3253 - RNA, 35 nt, Artificial Sequence
  Synthetic Oligonucleotide; ADORA2A exon 2; Set C
ucacaggagccaagugcagcccugcuggggcgcuc

SEQ ID NO: 3254 - RNA, 34 nt, Artificial Sequence
  Synthetic Oligonucleotide; ADORA2A exon 2; Set C
ucacaggagccaagugcagcccugcuggggcgcu

SEQ ID NO: 3255 - RNA, 32 nt, Artificial Sequence
  Synthetic Oligonucleotide; ADORA2A exon 2; Set C
cacaggagccaagugcagcccugcuggggcgc

SEQ ID NO: 3256 - RNA, 33 nt, Artificial Sequence
  Synthetic Oligonucleotide; ADORA2A exon 2; Set C
ucacaggagccaagugcagcccugcuggggcgc

SEQ ID NO: 3257 - RNA, 31 nt, Artificial Sequence
  Synthetic Oligonucleotide; ADORA2A exon 2; Set C
cacaggagccaagugcagcccugcuggggcg

SEQ ID NO: 3258 - RNA, 30 nt, Artificial Sequence
  Synthetic Oligonucleotide; ADORA2A exon 2; Set C
cacaggagccaagugcagcccugcuggggc

SEQ ID NO: 3259 - RNA, 32 nt, Artificial Sequence
  Synthetic Oligonucleotide; ADORA2A exon 2; Set C
ucacaggagccaagugcagcccugcuggggcg

SEQ ID NO: 3260 - RNA, 31 nt, Artificial Sequence
  Synthetic Oligonucleotide; ADORA2A exon 2; Set C
ucacaggagccaagugcagcccugcuggggc

SEQ ID NO: 3261 - RNA, 35 nt, Artificial Sequence
  Synthetic Oligonucleotide; ADORA2A exon 2; Set C
cucccagcccggcccaggcggaggggcccagaccc

SEQ ID NO: 3262 - RNA, 34 nt, Artificial Sequence
  Synthetic Oligonucleotide; ADORA2A exon 2; Set C
cucccagcccggcccaggcggaggggcccagacc

SEQ ID NO: 3263 - RNA, 30 nt, Artificial Sequence
  Synthetic Oligonucleotide; ADORA2A exon 2; Set C
ccagccgcccgccuggcucccagcccggcc

SEQ ID NO: 3264 - RNA, 28 nt, Artificial Sequence
  Synthetic Oligonucleotide; ADORA2A exon 2; Set C
gcagcccagccgcccgccuggcucccag

SEQ ID NO: 3265 - RNA, 28 nt, Artificial Sequence
  Synthetic Oligonucleotide; ADORA2A exon 2; Set A
uuuuucacagaggacucugagucuccug

SEQ ID NO: 3266 - RNA, 27 nt, Artificial Sequence
  Synthetic Oligonucleotide; ADORA2A exon 2; Set A
uuuuucacagaggacucugagucuccu

SEQ ID NO: 3267 - RNA, 15 nt, Artificial Sequence
  Synthetic Oligonucleotide; ADORA2A exon 2; Set C
uccaagggcuuuuuc

SEQ ID NO: 3268 - RNA, 15 nt, Artificial Sequence
  Synthetic Oligonucleotide; ADORA2A exon 2; Set C
cuccaagggcuuuuu

SEQ ID NO: 3269 - RNA, 36 nt, Artificial Sequence
  Synthetic Oligonucleotide; ADORA2A exon 2; Set C
ugcagcccugcuggggcgcucuccaagggcuuuuuc

SEQ ID NO: 3270 - RNA, 35 nt, Artificial Sequence
  Synthetic Oligonucleotide; ADORA2A exon 2; Set C
ugcagcccugcuggggcgcucuccaagggcuuuuu

SEQ ID NO: 3271 - RNA, 37 nt, Artificial Sequence
  Synthetic Oligonucleotide; ADORA2A exon 2; Set C
gugcagcccugcuggggcgcucuccaagggcuuuuuc

SEQ ID NO: 3272 - RNA, 34 nt, Artificial Sequence
  Synthetic Oligonucleotide; ADORA2A exon 2; Set C
ugcagcccugcuggggcgcucuccaagggcuuuu

SEQ ID NO: 3273 - RNA, 38 nt, Artificial Sequence
  Synthetic Oligonucleotide; ADORA2A exon 2; Set C
agugcagcccugcuggggcgcucuccaagggcuuuuuc

SEQ ID NO: 3274 - RNA, 36 nt, Artificial Sequence
  Synthetic Oligonucleotide; ADORA2A exon 2; Set C
gugcagcccugcuggggcgcucuccaagggcuuuuu

SEQ ID NO: 3275 - RNA, 37 nt, Artificial Sequence
  Synthetic Oligonucleotide; ADORA2A exon 2; Set C
agugcagcccugcuggggcgcucuccaagggcuuuuu

SEQ ID NO: 3276 - RNA, 36 nt, Artificial Sequence
  Synthetic Oligonucleotide; ADORA2A exon 2; Set C
agugcagcccugcuggggcgcucuccaagggcuuuu

SEQ ID NO: 3277 - RNA, 22 nt, Artificial Sequence
  Synthetic Oligonucleotide; ADORA2A exon 2; Set C
ugcagcccugcuggggcgcucu

SEQ ID NO: 3278 - RNA, 23 nt, Artificial Sequence
  Synthetic Oligonucleotide; ADORA2A exon 2; Set C
gugcagcccugcuggggcgcucu

SEQ ID NO: 3279 - RNA, 21 nt, Artificial Sequence
  Synthetic Oligonucleotide; ADORA2A exon 2; Set C
ugcagcccugcuggggcgcuc

SEQ ID NO: 3280 - RNA, 24 nt, Artificial Sequence
  Synthetic Oligonucleotide; ADORA2A exon 2; Set C
agugcagcccugcuggggcgcucu

SEQ ID NO: 3281 - RNA, 20 nt, Artificial Sequence
  Synthetic Oligonucleotide; ADORA2A exon 2; Set C
ugcagcccugcuggggcgcu

SEQ ID NO: 3282 - RNA, 20 nt, Artificial Sequence
  Synthetic Oligonucleotide; ADORA2A exon 2; Set C
ccccugagccccuuccucac

SEQ ID NO: 3283 - RNA, 21 nt, Artificial Sequence
  Synthetic Oligonucleotide; ADORA2A exon 2; Set C
accccugagccccuuccucac

SEQ ID NO: 3284 - RNA, 19 nt, Artificial Sequence
  Synthetic Oligonucleotide; ADORA2A exon 2; Set C
ccccugagccccuuccuca

SEQ ID NO: 3285 - RNA, 20 nt, Artificial Sequence
  Synthetic Oligonucleotide; ADORA2A exon 2; Set C
accccugagccccuuccuca

SEQ ID NO: 3286 - RNA, 24 nt, Artificial Sequence
  Synthetic Oligonucleotide; ADORA2A exon 2; Set C
gcccaggcggaggggcccagaccc

SEQ ID NO: 3287 - RNA, 25 nt, Artificial Sequence
  Synthetic Oligonucleotide; ADORA2A exon 2; Set C
ggcccaggcggaggggcccagaccc

SEQ ID NO: 3288 - RNA, 23 nt, Artificial Sequence
  Synthetic Oligonucleotide; ADORA2A exon 2; Set C
gcccaggcggaggggcccagacc

SEQ ID NO: 3289 - RNA, 24 nt, Artificial Sequence
  Synthetic Oligonucleotide; ADORA2A exon 2; Set C
ggcccaggcggaggggcccagacc

SEQ ID NO: 3290 - RNA, 19 nt, Artificial Sequence
  Synthetic Oligonucleotide; ADORA2A exon 2; Set C
ccagcccggcccaggcgga

SEQ ID NO: 3291 - RNA, 20 nt, Artificial Sequence
  Synthetic Oligonucleotide; ADORA2A exon 2; Set C
cccagcccggcccaggcgga

SEQ ID NO: 3292 - RNA, 18 nt, Artificial Sequence
  Synthetic Oligonucleotide; ADORA2A exon 2; Set C
ccagcccggcccaggcgg

SEQ ID NO: 3293 - RNA, 21 nt, Artificial Sequence
  Synthetic Oligonucleotide; ADORA2A exon 2; Set C
ucccagcccggcccaggcgga

SEQ ID NO: 3294 - RNA, 19 nt, Artificial Sequence
  Synthetic Oligonucleotide; ADORA2A exon 2; Set C
cccagcccggcccaggcgg

SEQ ID NO: 3295 - RNA, 20 nt, Artificial Sequence
  Synthetic Oligonucleotide; ADORA2A exon 2; Set C
ucccagcccggcccaggcgg

SEQ ID NO: 3296 - RNA, 15 nt, Artificial Sequence
  Synthetic Oligonucleotide; ADORA2A exon 2; Set C
ucccagcccggccca

SEQ ID NO: 3297 - RNA, 29 nt, Artificial Sequence
  Synthetic Oligonucleotide; ADORA2A exon 2; Set C
ccagccgcccgccuggcucccagcccggc

SEQ ID NO: 3298 - RNA, 35 nt, Artificial Sequence
  Synthetic Oligonucleotide; ADORA2A exon 2; Set C
gcagcccagccgcccgccuggcucccagcccggcc

SEQ ID NO: 3299 - RNA, 36 nt, Artificial Sequence
  Synthetic Oligonucleotide; ADORA2A exon 2; Set C
ugcagcccagccgcccgccuggcucccagcccggcc

SEQ ID NO: 3300 - RNA, 34 nt, Artificial Sequence
  Synthetic Oligonucleotide; ADORA2A exon 2; Set C
gcagcccagccgcccgccuggcucccagcccggc

SEQ ID NO: 3301 - RNA, 35 nt, Artificial Sequence
  Synthetic Oligonucleotide; ADORA2A exon 2; Set C
ugcagcccagccgcccgccuggcucccagcccggc

SEQ ID NO: 3302 - RNA, 40 nt, Artificial Sequence
  Synthetic Oligonucleotide; ADORA2A exon 2; Set C
auugcugcagcccagccgcccgccuggcucccagcccggc

SEQ ID NO: 3303 - RNA, 25 nt, Artificial Sequence
  Synthetic Oligonucleotide; ADORA2A exon 2; Set C
cauggcucagcccagcuucaggguu

SEQ ID NO: 3304 - RNA, 26 nt, Artificial Sequence
  Synthetic Oligonucleotide; ADORA2A exon 2; Set C
ucauggcucagcccagcuucaggguu

SEQ ID NO: 3305 - RNA, 27 nt, Artificial Sequence
  Synthetic Oligonucleotide; ADORA2A exon 2; Set C
aucauggcucagcccagcuucaggguu

SEQ ID NO: 3306 - RNA, 40 nt, Artificial Sequence
  Synthetic Oligonucleotide; ADORA2A exon 2; Set C
cugaaaccaggcccucugcagggguucuggcagcagcauc

SEQ ID NO: 3307 - RNA, 29 nt, Artificial Sequence
  Synthetic Oligonucleotide; ADORA2A exon 2; Set A
cuuuuucacagaggacucugagucuccug

SEQ ID NO: 3308 - RNA, 28 nt, Artificial Sequence
  Synthetic Oligonucleotide; ADORA2A exon 2; Set A
cuuuuucacagaggacucugagucuccu

SEQ ID NO: 3309 - RNA, 38 nt, Artificial Sequence
  Synthetic Oligonucleotide; ADORA2A exon 2; Set C
cuccaagggcuuuuucacagaggacucugagucuccug

SEQ ID NO: 3310 - RNA, 24 nt, Artificial Sequence
  Synthetic Oligonucleotide; ADORA2A exon 2; Set C
gcuggggcgcucuccaagggcuuu

SEQ ID NO: 3311 - RNA, 35 nt, Artificial Sequence
  Synthetic Oligonucleotide; ADORA2A exon 2; Set C
gcagcccugcuggggcgcucuccaagggcuuuuuc

SEQ ID NO: 3312 - RNA, 34 nt, Artificial Sequence
  Synthetic Oligonucleotide; ADORA2A exon 2; Set C
gcagcccugcuggggcgcucuccaagggcuuuuu

SEQ ID NO: 3313 - RNA, 33 nt, Artificial Sequence
  Synthetic Oligonucleotide; ADORA2A exon 2; Set C
gcagcccugcuggggcgcucuccaagggcuuuu

SEQ ID NO: 3314 - RNA, 35 nt, Artificial Sequence
  Synthetic Oligonucleotide; ADORA2A exon 2; Set C
gugcagcccugcuggggcgcucuccaagggcuuuu

SEQ ID NO: 3315 - RNA, 39 nt, Artificial Sequence
  Synthetic Oligonucleotide; ADORA2A exon 2; Set C
aagugcagcccugcuggggcgcucuccaagggcuuuuuc

SEQ ID NO: 3316 - RNA, 38 nt, Artificial Sequence
  Synthetic Oligonucleotide; ADORA2A exon 2; Set C
aagugcagcccugcuggggcgcucuccaagggcuuuuu

SEQ ID NO: 3317 - RNA, 37 nt, Artificial Sequence
  Synthetic Oligonucleotide; ADORA2A exon 2; Set C
aagugcagcccugcuggggcgcucuccaagggcuuuu

SEQ ID NO: 3318 - RNA, 21 nt, Artificial Sequence
  Synthetic Oligonucleotide; ADORA2A exon 2; Set C
gcagcccugcuggggcgcucu

SEQ ID NO: 3319 - RNA, 20 nt, Artificial Sequence
  Synthetic Oligonucleotide; ADORA2A exon 2; Set C
gcagcccugcuggggcgcuc

SEQ ID NO: 3320 - RNA, 19 nt, Artificial Sequence
  Synthetic Oligonucleotide; ADORA2A exon 2; Set C
gcagcccugcuggggcgcu

SEQ ID NO: 3321 - RNA, 22 nt, Artificial Sequence
  Synthetic Oligonucleotide; ADORA2A exon 2; Set C
gugcagcccugcuggggcgcuc

SEQ ID NO: 3322 - RNA, 25 nt, Artificial Sequence
  Synthetic Oligonucleotide; ADORA2A exon 2; Set C
aagugcagcccugcuggggcgcucu

SEQ ID NO: 3323 - RNA, 21 nt, Artificial Sequence
  Synthetic Oligonucleotide; ADORA2A exon 2; Set C
gugcagcccugcuggggcgcu

SEQ ID NO: 3324 - RNA, 23 nt, Artificial Sequence
  Synthetic Oligonucleotide; ADORA2A exon 2; Set C
agugcagcccugcuggggcgcuc

SEQ ID NO: 3325 - RNA, 19 nt, Artificial Sequence
  Synthetic Oligonucleotide; ADORA2A exon 2; Set C
ugcagcccugcuggggcgc

SEQ ID NO: 3326 - RNA, 22 nt, Artificial Sequence
  Synthetic Oligonucleotide; ADORA2A exon 2; Set C
agugcagcccugcuggggcgcu

SEQ ID NO: 3327 - RNA, 24 nt, Artificial Sequence
  Synthetic Oligonucleotide; ADORA2A exon 2; Set C
aagugcagcccugcuggggcgcuc

SEQ ID NO: 3328 - RNA, 20 nt, Artificial Sequence
  Synthetic Oligonucleotide; ADORA2A exon 2; Set C
gugcagcccugcuggggcgc

SEQ ID NO: 3329 - RNA, 18 nt, Artificial Sequence
  Synthetic Oligonucleotide; ADORA2A exon 2; Set C
ugcagcccugcuggggcg

SEQ ID NO: 3330 - RNA, 17 nt, Artificial Sequence
  Synthetic Oligonucleotide; ADORA2A exon 2; Set C
ugcagcccugcuggggc

SEQ ID NO: 3331 - RNA, 23 nt, Artificial Sequence
  Synthetic Oligonucleotide; ADORA2A exon 2; Set C
aagugcagcccugcuggggcgcu

SEQ ID NO: 3332 - RNA, 21 nt, Artificial Sequence
  Synthetic Oligonucleotide; ADORA2A exon 2; Set C
agugcagcccugcuggggcgc

SEQ ID NO: 3333 - RNA, 19 nt, Artificial Sequence
  Synthetic Oligonucleotide; ADORA2A exon 2; Set C
gugcagcccugcuggggcg

SEQ ID NO: 3334 - RNA, 18 nt, Artificial Sequence
  Synthetic Oligonucleotide; ADORA2A exon 2; Set C
gugcagcccugcuggggc

SEQ ID NO: 3335 - RNA, 20 nt, Artificial Sequence
  Synthetic Oligonucleotide; ADORA2A exon 2; Set C
agugcagcccugcuggggcg

SEQ ID NO: 3336 - RNA, 19 nt, Artificial Sequence
  Synthetic Oligonucleotide; ADORA2A exon 2; Set C
agugcagcccugcuggggc

SEQ ID NO: 3337 - RNA, 23 nt, Artificial Sequence
  Synthetic Oligonucleotide; ADORA2A exon 2; Set C
cccaggcggaggggcccagaccc

SEQ ID NO: 3338 - RNA, 26 nt, Artificial Sequence
  Synthetic Oligonucleotide; ADORA2A exon 2; Set C
cggcccaggcggaggggcccagaccc

SEQ ID NO: 3339 - RNA, 25 nt, Artificial Sequence
  Synthetic Oligonucleotide; ADORA2A exon 2; Set C
cggcccaggcggaggggcccagacc

SEQ ID NO: 3340 - RNA, 30 nt, Artificial Sequence
  Synthetic Oligonucleotide; ADORA2A exon 2; Set C
agcccggcccaggcggaggggcccagaccc

SEQ ID NO: 3341 - RNA, 29 nt, Artificial Sequence
  Synthetic Oligonucleotide; ADORA2A exon 2; Set C
agcccggcccaggcggaggggcccagacc

SEQ ID NO: 3342 - RNA, 36 nt, Artificial Sequence
  Synthetic Oligonucleotide; ADORA2A exon 2; Set C
gcucccagcccggcccaggcggaggggcccagaccc

SEQ ID NO: 3343 - RNA, 35 nt, Artificial Sequence
  Synthetic Oligonucleotide; ADORA2A exon 2; Set C
gcucccagcccggcccaggcggaggggcccagacc

SEQ ID NO: 3344 - RNA, 38 nt, Artificial Sequence
  Synthetic Oligonucleotide; ADORA2A exon 2; Set C
uggcucccagcccggcccaggcggaggggcccagaccc

SEQ ID NO: 3345 - RNA, 37 nt, Artificial Sequence
  Synthetic Oligonucleotide; ADORA2A exon 2; Set C
uggcucccagcccggcccaggcggaggggcccagacc

SEQ ID NO: 3346 - RNA, 40 nt, Artificial Sequence
  Synthetic Oligonucleotide; ADORA2A exon 2; Set C
ccuggcucccagcccggcccaggcggaggggcccagaccc

SEQ ID NO: 3347 - RNA, 39 nt, Artificial Sequence
  Synthetic Oligonucleotide; ADORA2A exon 2; Set C
ccuggcucccagcccggcccaggcggaggggcccagacc

SEQ ID NO: 3348 - RNA, 18 nt, Artificial Sequence
  Synthetic Oligonucleotide; ADORA2A exon 2; Set C
cagcccggcccaggcgga

SEQ ID NO: 3349 - RNA, 17 nt, Artificial Sequence
  Synthetic Oligonucleotide; ADORA2A exon 2; Set C
cagcccggcccaggcgg

SEQ ID NO: 3350 - RNA, 17 nt, Artificial Sequence
  Synthetic Oligonucleotide; ADORA2A exon 2; Set C
ccagcccggcccaggcg

SEQ ID NO: 3351 - RNA, 22 nt, Artificial Sequence
  Synthetic Oligonucleotide; ADORA2A exon 2; Set C
cucccagcccggcccaggcgga

SEQ ID NO: 3352 - RNA, 18 nt, Artificial Sequence
  Synthetic Oligonucleotide; ADORA2A exon 2; Set C
cccagcccggcccaggcg

SEQ ID NO: 3353 - RNA, 19 nt, Artificial Sequence
  Synthetic Oligonucleotide; ADORA2A exon 2; Set C
ucccagcccggcccaggcg

SEQ ID NO: 3354 - RNA, 15 nt, Artificial Sequence
  Synthetic Oligonucleotide; ADORA2A exon 2; Set A
ccagcccggcccagg

SEQ ID NO: 3355 - RNA, 17 nt, Artificial Sequence
  Synthetic Oligonucleotide; ADORA2A exon 2; Set C
ucccagcccggcccagg

SEQ ID NO: 3356 - RNA, 16 nt, Artificial Sequence
  Synthetic Oligonucleotide; ADORA2A exon 2; Set C
cucccagcccggccca

SEQ ID NO: 3357 - RNA, 15 nt, Artificial Sequence
  Synthetic Oligonucleotide; ADORA2A exon 2; Set A
cucccagcccggccc

SEQ ID NO: 3358 - RNA, 17 nt, Artificial Sequence
  Synthetic Oligonucleotide; ADORA2A exon 2; Set C
uggcucccagcccggcc

SEQ ID NO: 3359 - RNA, 38 nt, Artificial Sequence
  Synthetic Oligonucleotide; ADORA2A exon 2; Set C
ccagccgcccgccuggcucccagcccggcccaggcgga

SEQ ID NO: 3360 - RNA, 32 nt, Artificial Sequence
  Synthetic Oligonucleotide; ADORA2A exon 2; Set C
ccagccgcccgccuggcucccagcccggccca

SEQ ID NO: 3361 - RNA, 31 nt, Artificial Sequence
  Synthetic Oligonucleotide; ADORA2A exon 2; Set C
ccagccgcccgccuggcucccagcccggccc

SEQ ID NO: 3362 - RNA, 16 nt, Artificial Sequence
  Synthetic Oligonucleotide; ADORA2A exon 2; Set A
cccgccuggcucccag

SEQ ID NO: 3363 - RNA, 17 nt, Artificial Sequence
  Synthetic Oligonucleotide; ADORA2A exon 2; Set C
gcccgccuggcucccag

SEQ ID NO: 3364 - RNA, 28 nt, Artificial Sequence
  Synthetic Oligonucleotide; ADORA2A exon 2; Set C
ccagccgcccgccuggcucccagcccgg

SEQ ID NO: 3365 - RNA, 20 nt, Artificial Sequence
  Synthetic Oligonucleotide; ADORA2A exon 2; Set C
gccgcccgccuggcucccag

SEQ ID NO: 3366 - RNA, 36 nt, Artificial Sequence
  Synthetic Oligonucleotide; ADORA2A exon 2; Set C
gcagcccagccgcccgccuggcucccagcccggccc

SEQ ID NO: 3367 - RNA, 21 nt, Artificial Sequence
  Synthetic Oligonucleotide; ADORA2A exon 2; Set C
agccgcccgccuggcucccag

SEQ ID NO: 3368 - RNA, 37 nt, Artificial Sequence
  Synthetic Oligonucleotide; ADORA2A exon 2; Set C
ugcagcccagccgcccgccuggcucccagcccggccc

SEQ ID NO: 3369 - RNA, 22 nt, Artificial Sequence
  Synthetic Oligonucleotide; ADORA2A exon 2; Set C
cagccgcccgccuggcucccag

SEQ ID NO: 3370 - RNA, 24 nt, Artificial Sequence
  Synthetic Oligonucleotide; ADORA2A exon 2; Set C
ccagccgcccgccuggcucccagc

SEQ ID NO: 3371 - RNA, 38 nt, Artificial Sequence
  Synthetic Oligonucleotide; ADORA2A exon 2; Set C
cuggcagcagcaucauggcucagcccagcuucaggguu

SEQ ID NO: 3372 - RNA, 28 nt, Artificial Sequence
  Synthetic Oligonucleotide; ADORA2A exon 2; Set C
ucuggcagcagcaucauggcucagccca

SEQ ID NO: 3373 - RNA, 19 nt, Artificial Sequence
  Synthetic Oligonucleotide; ADORA2A exon 2; Set A
gggguucuggcagcagcau

SEQ ID NO: 3374 - RNA, 20 nt, Artificial Sequence
  Synthetic Oligonucleotide; ADORA2A exon 2; Set A
agggguucuggcagcagcau

SEQ ID NO: 3375 - RNA, 18 nt, Artificial Sequence
  Synthetic Oligonucleotide; ADORA2A exon 2; Set A
gggguucuggcagcagca

SEQ ID NO: 3376 - RNA, 19 nt, Artificial Sequence
  Synthetic Oligonucleotide; ADORA2A exon 2; Set A
agggguucuggcagcagca

SEQ ID NO: 3377 - RNA, 37 nt, Artificial Sequence
  Synthetic Oligonucleotide; ADORA2A exon 2; Set C
uccaagggcuuuuucacagaggacucugagucuccug

SEQ ID NO: 3378 - RNA, 36 nt, Artificial Sequence
  Synthetic Oligonucleotide; ADORA2A exon 2; Set C
uccaagggcuuuuucacagaggacucugagucuccu

SEQ ID NO: 3379 - RNA, 37 nt, Artificial Sequence
  Synthetic Oligonucleotide; ADORA2A exon 2; Set C
cuccaagggcuuuuucacagaggacucugagucuccu

SEQ ID NO: 3380 - RNA, 33 nt, Artificial Sequence
  Synthetic Oligonucleotide; ADORA2A exon 2; Set C
ugcagcccugcuggggcgcucuccaagggcuuu

SEQ ID NO: 3381 - RNA, 18 nt, Artificial Sequence
  Synthetic Oligonucleotide; ADORA2A exon 2; Set C
gcagcccugcuggggcgc

SEQ ID NO: 3382 - RNA, 17 nt, Artificial Sequence
  Synthetic Oligonucleotide; ADORA2A exon 2; Set C
gcagcccugcuggggcg

SEQ ID NO: 3383 - RNA, 16 nt, Artificial Sequence
  Synthetic Oligonucleotide; ADORA2A exon 2; Set C
gcagcccugcuggggc

SEQ ID NO: 3384 - RNA, 22 nt, Artificial Sequence
  Synthetic Oligonucleotide; ADORA2A exon 2; Set C
aagugcagcccugcuggggcgc

SEQ ID NO: 3385 - RNA, 21 nt, Artificial Sequence
  Synthetic Oligonucleotide; ADORA2A exon 2; Set C
aagugcagcccugcuggggcg

SEQ ID NO: 3386 - RNA, 20 nt, Artificial Sequence
  Synthetic Oligonucleotide; ADORA2A exon 2; Set C
aagugcagcccugcuggggc

SEQ ID NO: 3387 - RNA, 36 nt, Artificial Sequence
  Synthetic Oligonucleotide; ADORA2A exon 2; Set C
cacaggagccaagugcagcccugcuggggcgcucuc

SEQ ID NO: 3388 - RNA, 33 nt, Artificial Sequence
  Synthetic Oligonucleotide; ADORA2A exon 2; Set C
ccccugagccccuuccucacaggagccaagugc

SEQ ID NO: 3389 - RNA, 34 nt, Artificial Sequence
  Synthetic Oligonucleotide; ADORA2A exon 2; Set C
accccugagccccuuccucacaggagccaagugc

SEQ ID NO: 3390 - RNA, 16 nt, Artificial Sequence
  Synthetic Oligonucleotide; ADORA2A exon 2; Set A
ggaggggcccagaccc

SEQ ID NO: 3391 - RNA, 17 nt, Artificial Sequence
  Synthetic Oligonucleotide; ADORA2A exon 2; Set C
cggaggggcccagaccc

SEQ ID NO: 3392 - RNA, 22 nt, Artificial Sequence
  Synthetic Oligonucleotide; ADORA2A exon 2; Set C
ccaggcggaggggcccagaccc

SEQ ID NO: 3393 - RNA, 21 nt, Artificial Sequence
  Synthetic Oligonucleotide; ADORA2A exon 2; Set C
ccaggcggaggggcccagacc

SEQ ID NO: 3394 - RNA, 22 nt, Artificial Sequence
  Synthetic Oligonucleotide; ADORA2A exon 2; Set C
cccaggcggaggggcccagacc

SEQ ID NO: 3395 - RNA, 27 nt, Artificial Sequence
  Synthetic Oligonucleotide; ADORA2A exon 2; Set C
ccggcccaggcggaggggcccagaccc

SEQ ID NO: 3396 - RNA, 28 nt, Artificial Sequence
  Synthetic Oligonucleotide; ADORA2A exon 2; Set C
cccggcccaggcggaggggcccagaccc

SEQ ID NO: 3397 - RNA, 26 nt, Artificial Sequence
  Synthetic Oligonucleotide; ADORA2A exon 2; Set C
ccggcccaggcggaggggcccagacc

SEQ ID NO: 3398 - RNA, 27 nt, Artificial Sequence
  Synthetic Oligonucleotide; ADORA2A exon 2; Set C
cccggcccaggcggaggggcccagacc

SEQ ID NO: 3399 - RNA, 37 nt, Artificial Sequence
  Synthetic Oligonucleotide; ADORA2A exon 2; Set C
ggcucccagcccggcccaggcggaggggcccagaccc

SEQ ID NO: 3400 - RNA, 36 nt, Artificial Sequence
  Synthetic Oligonucleotide; ADORA2A exon 2; Set C
ggcucccagcccggcccaggcggaggggcccagacc

SEQ ID NO: 3401 - RNA, 16 nt, Artificial Sequence
  Synthetic Oligonucleotide; ADORA2A exon 2; Set C
cagcccggcccaggcg

SEQ ID NO: 3402 - RNA, 15 nt, Artificial Sequence
  Synthetic Oligonucleotide; ADORA2A exon 2; Set A
cagcccggcccaggc

SEQ ID NO: 3403 - RNA, 16 nt, Artificial Sequence
  Synthetic Oligonucleotide; ADORA2A exon 2; Set C
ccagcccggcccaggc

SEQ ID NO: 3404 - RNA, 21 nt, Artificial Sequence
  Synthetic Oligonucleotide; ADORA2A exon 2; Set C
cucccagcccggcccaggcgg

SEQ ID NO: 3405 - RNA, 17 nt, Artificial Sequence
  Synthetic Oligonucleotide; ADORA2A exon 2; Set C
cccagcccggcccaggc

SEQ ID NO: 3406 - RNA, 16 nt, Artificial Sequence
  Synthetic Oligonucleotide; ADORA2A exon 2; Set C
cccagcccggcccagg

SEQ ID NO: 3407 - RNA, 18 nt, Artificial Sequence
  Synthetic Oligonucleotide; ADORA2A exon 2; Set C
ucccagcccggcccaggc

SEQ ID NO: 3408 - RNA, 15 nt, Artificial Sequence
  Synthetic Oligonucleotide; ADORA2A exon 2; Set A
cccagcccggcccag

SEQ ID NO: 3409 - RNA, 16 nt, Artificial Sequence
  Synthetic Oligonucleotide; ADORA2A exon 2; Set C
ucccagcccggcccag

SEQ ID NO: 3410 - RNA, 15 nt, Artificial Sequence
  Synthetic Oligonucleotide; ADORA2A exon 2; Set C
gcucccagcccggcc

SEQ ID NO: 3411 - RNA, 16 nt, Artificial Sequence
  Synthetic Oligonucleotide; ADORA2A exon 2; Set C
ggcucccagcccggcc

SEQ ID NO: 3412 - RNA, 16 nt, Artificial Sequence
  Synthetic Oligonucleotide; ADORA2A exon 2; Set C
uggcucccagcccggc

SEQ ID NO: 3413 - RNA, 19 nt, Artificial Sequence
  Synthetic Oligonucleotide; ADORA2A exon 2; Set C
ccuggcucccagcccggcc

SEQ ID NO: 3414 - RNA, 18 nt, Artificial Sequence
  Synthetic Oligonucleotide; ADORA2A exon 2; Set C
ccuggcucccagcccggc

SEQ ID NO: 3415 - RNA, 37 nt, Artificial Sequence
  Synthetic Oligonucleotide; ADORA2A exon 2; Set C
ccagccgcccgccuggcucccagcccggcccaggcgg

SEQ ID NO: 3416 - RNA, 36 nt, Artificial Sequence
  Synthetic Oligonucleotide; ADORA2A exon 2; Set C
ccagccgcccgccuggcucccagcccggcccaggcg

SEQ ID NO: 3417 - RNA, 27 nt, Artificial Sequence
  Synthetic Oligonucleotide; ADORA2A exon 2; Set C
gccgcccgccuggcucccagcccggcc

SEQ ID NO: 3418 - RNA, 28 nt, Artificial Sequence
  Synthetic Oligonucleotide; ADORA2A exon 2; Set C
agccgcccgccuggcucccagcccggcc

SEQ ID NO: 3419 - RNA, 29 nt, Artificial Sequence
  Synthetic Oligonucleotide; ADORA2A exon 2; Set C
cagccgcccgccuggcucccagcccggcc

SEQ ID NO: 3420 - RNA, 37 nt, Artificial Sequence
  Synthetic Oligonucleotide; ADORA2A exon 2; Set C
gcagcccagccgcccgccuggcucccagcccggccca

SEQ ID NO: 3421 - RNA, 27 nt, Artificial Sequence
  Synthetic Oligonucleotide; ADORA2A exon 2; Set C
ccagccgcccgccuggcucccagcccg

SEQ ID NO: 3422 - RNA, 38 nt, Artificial Sequence
  Synthetic Oligonucleotide; ADORA2A exon 2; Set C
ugcagcccagccgcccgccuggcucccagcccggccca

SEQ ID NO: 3423 - RNA, 26 nt, Artificial Sequence
  Synthetic Oligonucleotide; ADORA2A exon 2; Set C
ccagccgcccgccuggcucccagccc

SEQ ID NO: 3424 - RNA, 33 nt, Artificial Sequence
  Synthetic Oligonucleotide; ADORA2A exon 2; Set C
gcagcccagccgcccgccuggcucccagcccgg

SEQ ID NO: 3425 - RNA, 34 nt, Artificial Sequence
  Synthetic Oligonucleotide; ADORA2A exon 2; Set C
ugcagcccagccgcccgccuggcucccagcccgg

SEQ ID NO: 3426 - RNA, 32 nt, Artificial Sequence
  Synthetic Oligonucleotide; ADORA2A exon 2; Set C
gcagcccagccgcccgccuggcucccagcccg

SEQ ID NO: 3427 - RNA, 33 nt, Artificial Sequence
  Synthetic Oligonucleotide; ADORA2A exon 2; Set C
ugcagcccagccgcccgccuggcucccagcccg

SEQ ID NO: 3428 - RNA, 29 nt, Artificial Sequence
  Synthetic Oligonucleotide; ADORA2A exon 2; Set C
gcagcccagccgcccgccuggcucccagc

SEQ ID NO: 3429 - RNA, 30 nt, Artificial Sequence
  Synthetic Oligonucleotide; ADORA2A exon 2; Set C
ugcagcccagccgcccgccuggcucccagc

SEQ ID NO: 3430 - RNA, 39 nt, Artificial Sequence
  Synthetic Oligonucleotide; ADORA2A exon 2; Set C
auugcugcagcccagccgcccgccuggcucccagcccgg

SEQ ID NO: 3431 - RNA, 38 nt, Artificial Sequence
  Synthetic Oligonucleotide; ADORA2A exon 2; Set C
auugcugcagcccagccgcccgccuggcucccagcccg

SEQ ID NO: 3432 - RNA, 35 nt, Artificial Sequence
  Synthetic Oligonucleotide; ADORA2A exon 2; Set C
auugcugcagcccagccgcccgccuggcucccagc

SEQ ID NO: 3433 - RNA, 38 nt, Artificial Sequence
  Synthetic Oligonucleotide; ADORA2A exon 2; Set C
guccauugcugcagcccagccgcccgccuggcucccag

SEQ ID NO: 3434 - RNA, 39 nt, Artificial Sequence
  Synthetic Oligonucleotide; ADORA2A exon 2; Set C
gguccauugcugcagcccagccgcccgccuggcucccag

SEQ ID NO: 3435 - RNA, 27 nt, Artificial Sequence
  Synthetic Oligonucleotide; PD-1 exon 2; Set A
gucugagagauggagagaggugaggaa

SEQ ID NO: 3436 - RNA, 31 nt, Artificial Sequence
  Synthetic Oligonucleotide; PD-1 exon 2; Set C
gggagucugagagauggagagaggugaggaa

SEQ ID NO: 3437 - RNA, 32 nt, Artificial Sequence
  Synthetic Oligonucleotide; PD-1 exon 2; Set C
ggggagucugagagauggagagaggugaggaa

SEQ ID NO: 3438 - RNA, 17 nt, Artificial Sequence
  Synthetic Oligonucleotide; PD-1 exon 2; Set C
gggagucugagagaugg

SEQ ID NO: 3439 - RNA, 18 nt, Artificial Sequence
  Synthetic Oligonucleotide; PD-1 exon 2; Set C
ggggagucugagagaugg

SEQ ID NO: 3440 - RNA, 19 nt, Artificial Sequence
  Synthetic Oligonucleotide; PD-1 exon 2; Set C
uggggagucugagagaugg

SEQ ID NO: 3441 - RNA, 36 nt, Artificial Sequence
  Synthetic Oligonucleotide; PD-1 exon 2; Set C
gaagguggggggguuccagggccugucuggggaguc

SEQ ID NO: 3442 - RNA, 37 nt, Artificial Sequence
  Synthetic Oligonucleotide; PD-1 exon 2; Set C
agaagguggggggguuccagggccugucuggggaguc

SEQ ID NO: 3443 - RNA, 33 nt, Artificial Sequence
  Synthetic Oligonucleotide; PD-1 exon 2; Set C
agaagguggggggguuccagggccugucugggg

SEQ ID NO: 3444 - RNA, 15 nt, Artificial Sequence
  Synthetic Oligonucleotide; PD-1 exon 2; Set C
gaagguggggggguu

SEQ ID NO: 3445 - RNA, 16 nt, Artificial Sequence
  Synthetic Oligonucleotide; PD-1 exon 2; Set C
agaagguggggggguu

SEQ ID NO: 3446 - RNA, 17 nt, Artificial Sequence
  Synthetic Oligonucleotide; PD-1 exon 2; Set A
gagaagguggggggguu

SEQ ID NO: 3447 - RNA, 15 nt, Artificial Sequence
  Synthetic Oligonucleotide; PD-1 exon 2; Set C
agaaggugggggggu

SEQ ID NO: 3448 - RNA, 16 nt, Artificial Sequence
  Synthetic Oligonucleotide; PD-1 exon 2; Set A
gagaaggugggggggu

SEQ ID NO: 3449 - RNA, 15 nt, Artificial Sequence
  Synthetic Oligonucleotide; PD-1 exon 2; Set C
gagaagguggggggg

SEQ ID NO: 3450 - RNA, 39 nt, Artificial Sequence
  Synthetic Oligonucleotide; PD-1 exon 2; Set C
ggucaccacgagcagggcuggggagaagguggggggguu

SEQ ID NO: 3451 - RNA, 38 nt, Artificial Sequence
  Synthetic Oligonucleotide; PD-1 exon 2; Set C
ggucaccacgagcagggcuggggagaaggugggggggu

SEQ ID NO: 3452 - RNA, 19 nt, Artificial Sequence
  Synthetic Oligonucleotide; PD-1 exon 2; Set B
uaggugccgcugucauugc

SEQ ID NO: 3453 - RNA, 18 nt, Artificial Sequence
  Synthetic Oligonucleotide; PD-1 exon 2; Set C
uaggugccgcugucauug

SEQ ID NO: 3454 - RNA, 20 nt, Artificial Sequence
  Synthetic Oligonucleotide; PD-1 exon 2; Set B
guaggugccgcugucauugc

SEQ ID NO: 3455 - RNA, 17 nt, Artificial Sequence
  Synthetic Oligonucleotide; PD-1 exon 2; Set C
uaggugccgcugucauu

SEQ ID NO: 3456 - RNA, 19 nt, Artificial Sequence
  Synthetic Oligonucleotide; PD-1 exon 2; Set B
guaggugccgcugucauug

SEQ ID NO: 3457 - RNA, 18 nt, Artificial Sequence
  Synthetic Oligonucleotide; PD-1 exon 2; Set B
guaggugccgcugucauu

SEQ ID NO: 3458 - RNA, 17 nt, Artificial Sequence
  Synthetic Oligonucleotide; PD-1 exon 2; Set B
guaggugccgcugucau

SEQ ID NO: 3459 - RNA, 15 nt, Artificial Sequence
  Synthetic Oligonucleotide; PD-1 exon 2; Set C
uugaucugcgccuug

SEQ ID NO: 3460 - RNA, 16 nt, Artificial Sequence
  Synthetic Oligonucleotide; PD-1 exon 2; Set C
uuugaucugcgccuug

SEQ ID NO: 3461 - RNA, 17 nt, Artificial Sequence
  Synthetic Oligonucleotide; PD-1 exon 2; Set C
cuuugaucugcgccuug

SEQ ID NO: 3462 - RNA, 15 nt, Artificial Sequence
  Synthetic Oligonucleotide; PD-1 exon 2; Set C
uuugaucugcgccuu

SEQ ID NO: 3463 - RNA, 18 nt, Artificial Sequence
  Synthetic Oligonucleotide; PD-1 exon 2; Set C
ucuuugaucugcgccuug

SEQ ID NO: 3464 - RNA, 16 nt, Artificial Sequence
  Synthetic Oligonucleotide; PD-1 exon 2; Set C
cuuugaucugcgccuu

SEQ ID NO: 3465 - RNA, 17 nt, Artificial Sequence
  Synthetic Oligonucleotide; PD-1 exon 2; Set C
ucuuugaucugcgccuu

SEQ ID NO: 3466 - RNA, 15 nt, Artificial Sequence
  Synthetic Oligonucleotide; PD-1 exon 2; Set C
gguggccccacaaag

SEQ ID NO: 3467 - RNA, 16 nt, Artificial Sequence
  Synthetic Oligonucleotide; PD-1 exon 2; Set C
ggguggccccacaaag

SEQ ID NO: 3468 - RNA, 17 nt, Artificial Sequence
  Synthetic Oligonucleotide; PD-1 exon 2; Set A
uggguggccccacaaag

SEQ ID NO: 3469 - RNA, 15 nt, Artificial Sequence
  Synthetic Oligonucleotide; PD-1 exon 2; Set C
ggguggccccacaaa

SEQ ID NO: 3470 - RNA, 16 nt, Artificial Sequence
  Synthetic Oligonucleotide; PD-1 exon 2; Set A
uggguggccccacaaa

SEQ ID NO: 3471 - RNA, 15 nt, Artificial Sequence
  Synthetic Oligonucleotide; PD-1 exon 2; Set A
uggguggccccacaa

SEQ ID NO: 3472 - RNA, 25 nt, Artificial Sequence
  Synthetic Oligonucleotide; PD-1 exon 2; Set C
gaaggggcuggguggccccacaaag

SEQ ID NO: 3473 - RNA, 26 nt, Artificial Sequence
  Synthetic Oligonucleotide; PD-1 exon 2; Set C
ggaaggggcuggguggccccacaaag

SEQ ID NO: 3474 - RNA, 24 nt, Artificial Sequence
  Synthetic Oligonucleotide; PD-1 exon 2; Set C
gaaggggcuggguggccccacaaa

SEQ ID NO: 3475 - RNA, 23 nt, Artificial Sequence
  Synthetic Oligonucleotide; PD-1 exon 2; Set C
gaaggggcuggguggccccacaa

SEQ ID NO: 3476 - RNA, 27 nt, Artificial Sequence
  Synthetic Oligonucleotide; PD-1 exon 2; Set C
aggaaggggcuggguggccccacaaag

SEQ ID NO: 3477 - RNA, 25 nt, Artificial Sequence
  Synthetic Oligonucleotide; PD-1 exon 2; Set C
ggaaggggcuggguggccccacaaa

SEQ ID NO: 3478 - RNA, 22 nt, Artificial Sequence
  Synthetic Oligonucleotide; PD-1 exon 2; Set C
gaaggggcuggguggccccaca

SEQ ID NO: 3479 - RNA, 24 nt, Artificial Sequence
  Synthetic Oligonucleotide; PD-1 exon 2; Set C
ggaaggggcuggguggccccacaa

SEQ ID NO: 3480 - RNA, 28 nt, Artificial Sequence
  Synthetic Oligonucleotide; PD-1 exon 2; Set C
gaggaaggggcuggguggccccacaaag

SEQ ID NO: 3481 - RNA, 26 nt, Artificial Sequence
  Synthetic Oligonucleotide; PD-1 exon 2; Set C
aggaaggggcuggguggccccacaaa

SEQ ID NO: 3482 - RNA, 23 nt, Artificial Sequence
  Synthetic Oligonucleotide; PD-1 exon 2; Set C
ggaaggggcuggguggccccaca

SEQ ID NO: 3483 - RNA, 25 nt, Artificial Sequence
  Synthetic Oligonucleotide; PD-1 exon 2; Set C
aggaaggggcuggguggccccacaa

SEQ ID NO: 3484 - RNA, 29 nt, Artificial Sequence
  Synthetic Oligonucleotide; PD-1 exon 2; Set C
ugaggaaggggcuggguggccccacaaag

SEQ ID NO: 3485 - RNA, 27 nt, Artificial Sequence
  Synthetic Oligonucleotide; PD-1 exon 2; Set C
gaggaaggggcuggguggccccacaaa

SEQ ID NO: 3486 - RNA, 24 nt, Artificial Sequence
  Synthetic Oligonucleotide; PD-1 exon 2; Set C
aggaaggggcuggguggccccaca

SEQ ID NO: 3487 - RNA, 26 nt, Artificial Sequence
  Synthetic Oligonucleotide; PD-1 exon 2; Set C
gaggaaggggcuggguggccccacaa

SEQ ID NO: 3488 - RNA, 28 nt, Artificial Sequence
  Synthetic Oligonucleotide; PD-1 exon 2; Set C
ugaggaaggggcuggguggccccacaaa

SEQ ID NO: 3489 - RNA, 27 nt, Artificial Sequence
  Synthetic Oligonucleotide; PD-1 exon 2; Set C
ugaggaaggggcuggguggccccacaa

SEQ ID NO: 3490 - RNA, 25 nt, Artificial Sequence
  Synthetic Oligonucleotide; PD-1 exon 2; Set C
gaggaaggggcuggguggccccaca

SEQ ID NO: 3491 - RNA, 26 nt, Artificial Sequence
  Synthetic Oligonucleotide; PD-1 exon 2; Set C
ugaggaaggggcuggguggccccaca

SEQ ID NO: 3492 - RNA, 33 nt, Artificial Sequence
  Synthetic Oligonucleotide; PD-1 exon 2; Set C
gaggugaggaaggggcuggguggccccacaaag

SEQ ID NO: 3493 - RNA, 15 nt, Artificial Sequence
  Synthetic Oligonucleotide; PD-1 exon 2; Set C
gaaggggcugggugg

SEQ ID NO: 3494 - RNA, 16 nt, Artificial Sequence
  Synthetic Oligonucleotide; PD-1 exon 2; Set A
ggaaggggcugggugg

SEQ ID NO: 3495 - RNA, 15 nt, Artificial Sequence
  Synthetic Oligonucleotide; PD-1 exon 2; Set C
ggaaggggcugggug

SEQ ID NO: 3496 - RNA, 17 nt, Artificial Sequence
  Synthetic Oligonucleotide; PD-1 exon 2; Set A
aggaaggggcugggugg

SEQ ID NO: 3497 - RNA, 16 nt, Artificial Sequence
  Synthetic Oligonucleotide; PD-1 exon 2; Set C
aggaaggggcugggug

SEQ ID NO: 3498 - RNA, 18 nt, Artificial Sequence
  Synthetic Oligonucleotide; PD-1 exon 2; Set A
gaggaaggggcugggugg

SEQ ID NO: 3499 - RNA, 17 nt, Artificial Sequence
  Synthetic Oligonucleotide; PD-1 exon 2; Set A
gaggaaggggcugggug

SEQ ID NO: 3500 - RNA, 15 nt, Artificial Sequence
  Synthetic Oligonucleotide; PD-1 exon 2; Set C
aggaaggggcugggu

SEQ ID NO: 3501 - RNA, 39 nt, Artificial Sequence
  Synthetic Oligonucleotide; PD-1 exon 2; Set C
uggagagaggugaggaaggggcuggguggccccacaaag

SEQ ID NO: 3502 - RNA, 19 nt, Artificial Sequence
  Synthetic Oligonucleotide; PD-1 exon 2; Set A
ugaggaaggggcugggugg

SEQ ID NO: 3503 - RNA, 18 nt, Artificial Sequence
  Synthetic Oligonucleotide; PD-1 exon 2; Set A
ugaggaaggggcugggug

SEQ ID NO: 3504 - RNA, 16 nt, Artificial Sequence
  Synthetic Oligonucleotide; PD-1 exon 2; Set A
gaggaaggggcugggu

SEQ ID NO: 3505 - RNA, 38 nt, Artificial Sequence
  Synthetic Oligonucleotide; PD-1 exon 2; Set C
uggagagaggugaggaaggggcuggguggccccacaaa

SEQ ID NO: 3506 - RNA, 17 nt, Artificial Sequence
  Synthetic Oligonucleotide; PD-1 exon 2; Set A
ugaggaaggggcugggu

SEQ ID NO: 3507 - RNA, 37 nt, Artificial Sequence
  Synthetic Oligonucleotide; PD-1 exon 2; Set C
uggagagaggugaggaaggggcuggguggccccacaa

SEQ ID NO: 3508 - RNA, 15 nt, Artificial Sequence
  Synthetic Oligonucleotide; PD-1 exon 2; Set C
gaggaaggggcuggg

SEQ ID NO: 3509 - RNA, 36 nt, Artificial Sequence
  Synthetic Oligonucleotide; PD-1 exon 2; Set C
uggagagaggugaggaaggggcuggguggccccaca

SEQ ID NO: 3510 - RNA, 16 nt, Artificial Sequence
  Synthetic Oligonucleotide; PD-1 exon 2; Set C
ugaggaaggggcuggg

SEQ ID NO: 3511 - RNA, 15 nt, Artificial Sequence
  Synthetic Oligonucleotide; PD-1 exon 2; Set C
ugaggaaggggcugg

SEQ ID NO: 3512 - RNA, 22 nt, Artificial Sequence
  Synthetic Oligonucleotide; PD-1 exon 2; Set A
gaggugaggaaggggcugggug

SEQ ID NO: 3513 - RNA, 21 nt, Artificial Sequence
  Synthetic Oligonucleotide; PD-1 exon 2; Set C
gaggugaggaaggggcugggu

SEQ ID NO: 3514 - RNA, 20 nt, Artificial Sequence
  Synthetic Oligonucleotide; PD-1 exon 2; Set A
gaggugaggaaggggcuggg

SEQ ID NO: 3515 - RNA, 29 nt, Artificial Sequence
  Synthetic Oligonucleotide; PD-1 exon 2; Set C
uggagagaggugaggaaggggcugggugg

SEQ ID NO: 3516 - RNA, 28 nt, Artificial Sequence
  Synthetic Oligonucleotide; PD-1 exon 2; Set C
uggagagaggugaggaaggggcugggug

SEQ ID NO: 3517 - RNA, 27 nt, Artificial Sequence
  Synthetic Oligonucleotide; PD-1 exon 2; Set C
uggagagaggugaggaaggggcugggu

SEQ ID NO: 3518 - RNA, 26 nt, Artificial Sequence
  Synthetic Oligonucleotide; PD-1 exon 2; Set C
uggagagaggugaggaaggggcuggg

SEQ ID NO: 3519 - RNA, 25 nt, Artificial Sequence
  Synthetic Oligonucleotide; PD-1 exon 2; Set C
uggagagaggugaggaaggggcugg

SEQ ID NO: 3520 - RNA, 38 nt, Artificial Sequence
  Synthetic Oligonucleotide; PD-1 exon 2; Set C
ucugagagauggagagaggugaggaaggggcugggugg

SEQ ID NO: 3521 - RNA, 37 nt, Artificial Sequence
  Synthetic Oligonucleotide; PD-1 exon 2; Set C
ucugagagauggagagaggugaggaaggggcugggug

SEQ ID NO: 3522 - RNA, 39 nt, Artificial Sequence
  Synthetic Oligonucleotide; PD-1 exon 2; Set C
gucugagagauggagagaggugaggaaggggcugggugg

SEQ ID NO: 3523 - RNA, 38 nt, Artificial Sequence
  Synthetic Oligonucleotide; PD-1 exon 2; Set C
gucugagagauggagagaggugaggaaggggcugggug

SEQ ID NO: 3524 - RNA, 36 nt, Artificial Sequence
  Synthetic Oligonucleotide; PD-1 exon 2; Set C
ucugagagauggagagaggugaggaaggggcugggu

SEQ ID NO: 3525 - RNA, 40 nt, Artificial Sequence
  Synthetic Oligonucleotide; PD-1 exon 2; Set C
agucugagagauggagagaggugaggaaggggcugggugg

SEQ ID NO: 3526 - RNA, 39 nt, Artificial Sequence
  Synthetic Oligonucleotide; PD-1 exon 2; Set C
agucugagagauggagagaggugaggaaggggcugggug

SEQ ID NO: 3527 - RNA, 17 nt, Artificial Sequence
  Synthetic Oligonucleotide; PD-1 exon 2; Set C
uggagagaggugaggaa

SEQ ID NO: 3528 - RNA, 37 nt, Artificial Sequence
  Synthetic Oligonucleotide; PD-1 exon 2; Set C
gucugagagauggagagaggugaggaaggggcugggu

SEQ ID NO: 3529 - RNA, 35 nt, Artificial Sequence
  Synthetic Oligonucleotide; PD-1 exon 2; Set C
ucugagagauggagagaggugaggaaggggcuggg

SEQ ID NO: 3530 - RNA, 40 nt, Artificial Sequence
  Synthetic Oligonucleotide; PD-1 exon 2; Set C
gagucugagagauggagagaggugaggaaggggcugggug

SEQ ID NO: 3531 - RNA, 38 nt, Artificial Sequence
  Synthetic Oligonucleotide; PD-1 exon 2; Set C
agucugagagauggagagaggugaggaaggggcugggu

SEQ ID NO: 3532 - RNA, 36 nt, Artificial Sequence
  Synthetic Oligonucleotide; PD-1 exon 2; Set C
gucugagagauggagagaggugaggaaggggcuggg

SEQ ID NO: 3533 - RNA, 34 nt, Artificial Sequence
  Synthetic Oligonucleotide; PD-1 exon 2; Set C
ucugagagauggagagaggugaggaaggggcugg

SEQ ID NO: 3534 - RNA, 16 nt, Artificial Sequence
  Synthetic Oligonucleotide; PD-1 exon 2; Set C
uggagagaggugagga

SEQ ID NO: 3535 - RNA, 39 nt, Artificial Sequence
  Synthetic Oligonucleotide; PD-1 exon 2; Set C
gagucugagagauggagagaggugaggaaggggcugggu

SEQ ID NO: 3536 - RNA, 37 nt, Artificial Sequence
  Synthetic Oligonucleotide; PD-1 exon 2; Set C
agucugagagauggagagaggugaggaaggggcuggg

SEQ ID NO: 3537 - RNA, 35 nt, Artificial Sequence
  Synthetic Oligonucleotide; PD-1 exon 2; Set C
gucugagagauggagagaggugaggaaggggcugg

SEQ ID NO: 3538 - RNA, 15 nt, Artificial Sequence
  Synthetic Oligonucleotide; PD-1 exon 2; Set C
uggagagaggugagg

SEQ ID NO: 3539 - RNA, 40 nt, Artificial Sequence
  Synthetic Oligonucleotide; PD-1 exon 2; Set C
ggagucugagagauggagagaggugaggaaggggcugggu

SEQ ID NO: 3540 - RNA, 38 nt, Artificial Sequence
  Synthetic Oligonucleotide; PD-1 exon 2; Set C
gagucugagagauggagagaggugaggaaggggcuggg

SEQ ID NO: 3541 - RNA, 36 nt, Artificial Sequence
  Synthetic Oligonucleotide; PD-1 exon 2; Set C
agucugagagauggagagaggugaggaaggggcugg

SEQ ID NO: 3542 - RNA, 21 nt, Artificial Sequence
  Synthetic Oligonucleotide; PD-1 exon 2; Set C
gagauggagagaggugaggaa

SEQ ID NO: 3543 - RNA, 39 nt, Artificial Sequence
  Synthetic Oligonucleotide; PD-1 exon 2; Set C
ggagucugagagauggagagaggugaggaaggggcuggg

SEQ ID NO: 3544 - RNA, 37 nt, Artificial Sequence
  Synthetic Oligonucleotide; PD-1 exon 2; Set C
gagucugagagauggagagaggugaggaaggggcugg

SEQ ID NO: 3545 - RNA, 22 nt, Artificial Sequence
  Synthetic Oligonucleotide; PD-1 exon 2; Set C
agagauggagagaggugaggaa

SEQ ID NO: 3546 - RNA, 40 nt, Artificial Sequence
  Synthetic Oligonucleotide; PD-1 exon 2; Set C
gggagucugagagauggagagaggugaggaaggggcuggg

SEQ ID NO: 3547 - RNA, 38 nt, Artificial Sequence
  Synthetic Oligonucleotide; PD-1 exon 2; Set C
ggagucugagagauggagagaggugaggaaggggcugg

SEQ ID NO: 3548 - RNA, 20 nt, Artificial Sequence
  Synthetic Oligonucleotide; PD-1 exon 2; Set C
gagauggagagaggugagga

SEQ ID NO: 3549 - RNA, 39 nt, Artificial Sequence
  Synthetic Oligonucleotide; PD-1 exon 2; Set C
gggagucugagagauggagagaggugaggaaggggcugg

SEQ ID NO: 3550 - RNA, 21 nt, Artificial Sequence
  Synthetic Oligonucleotide; PD-1 exon 2; Set A
agagauggagagaggugagga

SEQ ID NO: 3551 - RNA, 40 nt, Artificial Sequence
  Synthetic Oligonucleotide; PD-1 exon 2; Set C
ggggagucugagagauggagagaggugaggaaggggcugg

SEQ ID NO: 3552 - RNA, 26 nt, Artificial Sequence
  Synthetic Oligonucleotide; PD-1 exon 2; Set A
ucugagagauggagagaggugaggaa

SEQ ID NO: 3553 - RNA, 25 nt, Artificial Sequence
  Synthetic Oligonucleotide; PD-1 exon 2; Set A
ucugagagauggagagaggugagga

SEQ ID NO: 3554 - RNA, 28 nt, Artificial Sequence
  Synthetic Oligonucleotide; PD-1 exon 2; Set A
agucugagagauggagagaggugaggaa

SEQ ID NO: 3555 - RNA, 26 nt, Artificial Sequence
  Synthetic Oligonucleotide; PD-1 exon 2; Set A
gucugagagauggagagaggugagga

SEQ ID NO: 3556 - RNA, 24 nt, Artificial Sequence
  Synthetic Oligonucleotide; PD-1 exon 2; Set A
ucugagagauggagagaggugagg

SEQ ID NO: 3557 - RNA, 29 nt, Artificial Sequence
  Synthetic Oligonucleotide; PD-1 exon 2; Set A
gagucugagagauggagagaggugaggaa

SEQ ID NO: 3558 - RNA, 27 nt, Artificial Sequence
  Synthetic Oligonucleotide; PD-1 exon 2; Set A
agucugagagauggagagaggugagga

SEQ ID NO: 3559 - RNA, 25 nt, Artificial Sequence
  Synthetic Oligonucleotide; PD-1 exon 2; Set A
gucugagagauggagagaggugagg

SEQ ID NO: 3560 - RNA, 23 nt, Artificial Sequence
  Synthetic Oligonucleotide; PD-1 exon 2; Set A
ucugagagauggagagaggugag

SEQ ID NO: 3561 - RNA, 30 nt, Artificial Sequence
  Synthetic Oligonucleotide; PD-1 exon 2; Set C
ggagucugagagauggagagaggugaggaa

SEQ ID NO: 3562 - RNA, 28 nt, Artificial Sequence
  Synthetic Oligonucleotide; PD-1 exon 2; Set A
gagucugagagauggagagaggugagga

SEQ ID NO: 3563 - RNA, 26 nt, Artificial Sequence
  Synthetic Oligonucleotide; PD-1 exon 2; Set A
agucugagagauggagagaggugagg

SEQ ID NO: 3564 - RNA, 24 nt, Artificial Sequence
  Synthetic Oligonucleotide; PD-1 exon 2; Set A
gucugagagauggagagaggugag

SEQ ID NO: 3565 - RNA, 22 nt, Artificial Sequence
  Synthetic Oligonucleotide; PD-1 exon 2; Set A
ucugagagauggagagagguga

SEQ ID NO: 3566 - RNA, 29 nt, Artificial Sequence
  Synthetic Oligonucleotide; PD-1 exon 2; Set C
ggagucugagagauggagagaggugagga

SEQ ID NO: 3567 - RNA, 27 nt, Artificial Sequence
  Synthetic Oligonucleotide; PD-1 exon 2; Set A
gagucugagagauggagagaggugagg

SEQ ID NO: 3568 - RNA, 23 nt, Artificial Sequence
  Synthetic Oligonucleotide; PD-1 exon 2; Set A
gucugagagauggagagagguga

SEQ ID NO: 3569 - RNA, 25 nt, Artificial Sequence
  Synthetic Oligonucleotide; PD-1 exon 2; Set A
agucugagagauggagagaggugag

SEQ ID NO: 3570 - RNA, 30 nt, Artificial Sequence
  Synthetic Oligonucleotide; PD-1 exon 2; Set C
gggagucugagagauggagagaggugagga

SEQ ID NO: 3571 - RNA, 28 nt, Artificial Sequence
  Synthetic Oligonucleotide; PD-1 exon 2; Set A
ggagucugagagauggagagaggugagg

SEQ ID NO: 3572 - RNA, 26 nt, Artificial Sequence
  Synthetic Oligonucleotide; PD-1 exon 2; Set A
gagucugagagauggagagaggugag

SEQ ID NO: 3573 - RNA, 24 nt, Artificial Sequence
  Synthetic Oligonucleotide; PD-1 exon 2; Set A
agucugagagauggagagagguga

SEQ ID NO: 3574 - RNA, 33 nt, Artificial Sequence
  Synthetic Oligonucleotide; PD-1 exon 2; Set C
uggggagucugagagauggagagaggugaggaa

SEQ ID NO: 3575 - RNA, 31 nt, Artificial Sequence
  Synthetic Oligonucleotide; PD-1 exon 2; Set C
ggggagucugagagauggagagaggugagga

SEQ ID NO: 3576 - RNA, 29 nt, Artificial Sequence
  Synthetic Oligonucleotide; PD-1 exon 2; Set C
gggagucugagagauggagagaggugagg

SEQ ID NO: 3577 - RNA, 27 nt, Artificial Sequence
  Synthetic Oligonucleotide; PD-1 exon 2; Set A
ggagucugagagauggagagaggugag

SEQ ID NO: 3578 - RNA, 25 nt, Artificial Sequence
  Synthetic Oligonucleotide; PD-1 exon 2; Set A
gagucugagagauggagagagguga

SEQ ID NO: 3579 - RNA, 34 nt, Artificial Sequence
  Synthetic Oligonucleotide; PD-1 exon 2; Set C
cuggggagucugagagauggagagaggugaggaa

SEQ ID NO: 3580 - RNA, 32 nt, Artificial Sequence
  Synthetic Oligonucleotide; PD-1 exon 2; Set C
uggggagucugagagauggagagaggugagga

SEQ ID NO: 3581 - RNA, 30 nt, Artificial Sequence
  Synthetic Oligonucleotide; PD-1 exon 2; Set C
ggggagucugagagauggagagaggugagg

SEQ ID NO: 3582 - RNA, 28 nt, Artificial Sequence
  Synthetic Oligonucleotide; PD-1 exon 2; Set A
gggagucugagagauggagagaggugag

SEQ ID NO: 3583 - RNA, 26 nt, Artificial Sequence
  Synthetic Oligonucleotide; PD-1 exon 2; Set A
ggagucugagagauggagagagguga

SEQ ID NO: 3584 - RNA, 35 nt, Artificial Sequence
  Synthetic Oligonucleotide; PD-1 exon 2; Set C
ucuggggagucugagagauggagagaggugaggaa

SEQ ID NO: 3585 - RNA, 33 nt, Artificial Sequence
  Synthetic Oligonucleotide; PD-1 exon 2; Set C
cuggggagucugagagauggagagaggugagga

SEQ ID NO: 3586 - RNA, 31 nt, Artificial Sequence
  Synthetic Oligonucleotide; PD-1 exon 2; Set C
uggggagucugagagauggagagaggugagg

SEQ ID NO: 3587 - RNA, 27 nt, Artificial Sequence
  Synthetic Oligonucleotide; PD-1 exon 2; Set C
gggagucugagagauggagagagguga

SEQ ID NO: 3588 - RNA, 29 nt, Artificial Sequence
  Synthetic Oligonucleotide; PD-1 exon 2; Set C
ggggagucugagagauggagagaggugag

SEQ ID NO: 3589 - RNA, 19 nt, Artificial Sequence
  Synthetic Oligonucleotide; PD-1 exon 2; Set C
gucugagagauggagagag

SEQ ID NO: 3590 - RNA, 36 nt, Artificial Sequence
  Synthetic Oligonucleotide; PD-1 exon 2; Set C
gucuggggagucugagagauggagagaggugaggaa

SEQ ID NO: 3591 - RNA, 34 nt, Artificial Sequence
  Synthetic Oligonucleotide; PD-1 exon 2; Set C
ucuggggagucugagagauggagagaggugagga

SEQ ID NO: 3592 - RNA, 32 nt, Artificial Sequence
  Synthetic Oligonucleotide; PD-1 exon 2; Set C
cuggggagucugagagauggagagaggugagg

SEQ ID NO: 3593 - RNA, 28 nt, Artificial Sequence
  Synthetic Oligonucleotide; PD-1 exon 2; Set C
ggggagucugagagauggagagagguga

SEQ ID NO: 3594 - RNA, 30 nt, Artificial Sequence
  Synthetic Oligonucleotide; PD-1 exon 2; Set C
uggggagucugagagauggagagaggugag

SEQ ID NO: 3595 - RNA, 37 nt, Artificial Sequence
  Synthetic Oligonucleotide; PD-1 exon 2; Set C
ugucuggggagucugagagauggagagaggugaggaa

SEQ ID NO: 3596 - RNA, 35 nt, Artificial Sequence
  Synthetic Oligonucleotide; PD-1 exon 2; Set C
gucuggggagucugagagauggagagaggugagga

SEQ ID NO: 3597 - RNA, 33 nt, Artificial Sequence
  Synthetic Oligonucleotide; PD-1 exon 2; Set C
ucuggggagucugagagauggagagaggugagg

SEQ ID NO: 3598 - RNA, 29 nt, Artificial Sequence
  Synthetic Oligonucleotide; PD-1 exon 2; Set C
uggggagucugagagauggagagagguga

SEQ ID NO: 3599 - RNA, 31 nt, Artificial Sequence
  Synthetic Oligonucleotide; PD-1 exon 2; Set C
cuggggagucugagagauggagagaggugag

SEQ ID NO: 3600 - RNA, 36 nt, Artificial Sequence
  Synthetic Oligonucleotide; PD-1 exon 2; Set C
ugucuggggagucugagagauggagagaggugagga

SEQ ID NO: 3601 - RNA, 34 nt, Artificial Sequence
  Synthetic Oligonucleotide; PD-1 exon 2; Set C
gucuggggagucugagagauggagagaggugagg

SEQ ID NO: 3602 - RNA, 32 nt, Artificial Sequence
  Synthetic Oligonucleotide; PD-1 exon 2; Set C
ucuggggagucugagagauggagagaggugag

SEQ ID NO: 3603 - RNA, 30 nt, Artificial Sequence
  Synthetic Oligonucleotide; PD-1 exon 2; Set C
cuggggagucugagagauggagagagguga

SEQ ID NO: 3604 - RNA, 35 nt, Artificial Sequence
  Synthetic Oligonucleotide; PD-1 exon 2; Set C
ugucuggggagucugagagauggagagaggugagg

SEQ ID NO: 3605 - RNA, 33 nt, Artificial Sequence
  Synthetic Oligonucleotide; PD-1 exon 2; Set C
gucuggggagucugagagauggagagaggugag

SEQ ID NO: 3606 - RNA, 31 nt, Artificial Sequence
  Synthetic Oligonucleotide; PD-1 exon 2; Set C
ucuggggagucugagagauggagagagguga

SEQ ID NO: 3607 - RNA, 23 nt, Artificial Sequence
  Synthetic Oligonucleotide; PD-1 exon 2; Set A
gggagucugagagauggagagag

SEQ ID NO: 3608 - RNA, 34 nt, Artificial Sequence
  Synthetic Oligonucleotide; PD-1 exon 2; Set C
ugucuggggagucugagagauggagagaggugag

SEQ ID NO: 3609 - RNA, 32 nt, Artificial Sequence
  Synthetic Oligonucleotide; PD-1 exon 2; Set C
gucuggggagucugagagauggagagagguga

SEQ ID NO: 3610 - RNA, 24 nt, Artificial Sequence
  Synthetic Oligonucleotide; PD-1 exon 2; Set A
ggggagucugagagauggagagag

SEQ ID NO: 3611 - RNA, 33 nt, Artificial Sequence
  Synthetic Oligonucleotide; PD-1 exon 2; Set C
ugucuggggagucugagagauggagagagguga

SEQ ID NO: 3612 - RNA, 25 nt, Artificial Sequence
  Synthetic Oligonucleotide; PD-1 exon 2; Set A
uggggagucugagagauggagagag

SEQ ID NO: 3613 - RNA, 15 nt, Artificial Sequence
  Synthetic Oligonucleotide; PD-1 exon 2; Set C
agucugagagaugga

SEQ ID NO: 3614 - RNA, 16 nt, Artificial Sequence
  Synthetic Oligonucleotide; PD-1 exon 2; Set C
gagucugagagaugga

SEQ ID NO: 3615 - RNA, 15 nt, Artificial Sequence
  Synthetic Oligonucleotide; PD-1 exon 2; Set C
gagucugagagaugg

SEQ ID NO: 3616 - RNA, 17 nt, Artificial Sequence
  Synthetic Oligonucleotide; PD-1 exon 2; Set C
ggagucugagagaugga

SEQ ID NO: 3617 - RNA, 16 nt, Artificial Sequence
  Synthetic Oligonucleotide; PD-1 exon 2; Set C
ggagucugagagaugg

SEQ ID NO: 3618 - RNA, 18 nt, Artificial Sequence
  Synthetic Oligonucleotide; PD-1 exon 2; Set C
gggagucugagagaugga

SEQ ID NO: 3619 - RNA, 29 nt, Artificial Sequence
  Synthetic Oligonucleotide; PD-1 exon 2; Set C
ugucuggggagucugagagauggagagag

SEQ ID NO: 3620 - RNA, 19 nt, Artificial Sequence
  Synthetic Oligonucleotide; PD-1 exon 2; Set A
ggggagucugagagaugga

SEQ ID NO: 3621 - RNA, 20 nt, Artificial Sequence
  Synthetic Oligonucleotide; PD-1 exon 2; Set A
uggggagucugagagaugga

SEQ ID NO: 3622 - RNA, 21 nt, Artificial Sequence
  Synthetic Oligonucleotide; PD-1 exon 2; Set A
cuggggagucugagagaugga

SEQ ID NO: 3623 - RNA, 20 nt, Artificial Sequence
  Synthetic Oligonucleotide; PD-1 exon 2; Set A
cuggggagucugagagaugg

SEQ ID NO: 3624 - RNA, 22 nt, Artificial Sequence
  Synthetic Oligonucleotide; PD-1 exon 2; Set A
ucuggggagucugagagaugga

SEQ ID NO: 3625 - RNA, 21 nt, Artificial Sequence
  Synthetic Oligonucleotide; PD-1 exon 2; Set A
ucuggggagucugagagaugg

SEQ ID NO: 3626 - RNA, 23 nt, Artificial Sequence
  Synthetic Oligonucleotide; PD-1 exon 2; Set A
gucuggggagucugagagaugga

SEQ ID NO: 3627 - RNA, 22 nt, Artificial Sequence
  Synthetic Oligonucleotide; PD-1 exon 2; Set A
gucuggggagucugagagaugg

SEQ ID NO: 3628 - RNA, 24 nt, Artificial Sequence
  Synthetic Oligonucleotide; PD-1 exon 2; Set A
ugucuggggagucugagagaugga

SEQ ID NO: 3629 - RNA, 23 nt, Artificial Sequence
  Synthetic Oligonucleotide; PD-1 exon 2; Set A
ugucuggggagucugagagaugg

SEQ ID NO: 3630 - RNA, 15 nt, Artificial Sequence
  Synthetic Oligonucleotide; PD-1 exon 2; Set C
uggggagucugagag

SEQ ID NO: 3631 - RNA, 16 nt, Artificial Sequence
  Synthetic Oligonucleotide; PD-1 exon 2; Set C
cuggggagucugagag

SEQ ID NO: 3632 - RNA, 17 nt, Artificial Sequence
  Synthetic Oligonucleotide; PD-1 exon 2; Set C
ucuggggagucugagag

SEQ ID NO: 3633 - RNA, 15 nt, Artificial Sequence
  Synthetic Oligonucleotide; PD-1 exon 2; Set C
cuggggagucugaga

SEQ ID NO: 3634 - RNA, 18 nt, Artificial Sequence
  Synthetic Oligonucleotide; PD-1 exon 2; Set C
gucuggggagucugagag

SEQ ID NO: 3635 - RNA, 16 nt, Artificial Sequence
  Synthetic Oligonucleotide; PD-1 exon 2; Set C
ucuggggagucugaga

SEQ ID NO: 3636 - RNA, 19 nt, Artificial Sequence
  Synthetic Oligonucleotide; PD-1 exon 2; Set C
ugucuggggagucugagag

SEQ ID NO: 3637 - RNA, 17 nt, Artificial Sequence
  Synthetic Oligonucleotide; PD-1 exon 2; Set C
gucuggggagucugaga

SEQ ID NO: 3638 - RNA, 40 nt, Artificial Sequence
  Synthetic Oligonucleotide; PD-1 exon 2; Set C
guuccagggccugucuggggagucugagagauggagagag

SEQ ID NO: 3639 - RNA, 18 nt, Artificial Sequence
  Synthetic Oligonucleotide; PD-1 exon 2; Set C
ugucuggggagucugaga

SEQ ID NO: 3640 - RNA, 35 nt, Artificial Sequence
  Synthetic Oligonucleotide; PD-1 exon 2; Set C
guuccagggccugucuggggagucugagagaugga

SEQ ID NO: 3641 - RNA, 34 nt, Artificial Sequence
  Synthetic Oligonucleotide; PD-1 exon 2; Set C
guuccagggccugucuggggagucugagagaugg

SEQ ID NO: 3642 - RNA, 36 nt, Artificial Sequence
  Synthetic Oligonucleotide; PD-1 exon 2; Set C
gguuccagggccugucuggggagucugagagaugga

SEQ ID NO: 3643 - RNA, 35 nt, Artificial Sequence
  Synthetic Oligonucleotide; PD-1 exon 2; Set C
gguuccagggccugucuggggagucugagagaugg

SEQ ID NO: 3644 - RNA, 37 nt, Artificial Sequence
  Synthetic Oligonucleotide; PD-1 exon 2; Set C
ggguuccagggccugucuggggagucugagagaugga

SEQ ID NO: 3645 - RNA, 36 nt, Artificial Sequence
  Synthetic Oligonucleotide; PD-1 exon 2; Set C
ggguuccagggccugucuggggagucugagagaugg

SEQ ID NO: 3646 - RNA, 38 nt, Artificial Sequence
  Synthetic Oligonucleotide; PD-1 exon 2; Set C
gggguuccagggccugucuggggagucugagagaugga

SEQ ID NO: 3647 - RNA, 37 nt, Artificial Sequence
  Synthetic Oligonucleotide; PD-1 exon 2; Set C
gggguuccagggccugucuggggagucugagagaugg

SEQ ID NO: 3648 - RNA, 39 nt, Artificial Sequence
  Synthetic Oligonucleotide; PD-1 exon 2; Set C
ggggguuccagggccugucuggggagucugagagaugga

SEQ ID NO: 3649 - RNA, 38 nt, Artificial Sequence
  Synthetic Oligonucleotide; PD-1 exon 2; Set C
ggggguuccagggccugucuggggagucugagagaugg

SEQ ID NO: 3650 - RNA, 30 nt, Artificial Sequence
  Synthetic Oligonucleotide; PD-1 exon 2; Set C
guuccagggccugucuggggagucugagag

SEQ ID NO: 3651 - RNA, 39 nt, Artificial Sequence
  Synthetic Oligonucleotide; PD-1 exon 2; Set C
gggggguuccagggccugucuggggagucugagagaugg

SEQ ID NO: 3652 - RNA, 29 nt, Artificial Sequence
  Synthetic Oligonucleotide; PD-1 exon 2; Set C
guuccagggccugucuggggagucugaga

SEQ ID NO: 3653 - RNA, 31 nt, Artificial Sequence
  Synthetic Oligonucleotide; PD-1 exon 2; Set C
gguuccagggccugucuggggagucugagag

SEQ ID NO: 3654 - RNA, 40 nt, Artificial Sequence
  Synthetic Oligonucleotide; PD-1 exon 2; Set C
ggggggguuccagggccugucuggggagucugagagaugg

SEQ ID NO: 3655 - RNA, 30 nt, Artificial Sequence
  Synthetic Oligonucleotide; PD-1 exon 2; Set C
gguuccagggccugucuggggagucugaga

SEQ ID NO: 3656 - RNA, 32 nt, Artificial Sequence
  Synthetic Oligonucleotide; PD-1 exon 2; Set C
ggguuccagggccugucuggggagucugagag

SEQ ID NO: 3657 - RNA, 31 nt, Artificial Sequence
  Synthetic Oligonucleotide; PD-1 exon 2; Set C
ggguuccagggccugucuggggagucugaga

SEQ ID NO: 3658 - RNA, 33 nt, Artificial Sequence
  Synthetic Oligonucleotide; PD-1 exon 2; Set C
gggguuccagggccugucuggggagucugagag

SEQ ID NO: 3659 - RNA, 32 nt, Artificial Sequence
  Synthetic Oligonucleotide; PD-1 exon 2; Set C
gggguuccagggccugucuggggagucugaga

SEQ ID NO: 3660 - RNA, 34 nt, Artificial Sequence
  Synthetic Oligonucleotide; PD-1 exon 2; Set C
ggggguuccagggccugucuggggagucugagag

SEQ ID NO: 3661 - RNA, 25 nt, Artificial Sequence
  Synthetic Oligonucleotide; PD-1 exon 2; Set C
guuccagggccugucuggggagucu

SEQ ID NO: 3662 - RNA, 33 nt, Artificial Sequence
  Synthetic Oligonucleotide; PD-1 exon 2; Set C
ggggguuccagggccugucuggggagucugaga

SEQ ID NO: 3663 - RNA, 35 nt, Artificial Sequence
  Synthetic Oligonucleotide; PD-1 exon 2; Set C
gggggguuccagggccugucuggggagucugagag

SEQ ID NO: 3664 - RNA, 24 nt, Artificial Sequence
  Synthetic Oligonucleotide; PD-1 exon 2; Set C
guuccagggccugucuggggaguc

SEQ ID NO: 3665 - RNA, 26 nt, Artificial Sequence
  Synthetic Oligonucleotide; PD-1 exon 2; Set C
gguuccagggccugucuggggagucu

SEQ ID NO: 3666 - RNA, 34 nt, Artificial Sequence
  Synthetic Oligonucleotide; PD-1 exon 2; Set C
gggggguuccagggccugucuggggagucugaga

SEQ ID NO: 3667 - RNA, 25 nt, Artificial Sequence
  Synthetic Oligonucleotide; PD-1 exon 2; Set C
gguuccagggccugucuggggaguc

SEQ ID NO: 3668 - RNA, 27 nt, Artificial Sequence
  Synthetic Oligonucleotide; PD-1 exon 2; Set C
ggguuccagggccugucuggggagucu

SEQ ID NO: 3669 - RNA, 23 nt, Artificial Sequence
  Synthetic Oligonucleotide; PD-1 exon 2; Set C
guuccagggccugucuggggagu

SEQ ID NO: 3670 - RNA, 26 nt, Artificial Sequence
  Synthetic Oligonucleotide; PD-1 exon 2; Set C
ggguuccagggccugucuggggaguc

SEQ ID NO: 3671 - RNA, 28 nt, Artificial Sequence
  Synthetic Oligonucleotide; PD-1 exon 2; Set C
gggguuccagggccugucuggggagucu

SEQ ID NO: 3672 - RNA, 22 nt, Artificial Sequence
  Synthetic Oligonucleotide; PD-1 exon 2; Set C
guuccagggccugucuggggag

SEQ ID NO: 3673 - RNA, 24 nt, Artificial Sequence
  Synthetic Oligonucleotide; PD-1 exon 2; Set C
gguuccagggccugucuggggagu

SEQ ID NO: 3674 - RNA, 27 nt, Artificial Sequence
  Synthetic Oligonucleotide; PD-1 exon 2; Set C
gggguuccagggccugucuggggaguc

SEQ ID NO: 3675 - RNA, 29 nt, Artificial Sequence
  Synthetic Oligonucleotide; PD-1 exon 2; Set C
ggggguuccagggccugucuggggagucu

SEQ ID NO: 3676 - RNA, 21 nt, Artificial Sequence
  Synthetic Oligonucleotide; PD-1 exon 2; Set C
guuccagggccugucugggga

SEQ ID NO: 3677 - RNA, 23 nt, Artificial Sequence
  Synthetic Oligonucleotide; PD-1 exon 2; Set C
gguuccagggccugucuggggag

SEQ ID NO: 3678 - RNA, 25 nt, Artificial Sequence
  Synthetic Oligonucleotide; PD-1 exon 2; Set C
ggguuccagggccugucuggggagu

SEQ ID NO: 3679 - RNA, 28 nt, Artificial Sequence
  Synthetic Oligonucleotide; PD-1 exon 2; Set C
ggggguuccagggccugucuggggaguc

SEQ ID NO: 3680 - RNA, 20 nt, Artificial Sequence
  Synthetic Oligonucleotide; PD-1 exon 2; Set C
guuccagggccugucugggg

SEQ ID NO: 3681 - RNA, 30 nt, Artificial Sequence
  Synthetic Oligonucleotide; PD-1 exon 2; Set C
gggggguuccagggccugucuggggagucu

SEQ ID NO: 3682 - RNA, 22 nt, Artificial Sequence
  Synthetic Oligonucleotide; PD-1 exon 2; Set C
gguuccagggccugucugggga

SEQ ID NO: 3683 - RNA, 24 nt, Artificial Sequence
  Synthetic Oligonucleotide; PD-1 exon 2; Set C
ggguuccagggccugucuggggag

SEQ ID NO: 3684 - RNA, 26 nt, Artificial Sequence
  Synthetic Oligonucleotide; PD-1 exon 2; Set C
gggguuccagggccugucuggggagu

SEQ ID NO: 3685 - RNA, 40 nt, Artificial Sequence
  Synthetic Oligonucleotide; PD-1 exon 2; Set C
agguggggggguuccagggccugucuggggagucugagag

SEQ ID NO: 3686 - RNA, 29 nt, Artificial Sequence
  Synthetic Oligonucleotide; PD-1 exon 2; Set C
gggggguuccagggccugucuggggaguc

SEQ ID NO: 3687 - RNA, 21 nt, Artificial Sequence
  Synthetic Oligonucleotide; PD-1 exon 2; Set C
gguuccagggccugucugggg

SEQ ID NO: 3688 - RNA, 19 nt, Artificial Sequence
  Synthetic Oligonucleotide; PD-1 exon 2; Set A
guuccagggccugucuggg

SEQ ID NO: 3689 - RNA, 31 nt, Artificial Sequence
  Synthetic Oligonucleotide; PD-1 exon 2; Set C
ggggggguuccagggccugucuggggagucu

SEQ ID NO: 3690 - RNA, 23 nt, Artificial Sequence
  Synthetic Oligonucleotide; PD-1 exon 2; Set C
ggguuccagggccugucugggga

SEQ ID NO: 3691 - RNA, 25 nt, Artificial Sequence
  Synthetic Oligonucleotide; PD-1 exon 2; Set C
gggguuccagggccugucuggggag

SEQ ID NO: 3692 - RNA, 27 nt, Artificial Sequence
  Synthetic Oligonucleotide; PD-1 exon 2; Set C
ggggguuccagggccugucuggggagu

SEQ ID NO: 3693 - RNA, 39 nt, Artificial Sequence
  Synthetic Oligonucleotide; PD-1 exon 2; Set C
agguggggggguuccagggccugucuggggagucugaga

SEQ ID NO: 3694 - RNA, 30 nt, Artificial Sequence
  Synthetic Oligonucleotide; PD-1 exon 2; Set C
ggggggguuccagggccugucuggggaguc

SEQ ID NO: 3695 - RNA, 22 nt, Artificial Sequence
  Synthetic Oligonucleotide; PD-1 exon 2; Set C
ggguuccagggccugucugggg

SEQ ID NO: 3696 - RNA, 20 nt, Artificial Sequence
  Synthetic Oligonucleotide; PD-1 exon 2; Set C
gguuccagggccugucuggg

SEQ ID NO: 3697 - RNA, 18 nt, Artificial Sequence
  Synthetic Oligonucleotide; PD-1 exon 2; Set A
guuccagggccugucugg

SEQ ID NO: 3698 - RNA, 24 nt, Artificial Sequence
  Synthetic Oligonucleotide; PD-1 exon 2; Set C
gggguuccagggccugucugggga

SEQ ID NO: 3699 - RNA, 26 nt, Artificial Sequence
  Synthetic Oligonucleotide; PD-1 exon 2; Set C
ggggguuccagggccugucuggggag

SEQ ID NO: 3700 - RNA, 28 nt, Artificial Sequence
  Synthetic Oligonucleotide; PD-1 exon 2; Set C
gggggguuccagggccugucuggggagu

SEQ ID NO: 3701 - RNA, 40 nt, Artificial Sequence
  Synthetic Oligonucleotide; PD-1 exon 2; Set C
aagguggggggguuccagggccugucuggggagucugaga

SEQ ID NO: 3702 - RNA, 31 nt, Artificial Sequence
  Synthetic Oligonucleotide; PD-1 exon 2; Set C
uggggggguuccagggccugucuggggaguc

SEQ ID NO: 3703 - RNA, 23 nt, Artificial Sequence
  Synthetic Oligonucleotide; PD-1 exon 2; Set C
gggguuccagggccugucugggg

SEQ ID NO: 3704 - RNA, 21 nt, Artificial Sequence
  Synthetic Oligonucleotide; PD-1 exon 2; Set C
ggguuccagggccugucuggg

SEQ ID NO: 3705 - RNA, 19 nt, Artificial Sequence
  Synthetic Oligonucleotide; PD-1 exon 2; Set A
gguuccagggccugucugg

SEQ ID NO: 3706 - RNA, 25 nt, Artificial Sequence
  Synthetic Oligonucleotide; PD-1 exon 2; Set C
ggggguuccagggccugucugggga

SEQ ID NO: 3707 - RNA, 27 nt, Artificial Sequence
  Synthetic Oligonucleotide; PD-1 exon 2; Set C
gggggguuccagggccugucuggggag

SEQ ID NO: 3708 - RNA, 29 nt, Artificial Sequence
  Synthetic Oligonucleotide; PD-1 exon 2; Set C
ggggggguuccagggccugucuggggagu

SEQ ID NO: 3709 - RNA, 32 nt, Artificial Sequence
  Synthetic Oligonucleotide; PD-1 exon 2; Set C
guggggggguuccagggccugucuggggaguc

SEQ ID NO: 3710 - RNA, 24 nt, Artificial Sequence
  Synthetic Oligonucleotide; PD-1 exon 2; Set C
ggggguuccagggccugucugggg

SEQ ID NO: 3711 - RNA, 22 nt, Artificial Sequence
  Synthetic Oligonucleotide; PD-1 exon 2; Set C
gggguuccagggccugucuggg

SEQ ID NO: 3712 - RNA, 20 nt, Artificial Sequence
  Synthetic Oligonucleotide; PD-1 exon 2; Set C
ggguuccagggccugucugg

SEQ ID NO: 3713 - RNA, 34 nt, Artificial Sequence
  Synthetic Oligonucleotide; PD-1 exon 2; Set C
gguggggggguuccagggccugucuggggagucu

SEQ ID NO: 3714 - RNA, 26 nt, Artificial Sequence
  Synthetic Oligonucleotide; PD-1 exon 2; Set C
gggggguuccagggccugucugggga

SEQ ID NO: 3715 - RNA, 28 nt, Artificial Sequence
  Synthetic Oligonucleotide; PD-1 exon 2; Set C
ggggggguuccagggccugucuggggag

SEQ ID NO: 3716 - RNA, 33 nt, Artificial Sequence
  Synthetic Oligonucleotide; PD-1 exon 2; Set C
gguggggggguuccagggccugucuggggaguc

SEQ ID NO: 3717 - RNA, 25 nt, Artificial Sequence
  Synthetic Oligonucleotide; PD-1 exon 2; Set C
gggggguuccagggccugucugggg

SEQ ID NO: 3718 - RNA, 23 nt, Artificial Sequence
  Synthetic Oligonucleotide; PD-1 exon 2; Set C
ggggguuccagggccugucuggg

SEQ ID NO: 3719 - RNA, 21 nt, Artificial Sequence
  Synthetic Oligonucleotide; PD-1 exon 2; Set C
gggguuccagggccugucugg

SEQ ID NO: 3720 - RNA, 35 nt, Artificial Sequence
  Synthetic Oligonucleotide; PD-1 exon 2; Set C
agguggggggguuccagggccugucuggggagucu

SEQ ID NO: 3721 - RNA, 27 nt, Artificial Sequence
  Synthetic Oligonucleotide; PD-1 exon 2; Set C
ggggggguuccagggccugucugggga

SEQ ID NO: 3722 - RNA, 34 nt, Artificial Sequence
  Synthetic Oligonucleotide; PD-1 exon 2; Set C
agguggggggguuccagggccugucuggggaguc

SEQ ID NO: 3723 - RNA, 26 nt, Artificial Sequence
  Synthetic Oligonucleotide; PD-1 exon 2; Set C
ggggggguuccagggccugucugggg

SEQ ID NO: 3724 - RNA, 24 nt, Artificial Sequence
  Synthetic Oligonucleotide; PD-1 exon 2; Set C
gggggguuccagggccugucuggg

SEQ ID NO: 3725 - RNA, 22 nt, Artificial Sequence
  Synthetic Oligonucleotide; PD-1 exon 2; Set C
ggggguuccagggccugucugg

SEQ ID NO: 3726 - RNA, 36 nt, Artificial Sequence
  Synthetic Oligonucleotide; PD-1 exon 2; Set C
aagguggggggguuccagggccugucuggggagucu

SEQ ID NO: 3727 - RNA, 32 nt, Artificial Sequence
  Synthetic Oligonucleotide; PD-1 exon 2; Set C
gguggggggguuccagggccugucuggggagu

SEQ ID NO: 3728 - RNA, 35 nt, Artificial Sequence
  Synthetic Oligonucleotide; PD-1 exon 2; Set C
aagguggggggguuccagggccugucuggggaguc

SEQ ID NO: 3729 - RNA, 27 nt, Artificial Sequence
  Synthetic Oligonucleotide; PD-1 exon 2; Set C
uggggggguuccagggccugucugggg

SEQ ID NO: 3730 - RNA, 25 nt, Artificial Sequence
  Synthetic Oligonucleotide; PD-1 exon 2; Set C
ggggggguuccagggccugucuggg

SEQ ID NO: 3731 - RNA, 23 nt, Artificial Sequence
  Synthetic Oligonucleotide; PD-1 exon 2; Set C
gggggguuccagggccugucugg

SEQ ID NO: 3732 - RNA, 37 nt, Artificial Sequence
  Synthetic Oligonucleotide; PD-1 exon 2; Set C
gaagguggggggguuccagggccugucuggggagucu

SEQ ID NO: 3733 - RNA, 31 nt, Artificial Sequence
  Synthetic Oligonucleotide; PD-1 exon 2; Set C
gguggggggguuccagggccugucuggggag

SEQ ID NO: 3734 - RNA, 33 nt, Artificial Sequence
  Synthetic Oligonucleotide; PD-1 exon 2; Set C
agguggggggguuccagggccugucuggggagu

SEQ ID NO: 3735 - RNA, 21 nt, Artificial Sequence
  Synthetic Oligonucleotide; PD-1 exon 2; Set C
ggggguuccagggccugucug

SEQ ID NO: 3736 - RNA, 28 nt, Artificial Sequence
  Synthetic Oligonucleotide; PD-1 exon 2; Set C
guggggggguuccagggccugucugggg

SEQ ID NO: 3737 - RNA, 26 nt, Artificial Sequence
  Synthetic Oligonucleotide; PD-1 exon 2; Set C
uggggggguuccagggccugucuggg

SEQ ID NO: 3738 - RNA, 24 nt, Artificial Sequence
  Synthetic Oligonucleotide; PD-1 exon 2; Set C
ggggggguuccagggccugucugg

SEQ ID NO: 3739 - RNA, 38 nt, Artificial Sequence
  Synthetic Oligonucleotide; PD-1 exon 2; Set C
agaagguggggggguuccagggccugucuggggagucu

SEQ ID NO: 3740 - RNA, 32 nt, Artificial Sequence
  Synthetic Oligonucleotide; PD-1 exon 2; Set C
agguggggggguuccagggccugucuggggag

SEQ ID NO: 3741 - RNA, 34 nt, Artificial Sequence
  Synthetic Oligonucleotide; PD-1 exon 2; Set C
aagguggggggguuccagggccugucuggggagu

SEQ ID NO: 3742 - RNA, 29 nt, Artificial Sequence
  Synthetic Oligonucleotide; PD-1 exon 2; Set C
gguggggggguuccagggccugucugggg

SEQ ID NO: 3743 - RNA, 27 nt, Artificial Sequence
  Synthetic Oligonucleotide; PD-1 exon 2; Set C
guggggggguuccagggccugucuggg

SEQ ID NO: 3744 - RNA, 39 nt, Artificial Sequence
  Synthetic Oligonucleotide; PD-1 exon 2; Set C
gagaagguggggggguuccagggccugucuggggagucu

SEQ ID NO: 3745 - RNA, 33 nt, Artificial Sequence
  Synthetic Oligonucleotide; PD-1 exon 2; Set C
aagguggggggguuccagggccugucuggggag

SEQ ID NO: 3746 - RNA, 31 nt, Artificial Sequence
  Synthetic Oligonucleotide; PD-1 exon 2; Set C
agguggggggguuccagggccugucugggga

SEQ ID NO: 3747 - RNA, 35 nt, Artificial Sequence
  Synthetic Oligonucleotide; PD-1 exon 2; Set C
gaagguggggggguuccagggccugucuggggagu

SEQ ID NO: 3748 - RNA, 38 nt, Artificial Sequence
  Synthetic Oligonucleotide; PD-1 exon 2; Set C
gagaagguggggggguuccagggccugucuggggaguc

SEQ ID NO: 3749 - RNA, 30 nt, Artificial Sequence
  Synthetic Oligonucleotide; PD-1 exon 2; Set C
agguggggggguuccagggccugucugggg

SEQ ID NO: 3750 - RNA, 28 nt, Artificial Sequence
  Synthetic Oligonucleotide; PD-1 exon 2; Set C
gguggggggguuccagggccugucuggg

SEQ ID NO: 3751 - RNA, 34 nt, Artificial Sequence
  Synthetic Oligonucleotide; PD-1 exon 2; Set C
gaagguggggggguuccagggccugucuggggag

SEQ ID NO: 3752 - RNA, 32 nt, Artificial Sequence
  Synthetic Oligonucleotide; PD-1 exon 2; Set C
aagguggggggguuccagggccugucugggga

SEQ ID NO: 3753 - RNA, 36 nt, Artificial Sequence
  Synthetic Oligonucleotide; PD-1 exon 2; Set C
agaagguggggggguuccagggccugucuggggagu

SEQ ID NO: 3754 - RNA, 18 nt, Artificial Sequence
  Synthetic Oligonucleotide; PD-1 exon 2; Set C
ggggguuccagggccugu

SEQ ID NO: 3755 - RNA, 39 nt, Artificial Sequence
  Synthetic Oligonucleotide; PD-1 exon 2; Set C
ggagaagguggggggguuccagggccugucuggggaguc

SEQ ID NO: 3756 - RNA, 31 nt, Artificial Sequence
  Synthetic Oligonucleotide; PD-1 exon 2; Set C
aagguggggggguuccagggccugucugggg

SEQ ID NO: 3757 - RNA, 29 nt, Artificial Sequence
  Synthetic Oligonucleotide; PD-1 exon 2; Set C
agguggggggguuccagggccugucuggg

SEQ ID NO: 3758 - RNA, 35 nt, Artificial Sequence
  Synthetic Oligonucleotide; PD-1 exon 2; Set C
agaagguggggggguuccagggccugucuggggag

SEQ ID NO: 3759 - RNA, 33 nt, Artificial Sequence
  Synthetic Oligonucleotide; PD-1 exon 2; Set C
gaagguggggggguuccagggccugucugggga

SEQ ID NO: 3760 - RNA, 37 nt, Artificial Sequence
  Synthetic Oligonucleotide; PD-1 exon 2; Set C
gagaagguggggggguuccagggccugucuggggagu

SEQ ID NO: 3761 - RNA, 32 nt, Artificial Sequence
  Synthetic Oligonucleotide; PD-1 exon 2; Set C
gaagguggggggguuccagggccugucugggg

SEQ ID NO: 3762 - RNA, 30 nt, Artificial Sequence
  Synthetic Oligonucleotide; PD-1 exon 2; Set C
aagguggggggguuccagggccugucuggg

SEQ ID NO: 3763 - RNA, 28 nt, Artificial Sequence
  Synthetic Oligonucleotide; PD-1 exon 2; Set C
agguggggggguuccagggccugucugg

SEQ ID NO: 3764 - RNA, 34 nt, Artificial Sequence
  Synthetic Oligonucleotide; PD-1 exon 2; Set C
agaagguggggggguuccagggccugucugggga

SEQ ID NO: 3765 - RNA, 36 nt, Artificial Sequence
  Synthetic Oligonucleotide; PD-1 exon 2; Set C
gagaagguggggggguuccagggccugucuggggag

SEQ ID NO: 3766 - RNA, 31 nt, Artificial Sequence
  Synthetic Oligonucleotide; PD-1 exon 2; Set C
gaagguggggggguuccagggccugucuggg

SEQ ID NO: 3767 - RNA, 29 nt, Artificial Sequence
  Synthetic Oligonucleotide; PD-1 exon 2; Set C
aagguggggggguuccagggccugucugg

SEQ ID NO: 3768 - RNA, 35 nt, Artificial Sequence
  Synthetic Oligonucleotide; PD-1 exon 2; Set C
gagaagguggggggguuccagggccugucugggga

SEQ ID NO: 3769 - RNA, 27 nt, Artificial Sequence
  Synthetic Oligonucleotide; PD-1 exon 2; Set C
agguggggggguuccagggccugucug

SEQ ID NO: 3770 - RNA, 34 nt, Artificial Sequence
  Synthetic Oligonucleotide; PD-1 exon 2; Set C
gagaagguggggggguuccagggccugucugggg

SEQ ID NO: 3771 - RNA, 32 nt, Artificial Sequence
  Synthetic Oligonucleotide; PD-1 exon 2; Set C
agaagguggggggguuccagggccugucuggg

SEQ ID NO: 3772 - RNA, 30 nt, Artificial Sequence
  Synthetic Oligonucleotide; PD-1 exon 2; Set C
gaagguggggggguuccagggccugucugg

SEQ ID NO: 3773 - RNA, 28 nt, Artificial Sequence
  Synthetic Oligonucleotide; PD-1 exon 2; Set C
aagguggggggguuccagggccugucug

SEQ ID NO: 3774 - RNA, 26 nt, Artificial Sequence
  Synthetic Oligonucleotide; PD-1 exon 2; Set C
agguggggggguuccagggccugucu

SEQ ID NO: 3775 - RNA, 35 nt, Artificial Sequence
  Synthetic Oligonucleotide; PD-1 exon 2; Set C
ggagaagguggggggguuccagggccugucugggg

SEQ ID NO: 3776 - RNA, 33 nt, Artificial Sequence
  Synthetic Oligonucleotide; PD-1 exon 2; Set C
gagaagguggggggguuccagggccugucuggg

SEQ ID NO: 3777 - RNA, 31 nt, Artificial Sequence
  Synthetic Oligonucleotide; PD-1 exon 2; Set C
agaagguggggggguuccagggccugucugg

SEQ ID NO: 3778 - RNA, 29 nt, Artificial Sequence
  Synthetic Oligonucleotide; PD-1 exon 2; Set C
gaagguggggggguuccagggccugucug

SEQ ID NO: 3779 - RNA, 27 nt, Artificial Sequence
  Synthetic Oligonucleotide; PD-1 exon 2; Set C
aagguggggggguuccagggccugucu

SEQ ID NO: 3780 - RNA, 25 nt, Artificial Sequence
  Synthetic Oligonucleotide; PD-1 exon 2; Set C
agguggggggguuccagggccuguc

SEQ ID NO: 3781 - RNA, 34 nt, Artificial Sequence
  Synthetic Oligonucleotide; PD-1 exon 2; Set C
ggagaagguggggggguuccagggccugucuggg

SEQ ID NO: 3782 - RNA, 32 nt, Artificial Sequence
  Synthetic Oligonucleotide; PD-1 exon 2; Set C
gagaagguggggggguuccagggccugucugg

SEQ ID NO: 3783 - RNA, 24 nt, Artificial Sequence
  Synthetic Oligonucleotide; PD-1 exon 2; Set C
agguggggggguuccagggccugu

SEQ ID NO: 3784 - RNA, 30 nt, Artificial Sequence
  Synthetic Oligonucleotide; PD-1 exon 2; Set C
agaagguggggggguuccagggccugucug

SEQ ID NO: 3785 - RNA, 28 nt, Artificial Sequence
  Synthetic Oligonucleotide; PD-1 exon 2; Set C
gaagguggggggguuccagggccugucu

SEQ ID NO: 3786 - RNA, 26 nt, Artificial Sequence
  Synthetic Oligonucleotide; PD-1 exon 2; Set C
aagguggggggguuccagggccuguc

SEQ ID NO: 3787 - RNA, 25 nt, Artificial Sequence
  Synthetic Oligonucleotide; PD-1 exon 2; Set C
aagguggggggguuccagggccugu

SEQ ID NO: 3788 - RNA, 29 nt, Artificial Sequence
  Synthetic Oligonucleotide; PD-1 exon 2; Set C
agaagguggggggguuccagggccugucu

SEQ ID NO: 3789 - RNA, 27 nt, Artificial Sequence
  Synthetic Oligonucleotide; PD-1 exon 2; Set C
gaagguggggggguuccagggccuguc

SEQ ID NO: 3790 - RNA, 31 nt, Artificial Sequence
  Synthetic Oligonucleotide; PD-1 exon 2; Set C
gagaagguggggggguuccagggccugucug

SEQ ID NO: 3791 - RNA, 26 nt, Artificial Sequence
  Synthetic Oligonucleotide; PD-1 exon 2; Set C
gaagguggggggguuccagggccugu

SEQ ID NO: 3792 - RNA, 28 nt, Artificial Sequence
  Synthetic Oligonucleotide; PD-1 exon 2; Set C
agaagguggggggguuccagggccuguc

SEQ ID NO: 3793 - RNA, 30 nt, Artificial Sequence
  Synthetic Oligonucleotide; PD-1 exon 2; Set C
gagaagguggggggguuccagggccugucu

SEQ ID NO: 3794 - RNA, 27 nt, Artificial Sequence
  Synthetic Oligonucleotide; PD-1 exon 2; Set C
agaagguggggggguuccagggccugu

SEQ ID NO: 3795 - RNA, 29 nt, Artificial Sequence
  Synthetic Oligonucleotide; PD-1 exon 2; Set C
gagaagguggggggguuccagggccuguc

SEQ ID NO: 3796 - RNA, 28 nt, Artificial Sequence
  Synthetic Oligonucleotide; PD-1 exon 2; Set C
gagaagguggggggguuccagggccugu

SEQ ID NO: 3797 - RNA, 18 nt, Artificial Sequence
  Synthetic Oligonucleotide; PD-1 exon 2; Set A
ggagaagguggggggguu

SEQ ID NO: 3798 - RNA, 17 nt, Artificial Sequence
  Synthetic Oligonucleotide; PD-1 exon 2; Set A
ggagaaggugggggggu

SEQ ID NO: 3799 - RNA, 16 nt, Artificial Sequence
  Synthetic Oligonucleotide; PD-1 exon 2; Set A
ggagaagguggggggg

SEQ ID NO: 3800 - RNA, 15 nt, Artificial Sequence
  Synthetic Oligonucleotide; PD-1 exon 2; Set C
ggagaaggugggggg

SEQ ID NO: 3801 - RNA, 25 nt, Artificial Sequence
  Synthetic Oligonucleotide; PD-1 exon 2; Set C
gggcuggggagaagguggggggguu

SEQ ID NO: 3802 - RNA, 26 nt, Artificial Sequence
  Synthetic Oligonucleotide; PD-1 exon 2; Set C
agggcuggggagaagguggggggguu

SEQ ID NO: 3803 - RNA, 24 nt, Artificial Sequence
  Synthetic Oligonucleotide; PD-1 exon 2; Set C
gggcuggggagaaggugggggggu

SEQ ID NO: 3804 - RNA, 27 nt, Artificial Sequence
  Synthetic Oligonucleotide; PD-1 exon 2; Set C
cagggcuggggagaagguggggggguu

SEQ ID NO: 3805 - RNA, 25 nt, Artificial Sequence
  Synthetic Oligonucleotide; PD-1 exon 2; Set C
agggcuggggagaaggugggggggu

SEQ ID NO: 3806 - RNA, 23 nt, Artificial Sequence
  Synthetic Oligonucleotide; PD-1 exon 2; Set C
gggcuggggagaagguggggggg

SEQ ID NO: 3807 - RNA, 26 nt, Artificial Sequence
  Synthetic Oligonucleotide; PD-1 exon 2; Set C
cagggcuggggagaaggugggggggu

SEQ ID NO: 3808 - RNA, 24 nt, Artificial Sequence
  Synthetic Oligonucleotide; PD-1 exon 2; Set C
agggcuggggagaagguggggggg

SEQ ID NO: 3809 - RNA, 22 nt, Artificial Sequence
  Synthetic Oligonucleotide; PD-1 exon 2; Set C
gggcuggggagaaggugggggg

SEQ ID NO: 3810 - RNA, 25 nt, Artificial Sequence
  Synthetic Oligonucleotide; PD-1 exon 2; Set C
cagggcuggggagaagguggggggg

SEQ ID NO: 3811 - RNA, 23 nt, Artificial Sequence
  Synthetic Oligonucleotide; PD-1 exon 2; Set C
agggcuggggagaaggugggggg

SEQ ID NO: 3812 - RNA, 21 nt, Artificial Sequence
  Synthetic Oligonucleotide; PD-1 exon 2; Set C
gggcuggggagaagguggggg

SEQ ID NO: 3813 - RNA, 24 nt, Artificial Sequence
  Synthetic Oligonucleotide; PD-1 exon 2; Set C
cagggcuggggagaaggugggggg

SEQ ID NO: 3814 - RNA, 22 nt, Artificial Sequence
  Synthetic Oligonucleotide; PD-1 exon 2; Set C
agggcuggggagaagguggggg

SEQ ID NO: 3815 - RNA, 20 nt, Artificial Sequence
  Synthetic Oligonucleotide; PD-1 exon 2; Set C
gggcuggggagaaggugggg

SEQ ID NO: 3816 - RNA, 23 nt, Artificial Sequence
  Synthetic Oligonucleotide; PD-1 exon 2; Set C
cagggcuggggagaagguggggg

SEQ ID NO: 3817 - RNA, 21 nt, Artificial Sequence
  Synthetic Oligonucleotide; PD-1 exon 2; Set C
agggcuggggagaaggugggg

SEQ ID NO: 3818 - RNA, 19 nt, Artificial Sequence
  Synthetic Oligonucleotide; PD-1 exon 2; Set A
gggcuggggagaagguggg

SEQ ID NO: 3819 - RNA, 20 nt, Artificial Sequence
  Synthetic Oligonucleotide; PD-1 exon 2; Set A
agggcuggggagaagguggg

SEQ ID NO: 3820 - RNA, 19 nt, Artificial Sequence
  Synthetic Oligonucleotide; PD-1 exon 2; Set A
agggcuggggagaaggugg

SEQ ID NO: 3821 - RNA, 15 nt, Artificial Sequence
  Synthetic Oligonucleotide; PD-1 exon 2; Set C
gggcuggggagaagg

SEQ ID NO: 3822 - RNA, 17 nt, Artificial Sequence
  Synthetic Oligonucleotide; PD-1 exon 2; Set A
agggcuggggagaaggu

SEQ ID NO: 3823 - RNA, 16 nt, Artificial Sequence
  Synthetic Oligonucleotide; PD-1 exon 2; Set C
agggcuggggagaagg

SEQ ID NO: 3824 - RNA, 37 nt, Artificial Sequence
  Synthetic Oligonucleotide; PD-1 exon 2; Set C
ucaccacgagcagggcuggggagaagguggggggguu

SEQ ID NO: 3825 - RNA, 15 nt, Artificial Sequence
  Synthetic Oligonucleotide; PD-1 exon 2; Set C
agggcuggggagaag

SEQ ID NO: 3826 - RNA, 17 nt, Artificial Sequence
  Synthetic Oligonucleotide; PD-1 exon 2; Set A
cagggcuggggagaagg

SEQ ID NO: 3827 - RNA, 38 nt, Artificial Sequence
  Synthetic Oligonucleotide; PD-1 exon 2; Set C
gucaccacgagcagggcuggggagaagguggggggguu

SEQ ID NO: 3828 - RNA, 36 nt, Artificial Sequence
  Synthetic Oligonucleotide; PD-1 exon 2; Set C
ucaccacgagcagggcuggggagaaggugggggggu

SEQ ID NO: 3829 - RNA, 16 nt, Artificial Sequence
  Synthetic Oligonucleotide; PD-1 exon 2; Set C
cagggcuggggagaag

SEQ ID NO: 3830 - RNA, 37 nt, Artificial Sequence
  Synthetic Oligonucleotide; PD-1 exon 2; Set C
gucaccacgagcagggcuggggagaaggugggggggu

SEQ ID NO: 3831 - RNA, 35 nt, Artificial Sequence
  Synthetic Oligonucleotide; PD-1 exon 2; Set C
ucaccacgagcagggcuggggagaagguggggggg

SEQ ID NO: 3832 - RNA, 15 nt, Artificial Sequence
  Synthetic Oligonucleotide; PD-1 exon 2; Set C
cagggcuggggagaa

SEQ ID NO: 3833 - RNA, 36 nt, Artificial Sequence
  Synthetic Oligonucleotide; PD-1 exon 2; Set C
gucaccacgagcagggcuggggagaagguggggggg

SEQ ID NO: 3834 - RNA, 34 nt, Artificial Sequence
  Synthetic Oligonucleotide; PD-1 exon 2; Set C
ucaccacgagcagggcuggggagaaggugggggg

SEQ ID NO: 3835 - RNA, 37 nt, Artificial Sequence
  Synthetic Oligonucleotide; PD-1 exon 2; Set C
ggucaccacgagcagggcuggggagaagguggggggg

SEQ ID NO: 3836 - RNA, 35 nt, Artificial Sequence
  Synthetic Oligonucleotide; PD-1 exon 2; Set C
gucaccacgagcagggcuggggagaaggugggggg

SEQ ID NO: 3837 - RNA, 33 nt, Artificial Sequence
  Synthetic Oligonucleotide; PD-1 exon 2; Set C
ucaccacgagcagggcuggggagaagguggggg

SEQ ID NO: 3838 - RNA, 36 nt, Artificial Sequence
  Synthetic Oligonucleotide; PD-1 exon 2; Set C
ggucaccacgagcagggcuggggagaaggugggggg

SEQ ID NO: 3839 - RNA, 34 nt, Artificial Sequence
  Synthetic Oligonucleotide; PD-1 exon 2; Set C
gucaccacgagcagggcuggggagaagguggggg

SEQ ID NO: 3840 - RNA, 32 nt, Artificial Sequence
  Synthetic Oligonucleotide; PD-1 exon 2; Set C
ucaccacgagcagggcuggggagaaggugggg

SEQ ID NO: 3841 - RNA, 35 nt, Artificial Sequence
  Synthetic Oligonucleotide; PD-1 exon 2; Set C
ggucaccacgagcagggcuggggagaagguggggg

SEQ ID NO: 3842 - RNA, 33 nt, Artificial Sequence
  Synthetic Oligonucleotide; PD-1 exon 2; Set C
gucaccacgagcagggcuggggagaaggugggg

SEQ ID NO: 3843 - RNA, 31 nt, Artificial Sequence
  Synthetic Oligonucleotide; PD-1 exon 2; Set C
ucaccacgagcagggcuggggagaagguggg

SEQ ID NO: 3844 - RNA, 34 nt, Artificial Sequence
  Synthetic Oligonucleotide; PD-1 exon 2; Set C
ggucaccacgagcagggcuggggagaaggugggg

SEQ ID NO: 3845 - RNA, 32 nt, Artificial Sequence
  Synthetic Oligonucleotide; PD-1 exon 2; Set C
gucaccacgagcagggcuggggagaagguggg

SEQ ID NO: 3846 - RNA, 33 nt, Artificial Sequence
  Synthetic Oligonucleotide; PD-1 exon 2; Set C
ggucaccacgagcagggcuggggagaagguggg

SEQ ID NO: 3847 - RNA, 32 nt, Artificial Sequence
  Synthetic Oligonucleotide; PD-1 exon 2; Set C
ggucaccacgagcagggcuggggagaaggugg

SEQ ID NO: 3848 - RNA, 27 nt, Artificial Sequence
  Synthetic Oligonucleotide; PD-1 exon 2; Set C
ucaccacgagcagggcuggggagaagg

SEQ ID NO: 3849 - RNA, 31 nt, Artificial Sequence
  Synthetic Oligonucleotide; PD-1 exon 2; Set C
ggucaccacgagcagggcuggggagaaggug

SEQ ID NO: 3850 - RNA, 26 nt, Artificial Sequence
  Synthetic Oligonucleotide; PD-1 exon 2; Set C
ucaccacgagcagggcuggggagaag

SEQ ID NO: 3851 - RNA, 28 nt, Artificial Sequence
  Synthetic Oligonucleotide; PD-1 exon 2; Set C
gucaccacgagcagggcuggggagaagg

SEQ ID NO: 3852 - RNA, 30 nt, Artificial Sequence
  Synthetic Oligonucleotide; PD-1 exon 2; Set C
ggucaccacgagcagggcuggggagaaggu

SEQ ID NO: 3853 - RNA, 25 nt, Artificial Sequence
  Synthetic Oligonucleotide; PD-1 exon 2; Set C
ucaccacgagcagggcuggggagaa

SEQ ID NO: 3854 - RNA, 27 nt, Artificial Sequence
  Synthetic Oligonucleotide; PD-1 exon 2; Set C
gucaccacgagcagggcuggggagaag

SEQ ID NO: 3855 - RNA, 29 nt, Artificial Sequence
  Synthetic Oligonucleotide; PD-1 exon 2; Set C
ggucaccacgagcagggcuggggagaagg

SEQ ID NO: 3856 - RNA, 24 nt, Artificial Sequence
  Synthetic Oligonucleotide; PD-1 exon 2; Set C
ucaccacgagcagggcuggggaga

SEQ ID NO: 3857 - RNA, 26 nt, Artificial Sequence
  Synthetic Oligonucleotide; PD-1 exon 2; Set C
gucaccacgagcagggcuggggagaa

SEQ ID NO: 3858 - RNA, 28 nt, Artificial Sequence
  Synthetic Oligonucleotide; PD-1 exon 2; Set C
ggucaccacgagcagggcuggggagaag

SEQ ID NO: 3859 - RNA, 25 nt, Artificial Sequence
  Synthetic Oligonucleotide; PD-1 exon 2; Set C
gucaccacgagcagggcuggggaga

SEQ ID NO: 3860 - RNA, 27 nt, Artificial Sequence
  Synthetic Oligonucleotide; PD-1 exon 2; Set C
ggucaccacgagcagggcuggggagaa

SEQ ID NO: 3861 - RNA, 26 nt, Artificial Sequence
  Synthetic Oligonucleotide; PD-1 exon 2; Set C
ggucaccacgagcagggcuggggaga

SEQ ID NO: 3862 - RNA, 25 nt, Artificial Sequence
  Synthetic Oligonucleotide; PD-1 exon 2; Set C
ggucaccacgagcagggcuggggag

SEQ ID NO: 3863 - RNA, 39 nt, Artificial Sequence
  Synthetic Oligonucleotide; PD-1 exon 2; Set C
uguccccuucggucaccacgagcagggcuggggagaagg

SEQ ID NO: 3864 - RNA, 38 nt, Artificial Sequence
  Synthetic Oligonucleotide; PD-1 exon 2; Set C
uguccccuucggucaccacgagcagggcuggggagaag

SEQ ID NO: 3865 - RNA, 40 nt, Artificial Sequence
  Synthetic Oligonucleotide; PD-1 exon 2; Set C
uuguccccuucggucaccacgagcagggcuggggagaagg

SEQ ID NO: 3866 - RNA, 37 nt, Artificial Sequence
  Synthetic Oligonucleotide; PD-1 exon 2; Set C
uguccccuucggucaccacgagcagggcuggggagaa

SEQ ID NO: 3867 - RNA, 39 nt, Artificial Sequence
  Synthetic Oligonucleotide; PD-1 exon 2; Set C
uuguccccuucggucaccacgagcagggcuggggagaag

SEQ ID NO: 3868 - RNA, 36 nt, Artificial Sequence
  Synthetic Oligonucleotide; PD-1 exon 2; Set C
uguccccuucggucaccacgagcagggcuggggaga

SEQ ID NO: 3869 - RNA, 38 nt, Artificial Sequence
  Synthetic Oligonucleotide; PD-1 exon 2; Set C
uuguccccuucggucaccacgagcagggcuggggagaa

SEQ ID NO: 3870 - RNA, 37 nt, Artificial Sequence
  Synthetic Oligonucleotide; PD-1 exon 2; Set C
uuguccccuucggucaccacgagcagggcuggggaga

SEQ ID NO: 3871 - RNA, 26 nt, Artificial Sequence
  Synthetic Oligonucleotide; PD-1 exon 2; Set A
uuuagcacgaagcucuccgauguguu

SEQ ID NO: 3872 - RNA, 25 nt, Artificial Sequence
  Synthetic Oligonucleotide; PD-1 exon 2; Set A
uuuagcacgaagcucuccgaugugu

SEQ ID NO: 3873 - RNA, 27 nt, Artificial Sequence
  Synthetic Oligonucleotide; PD-1 exon 2; Set A
guuuagcacgaagcucuccgauguguu

SEQ ID NO: 3874 - RNA, 26 nt, Artificial Sequence
  Synthetic Oligonucleotide; PD-1 exon 2; Set A
guuuagcacgaagcucuccgaugugu

SEQ ID NO: 3875 - RNA, 28 nt, Artificial Sequence
  Synthetic Oligonucleotide; PD-1 exon 2; Set A
aguuuagcacgaagcucuccgauguguu

SEQ ID NO: 3876 - RNA, 24 nt, Artificial Sequence
  Synthetic Oligonucleotide; PD-1 exon 2; Set A
uuuagcacgaagcucuccgaugug

SEQ ID NO: 3877 - RNA, 27 nt, Artificial Sequence
  Synthetic Oligonucleotide; PD-1 exon 2; Set A
aguuuagcacgaagcucuccgaugugu

SEQ ID NO: 3878 - RNA, 26 nt, Artificial Sequence
  Synthetic Oligonucleotide; PD-1 exon 2; Set A
aguuuagcacgaagcucuccgaugug

SEQ ID NO: 3879 - RNA, 36 nt, Artificial Sequence
  Synthetic Oligonucleotide; PD-1 exon 2; Set C
guugcuggggcucaugcgguaccaguuuagcacgaa

SEQ ID NO: 3880 - RNA, 40 nt, Artificial Sequence
  Synthetic Oligonucleotide; PD-1 exon 2; Set C
ucugguugcuggggcucaugcgguaccaguuuagcacgaa

SEQ ID NO: 3881 - RNA, 39 nt, Artificial Sequence
  Synthetic Oligonucleotide; PD-1 exon 2; Set C
ucugguugcuggggcucaugcgguaccaguuuagcacga

SEQ ID NO: 3882 - RNA, 40 nt, Artificial Sequence
  Synthetic Oligonucleotide; PD-1 exon 2; Set C
gucugguugcuggggcucaugcgguaccaguuuagcacga

SEQ ID NO: 3883 - RNA, 38 nt, Artificial Sequence
  Synthetic Oligonucleotide; PD-1 exon 2; Set C
ucugguugcuggggcucaugcgguaccaguuuagcacg

SEQ ID NO: 3884 - RNA, 29 nt, Artificial Sequence
  Synthetic Oligonucleotide; PD-1 exon 2; Set C
guugcuggggcucaugcgguaccaguuua

SEQ ID NO: 3885 - RNA, 39 nt, Artificial Sequence
  Synthetic Oligonucleotide; PD-1 exon 2; Set C
gucugguugcuggggcucaugcgguaccaguuuagcacg

SEQ ID NO: 3886 - RNA, 28 nt, Artificial Sequence
  Synthetic Oligonucleotide; PD-1 exon 2; Set C
guugcuggggcucaugcgguaccaguuu

SEQ ID NO: 3887 - RNA, 27 nt, Artificial Sequence
  Synthetic Oligonucleotide; PD-1 exon 2; Set C
guugcuggggcucaugcgguaccaguu

SEQ ID NO: 3888 - RNA, 26 nt, Artificial Sequence
  Synthetic Oligonucleotide; PD-1 exon 2; Set C
guugcuggggcucaugcgguaccagu

SEQ ID NO: 3889 - RNA, 33 nt, Artificial Sequence
  Synthetic Oligonucleotide; PD-1 exon 2; Set C
ucugguugcuggggcucaugcgguaccaguuua

SEQ ID NO: 3890 - RNA, 32 nt, Artificial Sequence
  Synthetic Oligonucleotide; PD-1 exon 2; Set C
ucugguugcuggggcucaugcgguaccaguuu

SEQ ID NO: 3891 - RNA, 34 nt, Artificial Sequence
  Synthetic Oligonucleotide; PD-1 exon 2; Set C
gucugguugcuggggcucaugcgguaccaguuua

SEQ ID NO: 3892 - RNA, 33 nt, Artificial Sequence
  Synthetic Oligonucleotide; PD-1 exon 2; Set C
gucugguugcuggggcucaugcgguaccaguuu

SEQ ID NO: 3893 - RNA, 31 nt, Artificial Sequence
  Synthetic Oligonucleotide; PD-1 exon 2; Set C
ucugguugcuggggcucaugcgguaccaguu

SEQ ID NO: 3894 - RNA, 32 nt, Artificial Sequence
  Synthetic Oligonucleotide; PD-1 exon 2; Set C
gucugguugcuggggcucaugcgguaccaguu

SEQ ID NO: 3895 - RNA, 30 nt, Artificial Sequence
  Synthetic Oligonucleotide; PD-1 exon 2; Set C
ucugguugcuggggcucaugcgguaccagu

SEQ ID NO: 3896 - RNA, 31 nt, Artificial Sequence
  Synthetic Oligonucleotide; PD-1 exon 2; Set C
gucugguugcuggggcucaugcgguaccagu

SEQ ID NO: 3897 - RNA, 40 nt, Artificial Sequence
  Synthetic Oligonucleotide; PD-1 exon 2; Set C
uguccgucugguugcuggggcucaugcgguaccaguuuag

SEQ ID NO: 3898 - RNA, 39 nt, Artificial Sequence
  Synthetic Oligonucleotide; PD-1 exon 2; Set C
uguccgucugguugcuggggcucaugcgguaccaguuua

SEQ ID NO: 3899 - RNA, 38 nt, Artificial Sequence
  Synthetic Oligonucleotide; PD-1 exon 2; Set C
uguccgucugguugcuggggcucaugcgguaccaguuu

SEQ ID NO: 3900 - RNA, 40 nt, Artificial Sequence
  Synthetic Oligonucleotide; PD-1 exon 2; Set C
uuguccgucugguugcuggggcucaugcgguaccaguuua

SEQ ID NO: 3901 - RNA, 39 nt, Artificial Sequence
  Synthetic Oligonucleotide; PD-1 exon 2; Set C
uuguccgucugguugcuggggcucaugcgguaccaguuu

SEQ ID NO: 3902 - RNA, 37 nt, Artificial Sequence
  Synthetic Oligonucleotide; PD-1 exon 2; Set C
uguccgucugguugcuggggcucaugcgguaccaguu

SEQ ID NO: 3903 - RNA, 38 nt, Artificial Sequence
  Synthetic Oligonucleotide; PD-1 exon 2; Set C
uuguccgucugguugcuggggcucaugcgguaccaguu

SEQ ID NO: 3904 - RNA, 36 nt, Artificial Sequence
  Synthetic Oligonucleotide; PD-1 exon 2; Set C
uguccgucugguugcuggggcucaugcgguaccagu

SEQ ID NO: 3905 - RNA, 37 nt, Artificial Sequence
  Synthetic Oligonucleotide; PD-1 exon 2; Set C
uuguccgucugguugcuggggcucaugcgguaccagu

SEQ ID NO: 3906 - RNA, 23 nt, Artificial Sequence
  Synthetic Oligonucleotide; PD-1 exon 2; Set C
uuguccgucugguugcuggggcu

SEQ ID NO: 3907 - RNA, 20 nt, Artificial Sequence
  Synthetic Oligonucleotide; PD-1 exon 2; Set A
uguccgucugguugcugggg

SEQ ID NO: 3908 - RNA, 22 nt, Artificial Sequence
  Synthetic Oligonucleotide; PD-1 exon 2; Set C
uuguccgucugguugcuggggc

SEQ ID NO: 3909 - RNA, 21 nt, Artificial Sequence
  Synthetic Oligonucleotide; PD-1 exon 2; Set A
uuguccgucugguugcugggg

SEQ ID NO: 3910 - RNA, 32 nt, Artificial Sequence
  Synthetic Oligonucleotide; PD-1 exon 2; Set C
uugcgccgggcccugaccacgcucauguggaa

SEQ ID NO: 3911 - RNA, 33 nt, Artificial Sequence
  Synthetic Oligonucleotide; PD-1 exon 2; Set C
auugcgccgggcccugaccacgcucauguggaa

SEQ ID NO: 3912 - RNA, 34 nt, Artificial Sequence
  Synthetic Oligonucleotide; PD-1 exon 2; Set C
cauugcgccgggcccugaccacgcucauguggaa

SEQ ID NO: 3913 - RNA, 16 nt, Artificial Sequence
  Synthetic Oligonucleotide; PD-1 exon 2; Set C
gugccgcugucauugc

SEQ ID NO: 3914 - RNA, 15 nt, Artificial Sequence
  Synthetic Oligonucleotide; PD-1 exon 2; Set C
gugccgcugucauug

SEQ ID NO: 3915 - RNA, 17 nt, Artificial Sequence
  Synthetic Oligonucleotide; PD-1 exon 2; Set B
ggugccgcugucauugc

SEQ ID NO: 3916 - RNA, 16 nt, Artificial Sequence
  Synthetic Oligonucleotide; PD-1 exon 2; Set C
ggugccgcugucauug

SEQ ID NO: 3917 - RNA, 18 nt, Artificial Sequence
  Synthetic Oligonucleotide; PD-1 exon 2; Set B
aggugccgcugucauugc

SEQ ID NO: 3918 - RNA, 15 nt, Artificial Sequence
  Synthetic Oligonucleotide; PD-1 exon 2; Set C
ggugccgcugucauu

SEQ ID NO: 3919 - RNA, 17 nt, Artificial Sequence
  Synthetic Oligonucleotide; PD-1 exon 2; Set C
aggugccgcugucauug

SEQ ID NO: 3920 - RNA, 16 nt, Artificial Sequence
  Synthetic Oligonucleotide; PD-1 exon 2; Set C
aggugccgcugucauu

SEQ ID NO: 3921 - RNA, 15 nt, Artificial Sequence
  Synthetic Oligonucleotide; PD-1 exon 2; Set C
aggugccgcugucau

SEQ ID NO: 3922 - RNA, 16 nt, Artificial Sequence
  Synthetic Oligonucleotide; PD-1 exon 2; Set C
uaggugccgcugucau

SEQ ID NO: 3923 - RNA, 15 nt, Artificial Sequence
  Synthetic Oligonucleotide; PD-1 exon 2; Set C
uaggugccgcuguca

SEQ ID NO: 3924 - RNA, 16 nt, Artificial Sequence
  Synthetic Oligonucleotide; PD-1 exon 2; Set B
guaggugccgcuguca

SEQ ID NO: 3925 - RNA, 15 nt, Artificial Sequence
  Synthetic Oligonucleotide; PD-1 exon 2; Set C
guaggugccgcuguc

SEQ ID NO: 3926 - RNA, 16 nt, Artificial Sequence
  Synthetic Oligonucleotide; PD-1 exon 2; Set C
ucuuugaucugcgccu

SEQ ID NO: 3927 - RNA, 22 nt, Artificial Sequence
  Synthetic Oligonucleotide; PD-1 exon 2; Set B
gcucucuuugaucugcgccuug

SEQ ID NO: 3928 - RNA, 28 nt, Artificial Sequence
  Synthetic Oligonucleotide; PD-1 exon 2; Set C
ccgcaggcucucuuugaucugcgccuug

SEQ ID NO: 3929 - RNA, 29 nt, Artificial Sequence
  Synthetic Oligonucleotide; PD-1 exon 2; Set C
cccgcaggcucucuuugaucugcgccuug

SEQ ID NO: 3930 - RNA, 27 nt, Artificial Sequence
  Synthetic Oligonucleotide; PD-1 exon 2; Set C
ccgcaggcucucuuugaucugcgccuu

SEQ ID NO: 3931 - RNA, 28 nt, Artificial Sequence
  Synthetic Oligonucleotide; PD-1 exon 2; Set C
cccgcaggcucucuuugaucugcgccuu

SEQ ID NO: 3932 - RNA, 18 nt, Artificial Sequence
  Synthetic Oligonucleotide; PD-1 exon 2; Set B
ccgcaggcucucuuugau

SEQ ID NO: 3933 - RNA, 17 nt, Artificial Sequence
  Synthetic Oligonucleotide; PD-1 exon 2; Set B
ccgcaggcucucuuuga

SEQ ID NO: 3934 - RNA, 19 nt, Artificial Sequence
  Synthetic Oligonucleotide; PD-1 exon 2; Set B
cccgcaggcucucuuugau

SEQ ID NO: 3935 - RNA, 16 nt, Artificial Sequence
  Synthetic Oligonucleotide; PD-1 exon 2; Set C
ccgcaggcucucuuug

SEQ ID NO: 3936 - RNA, 18 nt, Artificial Sequence
  Synthetic Oligonucleotide; PD-1 exon 2; Set B
cccgcaggcucucuuuga

SEQ ID NO: 3937 - RNA, 15 nt, Artificial Sequence
  Synthetic Oligonucleotide; PD-1 exon 2; Set C
ccgcaggcucucuuu

SEQ ID NO: 3938 - RNA, 17 nt, Artificial Sequence
  Synthetic Oligonucleotide; PD-1 exon 2; Set B
cccgcaggcucucuuug

SEQ ID NO: 3939 - RNA, 16 nt, Artificial Sequence
  Synthetic Oligonucleotide; PD-1 exon 2; Set C
cccgcaggcucucuuu

SEQ ID NO: 3940 - RNA, 15 nt, Artificial Sequence
  Synthetic Oligonucleotide; PD-1 exon 2; Set C
cccgcaggcucucuu

SEQ ID NO: 3941 - RNA, 18 nt, Artificial Sequence
  Synthetic Oligonucleotide; PD-1 exon 2; Set A
cuggguggccccacaaag

SEQ ID NO: 3942 - RNA, 19 nt, Artificial Sequence
  Synthetic Oligonucleotide; PD-1 exon 2; Set A
gcuggguggccccacaaag

SEQ ID NO: 3943 - RNA, 17 nt, Artificial Sequence
  Synthetic Oligonucleotide; PD-1 exon 2; Set A
cuggguggccccacaaa

SEQ ID NO: 3944 - RNA, 16 nt, Artificial Sequence
  Synthetic Oligonucleotide; PD-1 exon 2; Set A
cuggguggccccacaa

SEQ ID NO: 3945 - RNA, 20 nt, Artificial Sequence
  Synthetic Oligonucleotide; PD-1 exon 2; Set C
ggcuggguggccccacaaag

SEQ ID NO: 3946 - RNA, 18 nt, Artificial Sequence
  Synthetic Oligonucleotide; PD-1 exon 2; Set A
gcuggguggccccacaaa

SEQ ID NO: 3947 - RNA, 15 nt, Artificial Sequence
  Synthetic Oligonucleotide; PD-1 exon 2; Set A
cuggguggccccaca

SEQ ID NO: 3948 - RNA, 17 nt, Artificial Sequence
  Synthetic Oligonucleotide; PD-1 exon 2; Set A
gcuggguggccccacaa

SEQ ID NO: 3949 - RNA, 19 nt, Artificial Sequence
  Synthetic Oligonucleotide; PD-1 exon 2; Set C
ggcuggguggccccacaaa

SEQ ID NO: 3950 - RNA, 16 nt, Artificial Sequence
  Synthetic Oligonucleotide; PD-1 exon 2; Set C
gcuggguggccccaca

SEQ ID NO: 3951 - RNA, 18 nt, Artificial Sequence
  Synthetic Oligonucleotide; PD-1 exon 2; Set C
ggcuggguggccccacaa

SEQ ID NO: 3952 - RNA, 17 nt, Artificial Sequence
  Synthetic Oligonucleotide; PD-1 exon 2; Set C
ggcuggguggccccaca

SEQ ID NO: 3953 - RNA, 32 nt, Artificial Sequence
  Synthetic Oligonucleotide; PD-1 exon 2; Set C
gaggugaggaaggggcuggguggccccacaaa

SEQ ID NO: 3954 - RNA, 31 nt, Artificial Sequence
  Synthetic Oligonucleotide; PD-1 exon 2; Set C
gaggugaggaaggggcuggguggccccacaa

SEQ ID NO: 3955 - RNA, 30 nt, Artificial Sequence
  Synthetic Oligonucleotide; PD-1 exon 2; Set C
gaggugaggaaggggcuggguggccccaca

SEQ ID NO: 3956 - RNA, 38 nt, Artificial Sequence
  Synthetic Oligonucleotide; PD-1 exon 2; Set C
ggagagaggugaggaaggggcuggguggccccacaaag

SEQ ID NO: 3957 - RNA, 37 nt, Artificial Sequence
  Synthetic Oligonucleotide; PD-1 exon 2; Set C
ggagagaggugaggaaggggcuggguggccccacaaa

SEQ ID NO: 3958 - RNA, 36 nt, Artificial Sequence
  Synthetic Oligonucleotide; PD-1 exon 2; Set C
ggagagaggugaggaaggggcuggguggccccacaa

SEQ ID NO: 3959 - RNA, 35 nt, Artificial Sequence
  Synthetic Oligonucleotide; PD-1 exon 2; Set C
ggagagaggugaggaaggggcuggguggccccaca

SEQ ID NO: 3960 - RNA, 23 nt, Artificial Sequence
  Synthetic Oligonucleotide; PD-1 exon 2; Set C
gaggugaggaaggggcugggugg

SEQ ID NO: 3961 - RNA, 40 nt, Artificial Sequence
  Synthetic Oligonucleotide; PD-1 exon 2; Set C
gagauggagagaggugaggaaggggcuggguggccccaca

SEQ ID NO: 3962 - RNA, 19 nt, Artificial Sequence
  Synthetic Oligonucleotide; PD-1 exon 2; Set A
gaggugaggaaggggcugg

SEQ ID NO: 3963 - RNA, 28 nt, Artificial Sequence
  Synthetic Oligonucleotide; PD-1 exon 2; Set C
ggagagaggugaggaaggggcugggugg

SEQ ID NO: 3964 - RNA, 27 nt, Artificial Sequence
  Synthetic Oligonucleotide; PD-1 exon 2; Set C
ggagagaggugaggaaggggcugggug

SEQ ID NO: 3965 - RNA, 26 nt, Artificial Sequence
  Synthetic Oligonucleotide; PD-1 exon 2; Set C
ggagagaggugaggaaggggcugggu

SEQ ID NO: 3966 - RNA, 25 nt, Artificial Sequence
  Synthetic Oligonucleotide; PD-1 exon 2; Set C
ggagagaggugaggaaggggcuggg

SEQ ID NO: 3967 - RNA, 24 nt, Artificial Sequence
  Synthetic Oligonucleotide; PD-1 exon 2; Set C
ggagagaggugaggaaggggcugg

SEQ ID NO: 3968 - RNA, 33 nt, Artificial Sequence
  Synthetic Oligonucleotide; PD-1 exon 2; Set C
gagauggagagaggugaggaaggggcugggugg

SEQ ID NO: 3969 - RNA, 32 nt, Artificial Sequence
  Synthetic Oligonucleotide; PD-1 exon 2; Set C
gagauggagagaggugaggaaggggcugggug

SEQ ID NO: 3970 - RNA, 34 nt, Artificial Sequence
  Synthetic Oligonucleotide; PD-1 exon 2; Set C
agagauggagagaggugaggaaggggcugggugg

SEQ ID NO: 3971 - RNA, 24 nt, Artificial Sequence
  Synthetic Oligonucleotide; PD-1 exon 2; Set A
uggagagaggugaggaaggggcug

SEQ ID NO: 3972 - RNA, 33 nt, Artificial Sequence
  Synthetic Oligonucleotide; PD-1 exon 2; Set C
agagauggagagaggugaggaaggggcugggug

SEQ ID NO: 3973 - RNA, 31 nt, Artificial Sequence
  Synthetic Oligonucleotide; PD-1 exon 2; Set C
gagauggagagaggugaggaaggggcugggu

SEQ ID NO: 3974 - RNA, 32 nt, Artificial Sequence
  Synthetic Oligonucleotide; PD-1 exon 2; Set C
agagauggagagaggugaggaaggggcugggu

SEQ ID NO: 3975 - RNA, 30 nt, Artificial Sequence
  Synthetic Oligonucleotide; PD-1 exon 2; Set C
gagauggagagaggugaggaaggggcuggg

SEQ ID NO: 3976 - RNA, 31 nt, Artificial Sequence
  Synthetic Oligonucleotide; PD-1 exon 2; Set C
agagauggagagaggugaggaaggggcuggg

SEQ ID NO: 3977 - RNA, 29 nt, Artificial Sequence
  Synthetic Oligonucleotide; PD-1 exon 2; Set C
gagauggagagaggugaggaaggggcugg

SEQ ID NO: 3978 - RNA, 30 nt, Artificial Sequence
  Synthetic Oligonucleotide; PD-1 exon 2; Set C
agagauggagagaggugaggaaggggcugg

SEQ ID NO: 3979 - RNA, 16 nt, Artificial Sequence
  Synthetic Oligonucleotide; PD-1 exon 2; Set C
ggagagaggugaggaa

SEQ ID NO: 3980 - RNA, 15 nt, Artificial Sequence
  Synthetic Oligonucleotide; PD-1 exon 2; Set C
ggagagaggugagga

SEQ ID NO: 3981 - RNA, 33 nt, Artificial Sequence
  Synthetic Oligonucleotide; PD-1 exon 2; Set C
ucugagagauggagagaggugaggaaggggcug

SEQ ID NO: 3982 - RNA, 34 nt, Artificial Sequence
  Synthetic Oligonucleotide; PD-1 exon 2; Set C
gucugagagauggagagaggugaggaaggggcug

SEQ ID NO: 3983 - RNA, 35 nt, Artificial Sequence
  Synthetic Oligonucleotide; PD-1 exon 2; Set C
agucugagagauggagagaggugaggaaggggcug

SEQ ID NO: 3984 - RNA, 33 nt, Artificial Sequence
  Synthetic Oligonucleotide; PD-1 exon 2; Set C
gucugagagauggagagaggugaggaaggggcu

SEQ ID NO: 3985 - RNA, 36 nt, Artificial Sequence
  Synthetic Oligonucleotide; PD-1 exon 2; Set C
gagucugagagauggagagaggugaggaaggggcug

SEQ ID NO: 3986 - RNA, 32 nt, Artificial Sequence
  Synthetic Oligonucleotide; PD-1 exon 2; Set C
gucugagagauggagagaggugaggaaggggc

SEQ ID NO: 3987 - RNA, 19 nt, Artificial Sequence
  Synthetic Oligonucleotide; PD-1 exon 2; Set C
gagauggagagaggugagg

SEQ ID NO: 3988 - RNA, 37 nt, Artificial Sequence
  Synthetic Oligonucleotide; PD-1 exon 2; Set C
ggagucugagagauggagagaggugaggaaggggcug

SEQ ID NO: 3989 - RNA, 20 nt, Artificial Sequence
  Synthetic Oligonucleotide; PD-1 exon 2; Set C
agagauggagagaggugagg

SEQ ID NO: 3990 - RNA, 18 nt, Artificial Sequence
  Synthetic Oligonucleotide; PD-1 exon 2; Set C
gagauggagagaggugag

SEQ ID NO: 3991 - RNA, 38 nt, Artificial Sequence
  Synthetic Oligonucleotide; PD-1 exon 2; Set C
gggagucugagagauggagagaggugaggaaggggcug

SEQ ID NO: 3992 - RNA, 36 nt, Artificial Sequence
  Synthetic Oligonucleotide; PD-1 exon 2; Set C
ggagucugagagauggagagaggugaggaaggggcu

SEQ ID NO: 3993 - RNA, 19 nt, Artificial Sequence
  Synthetic Oligonucleotide; PD-1 exon 2; Set C
agagauggagagaggugag

SEQ ID NO: 3994 - RNA, 17 nt, Artificial Sequence
  Synthetic Oligonucleotide; PD-1 exon 2; Set C
gagauggagagagguga

SEQ ID NO: 3995 - RNA, 39 nt, Artificial Sequence
  Synthetic Oligonucleotide; PD-1 exon 2; Set C
ggggagucugagagauggagagaggugaggaaggggcug

SEQ ID NO: 3996 - RNA, 37 nt, Artificial Sequence
  Synthetic Oligonucleotide; PD-1 exon 2; Set C
gggagucugagagauggagagaggugaggaaggggcu

SEQ ID NO: 3997 - RNA, 18 nt, Artificial Sequence
  Synthetic Oligonucleotide; PD-1 exon 2; Set C
agagauggagagagguga

SEQ ID NO: 3998 - RNA, 40 nt, Artificial Sequence
  Synthetic Oligonucleotide; PD-1 exon 2; Set C
uggggagucugagagauggagagaggugaggaaggggcug

SEQ ID NO: 3999 - RNA, 38 nt, Artificial Sequence
  Synthetic Oligonucleotide; PD-1 exon 2; Set C
ggggagucugagagauggagagaggugaggaaggggcu

SEQ ID NO: 4000 - RNA, 36 nt, Artificial Sequence
  Synthetic Oligonucleotide; PD-1 exon 2; Set C
gggagucugagagauggagagaggugaggaaggggc

SEQ ID NO: 4001 - RNA, 39 nt, Artificial Sequence
  Synthetic Oligonucleotide; PD-1 exon 2; Set C
uggggagucugagagauggagagaggugaggaaggggcu

SEQ ID NO: 4002 - RNA, 37 nt, Artificial Sequence
  Synthetic Oligonucleotide; PD-1 exon 2; Set C
ggggagucugagagauggagagaggugaggaaggggc

SEQ ID NO: 4003 - RNA, 38 nt, Artificial Sequence
  Synthetic Oligonucleotide; PD-1 exon 2; Set C
uggggagucugagagauggagagaggugaggaaggggc

SEQ ID NO: 4004 - RNA, 18 nt, Artificial Sequence
  Synthetic Oligonucleotide; PD-1 exon 2; Set C
ucugagagauggagagag

SEQ ID NO: 4005 - RNA, 20 nt, Artificial Sequence
  Synthetic Oligonucleotide; PD-1 exon 2; Set C
agucugagagauggagagag

SEQ ID NO: 4006 - RNA, 21 nt, Artificial Sequence
  Synthetic Oligonucleotide; PD-1 exon 2; Set C
gagucugagagauggagagag

SEQ ID NO: 4007 - RNA, 22 nt, Artificial Sequence
  Synthetic Oligonucleotide; PD-1 exon 2; Set C
ggagucugagagauggagagag

SEQ ID NO: 4008 - RNA, 26 nt, Artificial Sequence
  Synthetic Oligonucleotide; PD-1 exon 2; Set A
cuggggagucugagagauggagagag

SEQ ID NO: 4009 - RNA, 27 nt, Artificial Sequence
  Synthetic Oligonucleotide; PD-1 exon 2; Set A
ucuggggagucugagagauggagagag

SEQ ID NO: 4010 - RNA, 28 nt, Artificial Sequence
  Synthetic Oligonucleotide; PD-1 exon 2; Set A
gucuggggagucugagagauggagagag

SEQ ID NO: 4011 - RNA, 15 nt, Artificial Sequence
  Synthetic Oligonucleotide; PD-1 exon 2; Set C
ggagucugagagaug

SEQ ID NO: 4012 - RNA, 16 nt, Artificial Sequence
  Synthetic Oligonucleotide; PD-1 exon 2; Set C
gggagucugagagaug

SEQ ID NO: 4013 - RNA, 15 nt, Artificial Sequence
  Synthetic Oligonucleotide; PD-1 exon 2; Set C
gggagucugagagau

SEQ ID NO: 4014 - RNA, 17 nt, Artificial Sequence
  Synthetic Oligonucleotide; PD-1 exon 2; Set C
ggggagucugagagaug

SEQ ID NO: 4015 - RNA, 16 nt, Artificial Sequence
  Synthetic Oligonucleotide; PD-1 exon 2; Set C
ggggagucugagagau

SEQ ID NO: 4016 - RNA, 18 nt, Artificial Sequence
  Synthetic Oligonucleotide; PD-1 exon 2; Set C
uggggagucugagagaug

SEQ ID NO: 4017 - RNA, 15 nt, Artificial Sequence
  Synthetic Oligonucleotide; PD-1 exon 2; Set C
ggggagucugagaga

SEQ ID NO: 4018 - RNA, 17 nt, Artificial Sequence
  Synthetic Oligonucleotide; PD-1 exon 2; Set C
uggggagucugagagau

SEQ ID NO: 4019 - RNA, 16 nt, Artificial Sequence
  Synthetic Oligonucleotide; PD-1 exon 2; Set C
uggggagucugagaga

SEQ ID NO: 4020 - RNA, 22 nt, Artificial Sequence
  Synthetic Oligonucleotide; PD-1 exon 2; Set A
ugucuggggagucugagagaug

SEQ ID NO: 4021 - RNA, 21 nt, Artificial Sequence
  Synthetic Oligonucleotide; PD-1 exon 2; Set A
ugucuggggagucugagagau

SEQ ID NO: 4022 - RNA, 20 nt, Artificial Sequence
  Synthetic Oligonucleotide; PD-1 exon 2; Set A
ugucuggggagucugagaga

SEQ ID NO: 4023 - RNA, 17 nt, Artificial Sequence
  Synthetic Oligonucleotide; PD-1 exon 2; Set C
ugucuggggagucugag

SEQ ID NO: 4024 - RNA, 35 nt, Artificial Sequence
  Synthetic Oligonucleotide; PD-1 exon 2; Set C
ggguuccagggccugucuggggagucugagagaug

SEQ ID NO: 4025 - RNA, 40 nt, Artificial Sequence
  Synthetic Oligonucleotide; PD-1 exon 2; Set C
gggggguuccagggccugucuggggagucugagagaugga

SEQ ID NO: 4026 - RNA, 32 nt, Artificial Sequence
  Synthetic Oligonucleotide; PD-1 exon 2; Set C
gguuccagggccugucuggggagucugagaga

SEQ ID NO: 4027 - RNA, 34 nt, Artificial Sequence
  Synthetic Oligonucleotide; PD-1 exon 2; Set C
ggguuccagggccugucuggggagucugagagau

SEQ ID NO: 4028 - RNA, 36 nt, Artificial Sequence
  Synthetic Oligonucleotide; PD-1 exon 2; Set C
gggguuccagggccugucuggggagucugagagaug

SEQ ID NO: 4029 - RNA, 33 nt, Artificial Sequence
  Synthetic Oligonucleotide; PD-1 exon 2; Set C
ggguuccagggccugucuggggagucugagaga

SEQ ID NO: 4030 - RNA, 35 nt, Artificial Sequence
  Synthetic Oligonucleotide; PD-1 exon 2; Set C
gggguuccagggccugucuggggagucugagagau

SEQ ID NO: 4031 - RNA, 37 nt, Artificial Sequence
  Synthetic Oligonucleotide; PD-1 exon 2; Set C
ggggguuccagggccugucuggggagucugagagaug

SEQ ID NO: 4032 - RNA, 34 nt, Artificial Sequence
  Synthetic Oligonucleotide; PD-1 exon 2; Set C
gggguuccagggccugucuggggagucugagaga

SEQ ID NO: 4033 - RNA, 36 nt, Artificial Sequence
  Synthetic Oligonucleotide; PD-1 exon 2; Set C
ggggguuccagggccugucuggggagucugagagau

SEQ ID NO: 4034 - RNA, 35 nt, Artificial Sequence
  Synthetic Oligonucleotide; PD-1 exon 2; Set C
ggggguuccagggccugucuggggagucugagaga

SEQ ID NO: 4035 - RNA, 36 nt, Artificial Sequence
  Synthetic Oligonucleotide; PD-1 exon 2; Set C
ggggggguuccagggccugucuggggagucugagag

SEQ ID NO: 4036 - RNA, 35 nt, Artificial Sequence
  Synthetic Oligonucleotide; PD-1 exon 2; Set C
ggggggguuccagggccugucuggggagucugaga

SEQ ID NO: 4037 - RNA, 37 nt, Artificial Sequence
  Synthetic Oligonucleotide; PD-1 exon 2; Set C
uggggggguuccagggccugucuggggagucugagag

SEQ ID NO: 4038 - RNA, 36 nt, Artificial Sequence
  Synthetic Oligonucleotide; PD-1 exon 2; Set C
uggggggguuccagggccugucuggggagucugaga

SEQ ID NO: 4039 - RNA, 38 nt, Artificial Sequence
  Synthetic Oligonucleotide; PD-1 exon 2; Set C
guggggggguuccagggccugucuggggagucugagag

SEQ ID NO: 4040 - RNA, 39 nt, Artificial Sequence
  Synthetic Oligonucleotide; PD-1 exon 2; Set C
gguggggggguuccagggccugucuggggagucugagag

SEQ ID NO: 4041 - RNA, 37 nt, Artificial Sequence
  Synthetic Oligonucleotide; PD-1 exon 2; Set C
guggggggguuccagggccugucuggggagucugaga

SEQ ID NO: 4042 - RNA, 38 nt, Artificial Sequence
  Synthetic Oligonucleotide; PD-1 exon 2; Set C
gguggggggguuccagggccugucuggggagucugaga

SEQ ID NO: 4043 - RNA, 32 nt, Artificial Sequence
  Synthetic Oligonucleotide; PD-1 exon 2; Set C
uggggggguuccagggccugucuggggagucu

SEQ ID NO: 4044 - RNA, 33 nt, Artificial Sequence
  Synthetic Oligonucleotide; PD-1 exon 2; Set C
guggggggguuccagggccugucuggggagucu

SEQ ID NO: 4045 - RNA, 17 nt, Artificial Sequence
  Synthetic Oligonucleotide; PD-1 exon 2; Set A
guuccagggccugucug

SEQ ID NO: 4046 - RNA, 30 nt, Artificial Sequence
  Synthetic Oligonucleotide; PD-1 exon 2; Set C
uggggggguuccagggccugucuggggagu

SEQ ID NO: 4047 - RNA, 16 nt, Artificial Sequence
  Synthetic Oligonucleotide; PD-1 exon 2; Set A
guuccagggccugucu

SEQ ID NO: 4048 - RNA, 18 nt, Artificial Sequence
  Synthetic Oligonucleotide; PD-1 exon 2; Set A
gguuccagggccugucug

SEQ ID NO: 4049 - RNA, 29 nt, Artificial Sequence
  Synthetic Oligonucleotide; PD-1 exon 2; Set C
uggggggguuccagggccugucuggggag

SEQ ID NO: 4050 - RNA, 31 nt, Artificial Sequence
  Synthetic Oligonucleotide; PD-1 exon 2; Set C
guggggggguuccagggccugucuggggagu

SEQ ID NO: 4051 - RNA, 15 nt, Artificial Sequence
  Synthetic Oligonucleotide; PD-1 exon 2; Set C
guuccagggccuguc

SEQ ID NO: 4052 - RNA, 17 nt, Artificial Sequence
  Synthetic Oligonucleotide; PD-1 exon 2; Set A
gguuccagggccugucu

SEQ ID NO: 4053 - RNA, 19 nt, Artificial Sequence
  Synthetic Oligonucleotide; PD-1 exon 2; Set A
ggguuccagggccugucug

SEQ ID NO: 4054 - RNA, 28 nt, Artificial Sequence
  Synthetic Oligonucleotide; PD-1 exon 2; Set C
uggggggguuccagggccugucugggga

SEQ ID NO: 4055 - RNA, 30 nt, Artificial Sequence
  Synthetic Oligonucleotide; PD-1 exon 2; Set C
guggggggguuccagggccugucuggggag

SEQ ID NO: 4056 - RNA, 16 nt, Artificial Sequence
  Synthetic Oligonucleotide; PD-1 exon 2; Set A
gguuccagggccuguc

SEQ ID NO: 4057 - RNA, 18 nt, Artificial Sequence
  Synthetic Oligonucleotide; PD-1 exon 2; Set A
ggguuccagggccugucu

SEQ ID NO: 4058 - RNA, 20 nt, Artificial Sequence
  Synthetic Oligonucleotide; PD-1 exon 2; Set C
gggguuccagggccugucug

SEQ ID NO: 4059 - RNA, 29 nt, Artificial Sequence
  Synthetic Oligonucleotide; PD-1 exon 2; Set C
guggggggguuccagggccugucugggga

SEQ ID NO: 4060 - RNA, 15 nt, Artificial Sequence
  Synthetic Oligonucleotide; PD-1 exon 2; Set C
gguuccagggccugu

SEQ ID NO: 4061 - RNA, 17 nt, Artificial Sequence
  Synthetic Oligonucleotide; PD-1 exon 2; Set A
ggguuccagggccuguc

SEQ ID NO: 4062 - RNA, 19 nt, Artificial Sequence
  Synthetic Oligonucleotide; PD-1 exon 2; Set C
gggguuccagggccugucu

SEQ ID NO: 4063 - RNA, 30 nt, Artificial Sequence
  Synthetic Oligonucleotide; PD-1 exon 2; Set C
gguggggggguuccagggccugucugggga

SEQ ID NO: 4064 - RNA, 16 nt, Artificial Sequence
  Synthetic Oligonucleotide; PD-1 exon 2; Set A
ggguuccagggccugu

SEQ ID NO: 4065 - RNA, 18 nt, Artificial Sequence
  Synthetic Oligonucleotide; PD-1 exon 2; Set A
gggguuccagggccuguc

SEQ ID NO: 4066 - RNA, 20 nt, Artificial Sequence
  Synthetic Oligonucleotide; PD-1 exon 2; Set C
ggggguuccagggccugucu

SEQ ID NO: 4067 - RNA, 22 nt, Artificial Sequence
  Synthetic Oligonucleotide; PD-1 exon 2; Set C
gggggguuccagggccugucug

SEQ ID NO: 4068 - RNA, 25 nt, Artificial Sequence
  Synthetic Oligonucleotide; PD-1 exon 2; Set C
uggggggguuccagggccugucugg

SEQ ID NO: 4069 - RNA, 17 nt, Artificial Sequence
  Synthetic Oligonucleotide; PD-1 exon 2; Set A
gggguuccagggccugu

SEQ ID NO: 4070 - RNA, 19 nt, Artificial Sequence
  Synthetic Oligonucleotide; PD-1 exon 2; Set C
ggggguuccagggccuguc

SEQ ID NO: 4071 - RNA, 21 nt, Artificial Sequence
  Synthetic Oligonucleotide; PD-1 exon 2; Set C
gggggguuccagggccugucu

SEQ ID NO: 4072 - RNA, 23 nt, Artificial Sequence
  Synthetic Oligonucleotide; PD-1 exon 2; Set C
ggggggguuccagggccugucug

SEQ ID NO: 4073 - RNA, 26 nt, Artificial Sequence
  Synthetic Oligonucleotide; PD-1 exon 2; Set C
guggggggguuccagggccugucugg

SEQ ID NO: 4074 - RNA, 40 nt, Artificial Sequence
  Synthetic Oligonucleotide; PD-1 exon 2; Set C
ggagaagguggggggguuccagggccugucuggggagucu

SEQ ID NO: 4075 - RNA, 20 nt, Artificial Sequence
  Synthetic Oligonucleotide; PD-1 exon 2; Set C
gggggguuccagggccuguc

SEQ ID NO: 4076 - RNA, 22 nt, Artificial Sequence
  Synthetic Oligonucleotide; PD-1 exon 2; Set C
ggggggguuccagggccugucu

SEQ ID NO: 4077 - RNA, 24 nt, Artificial Sequence
  Synthetic Oligonucleotide; PD-1 exon 2; Set C
uggggggguuccagggccugucug

SEQ ID NO: 4078 - RNA, 27 nt, Artificial Sequence
  Synthetic Oligonucleotide; PD-1 exon 2; Set C
gguggggggguuccagggccugucugg

SEQ ID NO: 4079 - RNA, 19 nt, Artificial Sequence
  Synthetic Oligonucleotide; PD-1 exon 2; Set C
gggggguuccagggccugu

SEQ ID NO: 4080 - RNA, 21 nt, Artificial Sequence
  Synthetic Oligonucleotide; PD-1 exon 2; Set C
ggggggguuccagggccuguc

SEQ ID NO: 4081 - RNA, 23 nt, Artificial Sequence
  Synthetic Oligonucleotide; PD-1 exon 2; Set C
uggggggguuccagggccugucu

SEQ ID NO: 4082 - RNA, 25 nt, Artificial Sequence
  Synthetic Oligonucleotide; PD-1 exon 2; Set C
guggggggguuccagggccugucug

SEQ ID NO: 4083 - RNA, 40 nt, Artificial Sequence
  Synthetic Oligonucleotide; PD-1 exon 2; Set C
gggagaagguggggggguuccagggccugucuggggaguc

SEQ ID NO: 4084 - RNA, 38 nt, Artificial Sequence
  Synthetic Oligonucleotide; PD-1 exon 2; Set C
ggagaagguggggggguuccagggccugucuggggagu

SEQ ID NO: 4085 - RNA, 20 nt, Artificial Sequence
  Synthetic Oligonucleotide; PD-1 exon 2; Set C
ggggggguuccagggccugu

SEQ ID NO: 4086 - RNA, 26 nt, Artificial Sequence
  Synthetic Oligonucleotide; PD-1 exon 2; Set C
gguggggggguuccagggccugucug

SEQ ID NO: 4087 - RNA, 22 nt, Artificial Sequence
  Synthetic Oligonucleotide; PD-1 exon 2; Set C
uggggggguuccagggccuguc

SEQ ID NO: 4088 - RNA, 24 nt, Artificial Sequence
  Synthetic Oligonucleotide; PD-1 exon 2; Set C
guggggggguuccagggccugucu

SEQ ID NO: 4089 - RNA, 37 nt, Artificial Sequence
  Synthetic Oligonucleotide; PD-1 exon 2; Set C
ggagaagguggggggguuccagggccugucuggggag

SEQ ID NO: 4090 - RNA, 21 nt, Artificial Sequence
  Synthetic Oligonucleotide; PD-1 exon 2; Set C
uggggggguuccagggccugu

SEQ ID NO: 4091 - RNA, 25 nt, Artificial Sequence
  Synthetic Oligonucleotide; PD-1 exon 2; Set C
gguggggggguuccagggccugucu

SEQ ID NO: 4092 - RNA, 23 nt, Artificial Sequence
  Synthetic Oligonucleotide; PD-1 exon 2; Set C
guggggggguuccagggccuguc

SEQ ID NO: 4093 - RNA, 36 nt, Artificial Sequence
  Synthetic Oligonucleotide; PD-1 exon 2; Set C
ggagaagguggggggguuccagggccugucugggga

SEQ ID NO: 4094 - RNA, 22 nt, Artificial Sequence
  Synthetic Oligonucleotide; PD-1 exon 2; Set C
guggggggguuccagggccugu

SEQ ID NO: 4095 - RNA, 24 nt, Artificial Sequence
  Synthetic Oligonucleotide; PD-1 exon 2; Set C
gguggggggguuccagggccuguc

SEQ ID NO: 4096 - RNA, 23 nt, Artificial Sequence
  Synthetic Oligonucleotide; PD-1 exon 2; Set C
gguggggggguuccagggccugu

SEQ ID NO: 4097 - RNA, 33 nt, Artificial Sequence
  Synthetic Oligonucleotide; PD-1 exon 2; Set C
ggagaagguggggggguuccagggccugucugg

SEQ ID NO: 4098 - RNA, 38 nt, Artificial Sequence
  Synthetic Oligonucleotide; PD-1 exon 2; Set C
uggggagaagguggggggguuccagggccugucugggg

SEQ ID NO: 4099 - RNA, 32 nt, Artificial Sequence
  Synthetic Oligonucleotide; PD-1 exon 2; Set C
ggagaagguggggggguuccagggccugucug

SEQ ID NO: 4100 - RNA, 31 nt, Artificial Sequence
  Synthetic Oligonucleotide; PD-1 exon 2; Set C
ggagaagguggggggguuccagggccugucu

SEQ ID NO: 4101 - RNA, 30 nt, Artificial Sequence
  Synthetic Oligonucleotide; PD-1 exon 2; Set C
ggagaagguggggggguuccagggccuguc

SEQ ID NO: 4102 - RNA, 29 nt, Artificial Sequence
  Synthetic Oligonucleotide; PD-1 exon 2; Set C
ggagaagguggggggguuccagggccugu

SEQ ID NO: 4103 - RNA, 40 nt, Artificial Sequence
  Synthetic Oligonucleotide; PD-1 exon 2; Set C
gggcuggggagaagguggggggguuccagggccugucugg

SEQ ID NO: 4104 - RNA, 39 nt, Artificial Sequence
  Synthetic Oligonucleotide; PD-1 exon 2; Set C
gggcuggggagaagguggggggguuccagggccugucug

SEQ ID NO: 4105 - RNA, 40 nt, Artificial Sequence
  Synthetic Oligonucleotide; PD-1 exon 2; Set C
agggcuggggagaagguggggggguuccagggccugucug

SEQ ID NO: 4106 - RNA, 38 nt, Artificial Sequence
  Synthetic Oligonucleotide; PD-1 exon 2; Set C
gggcuggggagaagguggggggguuccagggccugucu

SEQ ID NO: 4107 - RNA, 39 nt, Artificial Sequence
  Synthetic Oligonucleotide; PD-1 exon 2; Set C
agggcuggggagaagguggggggguuccagggccugucu

SEQ ID NO: 4108 - RNA, 37 nt, Artificial Sequence
  Synthetic Oligonucleotide; PD-1 exon 2; Set C
gggcuggggagaagguggggggguuccagggccuguc

SEQ ID NO: 4109 - RNA, 36 nt, Artificial Sequence
  Synthetic Oligonucleotide; PD-1 exon 2; Set C
gggcuggggagaagguggggggguuccagggccugu

SEQ ID NO: 4110 - RNA, 38 nt, Artificial Sequence
  Synthetic Oligonucleotide; PD-1 exon 2; Set C
agggcuggggagaagguggggggguuccagggccuguc

SEQ ID NO: 4111 - RNA, 40 nt, Artificial Sequence
  Synthetic Oligonucleotide; PD-1 exon 2; Set C
cagggcuggggagaagguggggggguuccagggccugucu

SEQ ID NO: 4112 - RNA, 37 nt, Artificial Sequence
  Synthetic Oligonucleotide; PD-1 exon 2; Set C
agggcuggggagaagguggggggguuccagggccugu

SEQ ID NO: 4113 - RNA, 39 nt, Artificial Sequence
  Synthetic Oligonucleotide; PD-1 exon 2; Set C
cagggcuggggagaagguggggggguuccagggccuguc

SEQ ID NO: 4114 - RNA, 38 nt, Artificial Sequence
  Synthetic Oligonucleotide; PD-1 exon 2; Set C
cagggcuggggagaagguggggggguuccagggccugu

SEQ ID NO: 4115 - RNA, 19 nt, Artificial Sequence
  Synthetic Oligonucleotide; PD-1 exon 2; Set A
gggagaagguggggggguu

SEQ ID NO: 4116 - RNA, 20 nt, Artificial Sequence
  Synthetic Oligonucleotide; PD-1 exon 2; Set C
ggggagaagguggggggguu

SEQ ID NO: 4117 - RNA, 18 nt, Artificial Sequence
  Synthetic Oligonucleotide; PD-1 exon 2; Set A
gggagaaggugggggggu

SEQ ID NO: 4118 - RNA, 21 nt, Artificial Sequence
  Synthetic Oligonucleotide; PD-1 exon 2; Set C
uggggagaagguggggggguu

SEQ ID NO: 4119 - RNA, 19 nt, Artificial Sequence
  Synthetic Oligonucleotide; PD-1 exon 2; Set C
ggggagaaggugggggggu

SEQ ID NO: 4120 - RNA, 17 nt, Artificial Sequence
  Synthetic Oligonucleotide; PD-1 exon 2; Set A
gggagaagguggggggg

SEQ ID NO: 4121 - RNA, 22 nt, Artificial Sequence
  Synthetic Oligonucleotide; PD-1 exon 2; Set C
cuggggagaagguggggggguu

SEQ ID NO: 4122 - RNA, 20 nt, Artificial Sequence
  Synthetic Oligonucleotide; PD-1 exon 2; Set C
uggggagaaggugggggggu

SEQ ID NO: 4123 - RNA, 18 nt, Artificial Sequence
  Synthetic Oligonucleotide; PD-1 exon 2; Set A
ggggagaagguggggggg

SEQ ID NO: 4124 - RNA, 16 nt, Artificial Sequence
  Synthetic Oligonucleotide; PD-1 exon 2; Set A
gggagaaggugggggg

SEQ ID NO: 4125 - RNA, 23 nt, Artificial Sequence
  Synthetic Oligonucleotide; PD-1 exon 2; Set C
gcuggggagaagguggggggguu

SEQ ID NO: 4126 - RNA, 21 nt, Artificial Sequence
  Synthetic Oligonucleotide; PD-1 exon 2; Set C
cuggggagaaggugggggggu

SEQ ID NO: 4127 - RNA, 19 nt, Artificial Sequence
  Synthetic Oligonucleotide; PD-1 exon 2; Set A
uggggagaagguggggggg

SEQ ID NO: 4128 - RNA, 17 nt, Artificial Sequence
  Synthetic Oligonucleotide; PD-1 exon 2; Set A
ggggagaaggugggggg

SEQ ID NO: 4129 - RNA, 15 nt, Artificial Sequence
  Synthetic Oligonucleotide; PD-1 exon 2; Set C
gggagaagguggggg

SEQ ID NO: 4130 - RNA, 24 nt, Artificial Sequence
  Synthetic Oligonucleotide; PD-1 exon 2; Set C
ggcuggggagaagguggggggguu

SEQ ID NO: 4131 - RNA, 22 nt, Artificial Sequence
  Synthetic Oligonucleotide; PD-1 exon 2; Set C
gcuggggagaaggugggggggu

SEQ ID NO: 4132 - RNA, 20 nt, Artificial Sequence
  Synthetic Oligonucleotide; PD-1 exon 2; Set A
cuggggagaagguggggggg

SEQ ID NO: 4133 - RNA, 18 nt, Artificial Sequence
  Synthetic Oligonucleotide; PD-1 exon 2; Set A
uggggagaaggugggggg

SEQ ID NO: 4134 - RNA, 16 nt, Artificial Sequence
  Synthetic Oligonucleotide; PD-1 exon 2; Set A
ggggagaagguggggg

SEQ ID NO: 4135 - RNA, 23 nt, Artificial Sequence
  Synthetic Oligonucleotide; PD-1 exon 2; Set C
ggcuggggagaaggugggggggu

SEQ ID NO: 4136 - RNA, 21 nt, Artificial Sequence
  Synthetic Oligonucleotide; PD-1 exon 2; Set C
gcuggggagaagguggggggg

SEQ ID NO: 4137 - RNA, 19 nt, Artificial Sequence
  Synthetic Oligonucleotide; PD-1 exon 2; Set A
cuggggagaaggugggggg

SEQ ID NO: 4138 - RNA, 17 nt, Artificial Sequence
  Synthetic Oligonucleotide; PD-1 exon 2; Set A
uggggagaagguggggg

SEQ ID NO: 4139 - RNA, 22 nt, Artificial Sequence
  Synthetic Oligonucleotide; PD-1 exon 2; Set C
ggcuggggagaagguggggggg

SEQ ID NO: 4140 - RNA, 20 nt, Artificial Sequence
  Synthetic Oligonucleotide; PD-1 exon 2; Set C
gcuggggagaaggugggggg

SEQ ID NO: 4141 - RNA, 18 nt, Artificial Sequence
  Synthetic Oligonucleotide; PD-1 exon 2; Set A
cuggggagaagguggggg

SEQ ID NO: 4142 - RNA, 16 nt, Artificial Sequence
  Synthetic Oligonucleotide; PD-1 exon 2; Set C
uggggagaaggugggg

SEQ ID NO: 4143 - RNA, 21 nt, Artificial Sequence
  Synthetic Oligonucleotide; PD-1 exon 2; Set C
ggcuggggagaaggugggggg

SEQ ID NO: 4144 - RNA, 19 nt, Artificial Sequence
  Synthetic Oligonucleotide; PD-1 exon 2; Set A
gcuggggagaagguggggg

SEQ ID NO: 4145 - RNA, 15 nt, Artificial Sequence
  Synthetic Oligonucleotide; PD-1 exon 2; Set C
uggggagaagguggg

SEQ ID NO: 4146 - RNA, 20 nt, Artificial Sequence
  Synthetic Oligonucleotide; PD-1 exon 2; Set C
ggcuggggagaagguggggg

SEQ ID NO: 4147 - RNA, 22 nt, Artificial Sequence
  Synthetic Oligonucleotide; PD-1 exon 2; Set C
cagggcuggggagaaggugggg

SEQ ID NO: 4148 - RNA, 18 nt, Artificial Sequence
  Synthetic Oligonucleotide; PD-1 exon 2; Set A
gggcuggggagaaggugg

SEQ ID NO: 4149 - RNA, 21 nt, Artificial Sequence
  Synthetic Oligonucleotide; PD-1 exon 2; Set A
cagggcuggggagaagguggg

SEQ ID NO: 4150 - RNA, 17 nt, Artificial Sequence
  Synthetic Oligonucleotide; PD-1 exon 2; Set A
gggcuggggagaaggug

SEQ ID NO: 4151 - RNA, 16 nt, Artificial Sequence
  Synthetic Oligonucleotide; PD-1 exon 2; Set A
gggcuggggagaaggu

SEQ ID NO: 4152 - RNA, 20 nt, Artificial Sequence
  Synthetic Oligonucleotide; PD-1 exon 2; Set A
cagggcuggggagaaggugg

SEQ ID NO: 4153 - RNA, 18 nt, Artificial Sequence
  Synthetic Oligonucleotide; PD-1 exon 2; Set A
agggcuggggagaaggug

SEQ ID NO: 4154 - RNA, 19 nt, Artificial Sequence
  Synthetic Oligonucleotide; PD-1 exon 2; Set A
cagggcuggggagaaggug

SEQ ID NO: 4155 - RNA, 18 nt, Artificial Sequence
  Synthetic Oligonucleotide; PD-1 exon 2; Set A
cagggcuggggagaaggu

SEQ ID NO: 4156 - RNA, 40 nt, Artificial Sequence
  Synthetic Oligonucleotide; PD-1 exon 2; Set C
cggucaccacgagcagggcuggggagaagguggggggguu

SEQ ID NO: 4157 - RNA, 39 nt, Artificial Sequence
  Synthetic Oligonucleotide; PD-1 exon 2; Set C
cggucaccacgagcagggcuggggagaaggugggggggu

SEQ ID NO: 4158 - RNA, 40 nt, Artificial Sequence
  Synthetic Oligonucleotide; PD-1 exon 2; Set C
ucggucaccacgagcagggcuggggagaaggugggggggu

SEQ ID NO: 4159 - RNA, 38 nt, Artificial Sequence
  Synthetic Oligonucleotide; PD-1 exon 2; Set C
cggucaccacgagcagggcuggggagaagguggggggg

SEQ ID NO: 4160 - RNA, 39 nt, Artificial Sequence
  Synthetic Oligonucleotide; PD-1 exon 2; Set C
ucggucaccacgagcagggcuggggagaagguggggggg

SEQ ID NO: 4161 - RNA, 37 nt, Artificial Sequence
  Synthetic Oligonucleotide; PD-1 exon 2; Set C
cggucaccacgagcagggcuggggagaaggugggggg

SEQ ID NO: 4162 - RNA, 38 nt, Artificial Sequence
  Synthetic Oligonucleotide; PD-1 exon 2; Set C
ucggucaccacgagcagggcuggggagaaggugggggg

SEQ ID NO: 4163 - RNA, 36 nt, Artificial Sequence
  Synthetic Oligonucleotide; PD-1 exon 2; Set C
cggucaccacgagcagggcuggggagaagguggggg

SEQ ID NO: 4164 - RNA, 30 nt, Artificial Sequence
  Synthetic Oligonucleotide; PD-1 exon 2; Set C
ucaccacgagcagggcuggggagaaggugg

SEQ ID NO: 4165 - RNA, 37 nt, Artificial Sequence
  Synthetic Oligonucleotide; PD-1 exon 2; Set C
ucggucaccacgagcagggcuggggagaagguggggg

SEQ ID NO: 4166 - RNA, 35 nt, Artificial Sequence
  Synthetic Oligonucleotide; PD-1 exon 2; Set C
cggucaccacgagcagggcuggggagaaggugggg

SEQ ID NO: 4167 - RNA, 31 nt, Artificial Sequence
  Synthetic Oligonucleotide; PD-1 exon 2; Set C
gucaccacgagcagggcuggggagaaggugg

SEQ ID NO: 4168 - RNA, 29 nt, Artificial Sequence
  Synthetic Oligonucleotide; PD-1 exon 2; Set C
ucaccacgagcagggcuggggagaaggug

SEQ ID NO: 4169 - RNA, 36 nt, Artificial Sequence
  Synthetic Oligonucleotide; PD-1 exon 2; Set C
ucggucaccacgagcagggcuggggagaaggugggg

SEQ ID NO: 4170 - RNA, 34 nt, Artificial Sequence
  Synthetic Oligonucleotide; PD-1 exon 2; Set C
cggucaccacgagcagggcuggggagaagguggg

SEQ ID NO: 4171 - RNA, 28 nt, Artificial Sequence
  Synthetic Oligonucleotide; PD-1 exon 2; Set C
ucaccacgagcagggcuggggagaaggu

SEQ ID NO: 4172 - RNA, 30 nt, Artificial Sequence
  Synthetic Oligonucleotide; PD-1 exon 2; Set C
gucaccacgagcagggcuggggagaaggug

SEQ ID NO: 4173 - RNA, 35 nt, Artificial Sequence
  Synthetic Oligonucleotide; PD-1 exon 2; Set C
ucggucaccacgagcagggcuggggagaagguggg

SEQ ID NO: 4174 - RNA, 29 nt, Artificial Sequence
  Synthetic Oligonucleotide; PD-1 exon 2; Set C
gucaccacgagcagggcuggggagaaggu

SEQ ID NO: 4175 - RNA, 30 nt, Artificial Sequence
  Synthetic Oligonucleotide; PD-1 exon 2; Set C
cggucaccacgagcagggcuggggagaagg

SEQ ID NO: 4176 - RNA, 29 nt, Artificial Sequence
  Synthetic Oligonucleotide; PD-1 exon 2; Set C
cggucaccacgagcagggcuggggagaag

SEQ ID NO: 4177 - RNA, 31 nt, Artificial Sequence
  Synthetic Oligonucleotide; PD-1 exon 2; Set C
ucggucaccacgagcagggcuggggagaagg

SEQ ID NO: 4178 - RNA, 23 nt, Artificial Sequence
  Synthetic Oligonucleotide; PD-1 exon 2; Set C
ucaccacgagcagggcuggggag

SEQ ID NO: 4179 - RNA, 28 nt, Artificial Sequence
  Synthetic Oligonucleotide; PD-1 exon 2; Set C
cggucaccacgagcagggcuggggagaa

SEQ ID NO: 4180 - RNA, 30 nt, Artificial Sequence
  Synthetic Oligonucleotide; PD-1 exon 2; Set C
ucggucaccacgagcagggcuggggagaag

SEQ ID NO: 4181 - RNA, 24 nt, Artificial Sequence
  Synthetic Oligonucleotide; PD-1 exon 2; Set C
gucaccacgagcagggcuggggag

SEQ ID NO: 4182 - RNA, 22 nt, Artificial Sequence
  Synthetic Oligonucleotide; PD-1 exon 2; Set C
ucaccacgagcagggcugggga

SEQ ID NO: 4183 - RNA, 27 nt, Artificial Sequence
  Synthetic Oligonucleotide; PD-1 exon 2; Set C
cggucaccacgagcagggcuggggaga

SEQ ID NO: 4184 - RNA, 29 nt, Artificial Sequence
  Synthetic Oligonucleotide; PD-1 exon 2; Set C
ucggucaccacgagcagggcuggggagaa

SEQ ID NO: 4185 - RNA, 23 nt, Artificial Sequence
  Synthetic Oligonucleotide; PD-1 exon 2; Set C
gucaccacgagcagggcugggga

SEQ ID NO: 4186 - RNA, 28 nt, Artificial Sequence
  Synthetic Oligonucleotide; PD-1 exon 2; Set C
ucggucaccacgagcagggcuggggaga

SEQ ID NO: 4187 - RNA, 26 nt, Artificial Sequence
  Synthetic Oligonucleotide; PD-1 exon 2; Set C
cggucaccacgagcagggcuggggag

SEQ ID NO: 4188 - RNA, 24 nt, Artificial Sequence
  Synthetic Oligonucleotide; PD-1 exon 2; Set C
ggucaccacgagcagggcugggga

SEQ ID NO: 4189 - RNA, 27 nt, Artificial Sequence
  Synthetic Oligonucleotide; PD-1 exon 2; Set C
ucggucaccacgagcagggcuggggag

SEQ ID NO: 4190 - RNA, 40 nt, Artificial Sequence
  Synthetic Oligonucleotide; PD-1 exon 2; Set C
uguccccuucggucaccacgagcagggcuggggagaaggu

SEQ ID NO: 4191 - RNA, 15 nt, Artificial Sequence
  Synthetic Oligonucleotide; PD-1 exon 2; Set C
ucaccacgagcaggg

SEQ ID NO: 4192 - RNA, 16 nt, Artificial Sequence
  Synthetic Oligonucleotide; PD-1 exon 2; Set A
gucaccacgagcaggg

SEQ ID NO: 4193 - RNA, 15 nt, Artificial Sequence
  Synthetic Oligonucleotide; PD-1 exon 2; Set C
gucaccacgagcagg

SEQ ID NO: 4194 - RNA, 17 nt, Artificial Sequence
  Synthetic Oligonucleotide; PD-1 exon 2; Set A
ggucaccacgagcaggg

SEQ ID NO: 4195 - RNA, 40 nt, Artificial Sequence
  Synthetic Oligonucleotide; PD-1 exon 2; Set C
guuguccccuucggucaccacgagcagggcuggggagaag

SEQ ID NO: 4196 - RNA, 16 nt, Artificial Sequence
  Synthetic Oligonucleotide; PD-1 exon 2; Set A
ggucaccacgagcagg

SEQ ID NO: 4197 - RNA, 39 nt, Artificial Sequence
  Synthetic Oligonucleotide; PD-1 exon 2; Set C
guuguccccuucggucaccacgagcagggcuggggagaa

SEQ ID NO: 4198 - RNA, 35 nt, Artificial Sequence
  Synthetic Oligonucleotide; PD-1 exon 2; Set C
uguccccuucggucaccacgagcagggcuggggag

SEQ ID NO: 4199 - RNA, 15 nt, Artificial Sequence
  Synthetic Oligonucleotide; PD-1 exon 2; Set C
ggucaccacgagcag

SEQ ID NO: 4200 - RNA, 38 nt, Artificial Sequence
  Synthetic Oligonucleotide; PD-1 exon 2; Set C
guuguccccuucggucaccacgagcagggcuggggaga

SEQ ID NO: 4201 - RNA, 40 nt, Artificial Sequence
  Synthetic Oligonucleotide; PD-1 exon 2; Set C
cguuguccccuucggucaccacgagcagggcuggggagaa

SEQ ID NO: 4202 - RNA, 36 nt, Artificial Sequence
  Synthetic Oligonucleotide; PD-1 exon 2; Set C
uuguccccuucggucaccacgagcagggcuggggag

SEQ ID NO: 4203 - RNA, 34 nt, Artificial Sequence
  Synthetic Oligonucleotide; PD-1 exon 2; Set C
uguccccuucggucaccacgagcagggcugggga

SEQ ID NO: 4204 - RNA, 39 nt, Artificial Sequence
  Synthetic Oligonucleotide; PD-1 exon 2; Set C
cguuguccccuucggucaccacgagcagggcuggggaga

SEQ ID NO: 4205 - RNA, 37 nt, Artificial Sequence
  Synthetic Oligonucleotide; PD-1 exon 2; Set C
guuguccccuucggucaccacgagcagggcuggggag

SEQ ID NO: 4206 - RNA, 35 nt, Artificial Sequence
  Synthetic Oligonucleotide; PD-1 exon 2; Set C
uuguccccuucggucaccacgagcagggcugggga

SEQ ID NO: 4207 - RNA, 38 nt, Artificial Sequence
  Synthetic Oligonucleotide; PD-1 exon 2; Set C
cguuguccccuucggucaccacgagcagggcuggggag

SEQ ID NO: 4208 - RNA, 36 nt, Artificial Sequence
  Synthetic Oligonucleotide; PD-1 exon 2; Set C
guuguccccuucggucaccacgagcagggcugggga

SEQ ID NO: 4209 - RNA, 37 nt, Artificial Sequence
  Synthetic Oligonucleotide; PD-1 exon 2; Set C
cguuguccccuucggucaccacgagcagggcugggga

SEQ ID NO: 4210 - RNA, 26 nt, Artificial Sequence
  Synthetic Oligonucleotide; PD-1 exon 2; Set C
uguccccuucggucaccacgagcagg

SEQ ID NO: 4211 - RNA, 28 nt, Artificial Sequence
  Synthetic Oligonucleotide; PD-1 exon 2; Set C
uuguccccuucggucaccacgagcaggg

SEQ ID NO: 4212 - RNA, 27 nt, Artificial Sequence
  Synthetic Oligonucleotide; PD-1 exon 2; Set C
uuguccccuucggucaccacgagcagg

SEQ ID NO: 4213 - RNA, 15 nt, Artificial Sequence
  Synthetic Oligonucleotide; PD-1 exon 2; Set C
uguccccuucgguca

SEQ ID NO: 4214 - RNA, 16 nt, Artificial Sequence
  Synthetic Oligonucleotide; PD-1 exon 2; Set C
uuguccccuucgguca

SEQ ID NO: 4215 - RNA, 17 nt, Artificial Sequence
  Synthetic Oligonucleotide; PD-1 exon 2; Set A
guuguccccuucgguca

SEQ ID NO: 4216 - RNA, 15 nt, Artificial Sequence
  Synthetic Oligonucleotide; PD-1 exon 2; Set C
uuguccccuucgguc

SEQ ID NO: 4217 - RNA, 18 nt, Artificial Sequence
  Synthetic Oligonucleotide; PD-1 exon 2; Set A
cguuguccccuucgguca

SEQ ID NO: 4218 - RNA, 16 nt, Artificial Sequence
  Synthetic Oligonucleotide; PD-1 exon 2; Set C
guuguccccuucgguc

SEQ ID NO: 4219 - RNA, 15 nt, Artificial Sequence
  Synthetic Oligonucleotide; PD-1 exon 2; Set C
guuguccccuucggu

SEQ ID NO: 4220 - RNA, 17 nt, Artificial Sequence
  Synthetic Oligonucleotide; PD-1 exon 2; Set A
cguuguccccuucgguc

SEQ ID NO: 4221 - RNA, 16 nt, Artificial Sequence
  Synthetic Oligonucleotide; PD-1 exon 2; Set C
cguuguccccuucggu

SEQ ID NO: 4222 - RNA, 17 nt, Artificial Sequence
  Synthetic Oligonucleotide; PD-1 exon 2; Set C
ggugaagguggcguugu

SEQ ID NO: 4223 - RNA, 16 nt, Artificial Sequence
  Synthetic Oligonucleotide; PD-1 exon 2; Set C
ggugaagguggcguug

SEQ ID NO: 4224 - RNA, 18 nt, Artificial Sequence
  Synthetic Oligonucleotide; PD-1 exon 2; Set C
aggugaagguggcguugu

SEQ ID NO: 4225 - RNA, 17 nt, Artificial Sequence
  Synthetic Oligonucleotide; PD-1 exon 2; Set C
aggugaagguggcguug

SEQ ID NO: 4226 - RNA, 34 nt, Artificial Sequence
  Synthetic Oligonucleotide; PD-1 exon 2; Set C
guguuggagaagcugcaggugaagguggcguugu

SEQ ID NO: 4227 - RNA, 35 nt, Artificial Sequence
  Synthetic Oligonucleotide; PD-1 exon 2; Set C
uguguuggagaagcugcaggugaagguggcguugu

SEQ ID NO: 4228 - RNA, 34 nt, Artificial Sequence
  Synthetic Oligonucleotide; PD-1 exon 2; Set C
uguguuggagaagcugcaggugaagguggcguug

SEQ ID NO: 4229 - RNA, 36 nt, Artificial Sequence
  Synthetic Oligonucleotide; PD-1 exon 2; Set C
auguguuggagaagcugcaggugaagguggcguugu

SEQ ID NO: 4230 - RNA, 35 nt, Artificial Sequence
  Synthetic Oligonucleotide; PD-1 exon 2; Set C
auguguuggagaagcugcaggugaagguggcguug

SEQ ID NO: 4231 - RNA, 37 nt, Artificial Sequence
  Synthetic Oligonucleotide; PD-1 exon 2; Set C
gauguguuggagaagcugcaggugaagguggcguugu

SEQ ID NO: 4232 - RNA, 36 nt, Artificial Sequence
  Synthetic Oligonucleotide; PD-1 exon 2; Set C
gauguguuggagaagcugcaggugaagguggcguug

SEQ ID NO: 4233 - RNA, 18 nt, Artificial Sequence
  Synthetic Oligonucleotide; PD-1 exon 2; Set C
gaagcucuccgauguguu

SEQ ID NO: 4234 - RNA, 17 nt, Artificial Sequence
  Synthetic Oligonucleotide; PD-1 exon 2; Set C
gaagcucuccgaugugu

SEQ ID NO: 4235 - RNA, 19 nt, Artificial Sequence
  Synthetic Oligonucleotide; PD-1 exon 2; Set C
cgaagcucuccgauguguu

SEQ ID NO: 4236 - RNA, 18 nt, Artificial Sequence
  Synthetic Oligonucleotide; PD-1 exon 2; Set C
cgaagcucuccgaugugu

SEQ ID NO: 4237 - RNA, 20 nt, Artificial Sequence
  Synthetic Oligonucleotide; PD-1 exon 2; Set C
acgaagcucuccgauguguu

SEQ ID NO: 4238 - RNA, 16 nt, Artificial Sequence
  Synthetic Oligonucleotide; PD-1 exon 2; Set C
gaagcucuccgaugug

SEQ ID NO: 4239 - RNA, 19 nt, Artificial Sequence
  Synthetic Oligonucleotide; PD-1 exon 2; Set C
acgaagcucuccgaugugu

SEQ ID NO: 4240 - RNA, 21 nt, Artificial Sequence
  Synthetic Oligonucleotide; PD-1 exon 2; Set A
cacgaagcucuccgauguguu

SEQ ID NO: 4241 - RNA, 15 nt, Artificial Sequence
  Synthetic Oligonucleotide; PD-1 exon 2; Set C
gaagcucuccgaugu

SEQ ID NO: 4242 - RNA, 22 nt, Artificial Sequence
  Synthetic Oligonucleotide; PD-1 exon 2; Set A
gcacgaagcucuccgauguguu

SEQ ID NO: 4243 - RNA, 18 nt, Artificial Sequence
  Synthetic Oligonucleotide; PD-1 exon 2; Set C
acgaagcucuccgaugug

SEQ ID NO: 4244 - RNA, 23 nt, Artificial Sequence
  Synthetic Oligonucleotide; PD-1 exon 2; Set A
agcacgaagcucuccgauguguu

SEQ ID NO: 4245 - RNA, 21 nt, Artificial Sequence
  Synthetic Oligonucleotide; PD-1 exon 2; Set A
gcacgaagcucuccgaugugu

SEQ ID NO: 4246 - RNA, 24 nt, Artificial Sequence
  Synthetic Oligonucleotide; PD-1 exon 2; Set A
uagcacgaagcucuccgauguguu

SEQ ID NO: 4247 - RNA, 22 nt, Artificial Sequence
  Synthetic Oligonucleotide; PD-1 exon 2; Set A
agcacgaagcucuccgaugugu

SEQ ID NO: 4248 - RNA, 25 nt, Artificial Sequence
  Synthetic Oligonucleotide; PD-1 exon 2; Set A
uuagcacgaagcucuccgauguguu

SEQ ID NO: 4249 - RNA, 23 nt, Artificial Sequence
  Synthetic Oligonucleotide; PD-1 exon 2; Set A
uagcacgaagcucuccgaugugu

SEQ ID NO: 4250 - RNA, 21 nt, Artificial Sequence
  Synthetic Oligonucleotide; PD-1 exon 2; Set A
agcacgaagcucuccgaugug

SEQ ID NO: 4251 - RNA, 24 nt, Artificial Sequence
  Synthetic Oligonucleotide; PD-1 exon 2; Set A
uuagcacgaagcucuccgaugugu

SEQ ID NO: 4252 - RNA, 22 nt, Artificial Sequence
  Synthetic Oligonucleotide; PD-1 exon 2; Set A
uagcacgaagcucuccgaugug

SEQ ID NO: 4253 - RNA, 23 nt, Artificial Sequence
  Synthetic Oligonucleotide; PD-1 exon 2; Set A
uuagcacgaagcucuccgaugug

SEQ ID NO: 4254 - RNA, 21 nt, Artificial Sequence
  Synthetic Oligonucleotide; PD-1 exon 2; Set A
uagcacgaagcucuccgaugu

SEQ ID NO: 4255 - RNA, 22 nt, Artificial Sequence
  Synthetic Oligonucleotide; PD-1 exon 2; Set A
uuagcacgaagcucuccgaugu

SEQ ID NO: 4256 - RNA, 25 nt, Artificial Sequence
  Synthetic Oligonucleotide; PD-1 exon 2; Set A
guuuagcacgaagcucuccgaugug

SEQ ID NO: 4257 - RNA, 23 nt, Artificial Sequence
  Synthetic Oligonucleotide; PD-1 exon 2; Set A
uuuagcacgaagcucuccgaugu

SEQ ID NO: 4258 - RNA, 21 nt, Artificial Sequence
  Synthetic Oligonucleotide; PD-1 exon 2; Set A
uuagcacgaagcucuccgaug

SEQ ID NO: 4259 - RNA, 22 nt, Artificial Sequence
  Synthetic Oligonucleotide; PD-1 exon 2; Set A
uuuagcacgaagcucuccgaug

SEQ ID NO: 4260 - RNA, 24 nt, Artificial Sequence
  Synthetic Oligonucleotide; PD-1 exon 2; Set A
guuuagcacgaagcucuccgaugu

SEQ ID NO: 4261 - RNA, 20 nt, Artificial Sequence
  Synthetic Oligonucleotide; PD-1 exon 2; Set A
uuagcacgaagcucuccgau

SEQ ID NO: 4262 - RNA, 23 nt, Artificial Sequence
  Synthetic Oligonucleotide; PD-1 exon 2; Set A
guuuagcacgaagcucuccgaug

SEQ ID NO: 4263 - RNA, 25 nt, Artificial Sequence
  Synthetic Oligonucleotide; PD-1 exon 2; Set A
aguuuagcacgaagcucuccgaugu

SEQ ID NO: 4264 - RNA, 21 nt, Artificial Sequence
  Synthetic Oligonucleotide; PD-1 exon 2; Set A
uuuagcacgaagcucuccgau

SEQ ID NO: 4265 - RNA, 24 nt, Artificial Sequence
  Synthetic Oligonucleotide; PD-1 exon 2; Set A
aguuuagcacgaagcucuccgaug

SEQ ID NO: 4266 - RNA, 22 nt, Artificial Sequence
  Synthetic Oligonucleotide; PD-1 exon 2; Set A
guuuagcacgaagcucuccgau

SEQ ID NO: 4267 - RNA, 23 nt, Artificial Sequence
  Synthetic Oligonucleotide; PD-1 exon 2; Set A
aguuuagcacgaagcucuccgau

SEQ ID NO: 4268 - RNA, 34 nt, Artificial Sequence
  Synthetic Oligonucleotide; PD-1 exon 2; Set C
gguaccaguuuagcacgaagcucuccgauguguu

SEQ ID NO: 4269 - RNA, 33 nt, Artificial Sequence
  Synthetic Oligonucleotide; PD-1 exon 2; Set C
gguaccaguuuagcacgaagcucuccgaugugu

SEQ ID NO: 4270 - RNA, 32 nt, Artificial Sequence
  Synthetic Oligonucleotide; PD-1 exon 2; Set C
gguaccaguuuagcacgaagcucuccgaugug

SEQ ID NO: 4271 - RNA, 31 nt, Artificial Sequence
  Synthetic Oligonucleotide; PD-1 exon 2; Set C
gguaccaguuuagcacgaagcucuccgaugu

SEQ ID NO: 4272 - RNA, 30 nt, Artificial Sequence
  Synthetic Oligonucleotide; PD-1 exon 2; Set C
gguaccaguuuagcacgaagcucuccgaug

SEQ ID NO: 4273 - RNA, 19 nt, Artificial Sequence
  Synthetic Oligonucleotide; PD-1 exon 2; Set C
gguaccaguuuagcacgaa

SEQ ID NO: 4274 - RNA, 18 nt, Artificial Sequence
  Synthetic Oligonucleotide; PD-1 exon 2; Set C
gguaccaguuuagcacga

SEQ ID NO: 4275 - RNA, 17 nt, Artificial Sequence
  Synthetic Oligonucleotide; PD-1 exon 2; Set C
gguaccaguuuagcacg

SEQ ID NO: 4276 - RNA, 16 nt, Artificial Sequence
  Synthetic Oligonucleotide; PD-1 exon 2; Set C
gguaccaguuuagcac

SEQ ID NO: 4277 - RNA, 15 nt, Artificial Sequence
  Synthetic Oligonucleotide; PD-1 exon 2; Set C
gguaccaguuuagca

SEQ ID NO: 4278 - RNA, 27 nt, Artificial Sequence
  Synthetic Oligonucleotide; PD-1 exon 2; Set C
gcucaugcgguaccaguuuagcacgaa

SEQ ID NO: 4279 - RNA, 28 nt, Artificial Sequence
  Synthetic Oligonucleotide; PD-1 exon 2; Set C
ggcucaugcgguaccaguuuagcacgaa

SEQ ID NO: 4280 - RNA, 29 nt, Artificial Sequence
  Synthetic Oligonucleotide; PD-1 exon 2; Set C
gggcucaugcgguaccaguuuagcacgaa

SEQ ID NO: 4281 - RNA, 31 nt, Artificial Sequence
  Synthetic Oligonucleotide; PD-1 exon 2; Set C
uggggcucaugcgguaccaguuuagcacgaa

SEQ ID NO: 4282 - RNA, 35 nt, Artificial Sequence
  Synthetic Oligonucleotide; PD-1 exon 2; Set C
uugcuggggcucaugcgguaccaguuuagcacgaa

SEQ ID NO: 4283 - RNA, 21 nt, Artificial Sequence
  Synthetic Oligonucleotide; PD-1 exon 2; Set A
gggcucaugcgguaccaguuu

SEQ ID NO: 4284 - RNA, 37 nt, Artificial Sequence
  Synthetic Oligonucleotide; PD-1 exon 2; Set C
gguugcuggggcucaugcgguaccaguuuagcacgaa

SEQ ID NO: 4285 - RNA, 35 nt, Artificial Sequence
  Synthetic Oligonucleotide; PD-1 exon 2; Set C
guugcuggggcucaugcgguaccaguuuagcacga

SEQ ID NO: 4286 - RNA, 38 nt, Artificial Sequence
  Synthetic Oligonucleotide; PD-1 exon 2; Set C
ugguugcuggggcucaugcgguaccaguuuagcacgaa

SEQ ID NO: 4287 - RNA, 34 nt, Artificial Sequence
  Synthetic Oligonucleotide; PD-1 exon 2; Set C
guugcuggggcucaugcgguaccaguuuagcacg

SEQ ID NO: 4288 - RNA, 39 nt, Artificial Sequence
  Synthetic Oligonucleotide; PD-1 exon 2; Set C
cugguugcuggggcucaugcgguaccaguuuagcacgaa

SEQ ID NO: 4289 - RNA, 33 nt, Artificial Sequence
  Synthetic Oligonucleotide; PD-1 exon 2; Set C
guugcuggggcucaugcgguaccaguuuagcac

SEQ ID NO: 4290 - RNA, 32 nt, Artificial Sequence
  Synthetic Oligonucleotide; PD-1 exon 2; Set C
guugcuggggcucaugcgguaccaguuuagca

SEQ ID NO: 4291 - RNA, 31 nt, Artificial Sequence
  Synthetic Oligonucleotide; PD-1 exon 2; Set C
guugcuggggcucaugcgguaccaguuuagc

SEQ ID NO: 4292 - RNA, 30 nt, Artificial Sequence
  Synthetic Oligonucleotide; PD-1 exon 2; Set C
guugcuggggcucaugcgguaccaguuuag

SEQ ID NO: 4293 - RNA, 37 nt, Artificial Sequence
  Synthetic Oligonucleotide; PD-1 exon 2; Set C
ucugguugcuggggcucaugcgguaccaguuuagcac

SEQ ID NO: 4294 - RNA, 38 nt, Artificial Sequence
  Synthetic Oligonucleotide; PD-1 exon 2; Set C
gucugguugcuggggcucaugcgguaccaguuuagcac

SEQ ID NO: 4295 - RNA, 36 nt, Artificial Sequence
  Synthetic Oligonucleotide; PD-1 exon 2; Set C
ucugguugcuggggcucaugcgguaccaguuuagca

SEQ ID NO: 4296 - RNA, 29 nt, Artificial Sequence
  Synthetic Oligonucleotide; PD-1 exon 2; Set C
gguugcuggggcucaugcgguaccaguuu

SEQ ID NO: 4297 - RNA, 31 nt, Artificial Sequence
  Synthetic Oligonucleotide; PD-1 exon 2; Set C
ugguugcuggggcucaugcgguaccaguuua

SEQ ID NO: 4298 - RNA, 35 nt, Artificial Sequence
  Synthetic Oligonucleotide; PD-1 exon 2; Set C
ucugguugcuggggcucaugcgguaccaguuuagc

SEQ ID NO: 4299 - RNA, 37 nt, Artificial Sequence
  Synthetic Oligonucleotide; PD-1 exon 2; Set C
gucugguugcuggggcucaugcgguaccaguuuagca

SEQ ID NO: 4300 - RNA, 30 nt, Artificial Sequence
  Synthetic Oligonucleotide; PD-1 exon 2; Set C
ugguugcuggggcucaugcgguaccaguuu

SEQ ID NO: 4301 - RNA, 28 nt, Artificial Sequence
  Synthetic Oligonucleotide; PD-1 exon 2; Set C
gguugcuggggcucaugcgguaccaguu

SEQ ID NO: 4302 - RNA, 32 nt, Artificial Sequence
  Synthetic Oligonucleotide; PD-1 exon 2; Set C
cugguugcuggggcucaugcgguaccaguuua

SEQ ID NO: 4303 - RNA, 34 nt, Artificial Sequence
  Synthetic Oligonucleotide; PD-1 exon 2; Set C
ucugguugcuggggcucaugcgguaccaguuuag

SEQ ID NO: 4304 - RNA, 36 nt, Artificial Sequence
  Synthetic Oligonucleotide; PD-1 exon 2; Set C
gucugguugcuggggcucaugcgguaccaguuuagc

SEQ ID NO: 4305 - RNA, 31 nt, Artificial Sequence
  Synthetic Oligonucleotide; PD-1 exon 2; Set C
cugguugcuggggcucaugcgguaccaguuu

SEQ ID NO: 4306 - RNA, 29 nt, Artificial Sequence
  Synthetic Oligonucleotide; PD-1 exon 2; Set C
ugguugcuggggcucaugcgguaccaguu

SEQ ID NO: 4307 - RNA, 35 nt, Artificial Sequence
  Synthetic Oligonucleotide; PD-1 exon 2; Set C
gucugguugcuggggcucaugcgguaccaguuuag

SEQ ID NO: 4308 - RNA, 30 nt, Artificial Sequence
  Synthetic Oligonucleotide; PD-1 exon 2; Set C
cugguugcuggggcucaugcgguaccaguu

SEQ ID NO: 4309 - RNA, 28 nt, Artificial Sequence
  Synthetic Oligonucleotide; PD-1 exon 2; Set C
ugguugcuggggcucaugcgguaccagu

SEQ ID NO: 4310 - RNA, 29 nt, Artificial Sequence
  Synthetic Oligonucleotide; PD-1 exon 2; Set C
cugguugcuggggcucaugcgguaccagu

SEQ ID NO: 4311 - RNA, 35 nt, Artificial Sequence
  Synthetic Oligonucleotide; PD-1 exon 2; Set C
cgucugguugcuggggcucaugcgguaccaguuua

SEQ ID NO: 4312 - RNA, 34 nt, Artificial Sequence
  Synthetic Oligonucleotide; PD-1 exon 2; Set C
cgucugguugcuggggcucaugcgguaccaguuu

SEQ ID NO: 4313 - RNA, 33 nt, Artificial Sequence
  Synthetic Oligonucleotide; PD-1 exon 2; Set C
cgucugguugcuggggcucaugcgguaccaguu

SEQ ID NO: 4314 - RNA, 32 nt, Artificial Sequence
  Synthetic Oligonucleotide; PD-1 exon 2; Set C
cgucugguugcuggggcucaugcgguaccagu

SEQ ID NO: 4315 - RNA, 20 nt, Artificial Sequence
  Synthetic Oligonucleotide; PD-1 exon 2; Set C
guugcuggggcucaugcggu

SEQ ID NO: 4316 - RNA, 24 nt, Artificial Sequence
  Synthetic Oligonucleotide; PD-1 exon 2; Set C
ucugguugcuggggcucaugcggu

SEQ ID NO: 4317 - RNA, 25 nt, Artificial Sequence
  Synthetic Oligonucleotide; PD-1 exon 2; Set C
gucugguugcuggggcucaugcggu

SEQ ID NO: 4318 - RNA, 30 nt, Artificial Sequence
  Synthetic Oligonucleotide; PD-1 exon 2; Set C
uguccgucugguugcuggggcucaugcggu

SEQ ID NO: 4319 - RNA, 31 nt, Artificial Sequence
  Synthetic Oligonucleotide; PD-1 exon 2; Set C
uuguccgucugguugcuggggcucaugcggu

SEQ ID NO: 4320 - RNA, 16 nt, Artificial Sequence
  Synthetic Oligonucleotide; PD-1 exon 2; Set A
ucugguugcuggggcu

SEQ ID NO: 4321 - RNA, 15 nt, Artificial Sequence
  Synthetic Oligonucleotide; PD-1 exon 2; Set C
ucugguugcuggggc

SEQ ID NO: 4322 - RNA, 17 nt, Artificial Sequence
  Synthetic Oligonucleotide; PD-1 exon 2; Set A
gucugguugcuggggcu

SEQ ID NO: 4323 - RNA, 16 nt, Artificial Sequence
  Synthetic Oligonucleotide; PD-1 exon 2; Set A
gucugguugcuggggc

SEQ ID NO: 4324 - RNA, 15 nt, Artificial Sequence
  Synthetic Oligonucleotide; PD-1 exon 2; Set C
gucugguugcugggg

SEQ ID NO: 4325 - RNA, 22 nt, Artificial Sequence
  Synthetic Oligonucleotide; PD-1 exon 2; Set C
uguccgucugguugcuggggcu

SEQ ID NO: 4326 - RNA, 21 nt, Artificial Sequence
  Synthetic Oligonucleotide; PD-1 exon 2; Set C
uguccgucugguugcuggggc

SEQ ID NO: 4327 - RNA, 19 nt, Artificial Sequence
  Synthetic Oligonucleotide; PD-1 exon 2; Set A
uguccgucugguugcuggg

SEQ ID NO: 4328 - RNA, 18 nt, Artificial Sequence
  Synthetic Oligonucleotide; PD-1 exon 2; Set A
uguccgucugguugcugg

SEQ ID NO: 4329 - RNA, 20 nt, Artificial Sequence
  Synthetic Oligonucleotide; PD-1 exon 2; Set A
uuguccgucugguugcuggg

SEQ ID NO: 4330 - RNA, 19 nt, Artificial Sequence
  Synthetic Oligonucleotide; PD-1 exon 2; Set A
uuguccgucugguugcugg

SEQ ID NO: 4331 - RNA, 16 nt, Artificial Sequence
  Synthetic Oligonucleotide; PD-1 exon 2; Set C
uguccgucugguugcu

SEQ ID NO: 4332 - RNA, 15 nt, Artificial Sequence
  Synthetic Oligonucleotide; PD-1 exon 2; Set C
uguccgucugguugc

SEQ ID NO: 4333 - RNA, 17 nt, Artificial Sequence
  Synthetic Oligonucleotide; PD-1 exon 2; Set C
uuguccgucugguugcu

SEQ ID NO: 4334 - RNA, 16 nt, Artificial Sequence
  Synthetic Oligonucleotide; PD-1 exon 2; Set C
uuguccgucugguugc

SEQ ID NO: 4335 - RNA, 15 nt, Artificial Sequence
  Synthetic Oligonucleotide; PD-1 exon 2; Set C
uuguccgucugguug

SEQ ID NO: 4336 - RNA, 31 nt, Artificial Sequence
  Synthetic Oligonucleotide; PD-1 exon 2; Set C
cggggaaggcggccagcuuguccgucugguu

SEQ ID NO: 4337 - RNA, 32 nt, Artificial Sequence
  Synthetic Oligonucleotide; PD-1 exon 2; Set C
ucggggaaggcggccagcuuguccgucugguu

SEQ ID NO: 4338 - RNA, 27 nt, Artificial Sequence
  Synthetic Oligonucleotide; PD-1 exon 2; Set C
cggggaaggcggccagcuuguccgucu

SEQ ID NO: 4339 - RNA, 28 nt, Artificial Sequence
  Synthetic Oligonucleotide; PD-1 exon 2; Set C
ucggggaaggcggccagcuuguccgucu

SEQ ID NO: 4340 - RNA, 26 nt, Artificial Sequence
  Synthetic Oligonucleotide; PD-1 exon 2; Set C
cggggaaggcggccagcuuguccguc

SEQ ID NO: 4341 - RNA, 27 nt, Artificial Sequence
  Synthetic Oligonucleotide; PD-1 exon 2; Set C
ucggggaaggcggccagcuuguccguc

SEQ ID NO: 4342 - RNA, 21 nt, Artificial Sequence
  Synthetic Oligonucleotide; PD-1 exon 2; Set C
cggggaaggcggccagcuugu

SEQ ID NO: 4343 - RNA, 20 nt, Artificial Sequence
  Synthetic Oligonucleotide; PD-1 exon 2; Set C
cggggaaggcggccagcuug

SEQ ID NO: 4344 - RNA, 22 nt, Artificial Sequence
  Synthetic Oligonucleotide; PD-1 exon 2; Set C
ucggggaaggcggccagcuugu

SEQ ID NO: 4345 - RNA, 21 nt, Artificial Sequence
  Synthetic Oligonucleotide; PD-1 exon 2; Set C
ucggggaaggcggccagcuug

SEQ ID NO: 4346 - RNA, 31 nt, Artificial Sequence
  Synthetic Oligonucleotide; PD-1 exon 2; Set C
ugcgccgggcccugaccacgcucauguggaa

SEQ ID NO: 4347 - RNA, 30 nt, Artificial Sequence
  Synthetic Oligonucleotide; PD-1 exon 2; Set C
ugcgccgggcccugaccacgcucaugugga

SEQ ID NO: 4348 - RNA, 31 nt, Artificial Sequence
  Synthetic Oligonucleotide; PD-1 exon 2; Set C
uugcgccgggcccugaccacgcucaugugga

SEQ ID NO: 4349 - RNA, 32 nt, Artificial Sequence
  Synthetic Oligonucleotide; PD-1 exon 2; Set C
auugcgccgggcccugaccacgcucaugugga

SEQ ID NO: 4350 - RNA, 35 nt, Artificial Sequence
  Synthetic Oligonucleotide; PD-1 exon 2; Set C
ucauugcgccgggcccugaccacgcucauguggaa

SEQ ID NO: 4351 - RNA, 33 nt, Artificial Sequence
  Synthetic Oligonucleotide; PD-1 exon 2; Set C
cauugcgccgggcccugaccacgcucaugugga

SEQ ID NO: 4352 - RNA, 36 nt, Artificial Sequence
  Synthetic Oligonucleotide; PD-1 exon 2; Set C
gucauugcgccgggcccugaccacgcucauguggaa

SEQ ID NO: 4353 - RNA, 34 nt, Artificial Sequence
  Synthetic Oligonucleotide; PD-1 exon 2; Set C
ucauugcgccgggcccugaccacgcucaugugga

SEQ ID NO: 4354 - RNA, 37 nt, Artificial Sequence
  Synthetic Oligonucleotide; PD-1 exon 2; Set C
ugucauugcgccgggcccugaccacgcucauguggaa

SEQ ID NO: 4355 - RNA, 35 nt, Artificial Sequence
  Synthetic Oligonucleotide; PD-1 exon 2; Set C
gucauugcgccgggcccugaccacgcucaugugga

SEQ ID NO: 4356 - RNA, 25 nt, Artificial Sequence
  Synthetic Oligonucleotide; PD-1 exon 2; Set C
ugcgccgggcccugaccacgcucau

SEQ ID NO: 4357 - RNA, 38 nt, Artificial Sequence
  Synthetic Oligonucleotide; PD-1 exon 2; Set C
cugucauugcgccgggcccugaccacgcucauguggaa

SEQ ID NO: 4358 - RNA, 36 nt, Artificial Sequence
  Synthetic Oligonucleotide; PD-1 exon 2; Set C
ugucauugcgccgggcccugaccacgcucaugugga

SEQ ID NO: 4359 - RNA, 26 nt, Artificial Sequence
  Synthetic Oligonucleotide; PD-1 exon 2; Set C
uugcgccgggcccugaccacgcucau

SEQ ID NO: 4360 - RNA, 24 nt, Artificial Sequence
  Synthetic Oligonucleotide; PD-1 exon 2; Set C
ugcgccgggcccugaccacgcuca

SEQ ID NO: 4361 - RNA, 39 nt, Artificial Sequence
  Synthetic Oligonucleotide; PD-1 exon 2; Set C
gcugucauugcgccgggcccugaccacgcucauguggaa

SEQ ID NO: 4362 - RNA, 37 nt, Artificial Sequence
  Synthetic Oligonucleotide; PD-1 exon 2; Set C
cugucauugcgccgggcccugaccacgcucaugugga

SEQ ID NO: 4363 - RNA, 27 nt, Artificial Sequence
  Synthetic Oligonucleotide; PD-1 exon 2; Set C
auugcgccgggcccugaccacgcucau

SEQ ID NO: 4364 - RNA, 25 nt, Artificial Sequence
  Synthetic Oligonucleotide; PD-1 exon 2; Set C
uugcgccgggcccugaccacgcuca

SEQ ID NO: 4365 - RNA, 38 nt, Artificial Sequence
  Synthetic Oligonucleotide; PD-1 exon 2; Set C
gcugucauugcgccgggcccugaccacgcucaugugga

SEQ ID NO: 4366 - RNA, 28 nt, Artificial Sequence
  Synthetic Oligonucleotide; PD-1 exon 2; Set C
cauugcgccgggcccugaccacgcucau

SEQ ID NO: 4367 - RNA, 26 nt, Artificial Sequence
  Synthetic Oligonucleotide; PD-1 exon 2; Set C
auugcgccgggcccugaccacgcuca

SEQ ID NO: 4368 - RNA, 29 nt, Artificial Sequence
  Synthetic Oligonucleotide; PD-1 exon 2; Set C
ucauugcgccgggcccugaccacgcucau

SEQ ID NO: 4369 - RNA, 27 nt, Artificial Sequence
  Synthetic Oligonucleotide; PD-1 exon 2; Set C
cauugcgccgggcccugaccacgcuca

SEQ ID NO: 4370 - RNA, 25 nt, Artificial Sequence
  Synthetic Oligonucleotide; PD-1 exon 2; Set C
auugcgccgggcccugaccacgcuc

SEQ ID NO: 4371 - RNA, 30 nt, Artificial Sequence
  Synthetic Oligonucleotide; PD-1 exon 2; Set C
gucauugcgccgggcccugaccacgcucau

SEQ ID NO: 4372 - RNA, 31 nt, Artificial Sequence
  Synthetic Oligonucleotide; PD-1 exon 2; Set C
ugucauugcgccgggcccugaccacgcucau

SEQ ID NO: 4373 - RNA, 30 nt, Artificial Sequence
  Synthetic Oligonucleotide; PD-1 exon 2; Set C
ugucauugcgccgggcccugaccacgcuca

SEQ ID NO: 4374 - RNA, 40 nt, Artificial Sequence
  Synthetic Oligonucleotide; PD-1 exon 2; Set C
uaggugccgcugucauugcgccgggcccugaccacgcuca

SEQ ID NO: 4375 - RNA, 39 nt, Artificial Sequence
  Synthetic Oligonucleotide; PD-1 exon 2; Set C
uaggugccgcugucauugcgccgggcccugaccacgcuc

SEQ ID NO: 4376 - RNA, 38 nt, Artificial Sequence
  Synthetic Oligonucleotide; PD-1 exon 2; Set C
uaggugccgcugucauugcgccgggcccugaccacgcu

SEQ ID NO: 4377 - RNA, 40 nt, Artificial Sequence
  Synthetic Oligonucleotide; PD-1 exon 2; Set C
guaggugccgcugucauugcgccgggcccugaccacgcuc

SEQ ID NO: 4378 - RNA, 39 nt, Artificial Sequence
  Synthetic Oligonucleotide; PD-1 exon 2; Set C
guaggugccgcugucauugcgccgggcccugaccacgcu

SEQ ID NO: 4379 - RNA, 20 nt, Artificial Sequence
  Synthetic Oligonucleotide; PD-1 exon 2; Set B
uaggugccgcugucauugcg

SEQ ID NO: 4380 - RNA, 21 nt, Artificial Sequence
  Synthetic Oligonucleotide; PD-1 exon 2; Set B
guaggugccgcugucauugcg

SEQ ID NO: 4381 - RNA, 21 nt, Artificial Sequence
  Synthetic Oligonucleotide; PD-1 exon 2; Set B
gguaggugccgcugucauugc

SEQ ID NO: 4382 - RNA, 20 nt, Artificial Sequence
  Synthetic Oligonucleotide; PD-1 exon 2; Set B
gguaggugccgcugucauug

SEQ ID NO: 4383 - RNA, 22 nt, Artificial Sequence
  Synthetic Oligonucleotide; PD-1 exon 2; Set B
agguaggugccgcugucauugc

SEQ ID NO: 4384 - RNA, 19 nt, Artificial Sequence
  Synthetic Oligonucleotide; PD-1 exon 2; Set B
gguaggugccgcugucauu

SEQ ID NO: 4385 - RNA, 21 nt, Artificial Sequence
  Synthetic Oligonucleotide; PD-1 exon 2; Set B
agguaggugccgcugucauug

SEQ ID NO: 4386 - RNA, 23 nt, Artificial Sequence
  Synthetic Oligonucleotide; PD-1 exon 2; Set C
gagguaggugccgcugucauugc

SEQ ID NO: 4387 - RNA, 20 nt, Artificial Sequence
  Synthetic Oligonucleotide; PD-1 exon 2; Set B
agguaggugccgcugucauu

SEQ ID NO: 4388 - RNA, 22 nt, Artificial Sequence
  Synthetic Oligonucleotide; PD-1 exon 2; Set B
gagguaggugccgcugucauug

SEQ ID NO: 4389 - RNA, 18 nt, Artificial Sequence
  Synthetic Oligonucleotide; PD-1 exon 2; Set B
gguaggugccgcugucau

SEQ ID NO: 4390 - RNA, 21 nt, Artificial Sequence
  Synthetic Oligonucleotide; PD-1 exon 2; Set B
gagguaggugccgcugucauu

SEQ ID NO: 4391 - RNA, 19 nt, Artificial Sequence
  Synthetic Oligonucleotide; PD-1 exon 2; Set B
agguaggugccgcugucau

SEQ ID NO: 4392 - RNA, 17 nt, Artificial Sequence
  Synthetic Oligonucleotide; PD-1 exon 2; Set B
gguaggugccgcuguca

SEQ ID NO: 4393 - RNA, 20 nt, Artificial Sequence
  Synthetic Oligonucleotide; PD-1 exon 2; Set B
gagguaggugccgcugucau

SEQ ID NO: 4394 - RNA, 18 nt, Artificial Sequence
  Synthetic Oligonucleotide; PD-1 exon 2; Set B
agguaggugccgcuguca

SEQ ID NO: 4395 - RNA, 19 nt, Artificial Sequence
  Synthetic Oligonucleotide; PD-1 exon 2; Set B
gagguaggugccgcuguca

SEQ ID NO: 4396 - RNA, 17 nt, Artificial Sequence
  Synthetic Oligonucleotide; PD-1 exon 2; Set B
agguaggugccgcuguc

SEQ ID NO: 4397 - RNA, 18 nt, Artificial Sequence
  Synthetic Oligonucleotide; PD-1 exon 2; Set B
gagguaggugccgcuguc

SEQ ID NO: 4398 - RNA, 17 nt, Artificial Sequence
  Synthetic Oligonucleotide; PD-1 exon 2; Set B
gagguaggugccgcugu

SEQ ID NO: 4399 - RNA, 36 nt, Artificial Sequence
  Synthetic Oligonucleotide; PD-1 exon 2; Set C
agauggccccacagagguaggugccgcugucauugc

SEQ ID NO: 4400 - RNA, 35 nt, Artificial Sequence
  Synthetic Oligonucleotide; PD-1 exon 2; Set C
agauggccccacagagguaggugccgcugucauug

SEQ ID NO: 4401 - RNA, 37 nt, Artificial Sequence
  Synthetic Oligonucleotide; PD-1 exon 2; Set C
gagauggccccacagagguaggugccgcugucauugc

SEQ ID NO: 4402 - RNA, 34 nt, Artificial Sequence
  Synthetic Oligonucleotide; PD-1 exon 2; Set C
agauggccccacagagguaggugccgcugucauu

SEQ ID NO: 4403 - RNA, 36 nt, Artificial Sequence
  Synthetic Oligonucleotide; PD-1 exon 2; Set C
gagauggccccacagagguaggugccgcugucauug

SEQ ID NO: 4404 - RNA, 38 nt, Artificial Sequence
  Synthetic Oligonucleotide; PD-1 exon 2; Set C
ggagauggccccacagagguaggugccgcugucauugc

SEQ ID NO: 4405 - RNA, 35 nt, Artificial Sequence
  Synthetic Oligonucleotide; PD-1 exon 2; Set C
gagauggccccacagagguaggugccgcugucauu

SEQ ID NO: 4406 - RNA, 37 nt, Artificial Sequence
  Synthetic Oligonucleotide; PD-1 exon 2; Set C
ggagauggccccacagagguaggugccgcugucauug

SEQ ID NO: 4407 - RNA, 39 nt, Artificial Sequence
  Synthetic Oligonucleotide; PD-1 exon 2; Set C
gggagauggccccacagagguaggugccgcugucauugc

SEQ ID NO: 4408 - RNA, 33 nt, Artificial Sequence
  Synthetic Oligonucleotide; PD-1 exon 2; Set C
agauggccccacagagguaggugccgcugucau

SEQ ID NO: 4409 - RNA, 36 nt, Artificial Sequence
  Synthetic Oligonucleotide; PD-1 exon 2; Set C
ggagauggccccacagagguaggugccgcugucauu

SEQ ID NO: 4410 - RNA, 38 nt, Artificial Sequence
  Synthetic Oligonucleotide; PD-1 exon 2; Set C
gggagauggccccacagagguaggugccgcugucauug

SEQ ID NO: 4411 - RNA, 34 nt, Artificial Sequence
  Synthetic Oligonucleotide; PD-1 exon 2; Set C
gagauggccccacagagguaggugccgcugucau

SEQ ID NO: 4412 - RNA, 32 nt, Artificial Sequence
  Synthetic Oligonucleotide; PD-1 exon 2; Set C
agauggccccacagagguaggugccgcuguca

SEQ ID NO: 4413 - RNA, 37 nt, Artificial Sequence
  Synthetic Oligonucleotide; PD-1 exon 2; Set C
gggagauggccccacagagguaggugccgcugucauu

SEQ ID NO: 4414 - RNA, 35 nt, Artificial Sequence
  Synthetic Oligonucleotide; PD-1 exon 2; Set C
ggagauggccccacagagguaggugccgcugucau

SEQ ID NO: 4415 - RNA, 31 nt, Artificial Sequence
  Synthetic Oligonucleotide; PD-1 exon 2; Set C
agauggccccacagagguaggugccgcuguc

SEQ ID NO: 4416 - RNA, 33 nt, Artificial Sequence
  Synthetic Oligonucleotide; PD-1 exon 2; Set C
gagauggccccacagagguaggugccgcuguca

SEQ ID NO: 4417 - RNA, 36 nt, Artificial Sequence
  Synthetic Oligonucleotide; PD-1 exon 2; Set C
gggagauggccccacagagguaggugccgcugucau

SEQ ID NO: 4418 - RNA, 32 nt, Artificial Sequence
  Synthetic Oligonucleotide; PD-1 exon 2; Set C
gagauggccccacagagguaggugccgcuguc

SEQ ID NO: 4419 - RNA, 34 nt, Artificial Sequence
  Synthetic Oligonucleotide; PD-1 exon 2; Set C
ggagauggccccacagagguaggugccgcuguca

SEQ ID NO: 4420 - RNA, 31 nt, Artificial Sequence
  Synthetic Oligonucleotide; PD-1 exon 2; Set C
gagauggccccacagagguaggugccgcugu

SEQ ID NO: 4421 - RNA, 33 nt, Artificial Sequence
  Synthetic Oligonucleotide; PD-1 exon 2; Set C
ggagauggccccacagagguaggugccgcuguc

SEQ ID NO: 4422 - RNA, 35 nt, Artificial Sequence
  Synthetic Oligonucleotide; PD-1 exon 2; Set C
gggagauggccccacagagguaggugccgcuguca

SEQ ID NO: 4423 - RNA, 32 nt, Artificial Sequence
  Synthetic Oligonucleotide; PD-1 exon 2; Set C
ggagauggccccacagagguaggugccgcugu

SEQ ID NO: 4424 - RNA, 34 nt, Artificial Sequence
  Synthetic Oligonucleotide; PD-1 exon 2; Set C
gggagauggccccacagagguaggugccgcuguc

SEQ ID NO: 4425 - RNA, 33 nt, Artificial Sequence
  Synthetic Oligonucleotide; PD-1 exon 2; Set C
gggagauggccccacagagguaggugccgcugu

SEQ ID NO: 4426 - RNA, 26 nt, Artificial Sequence
  Synthetic Oligonucleotide; PD-1 exon 2; Set C
gaucugcgccuugggggccagggaga

SEQ ID NO: 4427 - RNA, 27 nt, Artificial Sequence
  Synthetic Oligonucleotide; PD-1 exon 2; Set C
ugaucugcgccuugggggccagggaga

SEQ ID NO: 4428 - RNA, 25 nt, Artificial Sequence
  Synthetic Oligonucleotide; PD-1 exon 2; Set C
gaucugcgccuugggggccagggag

SEQ ID NO: 4429 - RNA, 28 nt, Artificial Sequence
  Synthetic Oligonucleotide; PD-1 exon 2; Set C
uugaucugcgccuugggggccagggaga

SEQ ID NO: 4430 - RNA, 26 nt, Artificial Sequence
  Synthetic Oligonucleotide; PD-1 exon 2; Set C
ugaucugcgccuugggggccagggag

SEQ ID NO: 4431 - RNA, 24 nt, Artificial Sequence
  Synthetic Oligonucleotide; PD-1 exon 2; Set C
gaucugcgccuugggggccaggga

SEQ ID NO: 4432 - RNA, 29 nt, Artificial Sequence
  Synthetic Oligonucleotide; PD-1 exon 2; Set C
uuugaucugcgccuugggggccagggaga

SEQ ID NO: 4433 - RNA, 27 nt, Artificial Sequence
  Synthetic Oligonucleotide; PD-1 exon 2; Set C
uugaucugcgccuugggggccagggag

SEQ ID NO: 4434 - RNA, 25 nt, Artificial Sequence
  Synthetic Oligonucleotide; PD-1 exon 2; Set C
ugaucugcgccuugggggccaggga

SEQ ID NO: 4435 - RNA, 30 nt, Artificial Sequence
  Synthetic Oligonucleotide; PD-1 exon 2; Set C
cuuugaucugcgccuugggggccagggaga

SEQ ID NO: 4436 - RNA, 28 nt, Artificial Sequence
  Synthetic Oligonucleotide; PD-1 exon 2; Set C
uuugaucugcgccuugggggccagggag

SEQ ID NO: 4437 - RNA, 26 nt, Artificial Sequence
  Synthetic Oligonucleotide; PD-1 exon 2; Set C
uugaucugcgccuugggggccaggga

SEQ ID NO: 4438 - RNA, 31 nt, Artificial Sequence
  Synthetic Oligonucleotide; PD-1 exon 2; Set C
ucuuugaucugcgccuugggggccagggaga

SEQ ID NO: 4439 - RNA, 29 nt, Artificial Sequence
  Synthetic Oligonucleotide; PD-1 exon 2; Set C
cuuugaucugcgccuugggggccagggag

SEQ ID NO: 4440 - RNA, 27 nt, Artificial Sequence
  Synthetic Oligonucleotide; PD-1 exon 2; Set C
uuugaucugcgccuugggggccaggga

SEQ ID NO: 4441 - RNA, 25 nt, Artificial Sequence
  Synthetic Oligonucleotide; PD-1 exon 2; Set C
uugaucugcgccuugggggccaggg

SEQ ID NO: 4442 - RNA, 30 nt, Artificial Sequence
  Synthetic Oligonucleotide; PD-1 exon 2; Set C
ucuuugaucugcgccuugggggccagggag

SEQ ID NO: 4443 - RNA, 28 nt, Artificial Sequence
  Synthetic Oligonucleotide; PD-1 exon 2; Set C
cuuugaucugcgccuugggggccaggga

SEQ ID NO: 4444 - RNA, 26 nt, Artificial Sequence
  Synthetic Oligonucleotide; PD-1 exon 2; Set C
uuugaucugcgccuugggggccaggg

SEQ ID NO: 4445 - RNA, 29 nt, Artificial Sequence
  Synthetic Oligonucleotide; PD-1 exon 2; Set C
ucuuugaucugcgccuugggggccaggga

SEQ ID NO: 4446 - RNA, 27 nt, Artificial Sequence
  Synthetic Oligonucleotide; PD-1 exon 2; Set C
cuuugaucugcgccuugggggccaggg

SEQ ID NO: 4447 - RNA, 28 nt, Artificial Sequence
  Synthetic Oligonucleotide; PD-1 exon 2; Set C
ucuuugaucugcgccuugggggccaggg

SEQ ID NO: 4448 - RNA, 40 nt, Artificial Sequence
  Synthetic Oligonucleotide; PD-1 exon 2; Set C
ccgcaggcucucuuugaucugcgccuugggggccagggag

SEQ ID NO: 4449 - RNA, 39 nt, Artificial Sequence
  Synthetic Oligonucleotide; PD-1 exon 2; Set C
ccgcaggcucucuuugaucugcgccuugggggccaggga

SEQ ID NO: 4450 - RNA, 40 nt, Artificial Sequence
  Synthetic Oligonucleotide; PD-1 exon 2; Set C
cccgcaggcucucuuugaucugcgccuugggggccaggga

SEQ ID NO: 4451 - RNA, 38 nt, Artificial Sequence
  Synthetic Oligonucleotide; PD-1 exon 2; Set C
ccgcaggcucucuuugaucugcgccuugggggccaggg

SEQ ID NO: 4452 - RNA, 39 nt, Artificial Sequence
  Synthetic Oligonucleotide; PD-1 exon 2; Set C
cccgcaggcucucuuugaucugcgccuugggggccaggg

SEQ ID NO: 4453 - RNA, 19 nt, Artificial Sequence
  Synthetic Oligonucleotide; PD-1 exon 2; Set C
cucuuugaucugcgccuug

SEQ ID NO: 4454 - RNA, 15 nt, Artificial Sequence
  Synthetic Oligonucleotide; PD-1 exon 2; Set C
cuuugaucugcgccu

SEQ ID NO: 4455 - RNA, 20 nt, Artificial Sequence
  Synthetic Oligonucleotide; PD-1 exon 2; Set C
ucucuuugaucugcgccuug

SEQ ID NO: 4456 - RNA, 18 nt, Artificial Sequence
  Synthetic Oligonucleotide; PD-1 exon 2; Set C
cucuuugaucugcgccuu

SEQ ID NO: 4457 - RNA, 21 nt, Artificial Sequence
  Synthetic Oligonucleotide; PD-1 exon 2; Set B
cucucuuugaucugcgccuug

SEQ ID NO: 4458 - RNA, 19 nt, Artificial Sequence
  Synthetic Oligonucleotide; PD-1 exon 2; Set C
ucucuuugaucugcgccuu

SEQ ID NO: 4459 - RNA, 15 nt, Artificial Sequence
  Synthetic Oligonucleotide; PD-1 exon 2; Set C
ucuuugaucugcgcc

SEQ ID NO: 4460 - RNA, 20 nt, Artificial Sequence
  Synthetic Oligonucleotide; PD-1 exon 2; Set B
cucucuuugaucugcgccuu

SEQ ID NO: 4461 - RNA, 21 nt, Artificial Sequence
  Synthetic Oligonucleotide; PD-1 exon 2; Set B
gcucucuuugaucugcgccuu

SEQ ID NO: 4462 - RNA, 20 nt, Artificial Sequence
  Synthetic Oligonucleotide; PD-1 exon 2; Set B
ccgcaggcucucuuugaucu

SEQ ID NO: 4463 - RNA, 37 nt, Artificial Sequence
  Synthetic Oligonucleotide; PD-1 exon 2; Set C
gagcucugcccgcaggcucucuuugaucugcgccuug

SEQ ID NO: 4464 - RNA, 19 nt, Artificial Sequence
  Synthetic Oligonucleotide; PD-1 exon 2; Set B
ccgcaggcucucuuugauc

SEQ ID NO: 4465 - RNA, 21 nt, Artificial Sequence
  Synthetic Oligonucleotide; PD-1 exon 2; Set B
cccgcaggcucucuuugaucu

SEQ ID NO: 4466 - RNA, 38 nt, Artificial Sequence
  Synthetic Oligonucleotide; PD-1 exon 2; Set C
ugagcucugcccgcaggcucucuuugaucugcgccuug

SEQ ID NO: 4467 - RNA, 20 nt, Artificial Sequence
  Synthetic Oligonucleotide; PD-1 exon 2; Set B
cccgcaggcucucuuugauc

SEQ ID NO: 4468 - RNA, 37 nt, Artificial Sequence
  Synthetic Oligonucleotide; PD-1 exon 2; Set C
ugagcucugcccgcaggcucucuuugaucugcgccuu

SEQ ID NO: 4469 - RNA, 36 nt, Artificial Sequence
  Synthetic Oligonucleotide; PD-1 exon 2; Set C
ucacccugagcucugcccgcaggcucucuuugaucu

SEQ ID NO: 4470 - RNA, 35 nt, Artificial Sequence
  Synthetic Oligonucleotide; PD-1 exon 2; Set C
ucacccugagcucugcccgcaggcucucuuugauc

SEQ ID NO: 4471 - RNA, 37 nt, Artificial Sequence
  Synthetic Oligonucleotide; PD-1 exon 2; Set C
gucacccugagcucugcccgcaggcucucuuugaucu

SEQ ID NO: 4472 - RNA, 34 nt, Artificial Sequence
  Synthetic Oligonucleotide; PD-1 exon 2; Set C
ucacccugagcucugcccgcaggcucucuuugau

SEQ ID NO: 4473 - RNA, 36 nt, Artificial Sequence
  Synthetic Oligonucleotide; PD-1 exon 2; Set C
gucacccugagcucugcccgcaggcucucuuugauc

SEQ ID NO: 4474 - RNA, 38 nt, Artificial Sequence
  Synthetic Oligonucleotide; PD-1 exon 2; Set C
ugucacccugagcucugcccgcaggcucucuuugaucu

SEQ ID NO: 4475 - RNA, 35 nt, Artificial Sequence
  Synthetic Oligonucleotide; PD-1 exon 2; Set C
gucacccugagcucugcccgcaggcucucuuugau

SEQ ID NO: 4476 - RNA, 33 nt, Artificial Sequence
  Synthetic Oligonucleotide; PD-1 exon 2; Set C
ucacccugagcucugcccgcaggcucucuuuga

SEQ ID NO: 4477 - RNA, 37 nt, Artificial Sequence
  Synthetic Oligonucleotide; PD-1 exon 2; Set C
ugucacccugagcucugcccgcaggcucucuuugauc

SEQ ID NO: 4478 - RNA, 32 nt, Artificial Sequence
  Synthetic Oligonucleotide; PD-1 exon 2; Set C
ucacccugagcucugcccgcaggcucucuuug

SEQ ID NO: 4479 - RNA, 36 nt, Artificial Sequence
  Synthetic Oligonucleotide; PD-1 exon 2; Set C
ugucacccugagcucugcccgcaggcucucuuugau

SEQ ID NO: 4480 - RNA, 34 nt, Artificial Sequence
  Synthetic Oligonucleotide; PD-1 exon 2; Set C
gucacccugagcucugcccgcaggcucucuuuga

SEQ ID NO: 4481 - RNA, 31 nt, Artificial Sequence
  Synthetic Oligonucleotide; PD-1 exon 2; Set C
ucacccugagcucugcccgcaggcucucuuu

SEQ ID NO: 4482 - RNA, 33 nt, Artificial Sequence
  Synthetic Oligonucleotide; PD-1 exon 2; Set C
gucacccugagcucugcccgcaggcucucuuug

SEQ ID NO: 4483 - RNA, 35 nt, Artificial Sequence
  Synthetic Oligonucleotide; PD-1 exon 2; Set C
ugucacccugagcucugcccgcaggcucucuuuga

SEQ ID NO: 4484 - RNA, 32 nt, Artificial Sequence
  Synthetic Oligonucleotide; PD-1 exon 2; Set C
gucacccugagcucugcccgcaggcucucuuu

SEQ ID NO: 4485 - RNA, 30 nt, Artificial Sequence
  Synthetic Oligonucleotide; PD-1 exon 2; Set C
ucacccugagcucugcccgcaggcucucuu

SEQ ID NO: 4486 - RNA, 34 nt, Artificial Sequence
  Synthetic Oligonucleotide; PD-1 exon 2; Set C
ugucacccugagcucugcccgcaggcucucuuug

SEQ ID NO: 4487 - RNA, 33 nt, Artificial Sequence
  Synthetic Oligonucleotide; PD-1 exon 2; Set C
ugucacccugagcucugcccgcaggcucucuuu

SEQ ID NO: 4488 - RNA, 31 nt, Artificial Sequence
  Synthetic Oligonucleotide; PD-1 exon 2; Set C
gucacccugagcucugcccgcaggcucucuu

SEQ ID NO: 4489 - RNA, 29 nt, Artificial Sequence
  Synthetic Oligonucleotide; PD-1 exon 2; Set C
ucacccugagcucugcccgcaggcucucu

SEQ ID NO: 4490 - RNA, 32 nt, Artificial Sequence
  Synthetic Oligonucleotide; PD-1 exon 2; Set C
ugucacccugagcucugcccgcaggcucucuu

SEQ ID NO: 4491 - RNA, 30 nt, Artificial Sequence
  Synthetic Oligonucleotide; PD-1 exon 2; Set C
gucacccugagcucugcccgcaggcucucu

SEQ ID NO: 4492 - RNA, 31 nt, Artificial Sequence
  Synthetic Oligonucleotide; PD-1 exon 2; Set C
ugucacccugagcucugcccgcaggcucucu

SEQ ID NO: 4493 - RNA, 20 nt, Artificial Sequence
  Synthetic Oligonucleotide; PD-1 exon 2; Set C
gucacccugagcucugcccg

SEQ ID NO: 4494 - RNA, 21 nt, Artificial Sequence
  Synthetic Oligonucleotide; PD-1 exon 2; Set C
ugucacccugagcucugcccg

SEQ ID NO: 4495 - RNA, 20 nt, Artificial Sequence
  Synthetic Oligonucleotide; PD-1 exon 2; Set C
ugucacccugagcucugccc

SEQ ID NO: 4496 - RNA, 40 nt, Artificial Sequence
  Synthetic Oligonucleotide; PD-1 exon 2; Set C
gggccuccgaggccgcaccugucacccugagcucugcccg

SEQ ID NO: 4497 - RNA, 39 nt, Artificial Sequence
  Synthetic Oligonucleotide; PD-1 exon 2; Set C
gggccuccgaggccgcaccugucacccugagcucugccc

SEQ ID NO: 4498 - RNA, 24 nt, Artificial Sequence
  Synthetic Oligonucleotide; PD-1 exon 2; Set C
gggccuccgaggccgcaccuguca

SEQ ID NO: 4499 - RNA, 23 nt, Artificial Sequence
  Synthetic Oligonucleotide; PD-1 exon 2; Set C
gggccuccgaggccgcaccuguc

SEQ ID NO: 4500 - RNA, 22 nt, Artificial Sequence
  Synthetic Oligonucleotide; PD-1 exon 2; Set C
gggccuccgaggccgcaccugu

SEQ ID NO: 4501 - RNA, 30 nt, Artificial Sequence
  Synthetic Oligonucleotide; PD-1 exon 2; Set C
gugaggaaggggcuggguggccccacaaag

SEQ ID NO: 4502 - RNA, 31 nt, Artificial Sequence
  Synthetic Oligonucleotide; PD-1 exon 2; Set C
ggugaggaaggggcuggguggccccacaaag

SEQ ID NO: 4503 - RNA, 29 nt, Artificial Sequence
  Synthetic Oligonucleotide; PD-1 exon 2; Set C
gugaggaaggggcuggguggccccacaaa

SEQ ID NO: 4504 - RNA, 28 nt, Artificial Sequence
  Synthetic Oligonucleotide; PD-1 exon 2; Set C
gugaggaaggggcuggguggccccacaa

SEQ ID NO: 4505 - RNA, 32 nt, Artificial Sequence
  Synthetic Oligonucleotide; PD-1 exon 2; Set C
aggugaggaaggggcuggguggccccacaaag

SEQ ID NO: 4506 - RNA, 30 nt, Artificial Sequence
  Synthetic Oligonucleotide; PD-1 exon 2; Set C
ggugaggaaggggcuggguggccccacaaa

SEQ ID NO: 4507 - RNA, 29 nt, Artificial Sequence
  Synthetic Oligonucleotide; PD-1 exon 2; Set C
ggugaggaaggggcuggguggccccacaa

SEQ ID NO: 4508 - RNA, 31 nt, Artificial Sequence
  Synthetic Oligonucleotide; PD-1 exon 2; Set C
aggugaggaaggggcuggguggccccacaaa

SEQ ID NO: 4509 - RNA, 25 nt, Artificial Sequence
  Synthetic Oligonucleotide; PD-1 exon 2; Set C
ugaggaaggggcuggguggccccac

SEQ ID NO: 4510 - RNA, 28 nt, Artificial Sequence
  Synthetic Oligonucleotide; PD-1 exon 2; Set C
ggugaggaaggggcuggguggccccaca

SEQ ID NO: 4511 - RNA, 30 nt, Artificial Sequence
  Synthetic Oligonucleotide; PD-1 exon 2; Set C
aggugaggaaggggcuggguggccccacaa

SEQ ID NO: 4512 - RNA, 29 nt, Artificial Sequence
  Synthetic Oligonucleotide; PD-1 exon 2; Set C
aggugaggaaggggcuggguggccccaca

SEQ ID NO: 4513 - RNA, 20 nt, Artificial Sequence
  Synthetic Oligonucleotide; PD-1 exon 2; Set C
ugaggaaggggcuggguggc

SEQ ID NO: 4514 - RNA, 40 nt, Artificial Sequence
  Synthetic Oligonucleotide; PD-1 exon 2; Set C
auggagagaggugaggaaggggcuggguggccccacaaag

SEQ ID NO: 4515 - RNA, 19 nt, Artificial Sequence
  Synthetic Oligonucleotide; PD-1 exon 2; Set A
gugaggaaggggcugggug

SEQ ID NO: 4516 - RNA, 39 nt, Artificial Sequence
  Synthetic Oligonucleotide; PD-1 exon 2; Set C
auggagagaggugaggaaggggcuggguggccccacaaa

SEQ ID NO: 4517 - RNA, 21 nt, Artificial Sequence
  Synthetic Oligonucleotide; PD-1 exon 2; Set C
ggugaggaaggggcugggugg

SEQ ID NO: 4518 - RNA, 20 nt, Artificial Sequence
  Synthetic Oligonucleotide; PD-1 exon 2; Set A
ggugaggaaggggcugggug

SEQ ID NO: 4519 - RNA, 38 nt, Artificial Sequence
  Synthetic Oligonucleotide; PD-1 exon 2; Set C
auggagagaggugaggaaggggcuggguggccccacaa

SEQ ID NO: 4520 - RNA, 18 nt, Artificial Sequence
  Synthetic Oligonucleotide; PD-1 exon 2; Set A
gugaggaaggggcugggu

SEQ ID NO: 4521 - RNA, 40 nt, Artificial Sequence
  Synthetic Oligonucleotide; PD-1 exon 2; Set C
gauggagagaggugaggaaggggcuggguggccccacaaa

SEQ ID NO: 4522 - RNA, 22 nt, Artificial Sequence
  Synthetic Oligonucleotide; PD-1 exon 2; Set C
aggugaggaaggggcugggugg

SEQ ID NO: 4523 - RNA, 21 nt, Artificial Sequence
  Synthetic Oligonucleotide; PD-1 exon 2; Set A
aggugaggaaggggcugggug

SEQ ID NO: 4524 - RNA, 39 nt, Artificial Sequence
  Synthetic Oligonucleotide; PD-1 exon 2; Set C
gauggagagaggugaggaaggggcuggguggccccacaa

SEQ ID NO: 4525 - RNA, 37 nt, Artificial Sequence
  Synthetic Oligonucleotide; PD-1 exon 2; Set C
auggagagaggugaggaaggggcuggguggccccaca

SEQ ID NO: 4526 - RNA, 19 nt, Artificial Sequence
  Synthetic Oligonucleotide; PD-1 exon 2; Set A
ggugaggaaggggcugggu

SEQ ID NO: 4527 - RNA, 17 nt, Artificial Sequence
  Synthetic Oligonucleotide; PD-1 exon 2; Set A
gugaggaaggggcuggg

SEQ ID NO: 4528 - RNA, 40 nt, Artificial Sequence
  Synthetic Oligonucleotide; PD-1 exon 2; Set C
agauggagagaggugaggaaggggcuggguggccccacaa

SEQ ID NO: 4529 - RNA, 38 nt, Artificial Sequence
  Synthetic Oligonucleotide; PD-1 exon 2; Set C
gauggagagaggugaggaaggggcuggguggccccaca

SEQ ID NO: 4530 - RNA, 20 nt, Artificial Sequence
  Synthetic Oligonucleotide; PD-1 exon 2; Set A
aggugaggaaggggcugggu

SEQ ID NO: 4531 - RNA, 18 nt, Artificial Sequence
  Synthetic Oligonucleotide; PD-1 exon 2; Set A
ggugaggaaggggcuggg

SEQ ID NO: 4532 - RNA, 39 nt, Artificial Sequence
  Synthetic Oligonucleotide; PD-1 exon 2; Set C
agauggagagaggugaggaaggggcuggguggccccaca

SEQ ID NO: 4533 - RNA, 19 nt, Artificial Sequence
  Synthetic Oligonucleotide; PD-1 exon 2; Set A
aggugaggaaggggcuggg

SEQ ID NO: 4534 - RNA, 17 nt, Artificial Sequence
  Synthetic Oligonucleotide; PD-1 exon 2; Set A
ggugaggaaggggcugg

SEQ ID NO: 4535 - RNA, 18 nt, Artificial Sequence
  Synthetic Oligonucleotide; PD-1 exon 2; Set A
aggugaggaaggggcugg

SEQ ID NO: 4536 - RNA, 18 nt, Artificial Sequence
  Synthetic Oligonucleotide; PD-1 exon 2; Set A
gaggugaggaaggggcug

SEQ ID NO: 4537 - RNA, 17 nt, Artificial Sequence
  Synthetic Oligonucleotide; PD-1 exon 2; Set A
gaggugaggaaggggcu

SEQ ID NO: 4538 - RNA, 30 nt, Artificial Sequence
  Synthetic Oligonucleotide; PD-1 exon 2; Set C
auggagagaggugaggaaggggcugggugg

SEQ ID NO: 4539 - RNA, 16 nt, Artificial Sequence
  Synthetic Oligonucleotide; PD-1 exon 2; Set C
gaggugaggaaggggc

SEQ ID NO: 4540 - RNA, 29 nt, Artificial Sequence
  Synthetic Oligonucleotide; PD-1 exon 2; Set C
auggagagaggugaggaaggggcugggug

SEQ ID NO: 4541 - RNA, 31 nt, Artificial Sequence
  Synthetic Oligonucleotide; PD-1 exon 2; Set C
gauggagagaggugaggaaggggcugggugg

SEQ ID NO: 4542 - RNA, 30 nt, Artificial Sequence
  Synthetic Oligonucleotide; PD-1 exon 2; Set C
gauggagagaggugaggaaggggcugggug

SEQ ID NO: 4543 - RNA, 28 nt, Artificial Sequence
  Synthetic Oligonucleotide; PD-1 exon 2; Set C
auggagagaggugaggaaggggcugggu

SEQ ID NO: 4544 - RNA, 32 nt, Artificial Sequence
  Synthetic Oligonucleotide; PD-1 exon 2; Set C
agauggagagaggugaggaaggggcugggugg

SEQ ID NO: 4545 - RNA, 31 nt, Artificial Sequence
  Synthetic Oligonucleotide; PD-1 exon 2; Set C
agauggagagaggugaggaaggggcugggug

SEQ ID NO: 4546 - RNA, 29 nt, Artificial Sequence
  Synthetic Oligonucleotide; PD-1 exon 2; Set C
gauggagagaggugaggaaggggcugggu

SEQ ID NO: 4547 - RNA, 27 nt, Artificial Sequence
  Synthetic Oligonucleotide; PD-1 exon 2; Set C
auggagagaggugaggaaggggcuggg

SEQ ID NO: 4548 - RNA, 23 nt, Artificial Sequence
  Synthetic Oligonucleotide; PD-1 exon 2; Set A
ggagagaggugaggaaggggcug

SEQ ID NO: 4549 - RNA, 30 nt, Artificial Sequence
  Synthetic Oligonucleotide; PD-1 exon 2; Set C
agauggagagaggugaggaaggggcugggu

SEQ ID NO: 4550 - RNA, 28 nt, Artificial Sequence
  Synthetic Oligonucleotide; PD-1 exon 2; Set C
gauggagagaggugaggaaggggcuggg

SEQ ID NO: 4551 - RNA, 26 nt, Artificial Sequence
  Synthetic Oligonucleotide; PD-1 exon 2; Set C
auggagagaggugaggaaggggcugg

SEQ ID NO: 4552 - RNA, 22 nt, Artificial Sequence
  Synthetic Oligonucleotide; PD-1 exon 2; Set A
ggagagaggugaggaaggggcu

SEQ ID NO: 4553 - RNA, 29 nt, Artificial Sequence
  Synthetic Oligonucleotide; PD-1 exon 2; Set C
agauggagagaggugaggaaggggcuggg

SEQ ID NO: 4554 - RNA, 27 nt, Artificial Sequence
  Synthetic Oligonucleotide; PD-1 exon 2; Set C
gauggagagaggugaggaaggggcugg

SEQ ID NO: 4555 - RNA, 35 nt, Artificial Sequence
  Synthetic Oligonucleotide; PD-1 exon 2; Set C
gagagauggagagaggugaggaaggggcugggugg

SEQ ID NO: 4556 - RNA, 23 nt, Artificial Sequence
  Synthetic Oligonucleotide; PD-1 exon 2; Set A
uggagagaggugaggaaggggcu

SEQ ID NO: 4557 - RNA, 34 nt, Artificial Sequence
  Synthetic Oligonucleotide; PD-1 exon 2; Set C
gagagauggagagaggugaggaaggggcugggug

SEQ ID NO: 4558 - RNA, 28 nt, Artificial Sequence
  Synthetic Oligonucleotide; PD-1 exon 2; Set C
agauggagagaggugaggaaggggcugg

SEQ ID NO: 4559 - RNA, 22 nt, Artificial Sequence
  Synthetic Oligonucleotide; PD-1 exon 2; Set A
uggagagaggugaggaaggggc

SEQ ID NO: 4560 - RNA, 35 nt, Artificial Sequence
  Synthetic Oligonucleotide; PD-1 exon 2; Set C
ugagagauggagagaggugaggaaggggcugggug

SEQ ID NO: 4561 - RNA, 33 nt, Artificial Sequence
  Synthetic Oligonucleotide; PD-1 exon 2; Set C
gagagauggagagaggugaggaaggggcugggu

SEQ ID NO: 4562 - RNA, 37 nt, Artificial Sequence
  Synthetic Oligonucleotide; PD-1 exon 2; Set C
cugagagauggagagaggugaggaaggggcugggugg

SEQ ID NO: 4563 - RNA, 36 nt, Artificial Sequence
  Synthetic Oligonucleotide; PD-1 exon 2; Set C
cugagagauggagagaggugaggaaggggcugggug

SEQ ID NO: 4564 - RNA, 34 nt, Artificial Sequence
  Synthetic Oligonucleotide; PD-1 exon 2; Set C
ugagagauggagagaggugaggaaggggcugggu

SEQ ID NO: 4565 - RNA, 32 nt, Artificial Sequence
  Synthetic Oligonucleotide; PD-1 exon 2; Set C
gagagauggagagaggugaggaaggggcuggg

SEQ ID NO: 4566 - RNA, 28 nt, Artificial Sequence
  Synthetic Oligonucleotide; PD-1 exon 2; Set C
gagauggagagaggugaggaaggggcug

SEQ ID NO: 4567 - RNA, 40 nt, Artificial Sequence
  Synthetic Oligonucleotide; PD-1 exon 2; Set C
gucugagagauggagagaggugaggaaggggcuggguggc

SEQ ID NO: 4568 - RNA, 35 nt, Artificial Sequence
  Synthetic Oligonucleotide; PD-1 exon 2; Set C
cugagagauggagagaggugaggaaggggcugggu

SEQ ID NO: 4569 - RNA, 33 nt, Artificial Sequence
  Synthetic Oligonucleotide; PD-1 exon 2; Set C
ugagagauggagagaggugaggaaggggcuggg

SEQ ID NO: 4570 - RNA, 31 nt, Artificial Sequence
  Synthetic Oligonucleotide; PD-1 exon 2; Set C
gagagauggagagaggugaggaaggggcugg

SEQ ID NO: 4571 - RNA, 29 nt, Artificial Sequence
  Synthetic Oligonucleotide; PD-1 exon 2; Set C
agagauggagagaggugaggaaggggcug

SEQ ID NO: 4572 - RNA, 27 nt, Artificial Sequence
  Synthetic Oligonucleotide; PD-1 exon 2; Set C
gagauggagagaggugaggaaggggcu

SEQ ID NO: 4573 - RNA, 34 nt, Artificial Sequence
  Synthetic Oligonucleotide; PD-1 exon 2; Set C
cugagagauggagagaggugaggaaggggcuggg

SEQ ID NO: 4574 - RNA, 32 nt, Artificial Sequence
  Synthetic Oligonucleotide; PD-1 exon 2; Set C
ugagagauggagagaggugaggaaggggcugg

SEQ ID NO: 4575 - RNA, 28 nt, Artificial Sequence
  Synthetic Oligonucleotide; PD-1 exon 2; Set C
agagauggagagaggugaggaaggggcu

SEQ ID NO: 4576 - RNA, 26 nt, Artificial Sequence
  Synthetic Oligonucleotide; PD-1 exon 2; Set C
gagauggagagaggugaggaaggggc

SEQ ID NO: 4577 - RNA, 33 nt, Artificial Sequence
  Synthetic Oligonucleotide; PD-1 exon 2; Set C
cugagagauggagagaggugaggaaggggcugg

SEQ ID NO: 4578 - RNA, 27 nt, Artificial Sequence
  Synthetic Oligonucleotide; PD-1 exon 2; Set C
agagauggagagaggugaggaaggggc

SEQ ID NO: 4579 - RNA, 18 nt, Artificial Sequence
  Synthetic Oligonucleotide; PD-1 exon 2; Set C
auggagagaggugaggaa

SEQ ID NO: 4580 - RNA, 19 nt, Artificial Sequence
  Synthetic Oligonucleotide; PD-1 exon 2; Set C
gauggagagaggugaggaa

SEQ ID NO: 4581 - RNA, 17 nt, Artificial Sequence
  Synthetic Oligonucleotide; PD-1 exon 2; Set C
auggagagaggugagga

SEQ ID NO: 4582 - RNA, 20 nt, Artificial Sequence
  Synthetic Oligonucleotide; PD-1 exon 2; Set C
agauggagagaggugaggaa

SEQ ID NO: 4583 - RNA, 18 nt, Artificial Sequence
  Synthetic Oligonucleotide; PD-1 exon 2; Set C
gauggagagaggugagga

SEQ ID NO: 4584 - RNA, 16 nt, Artificial Sequence
  Synthetic Oligonucleotide; PD-1 exon 2; Set C
auggagagaggugagg

SEQ ID NO: 4585 - RNA, 32 nt, Artificial Sequence
  Synthetic Oligonucleotide; PD-1 exon 2; Set C
ucugagagauggagagaggugaggaaggggcu

SEQ ID NO: 4586 - RNA, 19 nt, Artificial Sequence
  Synthetic Oligonucleotide; PD-1 exon 2; Set C
agauggagagaggugagga

SEQ ID NO: 4587 - RNA, 17 nt, Artificial Sequence
  Synthetic Oligonucleotide; PD-1 exon 2; Set C
gauggagagaggugagg

SEQ ID NO: 4588 - RNA, 15 nt, Artificial Sequence
  Synthetic Oligonucleotide; PD-1 exon 2; Set C
auggagagaggugag

SEQ ID NO: 4589 - RNA, 31 nt, Artificial Sequence
  Synthetic Oligonucleotide; PD-1 exon 2; Set C
ucugagagauggagagaggugaggaaggggc

SEQ ID NO: 4590 - RNA, 18 nt, Artificial Sequence
  Synthetic Oligonucleotide; PD-1 exon 2; Set C
agauggagagaggugagg

SEQ ID NO: 4591 - RNA, 16 nt, Artificial Sequence
  Synthetic Oligonucleotide; PD-1 exon 2; Set C
gauggagagaggugag

SEQ ID NO: 4592 - RNA, 34 nt, Artificial Sequence
  Synthetic Oligonucleotide; PD-1 exon 2; Set C
agucugagagauggagagaggugaggaaggggcu

SEQ ID NO: 4593 - RNA, 23 nt, Artificial Sequence
  Synthetic Oligonucleotide; PD-1 exon 2; Set A
gagagauggagagaggugaggaa

SEQ ID NO: 4594 - RNA, 17 nt, Artificial Sequence
  Synthetic Oligonucleotide; PD-1 exon 2; Set C
agauggagagaggugag

SEQ ID NO: 4595 - RNA, 15 nt, Artificial Sequence
  Synthetic Oligonucleotide; PD-1 exon 2; Set C
gauggagagagguga

SEQ ID NO: 4596 - RNA, 35 nt, Artificial Sequence
  Synthetic Oligonucleotide; PD-1 exon 2; Set C
gagucugagagauggagagaggugaggaaggggcu

SEQ ID NO: 4597 - RNA, 33 nt, Artificial Sequence
  Synthetic Oligonucleotide; PD-1 exon 2; Set C
agucugagagauggagagaggugaggaaggggc

SEQ ID NO: 4598 - RNA, 24 nt, Artificial Sequence
  Synthetic Oligonucleotide; PD-1 exon 2; Set A
ugagagauggagagaggugaggaa

SEQ ID NO: 4599 - RNA, 22 nt, Artificial Sequence
  Synthetic Oligonucleotide; PD-1 exon 2; Set A
gagagauggagagaggugagga

SEQ ID NO: 4600 - RNA, 16 nt, Artificial Sequence
  Synthetic Oligonucleotide; PD-1 exon 2; Set C
agauggagagagguga

SEQ ID NO: 4601 - RNA, 34 nt, Artificial Sequence
  Synthetic Oligonucleotide; PD-1 exon 2; Set C
gagucugagagauggagagaggugaggaaggggc

SEQ ID NO: 4602 - RNA, 25 nt, Artificial Sequence
  Synthetic Oligonucleotide; PD-1 exon 2; Set A
cugagagauggagagaggugaggaa

SEQ ID NO: 4603 - RNA, 23 nt, Artificial Sequence
  Synthetic Oligonucleotide; PD-1 exon 2; Set A
ugagagauggagagaggugagga

SEQ ID NO: 4604 - RNA, 21 nt, Artificial Sequence
  Synthetic Oligonucleotide; PD-1 exon 2; Set C
gagagauggagagaggugagg

SEQ ID NO: 4605 - RNA, 35 nt, Artificial Sequence
  Synthetic Oligonucleotide; PD-1 exon 2; Set C
ggagucugagagauggagagaggugaggaaggggc

SEQ ID NO: 4606 - RNA, 24 nt, Artificial Sequence
  Synthetic Oligonucleotide; PD-1 exon 2; Set A
cugagagauggagagaggugagga

SEQ ID NO: 4607 - RNA, 22 nt, Artificial Sequence
  Synthetic Oligonucleotide; PD-1 exon 2; Set A
ugagagauggagagaggugagg

SEQ ID NO: 4608 - RNA, 20 nt, Artificial Sequence
  Synthetic Oligonucleotide; PD-1 exon 2; Set C
gagagauggagagaggugag

SEQ ID NO: 4609 - RNA, 23 nt, Artificial Sequence
  Synthetic Oligonucleotide; PD-1 exon 2; Set A
cugagagauggagagaggugagg

SEQ ID NO: 4610 - RNA, 19 nt, Artificial Sequence
  Synthetic Oligonucleotide; PD-1 exon 2; Set C
gagagauggagagagguga

SEQ ID NO: 4611 - RNA, 21 nt, Artificial Sequence
  Synthetic Oligonucleotide; PD-1 exon 2; Set C
ugagagauggagagaggugag

SEQ ID NO: 4612 - RNA, 22 nt, Artificial Sequence
  Synthetic Oligonucleotide; PD-1 exon 2; Set C
cugagagauggagagaggugag

SEQ ID NO: 4613 - RNA, 20 nt, Artificial Sequence
  Synthetic Oligonucleotide; PD-1 exon 2; Set C
ugagagauggagagagguga

SEQ ID NO: 4614 - RNA, 40 nt, Artificial Sequence
  Synthetic Oligonucleotide; PD-1 exon 2; Set C
cuggggagucugagagauggagagaggugaggaaggggcu

SEQ ID NO: 4615 - RNA, 21 nt, Artificial Sequence
  Synthetic Oligonucleotide; PD-1 exon 2; Set C
cugagagauggagagagguga

SEQ ID NO: 4616 - RNA, 39 nt, Artificial Sequence
  Synthetic Oligonucleotide; PD-1 exon 2; Set C
cuggggagucugagagauggagagaggugaggaaggggc

SEQ ID NO: 4617 - RNA, 40 nt, Artificial Sequence
  Synthetic Oligonucleotide; PD-1 exon 2; Set C
ucuggggagucugagagauggagagaggugaggaaggggc

SEQ ID NO: 4618 - RNA, 22 nt, Artificial Sequence
  Synthetic Oligonucleotide; PD-1 exon 2; Set A
gucugagagauggagagaggug

SEQ ID NO: 4619 - RNA, 21 nt, Artificial Sequence
  Synthetic Oligonucleotide; PD-1 exon 2; Set C
gucugagagauggagagaggu

SEQ ID NO: 4620 - RNA, 20 nt, Artificial Sequence
  Synthetic Oligonucleotide; PD-1 exon 2; Set C
gucugagagauggagagagg

SEQ ID NO: 4621 - RNA, 24 nt, Artificial Sequence
  Synthetic Oligonucleotide; PD-1 exon 2; Set A
gagucugagagauggagagaggug

SEQ ID NO: 4622 - RNA, 23 nt, Artificial Sequence
  Synthetic Oligonucleotide; PD-1 exon 2; Set A
gagucugagagauggagagaggu

SEQ ID NO: 4623 - RNA, 25 nt, Artificial Sequence
  Synthetic Oligonucleotide; PD-1 exon 2; Set A
ggagucugagagauggagagaggug

SEQ ID NO: 4624 - RNA, 24 nt, Artificial Sequence
  Synthetic Oligonucleotide; PD-1 exon 2; Set A
ggagucugagagauggagagaggu

SEQ ID NO: 4625 - RNA, 22 nt, Artificial Sequence
  Synthetic Oligonucleotide; PD-1 exon 2; Set C
gagucugagagauggagagagg

SEQ ID NO: 4626 - RNA, 26 nt, Artificial Sequence
  Synthetic Oligonucleotide; PD-1 exon 2; Set A
gggagucugagagauggagagaggug

SEQ ID NO: 4627 - RNA, 25 nt, Artificial Sequence
  Synthetic Oligonucleotide; PD-1 exon 2; Set A
gggagucugagagauggagagaggu

SEQ ID NO: 4628 - RNA, 23 nt, Artificial Sequence
  Synthetic Oligonucleotide; PD-1 exon 2; Set A
ggagucugagagauggagagagg

SEQ ID NO: 4629 - RNA, 27 nt, Artificial Sequence
  Synthetic Oligonucleotide; PD-1 exon 2; Set C
ggggagucugagagauggagagaggug

SEQ ID NO: 4630 - RNA, 38 nt, Artificial Sequence
  Synthetic Oligonucleotide; PD-1 exon 2; Set C
cugucuggggagucugagagauggagagaggugaggaa

SEQ ID NO: 4631 - RNA, 26 nt, Artificial Sequence
  Synthetic Oligonucleotide; PD-1 exon 2; Set C
ggggagucugagagauggagagaggu

SEQ ID NO: 4632 - RNA, 24 nt, Artificial Sequence
  Synthetic Oligonucleotide; PD-1 exon 2; Set A
gggagucugagagauggagagagg

SEQ ID NO: 4633 - RNA, 28 nt, Artificial Sequence
  Synthetic Oligonucleotide; PD-1 exon 2; Set C
uggggagucugagagauggagagaggug

SEQ ID NO: 4634 - RNA, 39 nt, Artificial Sequence
  Synthetic Oligonucleotide; PD-1 exon 2; Set C
ccugucuggggagucugagagauggagagaggugaggaa

SEQ ID NO: 4635 - RNA, 37 nt, Artificial Sequence
  Synthetic Oligonucleotide; PD-1 exon 2; Set C
cugucuggggagucugagagauggagagaggugagga

SEQ ID NO: 4636 - RNA, 27 nt, Artificial Sequence
  Synthetic Oligonucleotide; PD-1 exon 2; Set C
uggggagucugagagauggagagaggu

SEQ ID NO: 4637 - RNA, 25 nt, Artificial Sequence
  Synthetic Oligonucleotide; PD-1 exon 2; Set A
ggggagucugagagauggagagagg

SEQ ID NO: 4638 - RNA, 40 nt, Artificial Sequence
  Synthetic Oligonucleotide; PD-1 exon 2; Set C
gccugucuggggagucugagagauggagagaggugaggaa

SEQ ID NO: 4639 - RNA, 38 nt, Artificial Sequence
  Synthetic Oligonucleotide; PD-1 exon 2; Set C
ccugucuggggagucugagagauggagagaggugagga

SEQ ID NO: 4640 - RNA, 36 nt, Artificial Sequence
  Synthetic Oligonucleotide; PD-1 exon 2; Set C
cugucuggggagucugagagauggagagaggugagg

SEQ ID NO: 4641 - RNA, 28 nt, Artificial Sequence
  Synthetic Oligonucleotide; PD-1 exon 2; Set C
cuggggagucugagagauggagagaggu

SEQ ID NO: 4642 - RNA, 26 nt, Artificial Sequence
  Synthetic Oligonucleotide; PD-1 exon 2; Set A
uggggagucugagagauggagagagg

SEQ ID NO: 4643 - RNA, 39 nt, Artificial Sequence
  Synthetic Oligonucleotide; PD-1 exon 2; Set C
gccugucuggggagucugagagauggagagaggugagga

SEQ ID NO: 4644 - RNA, 37 nt, Artificial Sequence
  Synthetic Oligonucleotide; PD-1 exon 2; Set C
ccugucuggggagucugagagauggagagaggugagg

SEQ ID NO: 4645 - RNA, 35 nt, Artificial Sequence
  Synthetic Oligonucleotide; PD-1 exon 2; Set C
cugucuggggagucugagagauggagagaggugag

SEQ ID NO: 4646 - RNA, 29 nt, Artificial Sequence
  Synthetic Oligonucleotide; PD-1 exon 2; Set C
ucuggggagucugagagauggagagaggu

SEQ ID NO: 4647 - RNA, 31 nt, Artificial Sequence
  Synthetic Oligonucleotide; PD-1 exon 2; Set C
gucuggggagucugagagauggagagaggug

SEQ ID NO: 4648 - RNA, 40 nt, Artificial Sequence
  Synthetic Oligonucleotide; PD-1 exon 2; Set C
ggccugucuggggagucugagagauggagagaggugagga

SEQ ID NO: 4649 - RNA, 38 nt, Artificial Sequence
  Synthetic Oligonucleotide; PD-1 exon 2; Set C
gccugucuggggagucugagagauggagagaggugagg

SEQ ID NO: 4650 - RNA, 34 nt, Artificial Sequence
  Synthetic Oligonucleotide; PD-1 exon 2; Set C
cugucuggggagucugagagauggagagagguga

SEQ ID NO: 4651 - RNA, 36 nt, Artificial Sequence
  Synthetic Oligonucleotide; PD-1 exon 2; Set C
ccugucuggggagucugagagauggagagaggugag

SEQ ID NO: 4652 - RNA, 30 nt, Artificial Sequence
  Synthetic Oligonucleotide; PD-1 exon 2; Set C
gucuggggagucugagagauggagagaggu

SEQ ID NO: 4653 - RNA, 28 nt, Artificial Sequence
  Synthetic Oligonucleotide; PD-1 exon 2; Set C
ucuggggagucugagagauggagagagg

SEQ ID NO: 4654 - RNA, 32 nt, Artificial Sequence
  Synthetic Oligonucleotide; PD-1 exon 2; Set C
ugucuggggagucugagagauggagagaggug

SEQ ID NO: 4655 - RNA, 39 nt, Artificial Sequence
  Synthetic Oligonucleotide; PD-1 exon 2; Set C
ggccugucuggggagucugagagauggagagaggugagg

SEQ ID NO: 4656 - RNA, 37 nt, Artificial Sequence
  Synthetic Oligonucleotide; PD-1 exon 2; Set C
gccugucuggggagucugagagauggagagaggugag

SEQ ID NO: 4657 - RNA, 35 nt, Artificial Sequence
  Synthetic Oligonucleotide; PD-1 exon 2; Set C
ccugucuggggagucugagagauggagagagguga

SEQ ID NO: 4658 - RNA, 31 nt, Artificial Sequence
  Synthetic Oligonucleotide; PD-1 exon 2; Set C
ugucuggggagucugagagauggagagaggu

SEQ ID NO: 4659 - RNA, 29 nt, Artificial Sequence
  Synthetic Oligonucleotide; PD-1 exon 2; Set C
gucuggggagucugagagauggagagagg

SEQ ID NO: 4660 - RNA, 40 nt, Artificial Sequence
  Synthetic Oligonucleotide; PD-1 exon 2; Set C
gggccugucuggggagucugagagauggagagaggugagg

SEQ ID NO: 4661 - RNA, 38 nt, Artificial Sequence
  Synthetic Oligonucleotide; PD-1 exon 2; Set C
ggccugucuggggagucugagagauggagagaggugag

SEQ ID NO: 4662 - RNA, 36 nt, Artificial Sequence
  Synthetic Oligonucleotide; PD-1 exon 2; Set C
gccugucuggggagucugagagauggagagagguga

SEQ ID NO: 4663 - RNA, 30 nt, Artificial Sequence
  Synthetic Oligonucleotide; PD-1 exon 2; Set C
ugucuggggagucugagagauggagagagg

SEQ ID NO: 4664 - RNA, 39 nt, Artificial Sequence
  Synthetic Oligonucleotide; PD-1 exon 2; Set C
gggccugucuggggagucugagagauggagagaggugag

SEQ ID NO: 4665 - RNA, 37 nt, Artificial Sequence
  Synthetic Oligonucleotide; PD-1 exon 2; Set C
ggccugucuggggagucugagagauggagagagguga

SEQ ID NO: 4666 - RNA, 38 nt, Artificial Sequence
  Synthetic Oligonucleotide; PD-1 exon 2; Set C
gggccugucuggggagucugagagauggagagagguga

SEQ ID NO: 4667 - RNA, 30 nt, Artificial Sequence
  Synthetic Oligonucleotide; PD-1 exon 2; Set C
cugucuggggagucugagagauggagagag

SEQ ID NO: 4668 - RNA, 19 nt, Artificial Sequence
  Synthetic Oligonucleotide; PD-1 exon 2; Set C
cuggggagucugagagaug

SEQ ID NO: 4669 - RNA, 18 nt, Artificial Sequence
  Synthetic Oligonucleotide; PD-1 exon 2; Set C
cuggggagucugagagau

SEQ ID NO: 4670 - RNA, 20 nt, Artificial Sequence
  Synthetic Oligonucleotide; PD-1 exon 2; Set C
ucuggggagucugagagaug

SEQ ID NO: 4671 - RNA, 25 nt, Artificial Sequence
  Synthetic Oligonucleotide; PD-1 exon 2; Set A
cugucuggggagucugagagaugga

SEQ ID NO: 4672 - RNA, 17 nt, Artificial Sequence
  Synthetic Oligonucleotide; PD-1 exon 2; Set C
cuggggagucugagaga

SEQ ID NO: 4673 - RNA, 19 nt, Artificial Sequence
  Synthetic Oligonucleotide; PD-1 exon 2; Set C
ucuggggagucugagagau

SEQ ID NO: 4674 - RNA, 21 nt, Artificial Sequence
  Synthetic Oligonucleotide; PD-1 exon 2; Set A
gucuggggagucugagagaug

SEQ ID NO: 4675 - RNA, 24 nt, Artificial Sequence
  Synthetic Oligonucleotide; PD-1 exon 2; Set A
cugucuggggagucugagagaugg

SEQ ID NO: 4676 - RNA, 18 nt, Artificial Sequence
  Synthetic Oligonucleotide; PD-1 exon 2; Set C
ucuggggagucugagaga

SEQ ID NO: 4677 - RNA, 20 nt, Artificial Sequence
  Synthetic Oligonucleotide; PD-1 exon 2; Set A
gucuggggagucugagagau

SEQ ID NO: 4678 - RNA, 25 nt, Artificial Sequence
  Synthetic Oligonucleotide; PD-1 exon 2; Set A
ccugucuggggagucugagagaugg

SEQ ID NO: 4679 - RNA, 19 nt, Artificial Sequence
  Synthetic Oligonucleotide; PD-1 exon 2; Set A
gucuggggagucugagaga

SEQ ID NO: 4680 - RNA, 26 nt, Artificial Sequence
  Synthetic Oligonucleotide; PD-1 exon 2; Set C
gccugucuggggagucugagagaugg

SEQ ID NO: 4681 - RNA, 27 nt, Artificial Sequence
  Synthetic Oligonucleotide; PD-1 exon 2; Set C
ggccugucuggggagucugagagaugg

SEQ ID NO: 4682 - RNA, 15 nt, Artificial Sequence
  Synthetic Oligonucleotide; PD-1 exon 2; Set C
ucuggggagucugag

SEQ ID NO: 4683 - RNA, 28 nt, Artificial Sequence
  Synthetic Oligonucleotide; PD-1 exon 2; Set C
gggccugucuggggagucugagagaugg

SEQ ID NO: 4684 - RNA, 20 nt, Artificial Sequence
  Synthetic Oligonucleotide; PD-1 exon 2; Set A
cugucuggggagucugagag

SEQ ID NO: 4685 - RNA, 16 nt, Artificial Sequence
  Synthetic Oligonucleotide; PD-1 exon 2; Set C
gucuggggagucugag

SEQ ID NO: 4686 - RNA, 19 nt, Artificial Sequence
  Synthetic Oligonucleotide; PD-1 exon 2; Set A
cugucuggggagucugaga

SEQ ID NO: 4687 - RNA, 21 nt, Artificial Sequence
  Synthetic Oligonucleotide; PD-1 exon 2; Set A
ccugucuggggagucugagag

SEQ ID NO: 4688 - RNA, 15 nt, Artificial Sequence
  Synthetic Oligonucleotide; PD-1 exon 2; Set C
gucuggggagucuga

SEQ ID NO: 4689 - RNA, 22 nt, Artificial Sequence
  Synthetic Oligonucleotide; PD-1 exon 2; Set A
gccugucuggggagucugagag

SEQ ID NO: 4690 - RNA, 20 nt, Artificial Sequence
  Synthetic Oligonucleotide; PD-1 exon 2; Set A
ccugucuggggagucugaga

SEQ ID NO: 4691 - RNA, 16 nt, Artificial Sequence
  Synthetic Oligonucleotide; PD-1 exon 2; Set C
ugucuggggagucuga

SEQ ID NO: 4692 - RNA, 23 nt, Artificial Sequence
  Synthetic Oligonucleotide; PD-1 exon 2; Set C
ggccugucuggggagucugagag

SEQ ID NO: 4693 - RNA, 21 nt, Artificial Sequence
  Synthetic Oligonucleotide; PD-1 exon 2; Set A
gccugucuggggagucugaga

SEQ ID NO: 4694 - RNA, 15 nt, Artificial Sequence
  Synthetic Oligonucleotide; PD-1 exon 2; Set C
ugucuggggagucug

SEQ ID NO: 4695 - RNA, 22 nt, Artificial Sequence
  Synthetic Oligonucleotide; PD-1 exon 2; Set C
ggccugucuggggagucugaga

SEQ ID NO: 4696 - RNA, 15 nt, Artificial Sequence
  Synthetic Oligonucleotide; PD-1 exon 2; Set C
cugucuggggagucu

SEQ ID NO: 4697 - RNA, 16 nt, Artificial Sequence
  Synthetic Oligonucleotide; PD-1 exon 2; Set C
ccugucuggggagucu

SEQ ID NO: 4698 - RNA, 15 nt, Artificial Sequence
  Synthetic Oligonucleotide; PD-1 exon 2; Set C
ccugucuggggaguc

SEQ ID NO: 4699 - RNA, 17 nt, Artificial Sequence
  Synthetic Oligonucleotide; PD-1 exon 2; Set A
gccugucuggggagucu

SEQ ID NO: 4700 - RNA, 33 nt, Artificial Sequence
  Synthetic Oligonucleotide; PD-1 exon 2; Set C
guuccagggccugucuggggagucugagagaug

SEQ ID NO: 4701 - RNA, 16 nt, Artificial Sequence
  Synthetic Oligonucleotide; PD-1 exon 2; Set A
gccugucuggggaguc

SEQ ID NO: 4702 - RNA, 18 nt, Artificial Sequence
  Synthetic Oligonucleotide; PD-1 exon 2; Set A
ggccugucuggggagucu

SEQ ID NO: 4703 - RNA, 32 nt, Artificial Sequence
  Synthetic Oligonucleotide; PD-1 exon 2; Set C
guuccagggccugucuggggagucugagagau

SEQ ID NO: 4704 - RNA, 34 nt, Artificial Sequence
  Synthetic Oligonucleotide; PD-1 exon 2; Set C
gguuccagggccugucuggggagucugagagaug

SEQ ID NO: 4705 - RNA, 17 nt, Artificial Sequence
  Synthetic Oligonucleotide; PD-1 exon 2; Set A
ggccugucuggggaguc

SEQ ID NO: 4706 - RNA, 19 nt, Artificial Sequence
  Synthetic Oligonucleotide; PD-1 exon 2; Set A
gggccugucuggggagucu

SEQ ID NO: 4707 - RNA, 15 nt, Artificial Sequence
  Synthetic Oligonucleotide; PD-1 exon 2; Set C
gccugucuggggagu

SEQ ID NO: 4708 - RNA, 31 nt, Artificial Sequence
  Synthetic Oligonucleotide; PD-1 exon 2; Set C
guuccagggccugucuggggagucugagaga

SEQ ID NO: 4709 - RNA, 33 nt, Artificial Sequence
  Synthetic Oligonucleotide; PD-1 exon 2; Set C
gguuccagggccugucuggggagucugagagau

SEQ ID NO: 4710 - RNA, 18 nt, Artificial Sequence
  Synthetic Oligonucleotide; PD-1 exon 2; Set A
gggccugucuggggaguc

SEQ ID NO: 4711 - RNA, 16 nt, Artificial Sequence
  Synthetic Oligonucleotide; PD-1 exon 2; Set A
ggccugucuggggagu

SEQ ID NO: 4712 - RNA, 15 nt, Artificial Sequence
  Synthetic Oligonucleotide; PD-1 exon 2; Set C
ggccugucuggggag

SEQ ID NO: 4713 - RNA, 17 nt, Artificial Sequence
  Synthetic Oligonucleotide; PD-1 exon 2; Set A
gggccugucuggggagu

SEQ ID NO: 4714 - RNA, 16 nt, Artificial Sequence
  Synthetic Oligonucleotide; PD-1 exon 2; Set A
gggccugucuggggag

SEQ ID NO: 4715 - RNA, 38 nt, Artificial Sequence
  Synthetic Oligonucleotide; PD-1 exon 2; Set C
gggggguuccagggccugucuggggagucugagagaug

SEQ ID NO: 4716 - RNA, 28 nt, Artificial Sequence
  Synthetic Oligonucleotide; PD-1 exon 2; Set C
guuccagggccugucuggggagucugag

SEQ ID NO: 4717 - RNA, 15 nt, Artificial Sequence
  Synthetic Oligonucleotide; PD-1 exon 2; Set A
gggccugucugggga

SEQ ID NO: 4718 - RNA, 37 nt, Artificial Sequence
  Synthetic Oligonucleotide; PD-1 exon 2; Set C
gggggguuccagggccugucuggggagucugagagau

SEQ ID NO: 4719 - RNA, 39 nt, Artificial Sequence
  Synthetic Oligonucleotide; PD-1 exon 2; Set C
ggggggguuccagggccugucuggggagucugagagaug

SEQ ID NO: 4720 - RNA, 29 nt, Artificial Sequence
  Synthetic Oligonucleotide; PD-1 exon 2; Set C
gguuccagggccugucuggggagucugag

SEQ ID NO: 4721 - RNA, 27 nt, Artificial Sequence
  Synthetic Oligonucleotide; PD-1 exon 2; Set C
guuccagggccugucuggggagucuga

SEQ ID NO: 4722 - RNA, 36 nt, Artificial Sequence
  Synthetic Oligonucleotide; PD-1 exon 2; Set C
gggggguuccagggccugucuggggagucugagaga

SEQ ID NO: 4723 - RNA, 38 nt, Artificial Sequence
  Synthetic Oligonucleotide; PD-1 exon 2; Set C
ggggggguuccagggccugucuggggagucugagagau

SEQ ID NO: 4724 - RNA, 40 nt, Artificial Sequence
  Synthetic Oligonucleotide; PD-1 exon 2; Set C
uggggggguuccagggccugucuggggagucugagagaug

SEQ ID NO: 4725 - RNA, 30 nt, Artificial Sequence
  Synthetic Oligonucleotide; PD-1 exon 2; Set C
ggguuccagggccugucuggggagucugag

SEQ ID NO: 4726 - RNA, 26 nt, Artificial Sequence
  Synthetic Oligonucleotide; PD-1 exon 2; Set C
guuccagggccugucuggggagucug

SEQ ID NO: 4727 - RNA, 28 nt, Artificial Sequence
  Synthetic Oligonucleotide; PD-1 exon 2; Set C
gguuccagggccugucuggggagucuga

SEQ ID NO: 4728 - RNA, 37 nt, Artificial Sequence
  Synthetic Oligonucleotide; PD-1 exon 2; Set C
ggggggguuccagggccugucuggggagucugagaga

SEQ ID NO: 4729 - RNA, 39 nt, Artificial Sequence
  Synthetic Oligonucleotide; PD-1 exon 2; Set C
uggggggguuccagggccugucuggggagucugagagau

SEQ ID NO: 4730 - RNA, 31 nt, Artificial Sequence
  Synthetic Oligonucleotide; PD-1 exon 2; Set C
gggguuccagggccugucuggggagucugag

SEQ ID NO: 4731 - RNA, 27 nt, Artificial Sequence
  Synthetic Oligonucleotide; PD-1 exon 2; Set C
gguuccagggccugucuggggagucug

SEQ ID NO: 4732 - RNA, 29 nt, Artificial Sequence
  Synthetic Oligonucleotide; PD-1 exon 2; Set C
ggguuccagggccugucuggggagucuga

SEQ ID NO: 4733 - RNA, 38 nt, Artificial Sequence
  Synthetic Oligonucleotide; PD-1 exon 2; Set C
uggggggguuccagggccugucuggggagucugagaga

SEQ ID NO: 4734 - RNA, 40 nt, Artificial Sequence
  Synthetic Oligonucleotide; PD-1 exon 2; Set C
guggggggguuccagggccugucuggggagucugagagau

SEQ ID NO: 4735 - RNA, 32 nt, Artificial Sequence
  Synthetic Oligonucleotide; PD-1 exon 2; Set C
ggggguuccagggccugucuggggagucugag

SEQ ID NO: 4736 - RNA, 28 nt, Artificial Sequence
  Synthetic Oligonucleotide; PD-1 exon 2; Set C
ggguuccagggccugucuggggagucug

SEQ ID NO: 4737 - RNA, 30 nt, Artificial Sequence
  Synthetic Oligonucleotide; PD-1 exon 2; Set C
gggguuccagggccugucuggggagucuga

SEQ ID NO: 4738 - RNA, 39 nt, Artificial Sequence
  Synthetic Oligonucleotide; PD-1 exon 2; Set C
guggggggguuccagggccugucuggggagucugagaga

SEQ ID NO: 4739 - RNA, 33 nt, Artificial Sequence
  Synthetic Oligonucleotide; PD-1 exon 2; Set C
gggggguuccagggccugucuggggagucugag

SEQ ID NO: 4740 - RNA, 29 nt, Artificial Sequence
  Synthetic Oligonucleotide; PD-1 exon 2; Set C
gggguuccagggccugucuggggagucug

SEQ ID NO: 4741 - RNA, 31 nt, Artificial Sequence
  Synthetic Oligonucleotide; PD-1 exon 2; Set C
ggggguuccagggccugucuggggagucuga

SEQ ID NO: 4742 - RNA, 40 nt, Artificial Sequence
  Synthetic Oligonucleotide; PD-1 exon 2; Set C
gguggggggguuccagggccugucuggggagucugagaga

SEQ ID NO: 4743 - RNA, 34 nt, Artificial Sequence
  Synthetic Oligonucleotide; PD-1 exon 2; Set C
ggggggguuccagggccugucuggggagucugag

SEQ ID NO: 4744 - RNA, 30 nt, Artificial Sequence
  Synthetic Oligonucleotide; PD-1 exon 2; Set C
ggggguuccagggccugucuggggagucug

SEQ ID NO: 4745 - RNA, 32 nt, Artificial Sequence
  Synthetic Oligonucleotide; PD-1 exon 2; Set C
gggggguuccagggccugucuggggagucuga

SEQ ID NO: 4746 - RNA, 35 nt, Artificial Sequence
  Synthetic Oligonucleotide; PD-1 exon 2; Set C
uggggggguuccagggccugucuggggagucugag

SEQ ID NO: 4747 - RNA, 31 nt, Artificial Sequence
  Synthetic Oligonucleotide; PD-1 exon 2; Set C
gggggguuccagggccugucuggggagucug

SEQ ID NO: 4748 - RNA, 33 nt, Artificial Sequence
  Synthetic Oligonucleotide; PD-1 exon 2; Set C
ggggggguuccagggccugucuggggagucuga

SEQ ID NO: 4749 - RNA, 36 nt, Artificial Sequence
  Synthetic Oligonucleotide; PD-1 exon 2; Set C
guggggggguuccagggccugucuggggagucugag

SEQ ID NO: 4750 - RNA, 32 nt, Artificial Sequence
  Synthetic Oligonucleotide; PD-1 exon 2; Set C
ggggggguuccagggccugucuggggagucug

SEQ ID NO: 4751 - RNA, 37 nt, Artificial Sequence
  Synthetic Oligonucleotide; PD-1 exon 2; Set C
gguggggggguuccagggccugucuggggagucugag

SEQ ID NO: 4752 - RNA, 38 nt, Artificial Sequence
  Synthetic Oligonucleotide; PD-1 exon 2; Set C
agguggggggguuccagggccugucuggggagucugag

SEQ ID NO: 4753 - RNA, 36 nt, Artificial Sequence
  Synthetic Oligonucleotide; PD-1 exon 2; Set C
gguggggggguuccagggccugucuggggagucuga

SEQ ID NO: 4754 - RNA, 39 nt, Artificial Sequence
  Synthetic Oligonucleotide; PD-1 exon 2; Set C
aagguggggggguuccagggccugucuggggagucugag

SEQ ID NO: 4755 - RNA, 35 nt, Artificial Sequence
  Synthetic Oligonucleotide; PD-1 exon 2; Set C
gguggggggguuccagggccugucuggggagucug

SEQ ID NO: 4756 - RNA, 37 nt, Artificial Sequence
  Synthetic Oligonucleotide; PD-1 exon 2; Set C
agguggggggguuccagggccugucuggggagucuga

SEQ ID NO: 4757 - RNA, 40 nt, Artificial Sequence
  Synthetic Oligonucleotide; PD-1 exon 2; Set C
gaagguggggggguuccagggccugucuggggagucugag

SEQ ID NO: 4758 - RNA, 36 nt, Artificial Sequence
  Synthetic Oligonucleotide; PD-1 exon 2; Set C
agguggggggguuccagggccugucuggggagucug

SEQ ID NO: 4759 - RNA, 38 nt, Artificial Sequence
  Synthetic Oligonucleotide; PD-1 exon 2; Set C
aagguggggggguuccagggccugucuggggagucuga

SEQ ID NO: 4760 - RNA, 37 nt, Artificial Sequence
  Synthetic Oligonucleotide; PD-1 exon 2; Set C
aagguggggggguuccagggccugucuggggagucug

SEQ ID NO: 4761 - RNA, 39 nt, Artificial Sequence
  Synthetic Oligonucleotide; PD-1 exon 2; Set C
gaagguggggggguuccagggccugucuggggagucuga

SEQ ID NO: 4762 - RNA, 38 nt, Artificial Sequence
  Synthetic Oligonucleotide; PD-1 exon 2; Set C
gaagguggggggguuccagggccugucuggggagucug

SEQ ID NO: 4763 - RNA, 40 nt, Artificial Sequence
  Synthetic Oligonucleotide; PD-1 exon 2; Set C
agaagguggggggguuccagggccugucuggggagucuga

SEQ ID NO: 4764 - RNA, 39 nt, Artificial Sequence
  Synthetic Oligonucleotide; PD-1 exon 2; Set C
agaagguggggggguuccagggccugucuggggagucug

SEQ ID NO: 4765 - RNA, 40 nt, Artificial Sequence
  Synthetic Oligonucleotide; PD-1 exon 2; Set C
gagaagguggggggguuccagggccugucuggggagucug

SEQ ID NO: 4766 - RNA, 16 nt, Artificial Sequence
  Synthetic Oligonucleotide; PD-1 exon 2; Set A
gggguuccagggccug

SEQ ID NO: 4767 - RNA, 17 nt, Artificial Sequence
  Synthetic Oligonucleotide; PD-1 exon 2; Set A
ggggguuccagggccug

SEQ ID NO: 4768 - RNA, 39 nt, Artificial Sequence
  Synthetic Oligonucleotide; PD-1 exon 2; Set C
gggagaagguggggggguuccagggccugucuggggagu

SEQ ID NO: 4769 - RNA, 38 nt, Artificial Sequence
  Synthetic Oligonucleotide; PD-1 exon 2; Set C
gggagaagguggggggguuccagggccugucuggggag

SEQ ID NO: 4770 - RNA, 40 nt, Artificial Sequence
  Synthetic Oligonucleotide; PD-1 exon 2; Set C
ggggagaagguggggggguuccagggccugucuggggagu

SEQ ID NO: 4771 - RNA, 37 nt, Artificial Sequence
  Synthetic Oligonucleotide; PD-1 exon 2; Set C
gggagaagguggggggguuccagggccugucugggga

SEQ ID NO: 4772 - RNA, 39 nt, Artificial Sequence
  Synthetic Oligonucleotide; PD-1 exon 2; Set C
ggggagaagguggggggguuccagggccugucuggggag

SEQ ID NO: 4773 - RNA, 36 nt, Artificial Sequence
  Synthetic Oligonucleotide; PD-1 exon 2; Set C
gggagaagguggggggguuccagggccugucugggg

SEQ ID NO: 4774 - RNA, 40 nt, Artificial Sequence
  Synthetic Oligonucleotide; PD-1 exon 2; Set C
uggggagaagguggggggguuccagggccugucuggggag

SEQ ID NO: 4775 - RNA, 38 nt, Artificial Sequence
  Synthetic Oligonucleotide; PD-1 exon 2; Set C
ggggagaagguggggggguuccagggccugucugggga

SEQ ID NO: 4776 - RNA, 37 nt, Artificial Sequence
  Synthetic Oligonucleotide; PD-1 exon 2; Set C
ggggagaagguggggggguuccagggccugucugggg

SEQ ID NO: 4777 - RNA, 35 nt, Artificial Sequence
  Synthetic Oligonucleotide; PD-1 exon 2; Set C
gggagaagguggggggguuccagggccugucuggg

SEQ ID NO: 4778 - RNA, 39 nt, Artificial Sequence
  Synthetic Oligonucleotide; PD-1 exon 2; Set C
uggggagaagguggggggguuccagggccugucugggga

SEQ ID NO: 4779 - RNA, 23 nt, Artificial Sequence
  Synthetic Oligonucleotide; PD-1 exon 2; Set C
agguggggggguuccagggccug

SEQ ID NO: 4780 - RNA, 36 nt, Artificial Sequence
  Synthetic Oligonucleotide; PD-1 exon 2; Set C
ggggagaagguggggggguuccagggccugucuggg

SEQ ID NO: 4781 - RNA, 34 nt, Artificial Sequence
  Synthetic Oligonucleotide; PD-1 exon 2; Set C
gggagaagguggggggguuccagggccugucugg

SEQ ID NO: 4782 - RNA, 40 nt, Artificial Sequence
  Synthetic Oligonucleotide; PD-1 exon 2; Set C
cuggggagaagguggggggguuccagggccugucugggga

SEQ ID NO: 4783 - RNA, 24 nt, Artificial Sequence
  Synthetic Oligonucleotide; PD-1 exon 2; Set C
aagguggggggguuccagggccug

SEQ ID NO: 4784 - RNA, 39 nt, Artificial Sequence
  Synthetic Oligonucleotide; PD-1 exon 2; Set C
cuggggagaagguggggggguuccagggccugucugggg

SEQ ID NO: 4785 - RNA, 37 nt, Artificial Sequence
  Synthetic Oligonucleotide; PD-1 exon 2; Set C
uggggagaagguggggggguuccagggccugucuggg

SEQ ID NO: 4786 - RNA, 35 nt, Artificial Sequence
  Synthetic Oligonucleotide; PD-1 exon 2; Set C
ggggagaagguggggggguuccagggccugucugg

SEQ ID NO: 4787 - RNA, 33 nt, Artificial Sequence
  Synthetic Oligonucleotide; PD-1 exon 2; Set C
gggagaagguggggggguuccagggccugucug

SEQ ID NO: 4788 - RNA, 25 nt, Artificial Sequence
  Synthetic Oligonucleotide; PD-1 exon 2; Set C
gaagguggggggguuccagggccug

SEQ ID NO: 4789 - RNA, 23 nt, Artificial Sequence
  Synthetic Oligonucleotide; PD-1 exon 2; Set C
aagguggggggguuccagggccu

SEQ ID NO: 4790 - RNA, 40 nt, Artificial Sequence
  Synthetic Oligonucleotide; PD-1 exon 2; Set C
gcuggggagaagguggggggguuccagggccugucugggg

SEQ ID NO: 4791 - RNA, 38 nt, Artificial Sequence
  Synthetic Oligonucleotide; PD-1 exon 2; Set C
cuggggagaagguggggggguuccagggccugucuggg

SEQ ID NO: 4792 - RNA, 36 nt, Artificial Sequence
  Synthetic Oligonucleotide; PD-1 exon 2; Set C
uggggagaagguggggggguuccagggccugucugg

SEQ ID NO: 4793 - RNA, 32 nt, Artificial Sequence
  Synthetic Oligonucleotide; PD-1 exon 2; Set C
gggagaagguggggggguuccagggccugucu

SEQ ID NO: 4794 - RNA, 34 nt, Artificial Sequence
  Synthetic Oligonucleotide; PD-1 exon 2; Set C
ggggagaagguggggggguuccagggccugucug

SEQ ID NO: 4795 - RNA, 26 nt, Artificial Sequence
  Synthetic Oligonucleotide; PD-1 exon 2; Set C
agaagguggggggguuccagggccug

SEQ ID NO: 4796 - RNA, 24 nt, Artificial Sequence
  Synthetic Oligonucleotide; PD-1 exon 2; Set C
gaagguggggggguuccagggccu

SEQ ID NO: 4797 - RNA, 39 nt, Artificial Sequence
  Synthetic Oligonucleotide; PD-1 exon 2; Set C
gcuggggagaagguggggggguuccagggccugucuggg

SEQ ID NO: 4798 - RNA, 37 nt, Artificial Sequence
  Synthetic Oligonucleotide; PD-1 exon 2; Set C
cuggggagaagguggggggguuccagggccugucugg

SEQ ID NO: 4799 - RNA, 35 nt, Artificial Sequence
  Synthetic Oligonucleotide; PD-1 exon 2; Set C
uggggagaagguggggggguuccagggccugucug

SEQ ID NO: 4800 - RNA, 31 nt, Artificial Sequence
  Synthetic Oligonucleotide; PD-1 exon 2; Set C
gggagaagguggggggguuccagggccuguc

SEQ ID NO: 4801 - RNA, 33 nt, Artificial Sequence
  Synthetic Oligonucleotide; PD-1 exon 2; Set C
ggggagaagguggggggguuccagggccugucu

SEQ ID NO: 4802 - RNA, 27 nt, Artificial Sequence
  Synthetic Oligonucleotide; PD-1 exon 2; Set C
gagaagguggggggguuccagggccug

SEQ ID NO: 4803 - RNA, 19 nt, Artificial Sequence
  Synthetic Oligonucleotide; PD-1 exon 2; Set C
agguggggggguuccaggg

SEQ ID NO: 4804 - RNA, 21 nt, Artificial Sequence
  Synthetic Oligonucleotide; PD-1 exon 2; Set C
aagguggggggguuccagggc

SEQ ID NO: 4805 - RNA, 23 nt, Artificial Sequence
  Synthetic Oligonucleotide; PD-1 exon 2; Set C
gaagguggggggguuccagggcc

SEQ ID NO: 4806 - RNA, 25 nt, Artificial Sequence
  Synthetic Oligonucleotide; PD-1 exon 2; Set C
agaagguggggggguuccagggccu

SEQ ID NO: 4807 - RNA, 40 nt, Artificial Sequence
  Synthetic Oligonucleotide; PD-1 exon 2; Set C
ggcuggggagaagguggggggguuccagggccugucuggg

SEQ ID NO: 4808 - RNA, 38 nt, Artificial Sequence
  Synthetic Oligonucleotide; PD-1 exon 2; Set C
gcuggggagaagguggggggguuccagggccugucugg

SEQ ID NO: 4809 - RNA, 30 nt, Artificial Sequence
  Synthetic Oligonucleotide; PD-1 exon 2; Set C
gggagaagguggggggguuccagggccugu

SEQ ID NO: 4810 - RNA, 34 nt, Artificial Sequence
  Synthetic Oligonucleotide; PD-1 exon 2; Set C
uggggagaagguggggggguuccagggccugucu

SEQ ID NO: 4811 - RNA, 32 nt, Artificial Sequence
  Synthetic Oligonucleotide; PD-1 exon 2; Set C
ggggagaagguggggggguuccagggccuguc

SEQ ID NO: 4812 - RNA, 36 nt, Artificial Sequence
  Synthetic Oligonucleotide; PD-1 exon 2; Set C
cuggggagaagguggggggguuccagggccugucug

SEQ ID NO: 4813 - RNA, 20 nt, Artificial Sequence
  Synthetic Oligonucleotide; PD-1 exon 2; Set A
aagguggggggguuccaggg

SEQ ID NO: 4814 - RNA, 22 nt, Artificial Sequence
  Synthetic Oligonucleotide; PD-1 exon 2; Set C
gaagguggggggguuccagggc

SEQ ID NO: 4815 - RNA, 24 nt, Artificial Sequence
  Synthetic Oligonucleotide; PD-1 exon 2; Set C
agaagguggggggguuccagggcc

SEQ ID NO: 4816 - RNA, 26 nt, Artificial Sequence
  Synthetic Oligonucleotide; PD-1 exon 2; Set C
gagaagguggggggguuccagggccu

SEQ ID NO: 4817 - RNA, 39 nt, Artificial Sequence
  Synthetic Oligonucleotide; PD-1 exon 2; Set C
ggcuggggagaagguggggggguuccagggccugucugg

SEQ ID NO: 4818 - RNA, 31 nt, Artificial Sequence
  Synthetic Oligonucleotide; PD-1 exon 2; Set C
ggggagaagguggggggguuccagggccugu

SEQ ID NO: 4819 - RNA, 33 nt, Artificial Sequence
  Synthetic Oligonucleotide; PD-1 exon 2; Set C
uggggagaagguggggggguuccagggccuguc

SEQ ID NO: 4820 - RNA, 35 nt, Artificial Sequence
  Synthetic Oligonucleotide; PD-1 exon 2; Set C
cuggggagaagguggggggguuccagggccugucu

SEQ ID NO: 4821 - RNA, 37 nt, Artificial Sequence
  Synthetic Oligonucleotide; PD-1 exon 2; Set C
gcuggggagaagguggggggguuccagggccugucug

SEQ ID NO: 4822 - RNA, 21 nt, Artificial Sequence
  Synthetic Oligonucleotide; PD-1 exon 2; Set C
gaagguggggggguuccaggg

SEQ ID NO: 4823 - RNA, 23 nt, Artificial Sequence
  Synthetic Oligonucleotide; PD-1 exon 2; Set C
agaagguggggggguuccagggc

SEQ ID NO: 4824 - RNA, 25 nt, Artificial Sequence
  Synthetic Oligonucleotide; PD-1 exon 2; Set C
gagaagguggggggguuccagggcc

SEQ ID NO: 4825 - RNA, 32 nt, Artificial Sequence
  Synthetic Oligonucleotide; PD-1 exon 2; Set C
uggggagaagguggggggguuccagggccugu

SEQ ID NO: 4826 - RNA, 34 nt, Artificial Sequence
  Synthetic Oligonucleotide; PD-1 exon 2; Set C
cuggggagaagguggggggguuccagggccuguc

SEQ ID NO: 4827 - RNA, 36 nt, Artificial Sequence
  Synthetic Oligonucleotide; PD-1 exon 2; Set C
gcuggggagaagguggggggguuccagggccugucu

SEQ ID NO: 4828 - RNA, 38 nt, Artificial Sequence
  Synthetic Oligonucleotide; PD-1 exon 2; Set C
ggcuggggagaagguggggggguuccagggccugucug

SEQ ID NO: 4829 - RNA, 22 nt, Artificial Sequence
  Synthetic Oligonucleotide; PD-1 exon 2; Set C
agaagguggggggguuccaggg

SEQ ID NO: 4830 - RNA, 24 nt, Artificial Sequence
  Synthetic Oligonucleotide; PD-1 exon 2; Set C
gagaagguggggggguuccagggc

SEQ ID NO: 4831 - RNA, 33 nt, Artificial Sequence
  Synthetic Oligonucleotide; PD-1 exon 2; Set C
cuggggagaagguggggggguuccagggccugu

SEQ ID NO: 4832 - RNA, 37 nt, Artificial Sequence
  Synthetic Oligonucleotide; PD-1 exon 2; Set C
ggcuggggagaagguggggggguuccagggccugucu

SEQ ID NO: 4833 - RNA, 23 nt, Artificial Sequence
  Synthetic Oligonucleotide; PD-1 exon 2; Set C
gagaagguggggggguuccaggg

SEQ ID NO: 4834 - RNA, 34 nt, Artificial Sequence
  Synthetic Oligonucleotide; PD-1 exon 2; Set C
gcuggggagaagguggggggguuccagggccugu

SEQ ID NO: 4835 - RNA, 36 nt, Artificial Sequence
  Synthetic Oligonucleotide; PD-1 exon 2; Set C
ggcuggggagaagguggggggguuccagggccuguc

SEQ ID NO: 4836 - RNA, 35 nt, Artificial Sequence
  Synthetic Oligonucleotide; PD-1 exon 2; Set C
ggcuggggagaagguggggggguuccagggccugu

SEQ ID NO: 4837 - RNA, 15 nt, Artificial Sequence
  Synthetic Oligonucleotide; PD-1 exon 2; Set C
ggggagaaggugggg

SEQ ID NO: 4838 - RNA, 17 nt, Artificial Sequence
  Synthetic Oligonucleotide; PD-1 exon 2; Set C
cuggggagaaggugggg

SEQ ID NO: 4839 - RNA, 28 nt, Artificial Sequence
  Synthetic Oligonucleotide; PD-1 exon 2; Set C
gcagggcuggggagaagguggggggguu

SEQ ID NO: 4840 - RNA, 18 nt, Artificial Sequence
  Synthetic Oligonucleotide; PD-1 exon 2; Set A
gcuggggagaaggugggg

SEQ ID NO: 4841 - RNA, 16 nt, Artificial Sequence
  Synthetic Oligonucleotide; PD-1 exon 2; Set C
cuggggagaagguggg

SEQ ID NO: 4842 - RNA, 29 nt, Artificial Sequence
  Synthetic Oligonucleotide; PD-1 exon 2; Set C
agcagggcuggggagaagguggggggguu

SEQ ID NO: 4843 - RNA, 27 nt, Artificial Sequence
  Synthetic Oligonucleotide; PD-1 exon 2; Set C
gcagggcuggggagaaggugggggggu

SEQ ID NO: 4844 - RNA, 19 nt, Artificial Sequence
  Synthetic Oligonucleotide; PD-1 exon 2; Set A
ggcuggggagaaggugggg

SEQ ID NO: 4845 - RNA, 17 nt, Artificial Sequence
  Synthetic Oligonucleotide; PD-1 exon 2; Set A
gcuggggagaagguggg

SEQ ID NO: 4846 - RNA, 15 nt, Artificial Sequence
  Synthetic Oligonucleotide; PD-1 exon 2; Set C
cuggggagaaggugg

SEQ ID NO: 4847 - RNA, 28 nt, Artificial Sequence
  Synthetic Oligonucleotide; PD-1 exon 2; Set C
agcagggcuggggagaaggugggggggu

SEQ ID NO: 4848 - RNA, 26 nt, Artificial Sequence
  Synthetic Oligonucleotide; PD-1 exon 2; Set C
gcagggcuggggagaagguggggggg

SEQ ID NO: 4849 - RNA, 18 nt, Artificial Sequence
  Synthetic Oligonucleotide; PD-1 exon 2; Set A
ggcuggggagaagguggg

SEQ ID NO: 4850 - RNA, 16 nt, Artificial Sequence
  Synthetic Oligonucleotide; PD-1 exon 2; Set C
gcuggggagaaggugg

SEQ ID NO: 4851 - RNA, 31 nt, Artificial Sequence
  Synthetic Oligonucleotide; PD-1 exon 2; Set C
cgagcagggcuggggagaagguggggggguu

SEQ ID NO: 4852 - RNA, 27 nt, Artificial Sequence
  Synthetic Oligonucleotide; PD-1 exon 2; Set C
agcagggcuggggagaagguggggggg

SEQ ID NO: 4853 - RNA, 25 nt, Artificial Sequence
  Synthetic Oligonucleotide; PD-1 exon 2; Set C
gcagggcuggggagaaggugggggg

SEQ ID NO: 4854 - RNA, 17 nt, Artificial Sequence
  Synthetic Oligonucleotide; PD-1 exon 2; Set A
ggcuggggagaaggugg

SEQ ID NO: 4855 - RNA, 15 nt, Artificial Sequence
  Synthetic Oligonucleotide; PD-1 exon 2; Set C
gcuggggagaaggug

SEQ ID NO: 4856 - RNA, 32 nt, Artificial Sequence
  Synthetic Oligonucleotide; PD-1 exon 2; Set C
acgagcagggcuggggagaagguggggggguu

SEQ ID NO: 4857 - RNA, 30 nt, Artificial Sequence
  Synthetic Oligonucleotide; PD-1 exon 2; Set C
cgagcagggcuggggagaaggugggggggu

SEQ ID NO: 4858 - RNA, 26 nt, Artificial Sequence
  Synthetic Oligonucleotide; PD-1 exon 2; Set C
agcagggcuggggagaaggugggggg

SEQ ID NO: 4859 - RNA, 24 nt, Artificial Sequence
  Synthetic Oligonucleotide; PD-1 exon 2; Set C
gcagggcuggggagaagguggggg

SEQ ID NO: 4860 - RNA, 16 nt, Artificial Sequence
  Synthetic Oligonucleotide; PD-1 exon 2; Set C
ggcuggggagaaggug

SEQ ID NO: 4861 - RNA, 31 nt, Artificial Sequence
  Synthetic Oligonucleotide; PD-1 exon 2; Set C
acgagcagggcuggggagaaggugggggggu

SEQ ID NO: 4862 - RNA, 29 nt, Artificial Sequence
  Synthetic Oligonucleotide; PD-1 exon 2; Set C
cgagcagggcuggggagaagguggggggg

SEQ ID NO: 4863 - RNA, 25 nt, Artificial Sequence
  Synthetic Oligonucleotide; PD-1 exon 2; Set C
agcagggcuggggagaagguggggg

SEQ ID NO: 4864 - RNA, 23 nt, Artificial Sequence
  Synthetic Oligonucleotide; PD-1 exon 2; Set C
gcagggcuggggagaaggugggg

SEQ ID NO: 4865 - RNA, 15 nt, Artificial Sequence
  Synthetic Oligonucleotide; PD-1 exon 2; Set C
ggcuggggagaaggu

SEQ ID NO: 4866 - RNA, 30 nt, Artificial Sequence
  Synthetic Oligonucleotide; PD-1 exon 2; Set C
acgagcagggcuggggagaagguggggggg

SEQ ID NO: 4867 - RNA, 28 nt, Artificial Sequence
  Synthetic Oligonucleotide; PD-1 exon 2; Set C
cgagcagggcuggggagaaggugggggg

SEQ ID NO: 4868 - RNA, 24 nt, Artificial Sequence
  Synthetic Oligonucleotide; PD-1 exon 2; Set C
agcagggcuggggagaaggugggg

SEQ ID NO: 4869 - RNA, 29 nt, Artificial Sequence
  Synthetic Oligonucleotide; PD-1 exon 2; Set C
acgagcagggcuggggagaaggugggggg

SEQ ID NO: 4870 - RNA, 27 nt, Artificial Sequence
  Synthetic Oligonucleotide; PD-1 exon 2; Set C
cgagcagggcuggggagaagguggggg

SEQ ID NO: 4871 - RNA, 28 nt, Artificial Sequence
  Synthetic Oligonucleotide; PD-1 exon 2; Set C
acgagcagggcuggggagaagguggggg

SEQ ID NO: 4872 - RNA, 26 nt, Artificial Sequence
  Synthetic Oligonucleotide; PD-1 exon 2; Set C
cgagcagggcuggggagaaggugggg

SEQ ID NO: 4873 - RNA, 27 nt, Artificial Sequence
  Synthetic Oligonucleotide; PD-1 exon 2; Set C
acgagcagggcuggggagaaggugggg

SEQ ID NO: 4874 - RNA, 25 nt, Artificial Sequence
  Synthetic Oligonucleotide; PD-1 exon 2; Set C
cgagcagggcuggggagaagguggg

SEQ ID NO: 4875 - RNA, 18 nt, Artificial Sequence
  Synthetic Oligonucleotide; PD-1 exon 2; Set A
gcagggcuggggagaagg

SEQ ID NO: 4876 - RNA, 26 nt, Artificial Sequence
  Synthetic Oligonucleotide; PD-1 exon 2; Set C
acgagcagggcuggggagaagguggg

SEQ ID NO: 4877 - RNA, 24 nt, Artificial Sequence
  Synthetic Oligonucleotide; PD-1 exon 2; Set C
cgagcagggcuggggagaaggugg

SEQ ID NO: 4878 - RNA, 17 nt, Artificial Sequence
  Synthetic Oligonucleotide; PD-1 exon 2; Set A
gcagggcuggggagaag

SEQ ID NO: 4879 - RNA, 19 nt, Artificial Sequence
  Synthetic Oligonucleotide; PD-1 exon 2; Set A
agcagggcuggggagaagg

SEQ ID NO: 4880 - RNA, 25 nt, Artificial Sequence
  Synthetic Oligonucleotide; PD-1 exon 2; Set C
acgagcagggcuggggagaaggugg

SEQ ID NO: 4881 - RNA, 23 nt, Artificial Sequence
  Synthetic Oligonucleotide; PD-1 exon 2; Set C
cgagcagggcuggggagaaggug

SEQ ID NO: 4882 - RNA, 16 nt, Artificial Sequence
  Synthetic Oligonucleotide; PD-1 exon 2; Set A
gcagggcuggggagaa

SEQ ID NO: 4883 - RNA, 18 nt, Artificial Sequence
  Synthetic Oligonucleotide; PD-1 exon 2; Set A
agcagggcuggggagaag

SEQ ID NO: 4884 - RNA, 22 nt, Artificial Sequence
  Synthetic Oligonucleotide; PD-1 exon 2; Set C
cgagcagggcuggggagaaggu

SEQ ID NO: 4885 - RNA, 24 nt, Artificial Sequence
  Synthetic Oligonucleotide; PD-1 exon 2; Set C
acgagcagggcuggggagaaggug

SEQ ID NO: 4886 - RNA, 15 nt, Artificial Sequence
  Synthetic Oligonucleotide; PD-1 exon 2; Set A
gcagggcuggggaga

SEQ ID NO: 4887 - RNA, 17 nt, Artificial Sequence
  Synthetic Oligonucleotide; PD-1 exon 2; Set A
agcagggcuggggagaa

SEQ ID NO: 4888 - RNA, 21 nt, Artificial Sequence
  Synthetic Oligonucleotide; PD-1 exon 2; Set A
cgagcagggcuggggagaagg

SEQ ID NO: 4889 - RNA, 23 nt, Artificial Sequence
  Synthetic Oligonucleotide; PD-1 exon 2; Set C
acgagcagggcuggggagaaggu

SEQ ID NO: 4890 - RNA, 16 nt, Artificial Sequence
  Synthetic Oligonucleotide; PD-1 exon 2; Set A
agcagggcuggggaga

SEQ ID NO: 4891 - RNA, 20 nt, Artificial Sequence
  Synthetic Oligonucleotide; PD-1 exon 2; Set A
cgagcagggcuggggagaag

SEQ ID NO: 4892 - RNA, 22 nt, Artificial Sequence
  Synthetic Oligonucleotide; PD-1 exon 2; Set C
acgagcagggcuggggagaagg

SEQ ID NO: 4893 - RNA, 19 nt, Artificial Sequence
  Synthetic Oligonucleotide; PD-1 exon 2; Set A
cgagcagggcuggggagaa

SEQ ID NO: 4894 - RNA, 21 nt, Artificial Sequence
  Synthetic Oligonucleotide; PD-1 exon 2; Set A
acgagcagggcuggggagaag

SEQ ID NO: 4895 - RNA, 18 nt, Artificial Sequence
  Synthetic Oligonucleotide; PD-1 exon 2; Set A
cgagcagggcuggggaga

SEQ ID NO: 4896 - RNA, 20 nt, Artificial Sequence
  Synthetic Oligonucleotide; PD-1 exon 2; Set A
acgagcagggcuggggagaa

SEQ ID NO: 4897 - RNA, 19 nt, Artificial Sequence
  Synthetic Oligonucleotide; PD-1 exon 2; Set C
acgagcagggcuggggaga

SEQ ID NO: 4898 - RNA, 17 nt, Artificial Sequence
  Synthetic Oligonucleotide; PD-1 exon 2; Set A
cgagcagggcuggggag

SEQ ID NO: 4899 - RNA, 18 nt, Artificial Sequence
  Synthetic Oligonucleotide; PD-1 exon 2; Set A
acgagcagggcuggggag

SEQ ID NO: 4900 - RNA, 33 nt, Artificial Sequence
  Synthetic Oligonucleotide; PD-1 exon 2; Set C
cggucaccacgagcagggcuggggagaaggugg

SEQ ID NO: 4901 - RNA, 34 nt, Artificial Sequence
  Synthetic Oligonucleotide; PD-1 exon 2; Set C
ucggucaccacgagcagggcuggggagaaggugg

SEQ ID NO: 4902 - RNA, 32 nt, Artificial Sequence
  Synthetic Oligonucleotide; PD-1 exon 2; Set C
cggucaccacgagcagggcuggggagaaggug

SEQ ID NO: 4903 - RNA, 31 nt, Artificial Sequence
  Synthetic Oligonucleotide; PD-1 exon 2; Set C
cggucaccacgagcagggcuggggagaaggu

SEQ ID NO: 4904 - RNA, 33 nt, Artificial Sequence
  Synthetic Oligonucleotide; PD-1 exon 2; Set C
ucggucaccacgagcagggcuggggagaaggug

SEQ ID NO: 4905 - RNA, 32 nt, Artificial Sequence
  Synthetic Oligonucleotide; PD-1 exon 2; Set C
ucggucaccacgagcagggcuggggagaaggu

SEQ ID NO: 4906 - RNA, 22 nt, Artificial Sequence
  Synthetic Oligonucleotide; PD-1 exon 2; Set C
gucaccacgagcagggcugggg

SEQ ID NO: 4907 - RNA, 25 nt, Artificial Sequence
  Synthetic Oligonucleotide; PD-1 exon 2; Set C
cggucaccacgagcagggcugggga

SEQ ID NO: 4908 - RNA, 23 nt, Artificial Sequence
  Synthetic Oligonucleotide; PD-1 exon 2; Set C
ggucaccacgagcagggcugggg

SEQ ID NO: 4909 - RNA, 26 nt, Artificial Sequence
  Synthetic Oligonucleotide; PD-1 exon 2; Set C
ucggucaccacgagcagggcugggga

SEQ ID NO: 4910 - RNA, 22 nt, Artificial Sequence
  Synthetic Oligonucleotide; PD-1 exon 2; Set C
ggucaccacgagcagggcuggg

SEQ ID NO: 4911 - RNA, 21 nt, Artificial Sequence
  Synthetic Oligonucleotide; PD-1 exon 2; Set C
ggucaccacgagcagggcugg

SEQ ID NO: 4912 - RNA, 20 nt, Artificial Sequence
  Synthetic Oligonucleotide; PD-1 exon 2; Set C
ggucaccacgagcagggcug

SEQ ID NO: 4913 - RNA, 19 nt, Artificial Sequence
  Synthetic Oligonucleotide; PD-1 exon 2; Set C
ggucaccacgagcagggcu

SEQ ID NO: 4914 - RNA, 18 nt, Artificial Sequence
  Synthetic Oligonucleotide; PD-1 exon 2; Set C
ggucaccacgagcagggc

SEQ ID NO: 4915 - RNA, 18 nt, Artificial Sequence
  Synthetic Oligonucleotide; PD-1 exon 2; Set A
cggucaccacgagcaggg

SEQ ID NO: 4916 - RNA, 17 nt, Artificial Sequence
  Synthetic Oligonucleotide; PD-1 exon 2; Set A
cggucaccacgagcagg

SEQ ID NO: 4917 - RNA, 19 nt, Artificial Sequence
  Synthetic Oligonucleotide; PD-1 exon 2; Set A
ucggucaccacgagcaggg

SEQ ID NO: 4918 - RNA, 18 nt, Artificial Sequence
  Synthetic Oligonucleotide; PD-1 exon 2; Set A
ucggucaccacgagcagg

SEQ ID NO: 4919 - RNA, 34 nt, Artificial Sequence
  Synthetic Oligonucleotide; PD-1 exon 2; Set C
uuguccccuucggucaccacgagcagggcugggg

SEQ ID NO: 4920 - RNA, 27 nt, Artificial Sequence
  Synthetic Oligonucleotide; PD-1 exon 2; Set C
uguccccuucggucaccacgagcaggg

SEQ ID NO: 4921 - RNA, 29 nt, Artificial Sequence
  Synthetic Oligonucleotide; PD-1 exon 2; Set C
guuguccccuucggucaccacgagcaggg

SEQ ID NO: 4922 - RNA, 25 nt, Artificial Sequence
  Synthetic Oligonucleotide; PD-1 exon 2; Set C
uguccccuucggucaccacgagcag

SEQ ID NO: 4923 - RNA, 28 nt, Artificial Sequence
  Synthetic Oligonucleotide; PD-1 exon 2; Set C
guuguccccuucggucaccacgagcagg

SEQ ID NO: 4924 - RNA, 30 nt, Artificial Sequence
  Synthetic Oligonucleotide; PD-1 exon 2; Set C
cguuguccccuucggucaccacgagcaggg

SEQ ID NO: 4925 - RNA, 26 nt, Artificial Sequence
  Synthetic Oligonucleotide; PD-1 exon 2; Set C
uuguccccuucggucaccacgagcag

SEQ ID NO: 4926 - RNA, 29 nt, Artificial Sequence
  Synthetic Oligonucleotide; PD-1 exon 2; Set C
cguuguccccuucggucaccacgagcagg

SEQ ID NO: 4927 - RNA, 27 nt, Artificial Sequence
  Synthetic Oligonucleotide; PD-1 exon 2; Set C
guuguccccuucggucaccacgagcag

SEQ ID NO: 4928 - RNA, 28 nt, Artificial Sequence
  Synthetic Oligonucleotide; PD-1 exon 2; Set C
cguuguccccuucggucaccacgagcag

SEQ ID NO: 4929 - RNA, 40 nt, Artificial Sequence
  Synthetic Oligonucleotide; PD-1 exon 2; Set C
ggugaagguggcguuguccccuucggucaccacgagcagg

SEQ ID NO: 4930 - RNA, 29 nt, Artificial Sequence
  Synthetic Oligonucleotide; PD-1 exon 2; Set C
ggugaagguggcguuguccccuucgguca

SEQ ID NO: 4931 - RNA, 30 nt, Artificial Sequence
  Synthetic Oligonucleotide; PD-1 exon 2; Set C
aggugaagguggcguuguccccuucgguca

SEQ ID NO: 4932 - RNA, 28 nt, Artificial Sequence
  Synthetic Oligonucleotide; PD-1 exon 2; Set C
ggugaagguggcguuguccccuucgguc

SEQ ID NO: 4933 - RNA, 27 nt, Artificial Sequence
  Synthetic Oligonucleotide; PD-1 exon 2; Set C
ggugaagguggcguuguccccuucggu

SEQ ID NO: 4934 - RNA, 29 nt, Artificial Sequence
  Synthetic Oligonucleotide; PD-1 exon 2; Set C
aggugaagguggcguuguccccuucgguc

SEQ ID NO: 4935 - RNA, 28 nt, Artificial Sequence
  Synthetic Oligonucleotide; PD-1 exon 2; Set C
aggugaagguggcguuguccccuucggu

SEQ ID NO: 4936 - RNA, 15 nt, Artificial Sequence
  Synthetic Oligonucleotide; PD-1 exon 2; Set C
ggugaagguggcguu

SEQ ID NO: 4937 - RNA, 16 nt, Artificial Sequence
  Synthetic Oligonucleotide; PD-1 exon 2; Set C
aggugaagguggcguu

SEQ ID NO: 4938 - RNA, 15 nt, Artificial Sequence
  Synthetic Oligonucleotide; PD-1 exon 2; Set C
aggugaagguggcgu

SEQ ID NO: 4939 - RNA, 32 nt, Artificial Sequence
  Synthetic Oligonucleotide; PD-1 exon 2; Set C
guuggagaagcugcaggugaagguggcguugu

SEQ ID NO: 4940 - RNA, 31 nt, Artificial Sequence
  Synthetic Oligonucleotide; PD-1 exon 2; Set C
guuggagaagcugcaggugaagguggcguug

SEQ ID NO: 4941 - RNA, 33 nt, Artificial Sequence
  Synthetic Oligonucleotide; PD-1 exon 2; Set C
uguuggagaagcugcaggugaagguggcguugu

SEQ ID NO: 4942 - RNA, 32 nt, Artificial Sequence
  Synthetic Oligonucleotide; PD-1 exon 2; Set C
uguuggagaagcugcaggugaagguggcguug

SEQ ID NO: 4943 - RNA, 30 nt, Artificial Sequence
  Synthetic Oligonucleotide; PD-1 exon 2; Set C
guuggagaagcugcaggugaagguggcguu

SEQ ID NO: 4944 - RNA, 33 nt, Artificial Sequence
  Synthetic Oligonucleotide; PD-1 exon 2; Set C
guguuggagaagcugcaggugaagguggcguug

SEQ ID NO: 4945 - RNA, 31 nt, Artificial Sequence
  Synthetic Oligonucleotide; PD-1 exon 2; Set C
uguuggagaagcugcaggugaagguggcguu

SEQ ID NO: 4946 - RNA, 29 nt, Artificial Sequence
  Synthetic Oligonucleotide; PD-1 exon 2; Set C
guuggagaagcugcaggugaagguggcgu

SEQ ID NO: 4947 - RNA, 32 nt, Artificial Sequence
  Synthetic Oligonucleotide; PD-1 exon 2; Set C
guguuggagaagcugcaggugaagguggcguu

SEQ ID NO: 4948 - RNA, 30 nt, Artificial Sequence
  Synthetic Oligonucleotide; PD-1 exon 2; Set C
uguuggagaagcugcaggugaagguggcgu

SEQ ID NO: 4949 - RNA, 33 nt, Artificial Sequence
  Synthetic Oligonucleotide; PD-1 exon 2; Set C
uguguuggagaagcugcaggugaagguggcguu

SEQ ID NO: 4950 - RNA, 31 nt, Artificial Sequence
  Synthetic Oligonucleotide; PD-1 exon 2; Set C
guguuggagaagcugcaggugaagguggcgu

SEQ ID NO: 4951 - RNA, 34 nt, Artificial Sequence
  Synthetic Oligonucleotide; PD-1 exon 2; Set C
auguguuggagaagcugcaggugaagguggcguu

SEQ ID NO: 4952 - RNA, 32 nt, Artificial Sequence
  Synthetic Oligonucleotide; PD-1 exon 2; Set C
uguguuggagaagcugcaggugaagguggcgu

SEQ ID NO: 4953 - RNA, 35 nt, Artificial Sequence
  Synthetic Oligonucleotide; PD-1 exon 2; Set C
gauguguuggagaagcugcaggugaagguggcguu

SEQ ID NO: 4954 - RNA, 33 nt, Artificial Sequence
  Synthetic Oligonucleotide; PD-1 exon 2; Set C
auguguuggagaagcugcaggugaagguggcgu

SEQ ID NO: 4955 - RNA, 34 nt, Artificial Sequence
  Synthetic Oligonucleotide; PD-1 exon 2; Set C
gauguguuggagaagcugcaggugaagguggcgu

SEQ ID NO: 4956 - RNA, 18 nt, Artificial Sequence
  Synthetic Oligonucleotide; PD-1 exon 2; Set C
guuggagaagcugcaggu

SEQ ID NO: 4957 - RNA, 19 nt, Artificial Sequence
  Synthetic Oligonucleotide; PD-1 exon 2; Set C
uguuggagaagcugcaggu

SEQ ID NO: 4958 - RNA, 20 nt, Artificial Sequence
  Synthetic Oligonucleotide; PD-1 exon 2; Set A
guguuggagaagcugcaggu

SEQ ID NO: 4959 - RNA, 18 nt, Artificial Sequence
  Synthetic Oligonucleotide; PD-1 exon 2; Set C
uguuggagaagcugcagg

SEQ ID NO: 4960 - RNA, 21 nt, Artificial Sequence
  Synthetic Oligonucleotide; PD-1 exon 2; Set A
uguguuggagaagcugcaggu

SEQ ID NO: 4961 - RNA, 19 nt, Artificial Sequence
  Synthetic Oligonucleotide; PD-1 exon 2; Set C
guguuggagaagcugcagg

SEQ ID NO: 4962 - RNA, 22 nt, Artificial Sequence
  Synthetic Oligonucleotide; PD-1 exon 2; Set A
auguguuggagaagcugcaggu

SEQ ID NO: 4963 - RNA, 20 nt, Artificial Sequence
  Synthetic Oligonucleotide; PD-1 exon 2; Set A
uguguuggagaagcugcagg

SEQ ID NO: 4964 - RNA, 23 nt, Artificial Sequence
  Synthetic Oligonucleotide; PD-1 exon 2; Set A
gauguguuggagaagcugcaggu

SEQ ID NO: 4965 - RNA, 21 nt, Artificial Sequence
  Synthetic Oligonucleotide; PD-1 exon 2; Set A
auguguuggagaagcugcagg

SEQ ID NO: 4966 - RNA, 22 nt, Artificial Sequence
  Synthetic Oligonucleotide; PD-1 exon 2; Set A
gauguguuggagaagcugcagg

SEQ ID NO: 4967 - RNA, 33 nt, Artificial Sequence
  Synthetic Oligonucleotide; PD-1 exon 2; Set C
gaagcucuccgauguguuggagaagcugcaggu

SEQ ID NO: 4968 - RNA, 32 nt, Artificial Sequence
  Synthetic Oligonucleotide; PD-1 exon 2; Set C
gaagcucuccgauguguuggagaagcugcagg

SEQ ID NO: 4969 - RNA, 39 nt, Artificial Sequence
  Synthetic Oligonucleotide; PD-1 exon 2; Set C
uagcacgaagcucuccgauguguuggagaagcugcaggu

SEQ ID NO: 4970 - RNA, 40 nt, Artificial Sequence
  Synthetic Oligonucleotide; PD-1 exon 2; Set C
uuagcacgaagcucuccgauguguuggagaagcugcaggu

SEQ ID NO: 4971 - RNA, 39 nt, Artificial Sequence
  Synthetic Oligonucleotide; PD-1 exon 2; Set C
uuagcacgaagcucuccgauguguuggagaagcugcagg

SEQ ID NO: 4972 - RNA, 40 nt, Artificial Sequence
  Synthetic Oligonucleotide; PD-1 exon 2; Set C
uuuagcacgaagcucuccgauguguuggagaagcugcagg

SEQ ID NO: 4973 - RNA, 17 nt, Artificial Sequence
  Synthetic Oligonucleotide; PD-1 exon 2; Set C
cgaagcucuccgaugug

SEQ ID NO: 4974 - RNA, 20 nt, Artificial Sequence
  Synthetic Oligonucleotide; PD-1 exon 2; Set A
cacgaagcucuccgaugugu

SEQ ID NO: 4975 - RNA, 16 nt, Artificial Sequence
  Synthetic Oligonucleotide; PD-1 exon 2; Set C
cgaagcucuccgaugu

SEQ ID NO: 4976 - RNA, 19 nt, Artificial Sequence
  Synthetic Oligonucleotide; PD-1 exon 2; Set C
cacgaagcucuccgaugug

SEQ ID NO: 4977 - RNA, 15 nt, Artificial Sequence
  Synthetic Oligonucleotide; PD-1 exon 2; Set C
cgaagcucuccgaug

SEQ ID NO: 4978 - RNA, 17 nt, Artificial Sequence
  Synthetic Oligonucleotide; PD-1 exon 2; Set C
acgaagcucuccgaugu

SEQ ID NO: 4979 - RNA, 20 nt, Artificial Sequence
  Synthetic Oligonucleotide; PD-1 exon 2; Set A
gcacgaagcucuccgaugug

SEQ ID NO: 4980 - RNA, 16 nt, Artificial Sequence
  Synthetic Oligonucleotide; PD-1 exon 2; Set C
acgaagcucuccgaug

SEQ ID NO: 4981 - RNA, 18 nt, Artificial Sequence
  Synthetic Oligonucleotide; PD-1 exon 2; Set C
cacgaagcucuccgaugu

SEQ ID NO: 4982 - RNA, 17 nt, Artificial Sequence
  Synthetic Oligonucleotide; PD-1 exon 2; Set C
cacgaagcucuccgaug

SEQ ID NO: 4983 - RNA, 19 nt, Artificial Sequence
  Synthetic Oligonucleotide; PD-1 exon 2; Set A
gcacgaagcucuccgaugu

SEQ ID NO: 4984 - RNA, 15 nt, Artificial Sequence
  Synthetic Oligonucleotide; PD-1 exon 2; Set C
acgaagcucuccgau

SEQ ID NO: 4985 - RNA, 20 nt, Artificial Sequence
  Synthetic Oligonucleotide; PD-1 exon 2; Set A
agcacgaagcucuccgaugu

SEQ ID NO: 4986 - RNA, 18 nt, Artificial Sequence
  Synthetic Oligonucleotide; PD-1 exon 2; Set C
gcacgaagcucuccgaug

SEQ ID NO: 4987 - RNA, 16 nt, Artificial Sequence
  Synthetic Oligonucleotide; PD-1 exon 2; Set C
cacgaagcucuccgau

SEQ ID NO: 4988 - RNA, 19 nt, Artificial Sequence
  Synthetic Oligonucleotide; PD-1 exon 2; Set C
agcacgaagcucuccgaug

SEQ ID NO: 4989 - RNA, 17 nt, Artificial Sequence
  Synthetic Oligonucleotide; PD-1 exon 2; Set C
gcacgaagcucuccgau

SEQ ID NO: 4990 - RNA, 20 nt, Artificial Sequence
  Synthetic Oligonucleotide; PD-1 exon 2; Set A
uagcacgaagcucuccgaug

SEQ ID NO: 4991 - RNA, 18 nt, Artificial Sequence
  Synthetic Oligonucleotide; PD-1 exon 2; Set C
agcacgaagcucuccgau

SEQ ID NO: 4992 - RNA, 19 nt, Artificial Sequence
  Synthetic Oligonucleotide; PD-1 exon 2; Set C
uagcacgaagcucuccgau

SEQ ID NO: 4993 - RNA, 33 nt, Artificial Sequence
  Synthetic Oligonucleotide; PD-1 exon 2; Set C
guaccaguuuagcacgaagcucuccgauguguu

SEQ ID NO: 4994 - RNA, 32 nt, Artificial Sequence
  Synthetic Oligonucleotide; PD-1 exon 2; Set C
guaccaguuuagcacgaagcucuccgaugugu

SEQ ID NO: 4995 - RNA, 31 nt, Artificial Sequence
  Synthetic Oligonucleotide; PD-1 exon 2; Set C
guaccaguuuagcacgaagcucuccgaugug

SEQ ID NO: 4996 - RNA, 30 nt, Artificial Sequence
  Synthetic Oligonucleotide; PD-1 exon 2; Set C
guaccaguuuagcacgaagcucuccgaugu

SEQ ID NO: 4997 - RNA, 29 nt, Artificial Sequence
  Synthetic Oligonucleotide; PD-1 exon 2; Set C
guaccaguuuagcacgaagcucuccgaug

SEQ ID NO: 4998 - RNA, 29 nt, Artificial Sequence
  Synthetic Oligonucleotide; PD-1 exon 2; Set C
gguaccaguuuagcacgaagcucuccgau

SEQ ID NO: 4999 - RNA, 40 nt, Artificial Sequence
  Synthetic Oligonucleotide; PD-1 exon 2; Set C
gcucaugcgguaccaguuuagcacgaagcucuccgaugug

SEQ ID NO: 5000 - RNA, 39 nt, Artificial Sequence
  Synthetic Oligonucleotide; PD-1 exon 2; Set C
gcucaugcgguaccaguuuagcacgaagcucuccgaugu

SEQ ID NO: 5001 - RNA, 40 nt, Artificial Sequence
  Synthetic Oligonucleotide; PD-1 exon 2; Set C
ggcucaugcgguaccaguuuagcacgaagcucuccgaugu

SEQ ID NO: 5002 - RNA, 38 nt, Artificial Sequence
  Synthetic Oligonucleotide; PD-1 exon 2; Set C
gcucaugcgguaccaguuuagcacgaagcucuccgaug

SEQ ID NO: 5003 - RNA, 39 nt, Artificial Sequence
  Synthetic Oligonucleotide; PD-1 exon 2; Set C
ggcucaugcgguaccaguuuagcacgaagcucuccgaug

SEQ ID NO: 5004 - RNA, 37 nt, Artificial Sequence
  Synthetic Oligonucleotide; PD-1 exon 2; Set C
gcucaugcgguaccaguuuagcacgaagcucuccgau

SEQ ID NO: 5005 - RNA, 40 nt, Artificial Sequence
  Synthetic Oligonucleotide; PD-1 exon 2; Set C
gggcucaugcgguaccaguuuagcacgaagcucuccgaug

SEQ ID NO: 5006 - RNA, 38 nt, Artificial Sequence
  Synthetic Oligonucleotide; PD-1 exon 2; Set C
ggcucaugcgguaccaguuuagcacgaagcucuccgau

SEQ ID NO: 5007 - RNA, 18 nt, Artificial Sequence
  Synthetic Oligonucleotide; PD-1 exon 2; Set C
guaccaguuuagcacgaa

SEQ ID NO: 5008 - RNA, 39 nt, Artificial Sequence
  Synthetic Oligonucleotide; PD-1 exon 2; Set C
gggcucaugcgguaccaguuuagcacgaagcucuccgau

SEQ ID NO: 5009 - RNA, 17 nt, Artificial Sequence
  Synthetic Oligonucleotide; PD-1 exon 2; Set C
guaccaguuuagcacga

SEQ ID NO: 5010 - RNA, 40 nt, Artificial Sequence
  Synthetic Oligonucleotide; PD-1 exon 2; Set C
ggggcucaugcgguaccaguuuagcacgaagcucuccgau

SEQ ID NO: 5011 - RNA, 16 nt, Artificial Sequence
  Synthetic Oligonucleotide; PD-1 exon 2; Set C
guaccaguuuagcacg

SEQ ID NO: 5012 - RNA, 15 nt, Artificial Sequence
  Synthetic Oligonucleotide; PD-1 exon 2; Set C
guaccaguuuagcac

SEQ ID NO: 5013 - RNA, 25 nt, Artificial Sequence
  Synthetic Oligonucleotide; PD-1 exon 2; Set A
ucaugcgguaccaguuuagcacgaa

SEQ ID NO: 5014 - RNA, 26 nt, Artificial Sequence
  Synthetic Oligonucleotide; PD-1 exon 2; Set C
gcucaugcgguaccaguuuagcacga

SEQ ID NO: 5015 - RNA, 27 nt, Artificial Sequence
  Synthetic Oligonucleotide; PD-1 exon 2; Set C
ggcucaugcgguaccaguuuagcacga

SEQ ID NO: 5016 - RNA, 25 nt, Artificial Sequence
  Synthetic Oligonucleotide; PD-1 exon 2; Set C
gcucaugcgguaccaguuuagcacg

SEQ ID NO: 5017 - RNA, 30 nt, Artificial Sequence
  Synthetic Oligonucleotide; PD-1 exon 2; Set C
ggggcucaugcgguaccaguuuagcacgaa

SEQ ID NO: 5018 - RNA, 28 nt, Artificial Sequence
  Synthetic Oligonucleotide; PD-1 exon 2; Set C
gggcucaugcgguaccaguuuagcacga

SEQ ID NO: 5019 - RNA, 26 nt, Artificial Sequence
  Synthetic Oligonucleotide; PD-1 exon 2; Set C
ggcucaugcgguaccaguuuagcacg

SEQ ID NO: 5020 - RNA, 24 nt, Artificial Sequence
  Synthetic Oligonucleotide; PD-1 exon 2; Set C
gcucaugcgguaccaguuuagcac

SEQ ID NO: 5021 - RNA, 29 nt, Artificial Sequence
  Synthetic Oligonucleotide; PD-1 exon 2; Set C
ggggcucaugcgguaccaguuuagcacga

SEQ ID NO: 5022 - RNA, 27 nt, Artificial Sequence
  Synthetic Oligonucleotide; PD-1 exon 2; Set C
gggcucaugcgguaccaguuuagcacg

SEQ ID NO: 5023 - RNA, 25 nt, Artificial Sequence
  Synthetic Oligonucleotide; PD-1 exon 2; Set C
ggcucaugcgguaccaguuuagcac

SEQ ID NO: 5024 - RNA, 23 nt, Artificial Sequence
  Synthetic Oligonucleotide; PD-1 exon 2; Set C
gcucaugcgguaccaguuuagca

SEQ ID NO: 5025 - RNA, 30 nt, Artificial Sequence
  Synthetic Oligonucleotide; PD-1 exon 2; Set C
uggggcucaugcgguaccaguuuagcacga

SEQ ID NO: 5026 - RNA, 28 nt, Artificial Sequence
  Synthetic Oligonucleotide; PD-1 exon 2; Set C
ggggcucaugcgguaccaguuuagcacg

SEQ ID NO: 5027 - RNA, 26 nt, Artificial Sequence
  Synthetic Oligonucleotide; PD-1 exon 2; Set C
gggcucaugcgguaccaguuuagcac

SEQ ID NO: 5028 - RNA, 24 nt, Artificial Sequence
  Synthetic Oligonucleotide; PD-1 exon 2; Set C
ggcucaugcgguaccaguuuagca

SEQ ID NO: 5029 - RNA, 22 nt, Artificial Sequence
  Synthetic Oligonucleotide; PD-1 exon 2; Set A
gcucaugcgguaccaguuuagc

SEQ ID NO: 5030 - RNA, 33 nt, Artificial Sequence
  Synthetic Oligonucleotide; PD-1 exon 2; Set C
gcuggggcucaugcgguaccaguuuagcacgaa

SEQ ID NO: 5031 - RNA, 29 nt, Artificial Sequence
  Synthetic Oligonucleotide; PD-1 exon 2; Set C
uggggcucaugcgguaccaguuuagcacg

SEQ ID NO: 5032 - RNA, 21 nt, Artificial Sequence
  Synthetic Oligonucleotide; PD-1 exon 2; Set A
gcucaugcgguaccaguuuag

SEQ ID NO: 5033 - RNA, 27 nt, Artificial Sequence
  Synthetic Oligonucleotide; PD-1 exon 2; Set C
ggggcucaugcgguaccaguuuagcac

SEQ ID NO: 5034 - RNA, 25 nt, Artificial Sequence
  Synthetic Oligonucleotide; PD-1 exon 2; Set C
gggcucaugcgguaccaguuuagca

SEQ ID NO: 5035 - RNA, 23 nt, Artificial Sequence
  Synthetic Oligonucleotide; PD-1 exon 2; Set C
ggcucaugcgguaccaguuuagc

SEQ ID NO: 5036 - RNA, 34 nt, Artificial Sequence
  Synthetic Oligonucleotide; PD-1 exon 2; Set C
ugcuggggcucaugcgguaccaguuuagcacgaa

SEQ ID NO: 5037 - RNA, 20 nt, Artificial Sequence
  Synthetic Oligonucleotide; PD-1 exon 2; Set A
gcucaugcgguaccaguuua

SEQ ID NO: 5038 - RNA, 32 nt, Artificial Sequence
  Synthetic Oligonucleotide; PD-1 exon 2; Set C
gcuggggcucaugcgguaccaguuuagcacga

SEQ ID NO: 5039 - RNA, 22 nt, Artificial Sequence
  Synthetic Oligonucleotide; PD-1 exon 2; Set A
ggcucaugcgguaccaguuuag

SEQ ID NO: 5040 - RNA, 28 nt, Artificial Sequence
  Synthetic Oligonucleotide; PD-1 exon 2; Set C
uggggcucaugcgguaccaguuuagcac

SEQ ID NO: 5041 - RNA, 24 nt, Artificial Sequence
  Synthetic Oligonucleotide; PD-1 exon 2; Set C
gggcucaugcgguaccaguuuagc

SEQ ID NO: 5042 - RNA, 26 nt, Artificial Sequence
  Synthetic Oligonucleotide; PD-1 exon 2; Set C
ggggcucaugcgguaccaguuuagca

SEQ ID NO: 5043 - RNA, 19 nt, Artificial Sequence
  Synthetic Oligonucleotide; PD-1 exon 2; Set A
gcucaugcgguaccaguuu

SEQ ID NO: 5044 - RNA, 21 nt, Artificial Sequence
  Synthetic Oligonucleotide; PD-1 exon 2; Set A
ggcucaugcgguaccaguuua

SEQ ID NO: 5045 - RNA, 33 nt, Artificial Sequence
  Synthetic Oligonucleotide; PD-1 exon 2; Set C
ugcuggggcucaugcgguaccaguuuagcacga

SEQ ID NO: 5046 - RNA, 31 nt, Artificial Sequence
  Synthetic Oligonucleotide; PD-1 exon 2; Set C
gcuggggcucaugcgguaccaguuuagcacg

SEQ ID NO: 5047 - RNA, 23 nt, Artificial Sequence
  Synthetic Oligonucleotide; PD-1 exon 2; Set A
gggcucaugcgguaccaguuuag

SEQ ID NO: 5048 - RNA, 27 nt, Artificial Sequence
  Synthetic Oligonucleotide; PD-1 exon 2; Set C
uggggcucaugcgguaccaguuuagca

SEQ ID NO: 5049 - RNA, 25 nt, Artificial Sequence
  Synthetic Oligonucleotide; PD-1 exon 2; Set C
ggggcucaugcgguaccaguuuagc

SEQ ID NO: 5050 - RNA, 20 nt, Artificial Sequence
  Synthetic Oligonucleotide; PD-1 exon 2; Set A
ggcucaugcgguaccaguuu

SEQ ID NO: 5051 - RNA, 18 nt, Artificial Sequence
  Synthetic Oligonucleotide; PD-1 exon 2; Set A
gcucaugcgguaccaguu

SEQ ID NO: 5052 - RNA, 22 nt, Artificial Sequence
  Synthetic Oligonucleotide; PD-1 exon 2; Set C
gggcucaugcgguaccaguuua

SEQ ID NO: 5053 - RNA, 34 nt, Artificial Sequence
  Synthetic Oligonucleotide; PD-1 exon 2; Set C
uugcuggggcucaugcgguaccaguuuagcacga

SEQ ID NO: 5054 - RNA, 32 nt, Artificial Sequence
  Synthetic Oligonucleotide; PD-1 exon 2; Set C
ugcuggggcucaugcgguaccaguuuagcacg

SEQ ID NO: 5055 - RNA, 24 nt, Artificial Sequence
  Synthetic Oligonucleotide; PD-1 exon 2; Set C
ggggcucaugcgguaccaguuuag

SEQ ID NO: 5056 - RNA, 26 nt, Artificial Sequence
  Synthetic Oligonucleotide; PD-1 exon 2; Set C
uggggcucaugcgguaccaguuuagc

SEQ ID NO: 5057 - RNA, 19 nt, Artificial Sequence
  Synthetic Oligonucleotide; PD-1 exon 2; Set A
ggcucaugcgguaccaguu

SEQ ID NO: 5058 - RNA, 17 nt, Artificial Sequence
  Synthetic Oligonucleotide; PD-1 exon 2; Set A
gcucaugcgguaccagu

SEQ ID NO: 5059 - RNA, 23 nt, Artificial Sequence
  Synthetic Oligonucleotide; PD-1 exon 2; Set C
ggggcucaugcgguaccaguuua

SEQ ID NO: 5060 - RNA, 33 nt, Artificial Sequence
  Synthetic Oligonucleotide; PD-1 exon 2; Set C
uugcuggggcucaugcgguaccaguuuagcacg

SEQ ID NO: 5061 - RNA, 25 nt, Artificial Sequence
  Synthetic Oligonucleotide; PD-1 exon 2; Set C
uggggcucaugcgguaccaguuuag

SEQ ID NO: 5062 - RNA, 22 nt, Artificial Sequence
  Synthetic Oligonucleotide; PD-1 exon 2; Set C
ggggcucaugcgguaccaguuu

SEQ ID NO: 5063 - RNA, 20 nt, Artificial Sequence
  Synthetic Oligonucleotide; PD-1 exon 2; Set A
gggcucaugcgguaccaguu

SEQ ID NO: 5064 - RNA, 18 nt, Artificial Sequence
  Synthetic Oligonucleotide; PD-1 exon 2; Set A
ggcucaugcgguaccagu

SEQ ID NO: 5065 - RNA, 24 nt, Artificial Sequence
  Synthetic Oligonucleotide; PD-1 exon 2; Set C
uggggcucaugcgguaccaguuua

SEQ ID NO: 5066 - RNA, 36 nt, Artificial Sequence
  Synthetic Oligonucleotide; PD-1 exon 2; Set C
gguugcuggggcucaugcgguaccaguuuagcacga

SEQ ID NO: 5067 - RNA, 32 nt, Artificial Sequence
  Synthetic Oligonucleotide; PD-1 exon 2; Set C
uugcuggggcucaugcgguaccaguuuagcac

SEQ ID NO: 5068 - RNA, 23 nt, Artificial Sequence
  Synthetic Oligonucleotide; PD-1 exon 2; Set C
uggggcucaugcgguaccaguuu

SEQ ID NO: 5069 - RNA, 21 nt, Artificial Sequence
  Synthetic Oligonucleotide; PD-1 exon 2; Set C
ggggcucaugcgguaccaguu

SEQ ID NO: 5070 - RNA, 19 nt, Artificial Sequence
  Synthetic Oligonucleotide; PD-1 exon 2; Set A
gggcucaugcgguaccagu

SEQ ID NO: 5071 - RNA, 37 nt, Artificial Sequence
  Synthetic Oligonucleotide; PD-1 exon 2; Set C
ugguugcuggggcucaugcgguaccaguuuagcacga

SEQ ID NO: 5072 - RNA, 35 nt, Artificial Sequence
  Synthetic Oligonucleotide; PD-1 exon 2; Set C
gguugcuggggcucaugcgguaccaguuuagcacg

SEQ ID NO: 5073 - RNA, 31 nt, Artificial Sequence
  Synthetic Oligonucleotide; PD-1 exon 2; Set C
uugcuggggcucaugcgguaccaguuuagca

SEQ ID NO: 5074 - RNA, 22 nt, Artificial Sequence
  Synthetic Oligonucleotide; PD-1 exon 2; Set C
uggggcucaugcgguaccaguu

SEQ ID NO: 5075 - RNA, 20 nt, Artificial Sequence
  Synthetic Oligonucleotide; PD-1 exon 2; Set C
ggggcucaugcgguaccagu

SEQ ID NO: 5076 - RNA, 26 nt, Artificial Sequence
  Synthetic Oligonucleotide; PD-1 exon 2; Set C
gcuggggcucaugcgguaccaguuua

SEQ ID NO: 5077 - RNA, 38 nt, Artificial Sequence
  Synthetic Oligonucleotide; PD-1 exon 2; Set C
cugguugcuggggcucaugcgguaccaguuuagcacga

SEQ ID NO: 5078 - RNA, 36 nt, Artificial Sequence
  Synthetic Oligonucleotide; PD-1 exon 2; Set C
ugguugcuggggcucaugcgguaccaguuuagcacg

SEQ ID NO: 5079 - RNA, 34 nt, Artificial Sequence
  Synthetic Oligonucleotide; PD-1 exon 2; Set C
gguugcuggggcucaugcgguaccaguuuagcac

SEQ ID NO: 5080 - RNA, 30 nt, Artificial Sequence
  Synthetic Oligonucleotide; PD-1 exon 2; Set C
uugcuggggcucaugcgguaccaguuuagc

SEQ ID NO: 5081 - RNA, 25 nt, Artificial Sequence
  Synthetic Oligonucleotide; PD-1 exon 2; Set C
gcuggggcucaugcgguaccaguuu

SEQ ID NO: 5082 - RNA, 21 nt, Artificial Sequence
  Synthetic Oligonucleotide; PD-1 exon 2; Set C
uggggcucaugcgguaccagu

SEQ ID NO: 5083 - RNA, 27 nt, Artificial Sequence
  Synthetic Oligonucleotide; PD-1 exon 2; Set C
ugcuggggcucaugcgguaccaguuua

SEQ ID NO: 5084 - RNA, 37 nt, Artificial Sequence
  Synthetic Oligonucleotide; PD-1 exon 2; Set C
cugguugcuggggcucaugcgguaccaguuuagcacg

SEQ ID NO: 5085 - RNA, 29 nt, Artificial Sequence
  Synthetic Oligonucleotide; PD-1 exon 2; Set C
uugcuggggcucaugcgguaccaguuuag

SEQ ID NO: 5086 - RNA, 35 nt, Artificial Sequence
  Synthetic Oligonucleotide; PD-1 exon 2; Set C
ugguugcuggggcucaugcgguaccaguuuagcac

SEQ ID NO: 5087 - RNA, 33 nt, Artificial Sequence
  Synthetic Oligonucleotide; PD-1 exon 2; Set C
gguugcuggggcucaugcgguaccaguuuagca

SEQ ID NO: 5088 - RNA, 26 nt, Artificial Sequence
  Synthetic Oligonucleotide; PD-1 exon 2; Set C
ugcuggggcucaugcgguaccaguuu

SEQ ID NO: 5089 - RNA, 24 nt, Artificial Sequence
  Synthetic Oligonucleotide; PD-1 exon 2; Set C
gcuggggcucaugcgguaccaguu

SEQ ID NO: 5090 - RNA, 28 nt, Artificial Sequence
  Synthetic Oligonucleotide; PD-1 exon 2; Set C
uugcuggggcucaugcgguaccaguuua

SEQ ID NO: 5091 - RNA, 36 nt, Artificial Sequence
  Synthetic Oligonucleotide; PD-1 exon 2; Set C
cugguugcuggggcucaugcgguaccaguuuagcac

SEQ ID NO: 5092 - RNA, 34 nt, Artificial Sequence
  Synthetic Oligonucleotide; PD-1 exon 2; Set C
ugguugcuggggcucaugcgguaccaguuuagca

SEQ ID NO: 5093 - RNA, 32 nt, Artificial Sequence
  Synthetic Oligonucleotide; PD-1 exon 2; Set C
gguugcuggggcucaugcgguaccaguuuagc

SEQ ID NO: 5094 - RNA, 27 nt, Artificial Sequence
  Synthetic Oligonucleotide; PD-1 exon 2; Set C
uugcuggggcucaugcgguaccaguuu

SEQ ID NO: 5095 - RNA, 25 nt, Artificial Sequence
  Synthetic Oligonucleotide; PD-1 exon 2; Set C
ugcuggggcucaugcgguaccaguu

SEQ ID NO: 5096 - RNA, 23 nt, Artificial Sequence
  Synthetic Oligonucleotide; PD-1 exon 2; Set C
gcuggggcucaugcgguaccagu

SEQ ID NO: 5097 - RNA, 31 nt, Artificial Sequence
  Synthetic Oligonucleotide; PD-1 exon 2; Set C
gguugcuggggcucaugcgguaccaguuuag

SEQ ID NO: 5098 - RNA, 33 nt, Artificial Sequence
  Synthetic Oligonucleotide; PD-1 exon 2; Set C
ugguugcuggggcucaugcgguaccaguuuagc

SEQ ID NO: 5099 - RNA, 35 nt, Artificial Sequence
  Synthetic Oligonucleotide; PD-1 exon 2; Set C
cugguugcuggggcucaugcgguaccaguuuagca

SEQ ID NO: 5100 - RNA, 26 nt, Artificial Sequence
  Synthetic Oligonucleotide; PD-1 exon 2; Set C
uugcuggggcucaugcgguaccaguu

SEQ ID NO: 5101 - RNA, 24 nt, Artificial Sequence
  Synthetic Oligonucleotide; PD-1 exon 2; Set C
ugcuggggcucaugcgguaccagu

SEQ ID NO: 5102 - RNA, 30 nt, Artificial Sequence
  Synthetic Oligonucleotide; PD-1 exon 2; Set C
gguugcuggggcucaugcgguaccaguuua

SEQ ID NO: 5103 - RNA, 40 nt, Artificial Sequence
  Synthetic Oligonucleotide; PD-1 exon 2; Set C
cgucugguugcuggggcucaugcgguaccaguuuagcacg

SEQ ID NO: 5104 - RNA, 32 nt, Artificial Sequence
  Synthetic Oligonucleotide; PD-1 exon 2; Set C
ugguugcuggggcucaugcgguaccaguuuag

SEQ ID NO: 5105 - RNA, 34 nt, Artificial Sequence
  Synthetic Oligonucleotide; PD-1 exon 2; Set C
cugguugcuggggcucaugcgguaccaguuuagc

SEQ ID NO: 5106 - RNA, 25 nt, Artificial Sequence
  Synthetic Oligonucleotide; PD-1 exon 2; Set C
uugcuggggcucaugcgguaccagu

SEQ ID NO: 5107 - RNA, 33 nt, Artificial Sequence
  Synthetic Oligonucleotide; PD-1 exon 2; Set C
cugguugcuggggcucaugcgguaccaguuuag

SEQ ID NO: 5108 - RNA, 39 nt, Artificial Sequence
  Synthetic Oligonucleotide; PD-1 exon 2; Set C
cgucugguugcuggggcucaugcgguaccaguuuagcac

SEQ ID NO: 5109 - RNA, 38 nt, Artificial Sequence
  Synthetic Oligonucleotide; PD-1 exon 2; Set C
cgucugguugcuggggcucaugcgguaccaguuuagca

SEQ ID NO: 5110 - RNA, 27 nt, Artificial Sequence
  Synthetic Oligonucleotide; PD-1 exon 2; Set C
gguugcuggggcucaugcgguaccagu

SEQ ID NO: 5111 - RNA, 37 nt, Artificial Sequence
  Synthetic Oligonucleotide; PD-1 exon 2; Set C
cgucugguugcuggggcucaugcgguaccaguuuagc

SEQ ID NO: 5112 - RNA, 36 nt, Artificial Sequence
  Synthetic Oligonucleotide; PD-1 exon 2; Set C
cgucugguugcuggggcucaugcgguaccaguuuag

SEQ ID NO: 5113 - RNA, 19 nt, Artificial Sequence
  Synthetic Oligonucleotide; PD-1 exon 2; Set A
uugcuggggcucaugcggu

SEQ ID NO: 5114 - RNA, 21 nt, Artificial Sequence
  Synthetic Oligonucleotide; PD-1 exon 2; Set C
guugcuggggcucaugcggua

SEQ ID NO: 5115 - RNA, 21 nt, Artificial Sequence
  Synthetic Oligonucleotide; PD-1 exon 2; Set C
gguugcuggggcucaugcggu

SEQ ID NO: 5116 - RNA, 22 nt, Artificial Sequence
  Synthetic Oligonucleotide; PD-1 exon 2; Set C
ugguugcuggggcucaugcggu

SEQ ID NO: 5117 - RNA, 23 nt, Artificial Sequence
  Synthetic Oligonucleotide; PD-1 exon 2; Set C
cugguugcuggggcucaugcggu

SEQ ID NO: 5118 - RNA, 25 nt, Artificial Sequence
  Synthetic Oligonucleotide; PD-1 exon 2; Set C
ucugguugcuggggcucaugcggua

SEQ ID NO: 5119 - RNA, 26 nt, Artificial Sequence
  Synthetic Oligonucleotide; PD-1 exon 2; Set C
gucugguugcuggggcucaugcggua

SEQ ID NO: 5120 - RNA, 15 nt, Artificial Sequence
  Synthetic Oligonucleotide; PD-1 exon 2; Set C
guugcuggggcucau

SEQ ID NO: 5121 - RNA, 26 nt, Artificial Sequence
  Synthetic Oligonucleotide; PD-1 exon 2; Set C
cgucugguugcuggggcucaugcggu

SEQ ID NO: 5122 - RNA, 31 nt, Artificial Sequence
  Synthetic Oligonucleotide; PD-1 exon 2; Set C
uguccgucugguugcuggggcucaugcggua

SEQ ID NO: 5123 - RNA, 19 nt, Artificial Sequence
  Synthetic Oligonucleotide; PD-1 exon 2; Set A
ucugguugcuggggcucau

SEQ ID NO: 5124 - RNA, 32 nt, Artificial Sequence
  Synthetic Oligonucleotide; PD-1 exon 2; Set C
uuguccgucugguugcuggggcucaugcggua

SEQ ID NO: 5125 - RNA, 18 nt, Artificial Sequence
  Synthetic Oligonucleotide; PD-1 exon 2; Set A
ucugguugcuggggcuca

SEQ ID NO: 5126 - RNA, 20 nt, Artificial Sequence
  Synthetic Oligonucleotide; PD-1 exon 2; Set A
gucugguugcuggggcucau

SEQ ID NO: 5127 - RNA, 15 nt, Artificial Sequence
  Synthetic Oligonucleotide; PD-1 exon 2; Set C
cugguugcuggggcu

SEQ ID NO: 5128 - RNA, 19 nt, Artificial Sequence
  Synthetic Oligonucleotide; PD-1 exon 2; Set A
gucugguugcuggggcuca

SEQ ID NO: 5129 - RNA, 17 nt, Artificial Sequence
  Synthetic Oligonucleotide; PD-1 exon 2; Set A
ucugguugcuggggcuc

SEQ ID NO: 5130 - RNA, 18 nt, Artificial Sequence
  Synthetic Oligonucleotide; PD-1 exon 2; Set A
gucugguugcuggggcuc

SEQ ID NO: 5131 - RNA, 18 nt, Artificial Sequence
  Synthetic Oligonucleotide; PD-1 exon 2; Set A
cgucugguugcuggggcu

SEQ ID NO: 5132 - RNA, 17 nt, Artificial Sequence
  Synthetic Oligonucleotide; PD-1 exon 2; Set A
cgucugguugcuggggc

SEQ ID NO: 5133 - RNA, 25 nt, Artificial Sequence
  Synthetic Oligonucleotide; PD-1 exon 2; Set C
uguccgucugguugcuggggcucau

SEQ ID NO: 5134 - RNA, 16 nt, Artificial Sequence
  Synthetic Oligonucleotide; PD-1 exon 2; Set C
cgucugguugcugggg

SEQ ID NO: 5135 - RNA, 24 nt, Artificial Sequence
  Synthetic Oligonucleotide; PD-1 exon 2; Set C
uguccgucugguugcuggggcuca

SEQ ID NO: 5136 - RNA, 26 nt, Artificial Sequence
  Synthetic Oligonucleotide; PD-1 exon 2; Set C
uuguccgucugguugcuggggcucau

SEQ ID NO: 5137 - RNA, 15 nt, Artificial Sequence
  Synthetic Oligonucleotide; PD-1 exon 2; Set C
cgucugguugcuggg

SEQ ID NO: 5138 - RNA, 25 nt, Artificial Sequence
  Synthetic Oligonucleotide; PD-1 exon 2; Set C
uuguccgucugguugcuggggcuca

SEQ ID NO: 5139 - RNA, 23 nt, Artificial Sequence
  Synthetic Oligonucleotide; PD-1 exon 2; Set C
uguccgucugguugcuggggcuc

SEQ ID NO: 5140 - RNA, 24 nt, Artificial Sequence
  Synthetic Oligonucleotide; PD-1 exon 2; Set C
uuguccgucugguugcuggggcuc

SEQ ID NO: 5141 - RNA, 17 nt, Artificial Sequence
  Synthetic Oligonucleotide; PD-1 exon 2; Set C
uguccgucugguugcug

SEQ ID NO: 5142 - RNA, 18 nt, Artificial Sequence
  Synthetic Oligonucleotide; PD-1 exon 2; Set C
uuguccgucugguugcug

SEQ ID NO: 5143 - RNA, 40 nt, Artificial Sequence
  Synthetic Oligonucleotide; PD-1 exon 2; Set C
cggggaaggcggccagcuuguccgucugguugcuggggcu

SEQ ID NO: 5144 - RNA, 39 nt, Artificial Sequence
  Synthetic Oligonucleotide; PD-1 exon 2; Set C
cggggaaggcggccagcuuguccgucugguugcuggggc

SEQ ID NO: 5145 - RNA, 38 nt, Artificial Sequence
  Synthetic Oligonucleotide; PD-1 exon 2; Set C
cggggaaggcggccagcuuguccgucugguugcugggg

SEQ ID NO: 5146 - RNA, 40 nt, Artificial Sequence
  Synthetic Oligonucleotide; PD-1 exon 2; Set C
ucggggaaggcggccagcuuguccgucugguugcuggggc

SEQ ID NO: 5147 - RNA, 39 nt, Artificial Sequence
  Synthetic Oligonucleotide; PD-1 exon 2; Set C
ucggggaaggcggccagcuuguccgucugguugcugggg

SEQ ID NO: 5148 - RNA, 37 nt, Artificial Sequence
  Synthetic Oligonucleotide; PD-1 exon 2; Set C
cggggaaggcggccagcuuguccgucugguugcuggg

SEQ ID NO: 5149 - RNA, 26 nt, Artificial Sequence
  Synthetic Oligonucleotide; PD-1 exon 2; Set C
aaggcggccagcuuguccgucugguu

SEQ ID NO: 5150 - RNA, 36 nt, Artificial Sequence
  Synthetic Oligonucleotide; PD-1 exon 2; Set C
cggggaaggcggccagcuuguccgucugguugcugg

SEQ ID NO: 5151 - RNA, 38 nt, Artificial Sequence
  Synthetic Oligonucleotide; PD-1 exon 2; Set C
ucggggaaggcggccagcuuguccgucugguugcuggg

SEQ ID NO: 5152 - RNA, 27 nt, Artificial Sequence
  Synthetic Oligonucleotide; PD-1 exon 2; Set C
gaaggcggccagcuuguccgucugguu

SEQ ID NO: 5153 - RNA, 37 nt, Artificial Sequence
  Synthetic Oligonucleotide; PD-1 exon 2; Set C
ucggggaaggcggccagcuuguccgucugguugcugg

SEQ ID NO: 5154 - RNA, 28 nt, Artificial Sequence
  Synthetic Oligonucleotide; PD-1 exon 2; Set C
ggaaggcggccagcuuguccgucugguu

SEQ ID NO: 5155 - RNA, 29 nt, Artificial Sequence
  Synthetic Oligonucleotide; PD-1 exon 2; Set C
gggaaggcggccagcuuguccgucugguu

SEQ ID NO: 5156 - RNA, 22 nt, Artificial Sequence
  Synthetic Oligonucleotide; PD-1 exon 2; Set C
aaggcggccagcuuguccgucu

SEQ ID NO: 5157 - RNA, 30 nt, Artificial Sequence
  Synthetic Oligonucleotide; PD-1 exon 2; Set C
ggggaaggcggccagcuuguccgucugguu

SEQ ID NO: 5158 - RNA, 32 nt, Artificial Sequence
  Synthetic Oligonucleotide; PD-1 exon 2; Set C
cggggaaggcggccagcuuguccgucugguug

SEQ ID NO: 5159 - RNA, 33 nt, Artificial Sequence
  Synthetic Oligonucleotide; PD-1 exon 2; Set C
ucggggaaggcggccagcuuguccgucugguug

SEQ ID NO: 5160 - RNA, 30 nt, Artificial Sequence
  Synthetic Oligonucleotide; PD-1 exon 2; Set C
cggggaaggcggccagcuuguccgucuggu

SEQ ID NO: 5161 - RNA, 25 nt, Artificial Sequence
  Synthetic Oligonucleotide; PD-1 exon 2; Set C
gggaaggcggccagcuuguccgucu

SEQ ID NO: 5162 - RNA, 31 nt, Artificial Sequence
  Synthetic Oligonucleotide; PD-1 exon 2; Set C
ucggggaaggcggccagcuuguccgucuggu

SEQ ID NO: 5163 - RNA, 29 nt, Artificial Sequence
  Synthetic Oligonucleotide; PD-1 exon 2; Set C
cggggaaggcggccagcuuguccgucugg

SEQ ID NO: 5164 - RNA, 26 nt, Artificial Sequence
  Synthetic Oligonucleotide; PD-1 exon 2; Set C
ggggaaggcggccagcuuguccgucu

SEQ ID NO: 5165 - RNA, 30 nt, Artificial Sequence
  Synthetic Oligonucleotide; PD-1 exon 2; Set C
ucggggaaggcggccagcuuguccgucugg

SEQ ID NO: 5166 - RNA, 28 nt, Artificial Sequence
  Synthetic Oligonucleotide; PD-1 exon 2; Set C
cggggaaggcggccagcuuguccgucug

SEQ ID NO: 5167 - RNA, 25 nt, Artificial Sequence
  Synthetic Oligonucleotide; PD-1 exon 2; Set C
ggggaaggcggccagcuuguccguc

SEQ ID NO: 5168 - RNA, 29 nt, Artificial Sequence
  Synthetic Oligonucleotide; PD-1 exon 2; Set C
ucggggaaggcggccagcuuguccgucug

SEQ ID NO: 5169 - RNA, 37 nt, Artificial Sequence
  Synthetic Oligonucleotide; PD-1 exon 2; Set C
gguccucggggaaggcggccagcuuguccgucugguu

SEQ ID NO: 5170 - RNA, 25 nt, Artificial Sequence
  Synthetic Oligonucleotide; PD-1 exon 2; Set C
cggggaaggcggccagcuuguccgu

SEQ ID NO: 5171 - RNA, 26 nt, Artificial Sequence
  Synthetic Oligonucleotide; PD-1 exon 2; Set C
ucggggaaggcggccagcuuguccgu

SEQ ID NO: 5172 - RNA, 20 nt, Artificial Sequence
  Synthetic Oligonucleotide; PD-1 exon 2; Set C
ggggaaggcggccagcuugu

SEQ ID NO: 5173 - RNA, 19 nt, Artificial Sequence
  Synthetic Oligonucleotide; PD-1 exon 2; Set C
ggggaaggcggccagcuug

SEQ ID NO: 5174 - RNA, 33 nt, Artificial Sequence
  Synthetic Oligonucleotide; PD-1 exon 2; Set C
gguccucggggaaggcggccagcuuguccgucu

SEQ ID NO: 5175 - RNA, 32 nt, Artificial Sequence
  Synthetic Oligonucleotide; PD-1 exon 2; Set C
gguccucggggaaggcggccagcuuguccguc

SEQ ID NO: 5176 - RNA, 27 nt, Artificial Sequence
  Synthetic Oligonucleotide; PD-1 exon 2; Set C
gguccucggggaaggcggccagcuugu

SEQ ID NO: 5177 - RNA, 26 nt, Artificial Sequence
  Synthetic Oligonucleotide; PD-1 exon 2; Set C
gguccucggggaaggcggccagcuug

SEQ ID NO: 5178 - RNA, 24 nt, Artificial Sequence
  Synthetic Oligonucleotide; PD-1 exon 2; Set C
guugugugacacggaagcggcagu

SEQ ID NO: 5179 - RNA, 25 nt, Artificial Sequence
  Synthetic Oligonucleotide; PD-1 exon 2; Set C
aguugugugacacggaagcggcagu

SEQ ID NO: 5180 - RNA, 25 nt, Artificial Sequence
  Synthetic Oligonucleotide; PD-1 exon 2; Set C
gaagucacgcccguugggcaguugu

SEQ ID NO: 5181 - RNA, 24 nt, Artificial Sequence
  Synthetic Oligonucleotide; PD-1 exon 2; Set C
gaagucacgcccguugggcaguug

SEQ ID NO: 5182 - RNA, 26 nt, Artificial Sequence
  Synthetic Oligonucleotide; PD-1 exon 2; Set C
ggaagucacgcccguugggcaguugu

SEQ ID NO: 5183 - RNA, 25 nt, Artificial Sequence
  Synthetic Oligonucleotide; PD-1 exon 2; Set C
ggaagucacgcccguugggcaguug

SEQ ID NO: 5184 - RNA, 31 nt, Artificial Sequence
  Synthetic Oligonucleotide; PD-1 exon 2; Set C
cauguggaagucacgcccguugggcaguugu

SEQ ID NO: 5185 - RNA, 32 nt, Artificial Sequence
  Synthetic Oligonucleotide; PD-1 exon 2; Set C
ucauguggaagucacgcccguugggcaguugu

SEQ ID NO: 5186 - RNA, 31 nt, Artificial Sequence
  Synthetic Oligonucleotide; PD-1 exon 2; Set C
ucauguggaagucacgcccguugggcaguug

SEQ ID NO: 5187 - RNA, 15 nt, Artificial Sequence
  Synthetic Oligonucleotide; PD-1 exon 2; Set C
gaagucacgcccguu

SEQ ID NO: 5188 - RNA, 16 nt, Artificial Sequence
  Synthetic Oligonucleotide; PD-1 exon 2; Set C
ggaagucacgcccguu

SEQ ID NO: 5189 - RNA, 21 nt, Artificial Sequence
  Synthetic Oligonucleotide; PD-1 exon 2; Set A
cauguggaagucacgcccguu

SEQ ID NO: 5190 - RNA, 22 nt, Artificial Sequence
  Synthetic Oligonucleotide; PD-1 exon 2; Set A
ucauguggaagucacgcccguu

SEQ ID NO: 5191 - RNA, 23 nt, Artificial Sequence
  Synthetic Oligonucleotide; PD-1 exon 2; Set A
cucauguggaagucacgcccguu

SEQ ID NO: 5192 - RNA, 24 nt, Artificial Sequence
  Synthetic Oligonucleotide; PD-1 exon 2; Set C
gcucauguggaagucacgcccguu

SEQ ID NO: 5193 - RNA, 30 nt, Artificial Sequence
  Synthetic Oligonucleotide; PD-1 exon 2; Set C
gcgccgggcccugaccacgcucauguggaa

SEQ ID NO: 5194 - RNA, 32 nt, Artificial Sequence
  Synthetic Oligonucleotide; PD-1 exon 2; Set C
ugcgccgggcccugaccacgcucauguggaag

SEQ ID NO: 5195 - RNA, 29 nt, Artificial Sequence
  Synthetic Oligonucleotide; PD-1 exon 2; Set C
gcgccgggcccugaccacgcucaugugga

SEQ ID NO: 5196 - RNA, 33 nt, Artificial Sequence
  Synthetic Oligonucleotide; PD-1 exon 2; Set C
uugcgccgggcccugaccacgcucauguggaag

SEQ ID NO: 5197 - RNA, 34 nt, Artificial Sequence
  Synthetic Oligonucleotide; PD-1 exon 2; Set C
auugcgccgggcccugaccacgcucauguggaag

SEQ ID NO: 5198 - RNA, 35 nt, Artificial Sequence
  Synthetic Oligonucleotide; PD-1 exon 2; Set C
cauugcgccgggcccugaccacgcucauguggaag

SEQ ID NO: 5199 - RNA, 36 nt, Artificial Sequence
  Synthetic Oligonucleotide; PD-1 exon 2; Set C
ucauugcgccgggcccugaccacgcucauguggaag

SEQ ID NO: 5200 - RNA, 37 nt, Artificial Sequence
  Synthetic Oligonucleotide; PD-1 exon 2; Set C
gucauugcgccgggcccugaccacgcucauguggaag

SEQ ID NO: 5201 - RNA, 38 nt, Artificial Sequence
  Synthetic Oligonucleotide; PD-1 exon 2; Set C
ugucauugcgccgggcccugaccacgcucauguggaag

SEQ ID NO: 5202 - RNA, 39 nt, Artificial Sequence
  Synthetic Oligonucleotide; PD-1 exon 2; Set C
cugucauugcgccgggcccugaccacgcucauguggaag

SEQ ID NO: 5203 - RNA, 40 nt, Artificial Sequence
  Synthetic Oligonucleotide; PD-1 exon 2; Set C
gcugucauugcgccgggcccugaccacgcucauguggaag

SEQ ID NO: 5204 - RNA, 23 nt, Artificial Sequence
  Synthetic Oligonucleotide; PD-1 exon 2; Set C
ugcgccgggcccugaccacgcuc

SEQ ID NO: 5205 - RNA, 40 nt, Artificial Sequence
  Synthetic Oligonucleotide; PD-1 exon 2; Set C
cgcugucauugcgccgggcccugaccacgcucauguggaa

SEQ ID NO: 5206 - RNA, 22 nt, Artificial Sequence
  Synthetic Oligonucleotide; PD-1 exon 2; Set C
ugcgccgggcccugaccacgcu

SEQ ID NO: 5207 - RNA, 24 nt, Artificial Sequence
  Synthetic Oligonucleotide; PD-1 exon 2; Set C
uugcgccgggcccugaccacgcuc

SEQ ID NO: 5208 - RNA, 39 nt, Artificial Sequence
  Synthetic Oligonucleotide; PD-1 exon 2; Set C
cgcugucauugcgccgggcccugaccacgcucaugugga

SEQ ID NO: 5209 - RNA, 23 nt, Artificial Sequence
  Synthetic Oligonucleotide; PD-1 exon 2; Set C
uugcgccgggcccugaccacgcu

SEQ ID NO: 5210 - RNA, 28 nt, Artificial Sequence
  Synthetic Oligonucleotide; PD-1 exon 2; Set C
ucauugcgccgggcccugaccacgcuca

SEQ ID NO: 5211 - RNA, 24 nt, Artificial Sequence
  Synthetic Oligonucleotide; PD-1 exon 2; Set C
auugcgccgggcccugaccacgcu

SEQ ID NO: 5212 - RNA, 26 nt, Artificial Sequence
  Synthetic Oligonucleotide; PD-1 exon 2; Set C
cauugcgccgggcccugaccacgcuc

SEQ ID NO: 5213 - RNA, 29 nt, Artificial Sequence
  Synthetic Oligonucleotide; PD-1 exon 2; Set C
gucauugcgccgggcccugaccacgcuca

SEQ ID NO: 5214 - RNA, 25 nt, Artificial Sequence
  Synthetic Oligonucleotide; PD-1 exon 2; Set C
cauugcgccgggcccugaccacgcu

SEQ ID NO: 5215 - RNA, 27 nt, Artificial Sequence
  Synthetic Oligonucleotide; PD-1 exon 2; Set C
ucauugcgccgggcccugaccacgcuc

SEQ ID NO: 5216 - RNA, 32 nt, Artificial Sequence
  Synthetic Oligonucleotide; PD-1 exon 2; Set C
cugucauugcgccgggcccugaccacgcucau

SEQ ID NO: 5217 - RNA, 26 nt, Artificial Sequence
  Synthetic Oligonucleotide; PD-1 exon 2; Set C
ucauugcgccgggcccugaccacgcu

SEQ ID NO: 5218 - RNA, 28 nt, Artificial Sequence
  Synthetic Oligonucleotide; PD-1 exon 2; Set C
gucauugcgccgggcccugaccacgcuc

SEQ ID NO: 5219 - RNA, 33 nt, Artificial Sequence
  Synthetic Oligonucleotide; PD-1 exon 2; Set C
gcugucauugcgccgggcccugaccacgcucau

SEQ ID NO: 5220 - RNA, 31 nt, Artificial Sequence
  Synthetic Oligonucleotide; PD-1 exon 2; Set C
cugucauugcgccgggcccugaccacgcuca

SEQ ID NO: 5221 - RNA, 27 nt, Artificial Sequence
  Synthetic Oligonucleotide; PD-1 exon 2; Set C
gucauugcgccgggcccugaccacgcu

SEQ ID NO: 5222 - RNA, 29 nt, Artificial Sequence
  Synthetic Oligonucleotide; PD-1 exon 2; Set C
ugucauugcgccgggcccugaccacgcuc

SEQ ID NO: 5223 - RNA, 32 nt, Artificial Sequence
  Synthetic Oligonucleotide; PD-1 exon 2; Set C
gcugucauugcgccgggcccugaccacgcuca

SEQ ID NO: 5224 - RNA, 28 nt, Artificial Sequence
  Synthetic Oligonucleotide; PD-1 exon 2; Set C
ugucauugcgccgggcccugaccacgcu

SEQ ID NO: 5225 - RNA, 30 nt, Artificial Sequence
  Synthetic Oligonucleotide; PD-1 exon 2; Set C
cugucauugcgccgggcccugaccacgcuc

SEQ ID NO: 5226 - RNA, 29 nt, Artificial Sequence
  Synthetic Oligonucleotide; PD-1 exon 2; Set C
cugucauugcgccgggcccugaccacgcu

SEQ ID NO: 5227 - RNA, 31 nt, Artificial Sequence
  Synthetic Oligonucleotide; PD-1 exon 2; Set C
gcugucauugcgccgggcccugaccacgcuc

SEQ ID NO: 5228 - RNA, 30 nt, Artificial Sequence
  Synthetic Oligonucleotide; PD-1 exon 2; Set C
gcugucauugcgccgggcccugaccacgcu

SEQ ID NO: 5229 - RNA, 38 nt, Artificial Sequence
  Synthetic Oligonucleotide; PD-1 exon 2; Set C
gugccgcugucauugcgccgggcccugaccacgcucau

SEQ ID NO: 5230 - RNA, 39 nt, Artificial Sequence
  Synthetic Oligonucleotide; PD-1 exon 2; Set C
ggugccgcugucauugcgccgggcccugaccacgcucau

SEQ ID NO: 5231 - RNA, 37 nt, Artificial Sequence
  Synthetic Oligonucleotide; PD-1 exon 2; Set C
gugccgcugucauugcgccgggcccugaccacgcuca

SEQ ID NO: 5232 - RNA, 15 nt, Artificial Sequence
  Synthetic Oligonucleotide; PD-1 exon 2; Set B
auugcgccgggcccu

SEQ ID NO: 5233 - RNA, 40 nt, Artificial Sequence
  Synthetic Oligonucleotide; PD-1 exon 2; Set C
aggugccgcugucauugcgccgggcccugaccacgcucau

SEQ ID NO: 5234 - RNA, 38 nt, Artificial Sequence
  Synthetic Oligonucleotide; PD-1 exon 2; Set C
ggugccgcugucauugcgccgggcccugaccacgcuca

SEQ ID NO: 5235 - RNA, 36 nt, Artificial Sequence
  Synthetic Oligonucleotide; PD-1 exon 2; Set C
gugccgcugucauugcgccgggcccugaccacgcuc

SEQ ID NO: 5236 - RNA, 16 nt, Artificial Sequence
  Synthetic Oligonucleotide; PD-1 exon 2; Set B
cauugcgccgggcccu

SEQ ID NO: 5237 - RNA, 39 nt, Artificial Sequence
  Synthetic Oligonucleotide; PD-1 exon 2; Set C
aggugccgcugucauugcgccgggcccugaccacgcuca

SEQ ID NO: 5238 - RNA, 35 nt, Artificial Sequence
  Synthetic Oligonucleotide; PD-1 exon 2; Set C
gugccgcugucauugcgccgggcccugaccacgcu

SEQ ID NO: 5239 - RNA, 37 nt, Artificial Sequence
  Synthetic Oligonucleotide; PD-1 exon 2; Set C
ggugccgcugucauugcgccgggcccugaccacgcuc

SEQ ID NO: 5240 - RNA, 36 nt, Artificial Sequence
  Synthetic Oligonucleotide; PD-1 exon 2; Set C
ggugccgcugucauugcgccgggcccugaccacgcu

SEQ ID NO: 5241 - RNA, 38 nt, Artificial Sequence
  Synthetic Oligonucleotide; PD-1 exon 2; Set C
aggugccgcugucauugcgccgggcccugaccacgcuc

SEQ ID NO: 5242 - RNA, 37 nt, Artificial Sequence
  Synthetic Oligonucleotide; PD-1 exon 2; Set C
aggugccgcugucauugcgccgggcccugaccacgcu

SEQ ID NO: 5243 - RNA, 30 nt, Artificial Sequence
  Synthetic Oligonucleotide; PD-1 exon 2; Set C
uaggugccgcugucauugcgccgggcccug

SEQ ID NO: 5244 - RNA, 29 nt, Artificial Sequence
  Synthetic Oligonucleotide; PD-1 exon 2; Set C
uaggugccgcugucauugcgccgggcccu

SEQ ID NO: 5245 - RNA, 31 nt, Artificial Sequence
  Synthetic Oligonucleotide; PD-1 exon 2; Set C
guaggugccgcugucauugcgccgggcccug

SEQ ID NO: 5246 - RNA, 30 nt, Artificial Sequence
  Synthetic Oligonucleotide; PD-1 exon 2; Set C
guaggugccgcugucauugcgccgggcccu

SEQ ID NO: 5247 - RNA, 15 nt, Artificial Sequence
  Synthetic Oligonucleotide; PD-1 exon 2; Set C
ugccgcugucauugc

SEQ ID NO: 5248 - RNA, 17 nt, Artificial Sequence
  Synthetic Oligonucleotide; PD-1 exon 2; Set B
gugccgcugucauugcg

SEQ ID NO: 5249 - RNA, 18 nt, Artificial Sequence
  Synthetic Oligonucleotide; PD-1 exon 2; Set B
ggugccgcugucauugcg

SEQ ID NO: 5250 - RNA, 19 nt, Artificial Sequence
  Synthetic Oligonucleotide; PD-1 exon 2; Set B
aggugccgcugucauugcg

SEQ ID NO: 5251 - RNA, 21 nt, Artificial Sequence
  Synthetic Oligonucleotide; PD-1 exon 2; Set C
uaggugccgcugucauugcgc

SEQ ID NO: 5252 - RNA, 22 nt, Artificial Sequence
  Synthetic Oligonucleotide; PD-1 exon 2; Set C
guaggugccgcugucauugcgc

SEQ ID NO: 5253 - RNA, 22 nt, Artificial Sequence
  Synthetic Oligonucleotide; PD-1 exon 2; Set C
gguaggugccgcugucauugcg

SEQ ID NO: 5254 - RNA, 23 nt, Artificial Sequence
  Synthetic Oligonucleotide; PD-1 exon 2; Set C
agguaggugccgcugucauugcg

SEQ ID NO: 5255 - RNA, 24 nt, Artificial Sequence
  Synthetic Oligonucleotide; PD-1 exon 2; Set C
gagguaggugccgcugucauugcg

SEQ ID NO: 5256 - RNA, 16 nt, Artificial Sequence
  Synthetic Oligonucleotide; PD-1 exon 2; Set B
gguaggugccgcuguc

SEQ ID NO: 5257 - RNA, 15 nt, Artificial Sequence
  Synthetic Oligonucleotide; PD-1 exon 2; Set B
gguaggugccgcugu

SEQ ID NO: 5258 - RNA, 16 nt, Artificial Sequence
  Synthetic Oligonucleotide; PD-1 exon 2; Set B
agguaggugccgcugu

SEQ ID NO: 5259 - RNA, 15 nt, Artificial Sequence
  Synthetic Oligonucleotide; PD-1 exon 2; Set C
agguaggugccgcug

SEQ ID NO: 5260 - RNA, 16 nt, Artificial Sequence
  Synthetic Oligonucleotide; PD-1 exon 2; Set B
gagguaggugccgcug

SEQ ID NO: 5261 - RNA, 15 nt, Artificial Sequence
  Synthetic Oligonucleotide; PD-1 exon 2; Set C
gagguaggugccgcu

SEQ ID NO: 5262 - RNA, 37 nt, Artificial Sequence
  Synthetic Oligonucleotide; PD-1 exon 2; Set C
agauggccccacagagguaggugccgcugucauugcg

SEQ ID NO: 5263 - RNA, 38 nt, Artificial Sequence
  Synthetic Oligonucleotide; PD-1 exon 2; Set C
gagauggccccacagagguaggugccgcugucauugcg

SEQ ID NO: 5264 - RNA, 39 nt, Artificial Sequence
  Synthetic Oligonucleotide; PD-1 exon 2; Set C
ggagauggccccacagagguaggugccgcugucauugcg

SEQ ID NO: 5265 - RNA, 40 nt, Artificial Sequence
  Synthetic Oligonucleotide; PD-1 exon 2; Set C
gggagauggccccacagagguaggugccgcugucauugcg

SEQ ID NO: 5266 - RNA, 30 nt, Artificial Sequence
  Synthetic Oligonucleotide; PD-1 exon 2; Set C
agauggccccacagagguaggugccgcugu

SEQ ID NO: 5267 - RNA, 29 nt, Artificial Sequence
  Synthetic Oligonucleotide; PD-1 exon 2; Set C
agauggccccacagagguaggugccgcug

SEQ ID NO: 5268 - RNA, 28 nt, Artificial Sequence
  Synthetic Oligonucleotide; PD-1 exon 2; Set C
agauggccccacagagguaggugccgcu

SEQ ID NO: 5269 - RNA, 30 nt, Artificial Sequence
  Synthetic Oligonucleotide; PD-1 exon 2; Set C
gagauggccccacagagguaggugccgcug

SEQ ID NO: 5270 - RNA, 29 nt, Artificial Sequence
  Synthetic Oligonucleotide; PD-1 exon 2; Set C
gagauggccccacagagguaggugccgcu

SEQ ID NO: 5271 - RNA, 31 nt, Artificial Sequence
  Synthetic Oligonucleotide; PD-1 exon 2; Set C
ggagauggccccacagagguaggugccgcug

SEQ ID NO: 5272 - RNA, 30 nt, Artificial Sequence
  Synthetic Oligonucleotide; PD-1 exon 2; Set C
ggagauggccccacagagguaggugccgcu

SEQ ID NO: 5273 - RNA, 32 nt, Artificial Sequence
  Synthetic Oligonucleotide; PD-1 exon 2; Set C
gggagauggccccacagagguaggugccgcug

SEQ ID NO: 5274 - RNA, 31 nt, Artificial Sequence
  Synthetic Oligonucleotide; PD-1 exon 2; Set C
gggagauggccccacagagguaggugccgcu

SEQ ID NO: 5275 - RNA, 24 nt, Artificial Sequence
  Synthetic Oligonucleotide; PD-1 exon 2; Set C
gagauggccccacagagguaggug

SEQ ID NO: 5276 - RNA, 25 nt, Artificial Sequence
  Synthetic Oligonucleotide; PD-1 exon 2; Set C
ggagauggccccacagagguaggug

SEQ ID NO: 5277 - RNA, 20 nt, Artificial Sequence
  Synthetic Oligonucleotide; PD-1 exon 2; Set B
agauggccccacagagguag

SEQ ID NO: 5278 - RNA, 24 nt, Artificial Sequence
  Synthetic Oligonucleotide; PD-1 exon 2; Set C
ggagauggccccacagagguaggu

SEQ ID NO: 5279 - RNA, 26 nt, Artificial Sequence
  Synthetic Oligonucleotide; PD-1 exon 2; Set C
gggagauggccccacagagguaggug

SEQ ID NO: 5280 - RNA, 19 nt, Artificial Sequence
  Synthetic Oligonucleotide; PD-1 exon 2; Set B
agauggccccacagaggua

SEQ ID NO: 5281 - RNA, 21 nt, Artificial Sequence
  Synthetic Oligonucleotide; PD-1 exon 2; Set B
gagauggccccacagagguag

SEQ ID NO: 5282 - RNA, 25 nt, Artificial Sequence
  Synthetic Oligonucleotide; PD-1 exon 2; Set C
gggagauggccccacagagguaggu

SEQ ID NO: 5283 - RNA, 20 nt, Artificial Sequence
  Synthetic Oligonucleotide; PD-1 exon 2; Set B
gagauggccccacagaggua

SEQ ID NO: 5284 - RNA, 22 nt, Artificial Sequence
  Synthetic Oligonucleotide; PD-1 exon 2; Set B
ggagauggccccacagagguag

SEQ ID NO: 5285 - RNA, 24 nt, Artificial Sequence
  Synthetic Oligonucleotide; PD-1 exon 2; Set C
gggagauggccccacagagguagg

SEQ ID NO: 5286 - RNA, 21 nt, Artificial Sequence
  Synthetic Oligonucleotide; PD-1 exon 2; Set C
ggagauggccccacagaggua

SEQ ID NO: 5287 - RNA, 23 nt, Artificial Sequence
  Synthetic Oligonucleotide; PD-1 exon 2; Set C
gggagauggccccacagagguag

SEQ ID NO: 5288 - RNA, 22 nt, Artificial Sequence
  Synthetic Oligonucleotide; PD-1 exon 2; Set C
gggagauggccccacagaggua

SEQ ID NO: 5289 - RNA, 16 nt, Artificial Sequence
  Synthetic Oligonucleotide; PD-1 exon 2; Set B
uugggggccagggaga

SEQ ID NO: 5290 - RNA, 17 nt, Artificial Sequence
  Synthetic Oligonucleotide; PD-1 exon 2; Set B
cuugggggccagggaga

SEQ ID NO: 5291 - RNA, 15 nt, Artificial Sequence
  Synthetic Oligonucleotide; PD-1 exon 2; Set B
uugggggccagggag

SEQ ID NO: 5292 - RNA, 16 nt, Artificial Sequence
  Synthetic Oligonucleotide; PD-1 exon 2; Set B
cuugggggccagggag

SEQ ID NO: 5293 - RNA, 24 nt, Artificial Sequence
  Synthetic Oligonucleotide; PD-1 exon 2; Set C
ucugcgccuugggggccagggaga

SEQ ID NO: 5294 - RNA, 25 nt, Artificial Sequence
  Synthetic Oligonucleotide; PD-1 exon 2; Set C
aucugcgccuugggggccagggaga

SEQ ID NO: 5295 - RNA, 23 nt, Artificial Sequence
  Synthetic Oligonucleotide; PD-1 exon 2; Set C
ucugcgccuugggggccagggag

SEQ ID NO: 5296 - RNA, 24 nt, Artificial Sequence
  Synthetic Oligonucleotide; PD-1 exon 2; Set C
aucugcgccuugggggccagggag

SEQ ID NO: 5297 - RNA, 22 nt, Artificial Sequence
  Synthetic Oligonucleotide; PD-1 exon 2; Set C
ucugcgccuugggggccaggga

SEQ ID NO: 5298 - RNA, 23 nt, Artificial Sequence
  Synthetic Oligonucleotide; PD-1 exon 2; Set C
aucugcgccuugggggccaggga

SEQ ID NO: 5299 - RNA, 21 nt, Artificial Sequence
  Synthetic Oligonucleotide; PD-1 exon 2; Set C
ucugcgccuugggggccaggg

SEQ ID NO: 5300 - RNA, 22 nt, Artificial Sequence
  Synthetic Oligonucleotide; PD-1 exon 2; Set C
aucugcgccuugggggccaggg

SEQ ID NO: 5301 - RNA, 23 nt, Artificial Sequence
  Synthetic Oligonucleotide; PD-1 exon 2; Set C
gaucugcgccuugggggccaggg

SEQ ID NO: 5302 - RNA, 24 nt, Artificial Sequence
  Synthetic Oligonucleotide; PD-1 exon 2; Set C
ugaucugcgccuugggggccaggg

SEQ ID NO: 5303 - RNA, 32 nt, Artificial Sequence
  Synthetic Oligonucleotide; PD-1 exon 2; Set C
cucuuugaucugcgccuugggggccagggaga

SEQ ID NO: 5304 - RNA, 33 nt, Artificial Sequence
  Synthetic Oligonucleotide; PD-1 exon 2; Set C
ucucuuugaucugcgccuugggggccagggaga

SEQ ID NO: 5305 - RNA, 31 nt, Artificial Sequence
  Synthetic Oligonucleotide; PD-1 exon 2; Set C
cucuuugaucugcgccuugggggccagggag

SEQ ID NO: 5306 - RNA, 34 nt, Artificial Sequence
  Synthetic Oligonucleotide; PD-1 exon 2; Set C
cucucuuugaucugcgccuugggggccagggaga

SEQ ID NO: 5307 - RNA, 32 nt, Artificial Sequence
  Synthetic Oligonucleotide; PD-1 exon 2; Set C
ucucuuugaucugcgccuugggggccagggag

SEQ ID NO: 5308 - RNA, 30 nt, Artificial Sequence
  Synthetic Oligonucleotide; PD-1 exon 2; Set C
cucuuugaucugcgccuugggggccaggga

SEQ ID NO: 5309 - RNA, 35 nt, Artificial Sequence
  Synthetic Oligonucleotide; PD-1 exon 2; Set C
gcucucuuugaucugcgccuugggggccagggaga

SEQ ID NO: 5310 - RNA, 33 nt, Artificial Sequence
  Synthetic Oligonucleotide; PD-1 exon 2; Set C
cucucuuugaucugcgccuugggggccagggag

SEQ ID NO: 5311 - RNA, 31 nt, Artificial Sequence
  Synthetic Oligonucleotide; PD-1 exon 2; Set C
ucucuuugaucugcgccuugggggccaggga

SEQ ID NO: 5312 - RNA, 29 nt, Artificial Sequence
  Synthetic Oligonucleotide; PD-1 exon 2; Set C
cucuuugaucugcgccuugggggccaggg

SEQ ID NO: 5313 - RNA, 34 nt, Artificial Sequence
  Synthetic Oligonucleotide; PD-1 exon 2; Set C
gcucucuuugaucugcgccuugggggccagggag

SEQ ID NO: 5314 - RNA, 32 nt, Artificial Sequence
  Synthetic Oligonucleotide; PD-1 exon 2; Set C
cucucuuugaucugcgccuugggggccaggga

SEQ ID NO: 5315 - RNA, 30 nt, Artificial Sequence
  Synthetic Oligonucleotide; PD-1 exon 2; Set C
ucucuuugaucugcgccuugggggccaggg

SEQ ID NO: 5316 - RNA, 33 nt, Artificial Sequence
  Synthetic Oligonucleotide; PD-1 exon 2; Set C
gcucucuuugaucugcgccuugggggccaggga

SEQ ID NO: 5317 - RNA, 31 nt, Artificial Sequence
  Synthetic Oligonucleotide; PD-1 exon 2; Set C
cucucuuugaucugcgccuugggggccaggg

SEQ ID NO: 5318 - RNA, 32 nt, Artificial Sequence
  Synthetic Oligonucleotide; PD-1 exon 2; Set C
gcucucuuugaucugcgccuugggggccaggg

SEQ ID NO: 5319 - RNA, 17 nt, Artificial Sequence
  Synthetic Oligonucleotide; PD-1 exon 2; Set C
cucuuugaucugcgccu

SEQ ID NO: 5320 - RNA, 18 nt, Artificial Sequence
  Synthetic Oligonucleotide; PD-1 exon 2; Set C
ucucuuugaucugcgccu

SEQ ID NO: 5321 - RNA, 16 nt, Artificial Sequence
  Synthetic Oligonucleotide; PD-1 exon 2; Set C
cucuuugaucugcgcc

SEQ ID NO: 5322 - RNA, 19 nt, Artificial Sequence
  Synthetic Oligonucleotide; PD-1 exon 2; Set B
cucucuuugaucugcgccu

SEQ ID NO: 5323 - RNA, 17 nt, Artificial Sequence
  Synthetic Oligonucleotide; PD-1 exon 2; Set C
ucucuuugaucugcgcc

SEQ ID NO: 5324 - RNA, 20 nt, Artificial Sequence
  Synthetic Oligonucleotide; PD-1 exon 2; Set B
gcucucuuugaucugcgccu

SEQ ID NO: 5325 - RNA, 18 nt, Artificial Sequence
  Synthetic Oligonucleotide; PD-1 exon 2; Set C
cucucuuugaucugcgcc

SEQ ID NO: 5326 - RNA, 19 nt, Artificial Sequence
  Synthetic Oligonucleotide; PD-1 exon 2; Set B
gcucucuuugaucugcgcc

SEQ ID NO: 5327 - RNA, 26 nt, Artificial Sequence
  Synthetic Oligonucleotide; PD-1 exon 2; Set C
ccgcaggcucucuuugaucugcgccu

SEQ ID NO: 5328 - RNA, 27 nt, Artificial Sequence
  Synthetic Oligonucleotide; PD-1 exon 2; Set C
cccgcaggcucucuuugaucugcgccu

SEQ ID NO: 5329 - RNA, 25 nt, Artificial Sequence
  Synthetic Oligonucleotide; PD-1 exon 2; Set C
ccgcaggcucucuuugaucugcgcc

SEQ ID NO: 5330 - RNA, 26 nt, Artificial Sequence
  Synthetic Oligonucleotide; PD-1 exon 2; Set C
cccgcaggcucucuuugaucugcgcc

SEQ ID NO: 5331 - RNA, 33 nt, Artificial Sequence
  Synthetic Oligonucleotide; PD-1 exon 2; Set C
ucugcccgcaggcucucuuugaucugcgccuug

SEQ ID NO: 5332 - RNA, 36 nt, Artificial Sequence
  Synthetic Oligonucleotide; PD-1 exon 2; Set C
gagcucugcccgcaggcucucuuugaucugcgccuu

SEQ ID NO: 5333 - RNA, 29 nt, Artificial Sequence
  Synthetic Oligonucleotide; PD-1 exon 2; Set C
gagcucugcccgcaggcucucuuugaucu

SEQ ID NO: 5334 - RNA, 28 nt, Artificial Sequence
  Synthetic Oligonucleotide; PD-1 exon 2; Set C
gagcucugcccgcaggcucucuuugauc

SEQ ID NO: 5335 - RNA, 30 nt, Artificial Sequence
  Synthetic Oligonucleotide; PD-1 exon 2; Set C
ugagcucugcccgcaggcucucuuugaucu

SEQ ID NO: 5336 - RNA, 27 nt, Artificial Sequence
  Synthetic Oligonucleotide; PD-1 exon 2; Set C
gagcucugcccgcaggcucucuuugau

SEQ ID NO: 5337 - RNA, 29 nt, Artificial Sequence
  Synthetic Oligonucleotide; PD-1 exon 2; Set C
ugagcucugcccgcaggcucucuuugauc

SEQ ID NO: 5338 - RNA, 28 nt, Artificial Sequence
  Synthetic Oligonucleotide; PD-1 exon 2; Set C
ugagcucugcccgcaggcucucuuugau

SEQ ID NO: 5339 - RNA, 26 nt, Artificial Sequence
  Synthetic Oligonucleotide; PD-1 exon 2; Set C
gagcucugcccgcaggcucucuuuga

SEQ ID NO: 5340 - RNA, 25 nt, Artificial Sequence
  Synthetic Oligonucleotide; PD-1 exon 2; Set C
gagcucugcccgcaggcucucuuug

SEQ ID NO: 5341 - RNA, 27 nt, Artificial Sequence
  Synthetic Oligonucleotide; PD-1 exon 2; Set C
ugagcucugcccgcaggcucucuuuga

SEQ ID NO: 5342 - RNA, 24 nt, Artificial Sequence
  Synthetic Oligonucleotide; PD-1 exon 2; Set C
gagcucugcccgcaggcucucuuu

SEQ ID NO: 5343 - RNA, 26 nt, Artificial Sequence
  Synthetic Oligonucleotide; PD-1 exon 2; Set C
ugagcucugcccgcaggcucucuuug

SEQ ID NO: 5344 - RNA, 25 nt, Artificial Sequence
  Synthetic Oligonucleotide; PD-1 exon 2; Set C
ugagcucugcccgcaggcucucuuu

SEQ ID NO: 5345 - RNA, 23 nt, Artificial Sequence
  Synthetic Oligonucleotide; PD-1 exon 2; Set C
gagcucugcccgcaggcucucuu

SEQ ID NO: 5346 - RNA, 24 nt, Artificial Sequence
  Synthetic Oligonucleotide; PD-1 exon 2; Set C
ugagcucugcccgcaggcucucuu

SEQ ID NO: 5347 - RNA, 22 nt, Artificial Sequence
  Synthetic Oligonucleotide; PD-1 exon 2; Set C
gagcucugcccgcaggcucucu

SEQ ID NO: 5348 - RNA, 23 nt, Artificial Sequence
  Synthetic Oligonucleotide; PD-1 exon 2; Set C
ugagcucugcccgcaggcucucu

SEQ ID NO: 5349 - RNA, 29 nt, Artificial Sequence
  Synthetic Oligonucleotide; PD-1 exon 2; Set C
gucacccugagcucugcccgcaggcucuc

SEQ ID NO: 5350 - RNA, 30 nt, Artificial Sequence
  Synthetic Oligonucleotide; PD-1 exon 2; Set C
ugucacccugagcucugcccgcaggcucuc

SEQ ID NO: 5351 - RNA, 29 nt, Artificial Sequence
  Synthetic Oligonucleotide; PD-1 exon 2; Set C
ugucacccugagcucugcccgcaggcucu

SEQ ID NO: 5352 - RNA, 27 nt, Artificial Sequence
  Synthetic Oligonucleotide; PD-1 exon 2; Set C
ugucacccugagcucugcccgcaggcu

SEQ ID NO: 5353 - RNA, 19 nt, Artificial Sequence
  Synthetic Oligonucleotide; PD-1 exon 2; Set B
ucacccugagcucugcccg

SEQ ID NO: 5354 - RNA, 18 nt, Artificial Sequence
  Synthetic Oligonucleotide; PD-1 exon 2; Set B
ucacccugagcucugccc

SEQ ID NO: 5355 - RNA, 19 nt, Artificial Sequence
  Synthetic Oligonucleotide; PD-1 exon 2; Set B
gucacccugagcucugccc

SEQ ID NO: 5356 - RNA, 31 nt, Artificial Sequence
  Synthetic Oligonucleotide; PD-1 exon 2; Set C
aggccgcaccugucacccugagcucugcccg

SEQ ID NO: 5357 - RNA, 32 nt, Artificial Sequence
  Synthetic Oligonucleotide; PD-1 exon 2; Set C
gaggccgcaccugucacccugagcucugcccg

SEQ ID NO: 5358 - RNA, 30 nt, Artificial Sequence
  Synthetic Oligonucleotide; PD-1 exon 2; Set C
aggccgcaccugucacccugagcucugccc

SEQ ID NO: 5359 - RNA, 31 nt, Artificial Sequence
  Synthetic Oligonucleotide; PD-1 exon 2; Set C
gaggccgcaccugucacccugagcucugccc

SEQ ID NO: 5360 - RNA, 15 nt, Artificial Sequence
  Synthetic Oligonucleotide; PD-1 exon 2; Set B
aggccgcaccuguca

SEQ ID NO: 5361 - RNA, 16 nt, Artificial Sequence
  Synthetic Oligonucleotide; PD-1 exon 2; Set B
gaggccgcaccuguca

SEQ ID NO: 5362 - RNA, 15 nt, Artificial Sequence
  Synthetic Oligonucleotide; PD-1 exon 2; Set B
gaggccgcaccuguc

SEQ ID NO: 5363 - RNA, 31 nt, Artificial Sequence
  Synthetic Oligonucleotide; PD-1 exon 2; Set C
gggccuccgaggccgcaccugucacccugag

SEQ ID NO: 5364 - RNA, 30 nt, Artificial Sequence
  Synthetic Oligonucleotide; PD-1 exon 2; Set C
gggccuccgaggccgcaccugucacccuga

SEQ ID NO: 5365 - RNA, 15 nt, Artificial Sequence
  Synthetic Oligonucleotide; PD-1 exon 2; Set A
gcuggguggccccac

SEQ ID NO: 5366 - RNA, 16 nt, Artificial Sequence
  Synthetic Oligonucleotide; PD-1 exon 2; Set C
ggcuggguggccccac

SEQ ID NO: 5367 - RNA, 15 nt, Artificial Sequence
  Synthetic Oligonucleotide; PD-1 exon 2; Set C
ggcuggguggcccca

SEQ ID NO: 5368 - RNA, 21 nt, Artificial Sequence
  Synthetic Oligonucleotide; PD-1 exon 2; Set C
gaaggggcuggguggccccac

SEQ ID NO: 5369 - RNA, 22 nt, Artificial Sequence
  Synthetic Oligonucleotide; PD-1 exon 2; Set C
ggaaggggcuggguggccccac

SEQ ID NO: 5370 - RNA, 20 nt, Artificial Sequence
  Synthetic Oligonucleotide; PD-1 exon 2; Set C
gaaggggcuggguggcccca

SEQ ID NO: 5371 - RNA, 23 nt, Artificial Sequence
  Synthetic Oligonucleotide; PD-1 exon 2; Set C
aggaaggggcuggguggccccac

SEQ ID NO: 5372 - RNA, 21 nt, Artificial Sequence
  Synthetic Oligonucleotide; PD-1 exon 2; Set C
ggaaggggcuggguggcccca

SEQ ID NO: 5373 - RNA, 24 nt, Artificial Sequence
  Synthetic Oligonucleotide; PD-1 exon 2; Set C
gaggaaggggcuggguggccccac

SEQ ID NO: 5374 - RNA, 22 nt, Artificial Sequence
  Synthetic Oligonucleotide; PD-1 exon 2; Set C
aggaaggggcuggguggcccca

SEQ ID NO: 5375 - RNA, 27 nt, Artificial Sequence
  Synthetic Oligonucleotide; PD-1 exon 2; Set C
gugaggaaggggcuggguggccccaca

SEQ ID NO: 5376 - RNA, 23 nt, Artificial Sequence
  Synthetic Oligonucleotide; PD-1 exon 2; Set C
gaggaaggggcuggguggcccca

SEQ ID NO: 5377 - RNA, 24 nt, Artificial Sequence
  Synthetic Oligonucleotide; PD-1 exon 2; Set C
ugaggaaggggcuggguggcccca

SEQ ID NO: 5378 - RNA, 16 nt, Artificial Sequence
  Synthetic Oligonucleotide; PD-1 exon 2; Set A
gaaggggcuggguggc

SEQ ID NO: 5379 - RNA, 17 nt, Artificial Sequence
  Synthetic Oligonucleotide; PD-1 exon 2; Set A
ggaaggggcuggguggc

SEQ ID NO: 5380 - RNA, 18 nt, Artificial Sequence
  Synthetic Oligonucleotide; PD-1 exon 2; Set A
aggaaggggcuggguggc

SEQ ID NO: 5381 - RNA, 29 nt, Artificial Sequence
  Synthetic Oligonucleotide; PD-1 exon 2; Set C
gaggugaggaaggggcuggguggccccac

SEQ ID NO: 5382 - RNA, 19 nt, Artificial Sequence
  Synthetic Oligonucleotide; PD-1 exon 2; Set A
gaggaaggggcuggguggc

SEQ ID NO: 5383 - RNA, 28 nt, Artificial Sequence
  Synthetic Oligonucleotide; PD-1 exon 2; Set C
gaggugaggaaggggcuggguggcccca

SEQ ID NO: 5384 - RNA, 20 nt, Artificial Sequence
  Synthetic Oligonucleotide; PD-1 exon 2; Set A
gugaggaaggggcugggugg

SEQ ID NO: 5385 - RNA, 34 nt, Artificial Sequence
  Synthetic Oligonucleotide; PD-1 exon 2; Set C
ggagagaggugaggaaggggcuggguggccccac

SEQ ID NO: 5386 - RNA, 24 nt, Artificial Sequence
  Synthetic Oligonucleotide; PD-1 exon 2; Set C
gaggugaggaaggggcuggguggc

SEQ ID NO: 5387 - RNA, 35 nt, Artificial Sequence
  Synthetic Oligonucleotide; PD-1 exon 2; Set C
uggagagaggugaggaaggggcuggguggccccac

SEQ ID NO: 5388 - RNA, 33 nt, Artificial Sequence
  Synthetic Oligonucleotide; PD-1 exon 2; Set C
ggagagaggugaggaaggggcuggguggcccca

SEQ ID NO: 5389 - RNA, 16 nt, Artificial Sequence
  Synthetic Oligonucleotide; PD-1 exon 2; Set C
gugaggaaggggcugg

SEQ ID NO: 5390 - RNA, 34 nt, Artificial Sequence
  Synthetic Oligonucleotide; PD-1 exon 2; Set C
uggagagaggugaggaaggggcuggguggcccca

SEQ ID NO: 5391 - RNA, 17 nt, Artificial Sequence
  Synthetic Oligonucleotide; PD-1 exon 2; Set C
aggugaggaaggggcug

SEQ ID NO: 5392 - RNA, 39 nt, Artificial Sequence
  Synthetic Oligonucleotide; PD-1 exon 2; Set C
gagauggagagaggugaggaaggggcuggguggccccac

SEQ ID NO: 5393 - RNA, 29 nt, Artificial Sequence
  Synthetic Oligonucleotide; PD-1 exon 2; Set C
ggagagaggugaggaaggggcuggguggc

SEQ ID NO: 5394 - RNA, 40 nt, Artificial Sequence
  Synthetic Oligonucleotide; PD-1 exon 2; Set C
agagauggagagaggugaggaaggggcuggguggccccac

SEQ ID NO: 5395 - RNA, 38 nt, Artificial Sequence
  Synthetic Oligonucleotide; PD-1 exon 2; Set C
gagauggagagaggugaggaaggggcuggguggcccca

SEQ ID NO: 5396 - RNA, 30 nt, Artificial Sequence
  Synthetic Oligonucleotide; PD-1 exon 2; Set C
uggagagaggugaggaaggggcuggguggc

SEQ ID NO: 5397 - RNA, 39 nt, Artificial Sequence
  Synthetic Oligonucleotide; PD-1 exon 2; Set C
agagauggagagaggugaggaaggggcuggguggcccca

SEQ ID NO: 5398 - RNA, 34 nt, Artificial Sequence
  Synthetic Oligonucleotide; PD-1 exon 2; Set C
gagauggagagaggugaggaaggggcuggguggc

SEQ ID NO: 5399 - RNA, 35 nt, Artificial Sequence
  Synthetic Oligonucleotide; PD-1 exon 2; Set C
agagauggagagaggugaggaaggggcuggguggc

SEQ ID NO: 5400 - RNA, 25 nt, Artificial Sequence
  Synthetic Oligonucleotide; PD-1 exon 2; Set A
auggagagaggugaggaaggggcug

SEQ ID NO: 5401 - RNA, 21 nt, Artificial Sequence
  Synthetic Oligonucleotide; PD-1 exon 2; Set A
ggagagaggugaggaaggggc

SEQ ID NO: 5402 - RNA, 36 nt, Artificial Sequence
  Synthetic Oligonucleotide; PD-1 exon 2; Set C
ugagagauggagagaggugaggaaggggcugggugg

SEQ ID NO: 5403 - RNA, 26 nt, Artificial Sequence
  Synthetic Oligonucleotide; PD-1 exon 2; Set C
gauggagagaggugaggaaggggcug

SEQ ID NO: 5404 - RNA, 24 nt, Artificial Sequence
  Synthetic Oligonucleotide; PD-1 exon 2; Set A
auggagagaggugaggaaggggcu

SEQ ID NO: 5405 - RNA, 27 nt, Artificial Sequence
  Synthetic Oligonucleotide; PD-1 exon 2; Set C
agauggagagaggugaggaaggggcug

SEQ ID NO: 5406 - RNA, 25 nt, Artificial Sequence
  Synthetic Oligonucleotide; PD-1 exon 2; Set C
gauggagagaggugaggaaggggcu

SEQ ID NO: 5407 - RNA, 39 nt, Artificial Sequence
  Synthetic Oligonucleotide; PD-1 exon 2; Set C
ucugagagauggagagaggugaggaaggggcuggguggc

SEQ ID NO: 5408 - RNA, 26 nt, Artificial Sequence
  Synthetic Oligonucleotide; PD-1 exon 2; Set C
agauggagagaggugaggaaggggcu

SEQ ID NO: 5409 - RNA, 24 nt, Artificial Sequence
  Synthetic Oligonucleotide; PD-1 exon 2; Set A
gauggagagaggugaggaaggggc

SEQ ID NO: 5410 - RNA, 25 nt, Artificial Sequence
  Synthetic Oligonucleotide; PD-1 exon 2; Set A
agauggagagaggugaggaaggggc

SEQ ID NO: 5411 - RNA, 30 nt, Artificial Sequence
  Synthetic Oligonucleotide; PD-1 exon 2; Set C
gagagauggagagaggugaggaaggggcug

SEQ ID NO: 5412 - RNA, 29 nt, Artificial Sequence
  Synthetic Oligonucleotide; PD-1 exon 2; Set C
gagagauggagagaggugaggaaggggcu

SEQ ID NO: 5413 - RNA, 32 nt, Artificial Sequence
  Synthetic Oligonucleotide; PD-1 exon 2; Set C
cugagagauggagagaggugaggaaggggcug

SEQ ID NO: 5414 - RNA, 28 nt, Artificial Sequence
  Synthetic Oligonucleotide; PD-1 exon 2; Set C
gagagauggagagaggugaggaaggggc

SEQ ID NO: 5415 - RNA, 16 nt, Artificial Sequence
  Synthetic Oligonucleotide; PD-1 exon 2; Set C
gagauggagagaggug

SEQ ID NO: 5416 - RNA, 15 nt, Artificial Sequence
  Synthetic Oligonucleotide; PD-1 exon 2; Set C
gagauggagagaggu

SEQ ID NO: 5417 - RNA, 17 nt, Artificial Sequence
  Synthetic Oligonucleotide; PD-1 exon 2; Set C
agagauggagagaggug

SEQ ID NO: 5418 - RNA, 16 nt, Artificial Sequence
  Synthetic Oligonucleotide; PD-1 exon 2; Set C
agagauggagagaggu

SEQ ID NO: 5419 - RNA, 15 nt, Artificial Sequence
  Synthetic Oligonucleotide; PD-1 exon 2; Set C
agagauggagagagg

SEQ ID NO: 5420 - RNA, 15 nt, Artificial Sequence
  Synthetic Oligonucleotide; PD-1 exon 2; Set C
gagagauggagagag

SEQ ID NO: 5421 - RNA, 21 nt, Artificial Sequence
  Synthetic Oligonucleotide; PD-1 exon 2; Set C
ucugagagauggagagaggug

SEQ ID NO: 5422 - RNA, 16 nt, Artificial Sequence
  Synthetic Oligonucleotide; PD-1 exon 2; Set C
ugagagauggagagag

SEQ ID NO: 5423 - RNA, 20 nt, Artificial Sequence
  Synthetic Oligonucleotide; PD-1 exon 2; Set C
ucugagagauggagagaggu

SEQ ID NO: 5424 - RNA, 17 nt, Artificial Sequence
  Synthetic Oligonucleotide; PD-1 exon 2; Set C
cugagagauggagagag

SEQ ID NO: 5425 - RNA, 19 nt, Artificial Sequence
  Synthetic Oligonucleotide; PD-1 exon 2; Set C
ucugagagauggagagagg

SEQ ID NO: 5426 - RNA, 23 nt, Artificial Sequence
  Synthetic Oligonucleotide; PD-1 exon 2; Set A
agucugagagauggagagaggug

SEQ ID NO: 5427 - RNA, 22 nt, Artificial Sequence
  Synthetic Oligonucleotide; PD-1 exon 2; Set A
agucugagagauggagagaggu

SEQ ID NO: 5428 - RNA, 21 nt, Artificial Sequence
  Synthetic Oligonucleotide; PD-1 exon 2; Set C
agucugagagauggagagagg

SEQ ID NO: 5429 - RNA, 29 nt, Artificial Sequence
  Synthetic Oligonucleotide; PD-1 exon 2; Set C
cuggggagucugagagauggagagaggug

SEQ ID NO: 5430 - RNA, 30 nt, Artificial Sequence
  Synthetic Oligonucleotide; PD-1 exon 2; Set C
ucuggggagucugagagauggagagaggug

SEQ ID NO: 5431 - RNA, 27 nt, Artificial Sequence
  Synthetic Oligonucleotide; PD-1 exon 2; Set A
cuggggagucugagagauggagagagg

SEQ ID NO: 5432 - RNA, 31 nt, Artificial Sequence
  Synthetic Oligonucleotide; PD-1 exon 2; Set C
ccugucuggggagucugagagauggagagag

SEQ ID NO: 5433 - RNA, 32 nt, Artificial Sequence
  Synthetic Oligonucleotide; PD-1 exon 2; Set C
gccugucuggggagucugagagauggagagag

SEQ ID NO: 5434 - RNA, 33 nt, Artificial Sequence
  Synthetic Oligonucleotide; PD-1 exon 2; Set C
ggccugucuggggagucugagagauggagagag

SEQ ID NO: 5435 - RNA, 34 nt, Artificial Sequence
  Synthetic Oligonucleotide; PD-1 exon 2; Set C
gggccugucuggggagucugagagauggagagag

SEQ ID NO: 5436 - RNA, 26 nt, Artificial Sequence
  Synthetic Oligonucleotide; PD-1 exon 2; Set C
ccugucuggggagucugagagaugga

SEQ ID NO: 5437 - RNA, 27 nt, Artificial Sequence
  Synthetic Oligonucleotide; PD-1 exon 2; Set C
gccugucuggggagucugagagaugga

SEQ ID NO: 5438 - RNA, 23 nt, Artificial Sequence
  Synthetic Oligonucleotide; PD-1 exon 2; Set A
cugucuggggagucugagagaug

SEQ ID NO: 5439 - RNA, 28 nt, Artificial Sequence
  Synthetic Oligonucleotide; PD-1 exon 2; Set C
ggccugucuggggagucugagagaugga

SEQ ID NO: 5440 - RNA, 22 nt, Artificial Sequence
  Synthetic Oligonucleotide; PD-1 exon 2; Set A
cugucuggggagucugagagau

SEQ ID NO: 5441 - RNA, 29 nt, Artificial Sequence
  Synthetic Oligonucleotide; PD-1 exon 2; Set C
gggccugucuggggagucugagagaugga

SEQ ID NO: 5442 - RNA, 21 nt, Artificial Sequence
  Synthetic Oligonucleotide; PD-1 exon 2; Set A
cugucuggggagucugagaga

SEQ ID NO: 5443 - RNA, 18 nt, Artificial Sequence
  Synthetic Oligonucleotide; PD-1 exon 2; Set C
cugucuggggagucugag

SEQ ID NO: 5444 - RNA, 24 nt, Artificial Sequence
  Synthetic Oligonucleotide; PD-1 exon 2; Set C
gggccugucuggggagucugagag

SEQ ID NO: 5445 - RNA, 23 nt, Artificial Sequence
  Synthetic Oligonucleotide; PD-1 exon 2; Set C
gggccugucuggggagucugaga

SEQ ID NO: 5446 - RNA, 34 nt, Artificial Sequence
  Synthetic Oligonucleotide; PD-1 exon 2; Set C
uggggggguuccagggccugucuggggagucuga

SEQ ID NO: 5447 - RNA, 33 nt, Artificial Sequence
  Synthetic Oligonucleotide; PD-1 exon 2; Set C
uggggggguuccagggccugucuggggagucug

SEQ ID NO: 5448 - RNA, 35 nt, Artificial Sequence
  Synthetic Oligonucleotide; PD-1 exon 2; Set C
guggggggguuccagggccugucuggggagucuga

SEQ ID NO: 5449 - RNA, 34 nt, Artificial Sequence
  Synthetic Oligonucleotide; PD-1 exon 2; Set C
guggggggguuccagggccugucuggggagucug

SEQ ID NO: 5450 - RNA, 15 nt, Artificial Sequence
  Synthetic Oligonucleotide; PD-1 exon 2; Set A
ggguuccagggccug

SEQ ID NO: 5451 - RNA, 15 nt, Artificial Sequence
  Synthetic Oligonucleotide; PD-1 exon 2; Set A
gggguuccagggccu

SEQ ID NO: 5452 - RNA, 18 nt, Artificial Sequence
  Synthetic Oligonucleotide; PD-1 exon 2; Set C
gggggguuccagggccug

SEQ ID NO: 5453 - RNA, 16 nt, Artificial Sequence
  Synthetic Oligonucleotide; PD-1 exon 2; Set A
ggggguuccagggccu

SEQ ID NO: 5454 - RNA, 19 nt, Artificial Sequence
  Synthetic Oligonucleotide; PD-1 exon 2; Set C
ggggggguuccagggccug

SEQ ID NO: 5455 - RNA, 15 nt, Artificial Sequence
  Synthetic Oligonucleotide; PD-1 exon 2; Set A
ggggguuccagggcc

SEQ ID NO: 5456 - RNA, 17 nt, Artificial Sequence
  Synthetic Oligonucleotide; PD-1 exon 2; Set C
gggggguuccagggccu

SEQ ID NO: 5457 - RNA, 20 nt, Artificial Sequence
  Synthetic Oligonucleotide; PD-1 exon 2; Set C
uggggggguuccagggccug

SEQ ID NO: 5458 - RNA, 16 nt, Artificial Sequence
  Synthetic Oligonucleotide; PD-1 exon 2; Set A
gggggguuccagggcc

SEQ ID NO: 5459 - RNA, 18 nt, Artificial Sequence
  Synthetic Oligonucleotide; PD-1 exon 2; Set C
ggggggguuccagggccu

SEQ ID NO: 5460 - RNA, 21 nt, Artificial Sequence
  Synthetic Oligonucleotide; PD-1 exon 2; Set C
guggggggguuccagggccug

SEQ ID NO: 5461 - RNA, 15 nt, Artificial Sequence
  Synthetic Oligonucleotide; PD-1 exon 2; Set A
gggggguuccagggc

SEQ ID NO: 5462 - RNA, 17 nt, Artificial Sequence
  Synthetic Oligonucleotide; PD-1 exon 2; Set C
ggggggguuccagggcc

SEQ ID NO: 5463 - RNA, 19 nt, Artificial Sequence
  Synthetic Oligonucleotide; PD-1 exon 2; Set C
uggggggguuccagggccu

SEQ ID NO: 5464 - RNA, 22 nt, Artificial Sequence
  Synthetic Oligonucleotide; PD-1 exon 2; Set C
gguggggggguuccagggccug

SEQ ID NO: 5465 - RNA, 16 nt, Artificial Sequence
  Synthetic Oligonucleotide; PD-1 exon 2; Set A
ggggggguuccagggc

SEQ ID NO: 5466 - RNA, 18 nt, Artificial Sequence
  Synthetic Oligonucleotide; PD-1 exon 2; Set C
uggggggguuccagggcc

SEQ ID NO: 5467 - RNA, 20 nt, Artificial Sequence
  Synthetic Oligonucleotide; PD-1 exon 2; Set C
guggggggguuccagggccu

SEQ ID NO: 5468 - RNA, 15 nt, Artificial Sequence
  Synthetic Oligonucleotide; PD-1 exon 2; Set A
ggggggguuccaggg

SEQ ID NO: 5469 - RNA, 17 nt, Artificial Sequence
  Synthetic Oligonucleotide; PD-1 exon 2; Set C
uggggggguuccagggc

SEQ ID NO: 5470 - RNA, 19 nt, Artificial Sequence
  Synthetic Oligonucleotide; PD-1 exon 2; Set C
guggggggguuccagggcc

SEQ ID NO: 5471 - RNA, 21 nt, Artificial Sequence
  Synthetic Oligonucleotide; PD-1 exon 2; Set C
gguggggggguuccagggccu

SEQ ID NO: 5472 - RNA, 16 nt, Artificial Sequence
  Synthetic Oligonucleotide; PD-1 exon 2; Set A
uggggggguuccaggg

SEQ ID NO: 5473 - RNA, 18 nt, Artificial Sequence
  Synthetic Oligonucleotide; PD-1 exon 2; Set C
guggggggguuccagggc

SEQ ID NO: 5474 - RNA, 20 nt, Artificial Sequence
  Synthetic Oligonucleotide; PD-1 exon 2; Set C
gguggggggguuccagggcc

SEQ ID NO: 5475 - RNA, 22 nt, Artificial Sequence
  Synthetic Oligonucleotide; PD-1 exon 2; Set C
agguggggggguuccagggccu

SEQ ID NO: 5476 - RNA, 17 nt, Artificial Sequence
  Synthetic Oligonucleotide; PD-1 exon 2; Set A
guggggggguuccaggg

SEQ ID NO: 5477 - RNA, 19 nt, Artificial Sequence
  Synthetic Oligonucleotide; PD-1 exon 2; Set C
gguggggggguuccagggc

SEQ ID NO: 5478 - RNA, 21 nt, Artificial Sequence
  Synthetic Oligonucleotide; PD-1 exon 2; Set C
agguggggggguuccagggcc

SEQ ID NO: 5479 - RNA, 18 nt, Artificial Sequence
  Synthetic Oligonucleotide; PD-1 exon 2; Set C
gguggggggguuccaggg

SEQ ID NO: 5480 - RNA, 20 nt, Artificial Sequence
  Synthetic Oligonucleotide; PD-1 exon 2; Set C
agguggggggguuccagggc

SEQ ID NO: 5481 - RNA, 22 nt, Artificial Sequence
  Synthetic Oligonucleotide; PD-1 exon 2; Set C
aagguggggggguuccagggcc

SEQ ID NO: 5482 - RNA, 28 nt, Artificial Sequence
  Synthetic Oligonucleotide; PD-1 exon 2; Set C
ggagaagguggggggguuccagggccug

SEQ ID NO: 5483 - RNA, 27 nt, Artificial Sequence
  Synthetic Oligonucleotide; PD-1 exon 2; Set C
ggagaagguggggggguuccagggccu

SEQ ID NO: 5484 - RNA, 26 nt, Artificial Sequence
  Synthetic Oligonucleotide; PD-1 exon 2; Set C
ggagaagguggggggguuccagggcc

SEQ ID NO: 5485 - RNA, 35 nt, Artificial Sequence
  Synthetic Oligonucleotide; PD-1 exon 2; Set C
gcuggggagaagguggggggguuccagggccuguc

SEQ ID NO: 5486 - RNA, 25 nt, Artificial Sequence
  Synthetic Oligonucleotide; PD-1 exon 2; Set C
ggagaagguggggggguuccagggc

SEQ ID NO: 5487 - RNA, 24 nt, Artificial Sequence
  Synthetic Oligonucleotide; PD-1 exon 2; Set C
ggagaagguggggggguuccaggg

SEQ ID NO: 5488 - RNA, 35 nt, Artificial Sequence
  Synthetic Oligonucleotide; PD-1 exon 2; Set C
gggcuggggagaagguggggggguuccagggccug

SEQ ID NO: 5489 - RNA, 40 nt, Artificial Sequence
  Synthetic Oligonucleotide; PD-1 exon 2; Set C
gcagggcuggggagaagguggggggguuccagggccuguc

SEQ ID NO: 5490 - RNA, 36 nt, Artificial Sequence
  Synthetic Oligonucleotide; PD-1 exon 2; Set C
agggcuggggagaagguggggggguuccagggccug

SEQ ID NO: 5491 - RNA, 34 nt, Artificial Sequence
  Synthetic Oligonucleotide; PD-1 exon 2; Set C
gggcuggggagaagguggggggguuccagggccu

SEQ ID NO: 5492 - RNA, 39 nt, Artificial Sequence
  Synthetic Oligonucleotide; PD-1 exon 2; Set C
gcagggcuggggagaagguggggggguuccagggccugu

SEQ ID NO: 5493 - RNA, 37 nt, Artificial Sequence
  Synthetic Oligonucleotide; PD-1 exon 2; Set C
cagggcuggggagaagguggggggguuccagggccug

SEQ ID NO: 5494 - RNA, 33 nt, Artificial Sequence
  Synthetic Oligonucleotide; PD-1 exon 2; Set C
gggcuggggagaagguggggggguuccagggcc

SEQ ID NO: 5495 - RNA, 35 nt, Artificial Sequence
  Synthetic Oligonucleotide; PD-1 exon 2; Set C
agggcuggggagaagguggggggguuccagggccu

SEQ ID NO: 5496 - RNA, 40 nt, Artificial Sequence
  Synthetic Oligonucleotide; PD-1 exon 2; Set C
agcagggcuggggagaagguggggggguuccagggccugu

SEQ ID NO: 5497 - RNA, 32 nt, Artificial Sequence
  Synthetic Oligonucleotide; PD-1 exon 2; Set C
gggcuggggagaagguggggggguuccagggc

SEQ ID NO: 5498 - RNA, 34 nt, Artificial Sequence
  Synthetic Oligonucleotide; PD-1 exon 2; Set C
agggcuggggagaagguggggggguuccagggcc

SEQ ID NO: 5499 - RNA, 36 nt, Artificial Sequence
  Synthetic Oligonucleotide; PD-1 exon 2; Set C
cagggcuggggagaagguggggggguuccagggccu

SEQ ID NO: 5500 - RNA, 31 nt, Artificial Sequence
  Synthetic Oligonucleotide; PD-1 exon 2; Set C
gggcuggggagaagguggggggguuccaggg

SEQ ID NO: 5501 - RNA, 33 nt, Artificial Sequence
  Synthetic Oligonucleotide; PD-1 exon 2; Set C
agggcuggggagaagguggggggguuccagggc

SEQ ID NO: 5502 - RNA, 35 nt, Artificial Sequence
  Synthetic Oligonucleotide; PD-1 exon 2; Set C
cagggcuggggagaagguggggggguuccagggcc

SEQ ID NO: 5503 - RNA, 32 nt, Artificial Sequence
  Synthetic Oligonucleotide; PD-1 exon 2; Set C
agggcuggggagaagguggggggguuccaggg

SEQ ID NO: 5504 - RNA, 34 nt, Artificial Sequence
  Synthetic Oligonucleotide; PD-1 exon 2; Set C
cagggcuggggagaagguggggggguuccagggc

SEQ ID NO: 5505 - RNA, 33 nt, Artificial Sequence
  Synthetic Oligonucleotide; PD-1 exon 2; Set C
cagggcuggggagaagguggggggguuccaggg

SEQ ID NO: 5506 - RNA, 30 nt, Artificial Sequence
  Synthetic Oligonucleotide; PD-1 exon 2; Set C
gagcagggcuggggagaagguggggggguu

SEQ ID NO: 5507 - RNA, 29 nt, Artificial Sequence
  Synthetic Oligonucleotide; PD-1 exon 2; Set C
gagcagggcuggggagaaggugggggggu

SEQ ID NO: 5508 - RNA, 28 nt, Artificial Sequence
  Synthetic Oligonucleotide; PD-1 exon 2; Set C
gagcagggcuggggagaagguggggggg

SEQ ID NO: 5509 - RNA, 27 nt, Artificial Sequence
  Synthetic Oligonucleotide; PD-1 exon 2; Set C
gagcagggcuggggagaaggugggggg

SEQ ID NO: 5510 - RNA, 26 nt, Artificial Sequence
  Synthetic Oligonucleotide; PD-1 exon 2; Set C
gagcagggcuggggagaagguggggg

SEQ ID NO: 5511 - RNA, 22 nt, Artificial Sequence
  Synthetic Oligonucleotide; PD-1 exon 2; Set C
gcagggcuggggagaagguggg

SEQ ID NO: 5512 - RNA, 23 nt, Artificial Sequence
  Synthetic Oligonucleotide; PD-1 exon 2; Set C
agcagggcuggggagaagguggg

SEQ ID NO: 5513 - RNA, 21 nt, Artificial Sequence
  Synthetic Oligonucleotide; PD-1 exon 2; Set C
gcagggcuggggagaaggugg

SEQ ID NO: 5514 - RNA, 22 nt, Artificial Sequence
  Synthetic Oligonucleotide; PD-1 exon 2; Set C
agcagggcuggggagaaggugg

SEQ ID NO: 5515 - RNA, 20 nt, Artificial Sequence
  Synthetic Oligonucleotide; PD-1 exon 2; Set A
gcagggcuggggagaaggug

SEQ ID NO: 5516 - RNA, 19 nt, Artificial Sequence
  Synthetic Oligonucleotide; PD-1 exon 2; Set A
gcagggcuggggagaaggu

SEQ ID NO: 5517 - RNA, 21 nt, Artificial Sequence
  Synthetic Oligonucleotide; PD-1 exon 2; Set A
agcagggcuggggagaaggug

SEQ ID NO: 5518 - RNA, 20 nt, Artificial Sequence
  Synthetic Oligonucleotide; PD-1 exon 2; Set A
agcagggcuggggagaaggu

SEQ ID NO: 5519 - RNA, 17 nt, Artificial Sequence
  Synthetic Oligonucleotide; PD-1 exon 2; Set A
gagcagggcuggggaga

SEQ ID NO: 5520 - RNA, 15 nt, Artificial Sequence
  Synthetic Oligonucleotide; PD-1 exon 2; Set A
agcagggcuggggag

SEQ ID NO: 5521 - RNA, 40 nt, Artificial Sequence
  Synthetic Oligonucleotide; PD-1 exon 2; Set C
uucggucaccacgagcagggcuggggagaagguggggggg

SEQ ID NO: 5522 - RNA, 39 nt, Artificial Sequence
  Synthetic Oligonucleotide; PD-1 exon 2; Set C
uucggucaccacgagcagggcuggggagaaggugggggg

SEQ ID NO: 5523 - RNA, 40 nt, Artificial Sequence
  Synthetic Oligonucleotide; PD-1 exon 2; Set C
cuucggucaccacgagcagggcuggggagaaggugggggg

SEQ ID NO: 5524 - RNA, 38 nt, Artificial Sequence
  Synthetic Oligonucleotide; PD-1 exon 2; Set C
uucggucaccacgagcagggcuggggagaagguggggg

SEQ ID NO: 5525 - RNA, 16 nt, Artificial Sequence
  Synthetic Oligonucleotide; PD-1 exon 2; Set A
cgagcagggcugggga

SEQ ID NO: 5526 - RNA, 39 nt, Artificial Sequence
  Synthetic Oligonucleotide; PD-1 exon 2; Set C
cuucggucaccacgagcagggcuggggagaagguggggg

SEQ ID NO: 5527 - RNA, 37 nt, Artificial Sequence
  Synthetic Oligonucleotide; PD-1 exon 2; Set C
uucggucaccacgagcagggcuggggagaaggugggg

SEQ ID NO: 5528 - RNA, 17 nt, Artificial Sequence
  Synthetic Oligonucleotide; PD-1 exon 2; Set A
acgagcagggcugggga

SEQ ID NO: 5529 - RNA, 36 nt, Artificial Sequence
  Synthetic Oligonucleotide; PD-1 exon 2; Set C
uucggucaccacgagcagggcuggggagaagguggg

SEQ ID NO: 5530 - RNA, 35 nt, Artificial Sequence
  Synthetic Oligonucleotide; PD-1 exon 2; Set C
uucggucaccacgagcagggcuggggagaaggugg

SEQ ID NO: 5531 - RNA, 33 nt, Artificial Sequence
  Synthetic Oligonucleotide; PD-1 exon 2; Set C
uucggucaccacgagcagggcuggggagaaggu

SEQ ID NO: 5532 - RNA, 32 nt, Artificial Sequence
  Synthetic Oligonucleotide; PD-1 exon 2; Set C
uucggucaccacgagcagggcuggggagaagg

SEQ ID NO: 5533 - RNA, 31 nt, Artificial Sequence
  Synthetic Oligonucleotide; PD-1 exon 2; Set C
uucggucaccacgagcagggcuggggagaag

SEQ ID NO: 5534 - RNA, 21 nt, Artificial Sequence
  Synthetic Oligonucleotide; PD-1 exon 2; Set C
ucaccacgagcagggcugggg

SEQ ID NO: 5535 - RNA, 30 nt, Artificial Sequence
  Synthetic Oligonucleotide; PD-1 exon 2; Set C
uucggucaccacgagcagggcuggggagaa

SEQ ID NO: 5536 - RNA, 20 nt, Artificial Sequence
  Synthetic Oligonucleotide; PD-1 exon 2; Set C
ucaccacgagcagggcuggg

SEQ ID NO: 5537 - RNA, 29 nt, Artificial Sequence
  Synthetic Oligonucleotide; PD-1 exon 2; Set C
uucggucaccacgagcagggcuggggaga

SEQ ID NO: 5538 - RNA, 19 nt, Artificial Sequence
  Synthetic Oligonucleotide; PD-1 exon 2; Set A
ucaccacgagcagggcugg

SEQ ID NO: 5539 - RNA, 21 nt, Artificial Sequence
  Synthetic Oligonucleotide; PD-1 exon 2; Set C
gucaccacgagcagggcuggg

SEQ ID NO: 5540 - RNA, 28 nt, Artificial Sequence
  Synthetic Oligonucleotide; PD-1 exon 2; Set C
uucggucaccacgagcagggcuggggag

SEQ ID NO: 5541 - RNA, 20 nt, Artificial Sequence
  Synthetic Oligonucleotide; PD-1 exon 2; Set C
gucaccacgagcagggcugg

SEQ ID NO: 5542 - RNA, 24 nt, Artificial Sequence
  Synthetic Oligonucleotide; PD-1 exon 2; Set C
cggucaccacgagcagggcugggg

SEQ ID NO: 5543 - RNA, 18 nt, Artificial Sequence
  Synthetic Oligonucleotide; PD-1 exon 2; Set A
ucaccacgagcagggcug

SEQ ID NO: 5544 - RNA, 25 nt, Artificial Sequence
  Synthetic Oligonucleotide; PD-1 exon 2; Set C
ucggucaccacgagcagggcugggg

SEQ ID NO: 5545 - RNA, 19 nt, Artificial Sequence
  Synthetic Oligonucleotide; PD-1 exon 2; Set A
gucaccacgagcagggcug

SEQ ID NO: 5546 - RNA, 17 nt, Artificial Sequence
  Synthetic Oligonucleotide; PD-1 exon 2; Set A
ucaccacgagcagggcu

SEQ ID NO: 5547 - RNA, 22 nt, Artificial Sequence
  Synthetic Oligonucleotide; PD-1 exon 2; Set C
cggucaccacgagcagggcugg

SEQ ID NO: 5548 - RNA, 18 nt, Artificial Sequence
  Synthetic Oligonucleotide; PD-1 exon 2; Set A
gucaccacgagcagggcu

SEQ ID NO: 5549 - RNA, 16 nt, Artificial Sequence
  Synthetic Oligonucleotide; PD-1 exon 2; Set A
ucaccacgagcagggc

SEQ ID NO: 5550 - RNA, 23 nt, Artificial Sequence
  Synthetic Oligonucleotide; PD-1 exon 2; Set C
ucggucaccacgagcagggcugg

SEQ ID NO: 5551 - RNA, 17 nt, Artificial Sequence
  Synthetic Oligonucleotide; PD-1 exon 2; Set A
gucaccacgagcagggc

SEQ ID NO: 5552 - RNA, 16 nt, Artificial Sequence
  Synthetic Oligonucleotide; PD-1 exon 2; Set C
cggucaccacgagcag

SEQ ID NO: 5553 - RNA, 17 nt, Artificial Sequence
  Synthetic Oligonucleotide; PD-1 exon 2; Set A
ucggucaccacgagcag

SEQ ID NO: 5554 - RNA, 33 nt, Artificial Sequence
  Synthetic Oligonucleotide; PD-1 exon 2; Set C
uguccccuucggucaccacgagcagggcugggg

SEQ ID NO: 5555 - RNA, 32 nt, Artificial Sequence
  Synthetic Oligonucleotide; PD-1 exon 2; Set C
uguccccuucggucaccacgagcagggcuggg

SEQ ID NO: 5556 - RNA, 31 nt, Artificial Sequence
  Synthetic Oligonucleotide; PD-1 exon 2; Set C
uguccccuucggucaccacgagcagggcugg

SEQ ID NO: 5557 - RNA, 35 nt, Artificial Sequence
  Synthetic Oligonucleotide; PD-1 exon 2; Set C
guuguccccuucggucaccacgagcagggcugggg

SEQ ID NO: 5558 - RNA, 33 nt, Artificial Sequence
  Synthetic Oligonucleotide; PD-1 exon 2; Set C
uuguccccuucggucaccacgagcagggcuggg

SEQ ID NO: 5559 - RNA, 32 nt, Artificial Sequence
  Synthetic Oligonucleotide; PD-1 exon 2; Set C
uuguccccuucggucaccacgagcagggcugg

SEQ ID NO: 5560 - RNA, 36 nt, Artificial Sequence
  Synthetic Oligonucleotide; PD-1 exon 2; Set C
cguuguccccuucggucaccacgagcagggcugggg

SEQ ID NO: 5561 - RNA, 34 nt, Artificial Sequence
  Synthetic Oligonucleotide; PD-1 exon 2; Set C
guuguccccuucggucaccacgagcagggcuggg

SEQ ID NO: 5562 - RNA, 30 nt, Artificial Sequence
  Synthetic Oligonucleotide; PD-1 exon 2; Set C
uguccccuucggucaccacgagcagggcug

SEQ ID NO: 5563 - RNA, 33 nt, Artificial Sequence
  Synthetic Oligonucleotide; PD-1 exon 2; Set C
guuguccccuucggucaccacgagcagggcugg

SEQ ID NO: 5564 - RNA, 35 nt, Artificial Sequence
  Synthetic Oligonucleotide; PD-1 exon 2; Set C
cguuguccccuucggucaccacgagcagggcuggg

SEQ ID NO: 5565 - RNA, 31 nt, Artificial Sequence
  Synthetic Oligonucleotide; PD-1 exon 2; Set C
uuguccccuucggucaccacgagcagggcug

SEQ ID NO: 5566 - RNA, 29 nt, Artificial Sequence
  Synthetic Oligonucleotide; PD-1 exon 2; Set C
uguccccuucggucaccacgagcagggcu

SEQ ID NO: 5567 - RNA, 34 nt, Artificial Sequence
  Synthetic Oligonucleotide; PD-1 exon 2; Set C
cguuguccccuucggucaccacgagcagggcugg

SEQ ID NO: 5568 - RNA, 32 nt, Artificial Sequence
  Synthetic Oligonucleotide; PD-1 exon 2; Set C
guuguccccuucggucaccacgagcagggcug

SEQ ID NO: 5569 - RNA, 30 nt, Artificial Sequence
  Synthetic Oligonucleotide; PD-1 exon 2; Set C
uuguccccuucggucaccacgagcagggcu

SEQ ID NO: 5570 - RNA, 28 nt, Artificial Sequence
  Synthetic Oligonucleotide; PD-1 exon 2; Set C
uguccccuucggucaccacgagcagggc

SEQ ID NO: 5571 - RNA, 33 nt, Artificial Sequence
  Synthetic Oligonucleotide; PD-1 exon 2; Set C
cguuguccccuucggucaccacgagcagggcug

SEQ ID NO: 5572 - RNA, 31 nt, Artificial Sequence
  Synthetic Oligonucleotide; PD-1 exon 2; Set C
guuguccccuucggucaccacgagcagggcu

SEQ ID NO: 5573 - RNA, 29 nt, Artificial Sequence
  Synthetic Oligonucleotide; PD-1 exon 2; Set C
uuguccccuucggucaccacgagcagggc

SEQ ID NO: 5574 - RNA, 32 nt, Artificial Sequence
  Synthetic Oligonucleotide; PD-1 exon 2; Set C
cguuguccccuucggucaccacgagcagggcu

SEQ ID NO: 5575 - RNA, 30 nt, Artificial Sequence
  Synthetic Oligonucleotide; PD-1 exon 2; Set C
guuguccccuucggucaccacgagcagggc

SEQ ID NO: 5576 - RNA, 31 nt, Artificial Sequence
  Synthetic Oligonucleotide; PD-1 exon 2; Set C
cguuguccccuucggucaccacgagcagggc

SEQ ID NO: 5577 - RNA, 21 nt, Artificial Sequence
  Synthetic Oligonucleotide; PD-1 exon 2; Set C
uguccccuucggucaccacga

SEQ ID NO: 5578 - RNA, 22 nt, Artificial Sequence
  Synthetic Oligonucleotide; PD-1 exon 2; Set C
uuguccccuucggucaccacga

SEQ ID NO: 5579 - RNA, 39 nt, Artificial Sequence
  Synthetic Oligonucleotide; PD-1 exon 2; Set C
ggugaagguggcguuguccccuucggucaccacgagcag

SEQ ID NO: 5580 - RNA, 40 nt, Artificial Sequence
  Synthetic Oligonucleotide; PD-1 exon 2; Set C
aggugaagguggcguuguccccuucggucaccacgagcag

SEQ ID NO: 5581 - RNA, 15 nt, Artificial Sequence
  Synthetic Oligonucleotide; PD-1 exon 2; Set C
cguuguccccuucgg

SEQ ID NO: 5582 - RNA, 26 nt, Artificial Sequence
  Synthetic Oligonucleotide; PD-1 exon 2; Set C
ggugaagguggcguuguccccuucgg

SEQ ID NO: 5583 - RNA, 25 nt, Artificial Sequence
  Synthetic Oligonucleotide; PD-1 exon 2; Set C
ggugaagguggcguuguccccuucg

SEQ ID NO: 5584 - RNA, 27 nt, Artificial Sequence
  Synthetic Oligonucleotide; PD-1 exon 2; Set C
aggugaagguggcguuguccccuucgg

SEQ ID NO: 5585 - RNA, 26 nt, Artificial Sequence
  Synthetic Oligonucleotide; PD-1 exon 2; Set C
aggugaagguggcguuguccccuucg

SEQ ID NO: 5586 - RNA, 40 nt, Artificial Sequence
  Synthetic Oligonucleotide; PD-1 exon 2; Set C
guuggagaagcugcaggugaagguggcguuguccccuucg

SEQ ID NO: 5587 - RNA, 17 nt, Artificial Sequence
  Synthetic Oligonucleotide; PD-1 exon 2; Set C
guuggagaagcugcagg

SEQ ID NO: 5588 - RNA, 34 nt, Artificial Sequence
  Synthetic Oligonucleotide; PD-1 exon 2; Set C
cgaagcucuccgauguguuggagaagcugcaggu

SEQ ID NO: 5589 - RNA, 35 nt, Artificial Sequence
  Synthetic Oligonucleotide; PD-1 exon 2; Set C
acgaagcucuccgauguguuggagaagcugcaggu

SEQ ID NO: 5590 - RNA, 33 nt, Artificial Sequence
  Synthetic Oligonucleotide; PD-1 exon 2; Set C
cgaagcucuccgauguguuggagaagcugcagg

SEQ ID NO: 5591 - RNA, 36 nt, Artificial Sequence
  Synthetic Oligonucleotide; PD-1 exon 2; Set C
cacgaagcucuccgauguguuggagaagcugcaggu

SEQ ID NO: 5592 - RNA, 34 nt, Artificial Sequence
  Synthetic Oligonucleotide; PD-1 exon 2; Set C
acgaagcucuccgauguguuggagaagcugcagg

SEQ ID NO: 5593 - RNA, 37 nt, Artificial Sequence
  Synthetic Oligonucleotide; PD-1 exon 2; Set C
gcacgaagcucuccgauguguuggagaagcugcaggu

SEQ ID NO: 5594 - RNA, 35 nt, Artificial Sequence
  Synthetic Oligonucleotide; PD-1 exon 2; Set C
cacgaagcucuccgauguguuggagaagcugcagg

SEQ ID NO: 5595 - RNA, 38 nt, Artificial Sequence
  Synthetic Oligonucleotide; PD-1 exon 2; Set C
agcacgaagcucuccgauguguuggagaagcugcaggu

SEQ ID NO: 5596 - RNA, 36 nt, Artificial Sequence
  Synthetic Oligonucleotide; PD-1 exon 2; Set C
gcacgaagcucuccgauguguuggagaagcugcagg

SEQ ID NO: 5597 - RNA, 37 nt, Artificial Sequence
  Synthetic Oligonucleotide; PD-1 exon 2; Set C
agcacgaagcucuccgauguguuggagaagcugcagg

SEQ ID NO: 5598 - RNA, 38 nt, Artificial Sequence
  Synthetic Oligonucleotide; PD-1 exon 2; Set C
uagcacgaagcucuccgauguguuggagaagcugcagg

SEQ ID NO: 5599 - RNA, 28 nt, Artificial Sequence
  Synthetic Oligonucleotide; PD-1 exon 2; Set C
guaccaguuuagcacgaagcucuccgau

SEQ ID NO: 5600 - RNA, 39 nt, Artificial Sequence
  Synthetic Oligonucleotide; PD-1 exon 2; Set C
caugcgguaccaguuuagcacgaagcucuccgauguguu

SEQ ID NO: 5601 - RNA, 40 nt, Artificial Sequence
  Synthetic Oligonucleotide; PD-1 exon 2; Set C
ucaugcgguaccaguuuagcacgaagcucuccgauguguu

SEQ ID NO: 5602 - RNA, 38 nt, Artificial Sequence
  Synthetic Oligonucleotide; PD-1 exon 2; Set C
caugcgguaccaguuuagcacgaagcucuccgaugugu

SEQ ID NO: 5603 - RNA, 39 nt, Artificial Sequence
  Synthetic Oligonucleotide; PD-1 exon 2; Set C
ucaugcgguaccaguuuagcacgaagcucuccgaugugu

SEQ ID NO: 5604 - RNA, 37 nt, Artificial Sequence
  Synthetic Oligonucleotide; PD-1 exon 2; Set C
caugcgguaccaguuuagcacgaagcucuccgaugug

SEQ ID NO: 5605 - RNA, 40 nt, Artificial Sequence
  Synthetic Oligonucleotide; PD-1 exon 2; Set C
cucaugcgguaccaguuuagcacgaagcucuccgaugugu

SEQ ID NO: 5606 - RNA, 38 nt, Artificial Sequence
  Synthetic Oligonucleotide; PD-1 exon 2; Set C
ucaugcgguaccaguuuagcacgaagcucuccgaugug

SEQ ID NO: 5607 - RNA, 36 nt, Artificial Sequence
  Synthetic Oligonucleotide; PD-1 exon 2; Set C
caugcgguaccaguuuagcacgaagcucuccgaugu

SEQ ID NO: 5608 - RNA, 39 nt, Artificial Sequence
  Synthetic Oligonucleotide; PD-1 exon 2; Set C
cucaugcgguaccaguuuagcacgaagcucuccgaugug

SEQ ID NO: 5609 - RNA, 37 nt, Artificial Sequence
  Synthetic Oligonucleotide; PD-1 exon 2; Set C
ucaugcgguaccaguuuagcacgaagcucuccgaugu

SEQ ID NO: 5610 - RNA, 35 nt, Artificial Sequence
  Synthetic Oligonucleotide; PD-1 exon 2; Set C
caugcgguaccaguuuagcacgaagcucuccgaug

SEQ ID NO: 5611 - RNA, 36 nt, Artificial Sequence
  Synthetic Oligonucleotide; PD-1 exon 2; Set C
ucaugcgguaccaguuuagcacgaagcucuccgaug

SEQ ID NO: 5612 - RNA, 38 nt, Artificial Sequence
  Synthetic Oligonucleotide; PD-1 exon 2; Set C
cucaugcgguaccaguuuagcacgaagcucuccgaugu

SEQ ID NO: 5613 - RNA, 34 nt, Artificial Sequence
  Synthetic Oligonucleotide; PD-1 exon 2; Set C
caugcgguaccaguuuagcacgaagcucuccgau

SEQ ID NO: 5614 - RNA, 37 nt, Artificial Sequence
  Synthetic Oligonucleotide; PD-1 exon 2; Set C
cucaugcgguaccaguuuagcacgaagcucuccgaug

SEQ ID NO: 5615 - RNA, 35 nt, Artificial Sequence
  Synthetic Oligonucleotide; PD-1 exon 2; Set C
ucaugcgguaccaguuuagcacgaagcucuccgau

SEQ ID NO: 5616 - RNA, 36 nt, Artificial Sequence
  Synthetic Oligonucleotide; PD-1 exon 2; Set C
cucaugcgguaccaguuuagcacgaagcucuccgau

SEQ ID NO: 5617 - RNA, 17 nt, Artificial Sequence
  Synthetic Oligonucleotide; PD-1 exon 2; Set C
uaccaguuuagcacgaa

SEQ ID NO: 5618 - RNA, 24 nt, Artificial Sequence
  Synthetic Oligonucleotide; PD-1 exon 2; Set A
caugcgguaccaguuuagcacgaa

SEQ ID NO: 5619 - RNA, 23 nt, Artificial Sequence
  Synthetic Oligonucleotide; PD-1 exon 2; Set A
caugcgguaccaguuuagcacga

SEQ ID NO: 5620 - RNA, 26 nt, Artificial Sequence
  Synthetic Oligonucleotide; PD-1 exon 2; Set C
cucaugcgguaccaguuuagcacgaa

SEQ ID NO: 5621 - RNA, 24 nt, Artificial Sequence
  Synthetic Oligonucleotide; PD-1 exon 2; Set C
ucaugcgguaccaguuuagcacga

SEQ ID NO: 5622 - RNA, 22 nt, Artificial Sequence
  Synthetic Oligonucleotide; PD-1 exon 2; Set A
caugcgguaccaguuuagcacg

SEQ ID NO: 5623 - RNA, 25 nt, Artificial Sequence
  Synthetic Oligonucleotide; PD-1 exon 2; Set C
cucaugcgguaccaguuuagcacga

SEQ ID NO: 5624 - RNA, 23 nt, Artificial Sequence
  Synthetic Oligonucleotide; PD-1 exon 2; Set A
ucaugcgguaccaguuuagcacg

SEQ ID NO: 5625 - RNA, 21 nt, Artificial Sequence
  Synthetic Oligonucleotide; PD-1 exon 2; Set A
caugcgguaccaguuuagcac

SEQ ID NO: 5626 - RNA, 24 nt, Artificial Sequence
  Synthetic Oligonucleotide; PD-1 exon 2; Set A
cucaugcgguaccaguuuagcacg

SEQ ID NO: 5627 - RNA, 22 nt, Artificial Sequence
  Synthetic Oligonucleotide; PD-1 exon 2; Set A
ucaugcgguaccaguuuagcac

SEQ ID NO: 5628 - RNA, 20 nt, Artificial Sequence
  Synthetic Oligonucleotide; PD-1 exon 2; Set A
caugcgguaccaguuuagca

SEQ ID NO: 5629 - RNA, 21 nt, Artificial Sequence
  Synthetic Oligonucleotide; PD-1 exon 2; Set A
ucaugcgguaccaguuuagca

SEQ ID NO: 5630 - RNA, 20 nt, Artificial Sequence
  Synthetic Oligonucleotide; PD-1 exon 2; Set A
ucaugcgguaccaguuuagc

SEQ ID NO: 5631 - RNA, 17 nt, Artificial Sequence
  Synthetic Oligonucleotide; PD-1 exon 2; Set C
caugcgguaccaguuua

SEQ ID NO: 5632 - RNA, 19 nt, Artificial Sequence
  Synthetic Oligonucleotide; PD-1 exon 2; Set C
ucaugcgguaccaguuuag

SEQ ID NO: 5633 - RNA, 16 nt, Artificial Sequence
  Synthetic Oligonucleotide; PD-1 exon 2; Set C
caugcgguaccaguuu

SEQ ID NO: 5634 - RNA, 32 nt, Artificial Sequence
  Synthetic Oligonucleotide; PD-1 exon 2; Set C
cuggggcucaugcgguaccaguuuagcacgaa

SEQ ID NO: 5635 - RNA, 18 nt, Artificial Sequence
  Synthetic Oligonucleotide; PD-1 exon 2; Set C
ucaugcgguaccaguuua

SEQ ID NO: 5636 - RNA, 17 nt, Artificial Sequence
  Synthetic Oligonucleotide; PD-1 exon 2; Set C
ucaugcgguaccaguuu

SEQ ID NO: 5637 - RNA, 15 nt, Artificial Sequence
  Synthetic Oligonucleotide; PD-1 exon 2; Set C
caugcgguaccaguu

SEQ ID NO: 5638 - RNA, 19 nt, Artificial Sequence
  Synthetic Oligonucleotide; PD-1 exon 2; Set C
cucaugcgguaccaguuua

SEQ ID NO: 5639 - RNA, 31 nt, Artificial Sequence
  Synthetic Oligonucleotide; PD-1 exon 2; Set C
cuggggcucaugcgguaccaguuuagcacga

SEQ ID NO: 5640 - RNA, 18 nt, Artificial Sequence
  Synthetic Oligonucleotide; PD-1 exon 2; Set C
cucaugcgguaccaguuu

SEQ ID NO: 5641 - RNA, 16 nt, Artificial Sequence
  Synthetic Oligonucleotide; PD-1 exon 2; Set C
ucaugcgguaccaguu

SEQ ID NO: 5642 - RNA, 30 nt, Artificial Sequence
  Synthetic Oligonucleotide; PD-1 exon 2; Set C
cuggggcucaugcgguaccaguuuagcacg

SEQ ID NO: 5643 - RNA, 17 nt, Artificial Sequence
  Synthetic Oligonucleotide; PD-1 exon 2; Set C
cucaugcgguaccaguu

SEQ ID NO: 5644 - RNA, 15 nt, Artificial Sequence
  Synthetic Oligonucleotide; PD-1 exon 2; Set C
ucaugcgguaccagu

SEQ ID NO: 5645 - RNA, 16 nt, Artificial Sequence
  Synthetic Oligonucleotide; PD-1 exon 2; Set C
cucaugcgguaccagu

SEQ ID NO: 5646 - RNA, 30 nt, Artificial Sequence
  Synthetic Oligonucleotide; PD-1 exon 2; Set C
gcuggggcucaugcgguaccaguuuagcac

SEQ ID NO: 5647 - RNA, 31 nt, Artificial Sequence
  Synthetic Oligonucleotide; PD-1 exon 2; Set C
ugcuggggcucaugcgguaccaguuuagcac

SEQ ID NO: 5648 - RNA, 29 nt, Artificial Sequence
  Synthetic Oligonucleotide; PD-1 exon 2; Set C
gcuggggcucaugcgguaccaguuuagca

SEQ ID NO: 5649 - RNA, 30 nt, Artificial Sequence
  Synthetic Oligonucleotide; PD-1 exon 2; Set C
ugcuggggcucaugcgguaccaguuuagca

SEQ ID NO: 5650 - RNA, 28 nt, Artificial Sequence
  Synthetic Oligonucleotide; PD-1 exon 2; Set C
gcuggggcucaugcgguaccaguuuagc

SEQ ID NO: 5651 - RNA, 25 nt, Artificial Sequence
  Synthetic Oligonucleotide; PD-1 exon 2; Set C
cuggggcucaugcgguaccaguuua

SEQ ID NO: 5652 - RNA, 27 nt, Artificial Sequence
  Synthetic Oligonucleotide; PD-1 exon 2; Set C
gcuggggcucaugcgguaccaguuuag

SEQ ID NO: 5653 - RNA, 29 nt, Artificial Sequence
  Synthetic Oligonucleotide; PD-1 exon 2; Set C
ugcuggggcucaugcgguaccaguuuagc

SEQ ID NO: 5654 - RNA, 24 nt, Artificial Sequence
  Synthetic Oligonucleotide; PD-1 exon 2; Set C
cuggggcucaugcgguaccaguuu

SEQ ID NO: 5655 - RNA, 28 nt, Artificial Sequence
  Synthetic Oligonucleotide; PD-1 exon 2; Set C
ugcuggggcucaugcgguaccaguuuag

SEQ ID NO: 5656 - RNA, 23 nt, Artificial Sequence
  Synthetic Oligonucleotide; PD-1 exon 2; Set C
cuggggcucaugcgguaccaguu

SEQ ID NO: 5657 - RNA, 22 nt, Artificial Sequence
  Synthetic Oligonucleotide; PD-1 exon 2; Set C
cuggggcucaugcgguaccagu

SEQ ID NO: 5658 - RNA, 40 nt, Artificial Sequence
  Synthetic Oligonucleotide; PD-1 exon 2; Set C
ccgucugguugcuggggcucaugcgguaccaguuuagcac

SEQ ID NO: 5659 - RNA, 39 nt, Artificial Sequence
  Synthetic Oligonucleotide; PD-1 exon 2; Set C
ccgucugguugcuggggcucaugcgguaccaguuuagca

SEQ ID NO: 5660 - RNA, 15 nt, Artificial Sequence
  Synthetic Oligonucleotide; PD-1 exon 2; Set A
uggggcucaugcggu

SEQ ID NO: 5661 - RNA, 40 nt, Artificial Sequence
  Synthetic Oligonucleotide; PD-1 exon 2; Set C
uccgucugguugcuggggcucaugcgguaccaguuuagca

SEQ ID NO: 5662 - RNA, 38 nt, Artificial Sequence
  Synthetic Oligonucleotide; PD-1 exon 2; Set C
ccgucugguugcuggggcucaugcgguaccaguuuagc

SEQ ID NO: 5663 - RNA, 37 nt, Artificial Sequence
  Synthetic Oligonucleotide; PD-1 exon 2; Set C
ccgucugguugcuggggcucaugcgguaccaguuuag

SEQ ID NO: 5664 - RNA, 39 nt, Artificial Sequence
  Synthetic Oligonucleotide; PD-1 exon 2; Set C
uccgucugguugcuggggcucaugcgguaccaguuuagc

SEQ ID NO: 5665 - RNA, 17 nt, Artificial Sequence
  Synthetic Oligonucleotide; PD-1 exon 2; Set A
gcuggggcucaugcggu

SEQ ID NO: 5666 - RNA, 36 nt, Artificial Sequence
  Synthetic Oligonucleotide; PD-1 exon 2; Set C
ccgucugguugcuggggcucaugcgguaccaguuua

SEQ ID NO: 5667 - RNA, 38 nt, Artificial Sequence
  Synthetic Oligonucleotide; PD-1 exon 2; Set C
uccgucugguugcuggggcucaugcgguaccaguuuag

SEQ ID NO: 5668 - RNA, 40 nt, Artificial Sequence
  Synthetic Oligonucleotide; PD-1 exon 2; Set C
guccgucugguugcuggggcucaugcgguaccaguuuagc

SEQ ID NO: 5669 - RNA, 18 nt, Artificial Sequence
  Synthetic Oligonucleotide; PD-1 exon 2; Set A
ugcuggggcucaugcggu

SEQ ID NO: 5670 - RNA, 20 nt, Artificial Sequence
  Synthetic Oligonucleotide; PD-1 exon 2; Set C
uugcuggggcucaugcggua

SEQ ID NO: 5671 - RNA, 35 nt, Artificial Sequence
  Synthetic Oligonucleotide; PD-1 exon 2; Set C
ccgucugguugcuggggcucaugcgguaccaguuu

SEQ ID NO: 5672 - RNA, 37 nt, Artificial Sequence
  Synthetic Oligonucleotide; PD-1 exon 2; Set C
uccgucugguugcuggggcucaugcgguaccaguuua

SEQ ID NO: 5673 - RNA, 39 nt, Artificial Sequence
  Synthetic Oligonucleotide; PD-1 exon 2; Set C
guccgucugguugcuggggcucaugcgguaccaguuuag

SEQ ID NO: 5674 - RNA, 36 nt, Artificial Sequence
  Synthetic Oligonucleotide; PD-1 exon 2; Set C
uccgucugguugcuggggcucaugcgguaccaguuu

SEQ ID NO: 5675 - RNA, 34 nt, Artificial Sequence
  Synthetic Oligonucleotide; PD-1 exon 2; Set C
ccgucugguugcuggggcucaugcgguaccaguu

SEQ ID NO: 5676 - RNA, 38 nt, Artificial Sequence
  Synthetic Oligonucleotide; PD-1 exon 2; Set C
guccgucugguugcuggggcucaugcgguaccaguuua

SEQ ID NO: 5677 - RNA, 22 nt, Artificial Sequence
  Synthetic Oligonucleotide; PD-1 exon 2; Set C
gguugcuggggcucaugcggua

SEQ ID NO: 5678 - RNA, 37 nt, Artificial Sequence
  Synthetic Oligonucleotide; PD-1 exon 2; Set C
guccgucugguugcuggggcucaugcgguaccaguuu

SEQ ID NO: 5679 - RNA, 35 nt, Artificial Sequence
  Synthetic Oligonucleotide; PD-1 exon 2; Set C
uccgucugguugcuggggcucaugcgguaccaguu

SEQ ID NO: 5680 - RNA, 33 nt, Artificial Sequence
  Synthetic Oligonucleotide; PD-1 exon 2; Set C
ccgucugguugcuggggcucaugcgguaccagu

SEQ ID NO: 5681 - RNA, 23 nt, Artificial Sequence
  Synthetic Oligonucleotide; PD-1 exon 2; Set C
ugguugcuggggcucaugcggua

SEQ ID NO: 5682 - RNA, 36 nt, Artificial Sequence
  Synthetic Oligonucleotide; PD-1 exon 2; Set C
guccgucugguugcuggggcucaugcgguaccaguu

SEQ ID NO: 5683 - RNA, 34 nt, Artificial Sequence
  Synthetic Oligonucleotide; PD-1 exon 2; Set C
uccgucugguugcuggggcucaugcgguaccagu

SEQ ID NO: 5684 - RNA, 24 nt, Artificial Sequence
  Synthetic Oligonucleotide; PD-1 exon 2; Set C
cugguugcuggggcucaugcggua

SEQ ID NO: 5685 - RNA, 35 nt, Artificial Sequence
  Synthetic Oligonucleotide; PD-1 exon 2; Set C
guccgucugguugcuggggcucaugcgguaccagu

SEQ ID NO: 5686 - RNA, 27 nt, Artificial Sequence
  Synthetic Oligonucleotide; PD-1 exon 2; Set C
cgucugguugcuggggcucaugcggua

SEQ ID NO: 5687 - RNA, 16 nt, Artificial Sequence
  Synthetic Oligonucleotide; PD-1 exon 2; Set A
gguugcuggggcucau

SEQ ID NO: 5688 - RNA, 15 nt, Artificial Sequence
  Synthetic Oligonucleotide; PD-1 exon 2; Set A
gguugcuggggcuca

SEQ ID NO: 5689 - RNA, 17 nt, Artificial Sequence
  Synthetic Oligonucleotide; PD-1 exon 2; Set A
ugguugcuggggcucau

SEQ ID NO: 5690 - RNA, 16 nt, Artificial Sequence
  Synthetic Oligonucleotide; PD-1 exon 2; Set A
ugguugcuggggcuca

SEQ ID NO: 5691 - RNA, 18 nt, Artificial Sequence
  Synthetic Oligonucleotide; PD-1 exon 2; Set A
cugguugcuggggcucau

SEQ ID NO: 5692 - RNA, 29 nt, Artificial Sequence
  Synthetic Oligonucleotide; PD-1 exon 2; Set C
guccgucugguugcuggggcucaugcggu

SEQ ID NO: 5693 - RNA, 17 nt, Artificial Sequence
  Synthetic Oligonucleotide; PD-1 exon 2; Set A
cugguugcuggggcuca

SEQ ID NO: 5694 - RNA, 15 nt, Artificial Sequence
  Synthetic Oligonucleotide; PD-1 exon 2; Set C
ugguugcuggggcuc

SEQ ID NO: 5695 - RNA, 16 nt, Artificial Sequence
  Synthetic Oligonucleotide; PD-1 exon 2; Set A
cugguugcuggggcuc

SEQ ID NO: 5696 - RNA, 21 nt, Artificial Sequence
  Synthetic Oligonucleotide; PD-1 exon 2; Set C
cgucugguugcuggggcucau

SEQ ID NO: 5697 - RNA, 20 nt, Artificial Sequence
  Synthetic Oligonucleotide; PD-1 exon 2; Set C
cgucugguugcuggggcuca

SEQ ID NO: 5698 - RNA, 19 nt, Artificial Sequence
  Synthetic Oligonucleotide; PD-1 exon 2; Set A
cgucugguugcuggggcuc

SEQ ID NO: 5699 - RNA, 19 nt, Artificial Sequence
  Synthetic Oligonucleotide; PD-1 exon 2; Set C
ccgucugguugcuggggcu

SEQ ID NO: 5700 - RNA, 18 nt, Artificial Sequence
  Synthetic Oligonucleotide; PD-1 exon 2; Set A
ccgucugguugcuggggc

SEQ ID NO: 5701 - RNA, 20 nt, Artificial Sequence
  Synthetic Oligonucleotide; PD-1 exon 2; Set C
uccgucugguugcuggggcu

SEQ ID NO: 5702 - RNA, 17 nt, Artificial Sequence
  Synthetic Oligonucleotide; PD-1 exon 2; Set A
ccgucugguugcugggg

SEQ ID NO: 5703 - RNA, 19 nt, Artificial Sequence
  Synthetic Oligonucleotide; PD-1 exon 2; Set A
uccgucugguugcuggggc

SEQ ID NO: 5704 - RNA, 21 nt, Artificial Sequence
  Synthetic Oligonucleotide; PD-1 exon 2; Set C
guccgucugguugcuggggcu

SEQ ID NO: 5705 - RNA, 18 nt, Artificial Sequence
  Synthetic Oligonucleotide; PD-1 exon 2; Set A
uccgucugguugcugggg

SEQ ID NO: 5706 - RNA, 20 nt, Artificial Sequence
  Synthetic Oligonucleotide; PD-1 exon 2; Set C
guccgucugguugcuggggc

SEQ ID NO: 5707 - RNA, 19 nt, Artificial Sequence
  Synthetic Oligonucleotide; PD-1 exon 2; Set A
guccgucugguugcugggg

SEQ ID NO: 5708 - RNA, 17 nt, Artificial Sequence
  Synthetic Oligonucleotide; PD-1 exon 2; Set A
guccgucugguugcugg

SEQ ID NO: 5709 - RNA, 35 nt, Artificial Sequence
  Synthetic Oligonucleotide; PD-1 exon 2; Set C
aaggcggccagcuuguccgucugguugcuggggcu

SEQ ID NO: 5710 - RNA, 34 nt, Artificial Sequence
  Synthetic Oligonucleotide; PD-1 exon 2; Set C
aaggcggccagcuuguccgucugguugcuggggc

SEQ ID NO: 5711 - RNA, 36 nt, Artificial Sequence
  Synthetic Oligonucleotide; PD-1 exon 2; Set C
gaaggcggccagcuuguccgucugguugcuggggcu

SEQ ID NO: 5712 - RNA, 33 nt, Artificial Sequence
  Synthetic Oligonucleotide; PD-1 exon 2; Set C
aaggcggccagcuuguccgucugguugcugggg

SEQ ID NO: 5713 - RNA, 35 nt, Artificial Sequence
  Synthetic Oligonucleotide; PD-1 exon 2; Set C
gaaggcggccagcuuguccgucugguugcuggggc

SEQ ID NO: 5714 - RNA, 37 nt, Artificial Sequence
  Synthetic Oligonucleotide; PD-1 exon 2; Set C
ggaaggcggccagcuuguccgucugguugcuggggcu

SEQ ID NO: 5715 - RNA, 34 nt, Artificial Sequence
  Synthetic Oligonucleotide; PD-1 exon 2; Set C
gaaggcggccagcuuguccgucugguugcugggg

SEQ ID NO: 5716 - RNA, 36 nt, Artificial Sequence
  Synthetic Oligonucleotide; PD-1 exon 2; Set C
ggaaggcggccagcuuguccgucugguugcuggggc

SEQ ID NO: 5717 - RNA, 38 nt, Artificial Sequence
  Synthetic Oligonucleotide; PD-1 exon 2; Set C
gggaaggcggccagcuuguccgucugguugcuggggcu

SEQ ID NO: 5718 - RNA, 32 nt, Artificial Sequence
  Synthetic Oligonucleotide; PD-1 exon 2; Set C
aaggcggccagcuuguccgucugguugcuggg

SEQ ID NO: 5719 - RNA, 35 nt, Artificial Sequence
  Synthetic Oligonucleotide; PD-1 exon 2; Set C
ggaaggcggccagcuuguccgucugguugcugggg

SEQ ID NO: 5720 - RNA, 37 nt, Artificial Sequence
  Synthetic Oligonucleotide; PD-1 exon 2; Set C
gggaaggcggccagcuuguccgucugguugcuggggc

SEQ ID NO: 5721 - RNA, 39 nt, Artificial Sequence
  Synthetic Oligonucleotide; PD-1 exon 2; Set C
ggggaaggcggccagcuuguccgucugguugcuggggcu

SEQ ID NO: 5722 - RNA, 31 nt, Artificial Sequence
  Synthetic Oligonucleotide; PD-1 exon 2; Set C
aaggcggccagcuuguccgucugguugcugg

SEQ ID NO: 5723 - RNA, 33 nt, Artificial Sequence
  Synthetic Oligonucleotide; PD-1 exon 2; Set C
gaaggcggccagcuuguccgucugguugcuggg

SEQ ID NO: 5724 - RNA, 36 nt, Artificial Sequence
  Synthetic Oligonucleotide; PD-1 exon 2; Set C
gggaaggcggccagcuuguccgucugguugcugggg

SEQ ID NO: 5725 - RNA, 38 nt, Artificial Sequence
  Synthetic Oligonucleotide; PD-1 exon 2; Set C
ggggaaggcggccagcuuguccgucugguugcuggggc

SEQ ID NO: 5726 - RNA, 32 nt, Artificial Sequence
  Synthetic Oligonucleotide; PD-1 exon 2; Set C
gaaggcggccagcuuguccgucugguugcugg

SEQ ID NO: 5727 - RNA, 34 nt, Artificial Sequence
  Synthetic Oligonucleotide; PD-1 exon 2; Set C
ggaaggcggccagcuuguccgucugguugcuggg

SEQ ID NO: 5728 - RNA, 37 nt, Artificial Sequence
  Synthetic Oligonucleotide; PD-1 exon 2; Set C
ggggaaggcggccagcuuguccgucugguugcugggg

SEQ ID NO: 5729 - RNA, 33 nt, Artificial Sequence
  Synthetic Oligonucleotide; PD-1 exon 2; Set C
ggaaggcggccagcuuguccgucugguugcugg

SEQ ID NO: 5730 - RNA, 35 nt, Artificial Sequence
  Synthetic Oligonucleotide; PD-1 exon 2; Set C
gggaaggcggccagcuuguccgucugguugcuggg

SEQ ID NO: 5731 - RNA, 34 nt, Artificial Sequence
  Synthetic Oligonucleotide; PD-1 exon 2; Set C
gggaaggcggccagcuuguccgucugguugcugg

SEQ ID NO: 5732 - RNA, 36 nt, Artificial Sequence
  Synthetic Oligonucleotide; PD-1 exon 2; Set C
ggggaaggcggccagcuuguccgucugguugcuggg

SEQ ID NO: 5733 - RNA, 35 nt, Artificial Sequence
  Synthetic Oligonucleotide; PD-1 exon 2; Set C
ggggaaggcggccagcuuguccgucugguugcugg

SEQ ID NO: 5734 - RNA, 27 nt, Artificial Sequence
  Synthetic Oligonucleotide; PD-1 exon 2; Set C
aaggcggccagcuuguccgucugguug

SEQ ID NO: 5735 - RNA, 28 nt, Artificial Sequence
  Synthetic Oligonucleotide; PD-1 exon 2; Set C
gaaggcggccagcuuguccgucugguug

SEQ ID NO: 5736 - RNA, 25 nt, Artificial Sequence
  Synthetic Oligonucleotide; PD-1 exon 2; Set C
aaggcggccagcuuguccgucuggu

SEQ ID NO: 5737 - RNA, 29 nt, Artificial Sequence
  Synthetic Oligonucleotide; PD-1 exon 2; Set C
ggaaggcggccagcuuguccgucugguug

SEQ ID NO: 5738 - RNA, 35 nt, Artificial Sequence
  Synthetic Oligonucleotide; PD-1 exon 2; Set C
cggggaaggcggccagcuuguccgucugguugcug

SEQ ID NO: 5739 - RNA, 24 nt, Artificial Sequence
  Synthetic Oligonucleotide; PD-1 exon 2; Set C
aaggcggccagcuuguccgucugg

SEQ ID NO: 5740 - RNA, 26 nt, Artificial Sequence
  Synthetic Oligonucleotide; PD-1 exon 2; Set C
gaaggcggccagcuuguccgucuggu

SEQ ID NO: 5741 - RNA, 30 nt, Artificial Sequence
  Synthetic Oligonucleotide; PD-1 exon 2; Set C
gggaaggcggccagcuuguccgucugguug

SEQ ID NO: 5742 - RNA, 34 nt, Artificial Sequence
  Synthetic Oligonucleotide; PD-1 exon 2; Set C
cggggaaggcggccagcuuguccgucugguugcu

SEQ ID NO: 5743 - RNA, 36 nt, Artificial Sequence
  Synthetic Oligonucleotide; PD-1 exon 2; Set C
ucggggaaggcggccagcuuguccgucugguugcug

SEQ ID NO: 5744 - RNA, 25 nt, Artificial Sequence
  Synthetic Oligonucleotide; PD-1 exon 2; Set C
gaaggcggccagcuuguccgucugg

SEQ ID NO: 5745 - RNA, 27 nt, Artificial Sequence
  Synthetic Oligonucleotide; PD-1 exon 2; Set C
ggaaggcggccagcuuguccgucuggu

SEQ ID NO: 5746 - RNA, 31 nt, Artificial Sequence
  Synthetic Oligonucleotide; PD-1 exon 2; Set C
ggggaaggcggccagcuuguccgucugguug

SEQ ID NO: 5747 - RNA, 33 nt, Artificial Sequence
  Synthetic Oligonucleotide; PD-1 exon 2; Set C
cggggaaggcggccagcuuguccgucugguugc

SEQ ID NO: 5748 - RNA, 35 nt, Artificial Sequence
  Synthetic Oligonucleotide; PD-1 exon 2; Set C
ucggggaaggcggccagcuuguccgucugguugcu

SEQ ID NO: 5749 - RNA, 26 nt, Artificial Sequence
  Synthetic Oligonucleotide; PD-1 exon 2; Set C
ggaaggcggccagcuuguccgucugg

SEQ ID NO: 5750 - RNA, 28 nt, Artificial Sequence
  Synthetic Oligonucleotide; PD-1 exon 2; Set C
gggaaggcggccagcuuguccgucuggu

SEQ ID NO: 5751 - RNA, 34 nt, Artificial Sequence
  Synthetic Oligonucleotide; PD-1 exon 2; Set C
ucggggaaggcggccagcuuguccgucugguugc

SEQ ID NO: 5752 - RNA, 23 nt, Artificial Sequence
  Synthetic Oligonucleotide; PD-1 exon 2; Set C
gaaggcggccagcuuguccgucu

SEQ ID NO: 5753 - RNA, 21 nt, Artificial Sequence
  Synthetic Oligonucleotide; PD-1 exon 2; Set C
aaggcggccagcuuguccguc

SEQ ID NO: 5754 - RNA, 29 nt, Artificial Sequence
  Synthetic Oligonucleotide; PD-1 exon 2; Set C
ggggaaggcggccagcuuguccgucuggu

SEQ ID NO: 5755 - RNA, 27 nt, Artificial Sequence
  Synthetic Oligonucleotide; PD-1 exon 2; Set C
gggaaggcggccagcuuguccgucugg

SEQ ID NO: 5756 - RNA, 24 nt, Artificial Sequence
  Synthetic Oligonucleotide; PD-1 exon 2; Set C
ggaaggcggccagcuuguccgucu

SEQ ID NO: 5757 - RNA, 22 nt, Artificial Sequence
  Synthetic Oligonucleotide; PD-1 exon 2; Set C
gaaggcggccagcuuguccguc

SEQ ID NO: 5758 - RNA, 28 nt, Artificial Sequence
  Synthetic Oligonucleotide; PD-1 exon 2; Set C
ggggaaggcggccagcuuguccgucugg

SEQ ID NO: 5759 - RNA, 23 nt, Artificial Sequence
  Synthetic Oligonucleotide; PD-1 exon 2; Set C
ggaaggcggccagcuuguccguc

SEQ ID NO: 5760 - RNA, 27 nt, Artificial Sequence
  Synthetic Oligonucleotide; PD-1 exon 2; Set C
ggggaaggcggccagcuuguccgucug

SEQ ID NO: 5761 - RNA, 24 nt, Artificial Sequence
  Synthetic Oligonucleotide; PD-1 exon 2; Set C
gggaaggcggccagcuuguccguc

SEQ ID NO: 5762 - RNA, 16 nt, Artificial Sequence
  Synthetic Oligonucleotide; PD-1 exon 2; Set A
aaggcggccagcuugu

SEQ ID NO: 5763 - RNA, 24 nt, Artificial Sequence
  Synthetic Oligonucleotide; PD-1 exon 2; Set C
ggggaaggcggccagcuuguccgu

SEQ ID NO: 5764 - RNA, 38 nt, Artificial Sequence
  Synthetic Oligonucleotide; PD-1 exon 2; Set C
gguccucggggaaggcggccagcuuguccgucugguug

SEQ ID NO: 5765 - RNA, 15 nt, Artificial Sequence
  Synthetic Oligonucleotide; PD-1 exon 2; Set C
aaggcggccagcuug

SEQ ID NO: 5766 - RNA, 17 nt, Artificial Sequence
  Synthetic Oligonucleotide; PD-1 exon 2; Set A
gaaggcggccagcuugu

SEQ ID NO: 5767 - RNA, 16 nt, Artificial Sequence
  Synthetic Oligonucleotide; PD-1 exon 2; Set C
gaaggcggccagcuug

SEQ ID NO: 5768 - RNA, 18 nt, Artificial Sequence
  Synthetic Oligonucleotide; PD-1 exon 2; Set A
ggaaggcggccagcuugu

SEQ ID NO: 5769 - RNA, 36 nt, Artificial Sequence
  Synthetic Oligonucleotide; PD-1 exon 2; Set C
gguccucggggaaggcggccagcuuguccgucuggu

SEQ ID NO: 5770 - RNA, 17 nt, Artificial Sequence
  Synthetic Oligonucleotide; PD-1 exon 2; Set A
ggaaggcggccagcuug

SEQ ID NO: 5771 - RNA, 19 nt, Artificial Sequence
  Synthetic Oligonucleotide; PD-1 exon 2; Set C
gggaaggcggccagcuugu

SEQ ID NO: 5772 - RNA, 35 nt, Artificial Sequence
  Synthetic Oligonucleotide; PD-1 exon 2; Set C
gguccucggggaaggcggccagcuuguccgucugg

SEQ ID NO: 5773 - RNA, 18 nt, Artificial Sequence
  Synthetic Oligonucleotide; PD-1 exon 2; Set A
gggaaggcggccagcuug

SEQ ID NO: 5774 - RNA, 34 nt, Artificial Sequence
  Synthetic Oligonucleotide; PD-1 exon 2; Set C
gguccucggggaaggcggccagcuuguccgucug

SEQ ID NO: 5775 - RNA, 31 nt, Artificial Sequence
  Synthetic Oligonucleotide; PD-1 exon 2; Set C
gguccucggggaaggcggccagcuuguccgu

SEQ ID NO: 5776 - RNA, 30 nt, Artificial Sequence
  Synthetic Oligonucleotide; PD-1 exon 2; Set C
aguccuggccgggcuggcugcgguccucgg

SEQ ID NO: 5777 - RNA, 29 nt, Artificial Sequence
  Synthetic Oligonucleotide; PD-1 exon 2; Set C
aguccuggccgggcuggcugcgguccucg

SEQ ID NO: 5778 - RNA, 31 nt, Artificial Sequence
  Synthetic Oligonucleotide; PD-1 exon 2; Set C
caguccuggccgggcuggcugcgguccucgg

SEQ ID NO: 5779 - RNA, 30 nt, Artificial Sequence
  Synthetic Oligonucleotide; PD-1 exon 2; Set C
caguccuggccgggcuggcugcgguccucg

SEQ ID NO: 5780 - RNA, 39 nt, Artificial Sequence
  Synthetic Oligonucleotide; PD-1 exon 2; Set C
ggaagcggcaguccuggccgggcuggcugcgguccucgg

SEQ ID NO: 5781 - RNA, 40 nt, Artificial Sequence
  Synthetic Oligonucleotide; PD-1 exon 2; Set C
cggaagcggcaguccuggccgggcuggcugcgguccucgg

SEQ ID NO: 5782 - RNA, 38 nt, Artificial Sequence
  Synthetic Oligonucleotide; PD-1 exon 2; Set C
ggaagcggcaguccuggccgggcuggcugcgguccucg

SEQ ID NO: 5783 - RNA, 39 nt, Artificial Sequence
  Synthetic Oligonucleotide; PD-1 exon 2; Set C
cggaagcggcaguccuggccgggcuggcugcgguccucg

SEQ ID NO: 5784 - RNA, 22 nt, Artificial Sequence
  Synthetic Oligonucleotide; PD-1 exon 2; Set C
ugugugacacggaagcggcagu

SEQ ID NO: 5785 - RNA, 23 nt, Artificial Sequence
  Synthetic Oligonucleotide; PD-1 exon 2; Set C
uugugugacacggaagcggcagu

SEQ ID NO: 5786 - RNA, 21 nt, Artificial Sequence
  Synthetic Oligonucleotide; PD-1 exon 2; Set A
ugugugacacggaagcggcag

SEQ ID NO: 5787 - RNA, 22 nt, Artificial Sequence
  Synthetic Oligonucleotide; PD-1 exon 2; Set A
uugugugacacggaagcggcag

SEQ ID NO: 5788 - RNA, 23 nt, Artificial Sequence
  Synthetic Oligonucleotide; PD-1 exon 2; Set C
guugugugacacggaagcggcag

SEQ ID NO: 5789 - RNA, 24 nt, Artificial Sequence
  Synthetic Oligonucleotide; PD-1 exon 2; Set A
aguugugugacacggaagcggcag

SEQ ID NO: 5790 - RNA, 15 nt, Artificial Sequence
  Synthetic Oligonucleotide; PD-1 exon 2; Set C
uugugugacacggaa

SEQ ID NO: 5791 - RNA, 32 nt, Artificial Sequence
  Synthetic Oligonucleotide; PD-1 exon 2; Set C
guugggcaguugugugacacggaagcggcagu

SEQ ID NO: 5792 - RNA, 16 nt, Artificial Sequence
  Synthetic Oligonucleotide; PD-1 exon 2; Set C
guugugugacacggaa

SEQ ID NO: 5793 - RNA, 31 nt, Artificial Sequence
  Synthetic Oligonucleotide; PD-1 exon 2; Set C
guugggcaguugugugacacggaagcggcag

SEQ ID NO: 5794 - RNA, 15 nt, Artificial Sequence
  Synthetic Oligonucleotide; PD-1 exon 2; Set C
guugugugacacgga

SEQ ID NO: 5795 - RNA, 17 nt, Artificial Sequence
  Synthetic Oligonucleotide; PD-1 exon 2; Set C
aguugugugacacggaa

SEQ ID NO: 5796 - RNA, 16 nt, Artificial Sequence
  Synthetic Oligonucleotide; PD-1 exon 2; Set C
aguugugugacacgga

SEQ ID NO: 5797 - RNA, 15 nt, Artificial Sequence
  Synthetic Oligonucleotide; PD-1 exon 2; Set C
aguugugugacacgg

SEQ ID NO: 5798 - RNA, 23 nt, Artificial Sequence
  Synthetic Oligonucleotide; PD-1 exon 2; Set C
gaagucacgcccguugggcaguu

SEQ ID NO: 5799 - RNA, 22 nt, Artificial Sequence
  Synthetic Oligonucleotide; PD-1 exon 2; Set C
gaagucacgcccguugggcagu

SEQ ID NO: 5800 - RNA, 24 nt, Artificial Sequence
  Synthetic Oligonucleotide; PD-1 exon 2; Set C
ggaagucacgcccguugggcaguu

SEQ ID NO: 5801 - RNA, 23 nt, Artificial Sequence
  Synthetic Oligonucleotide; PD-1 exon 2; Set C
ggaagucacgcccguugggcagu

SEQ ID NO: 5802 - RNA, 30 nt, Artificial Sequence
  Synthetic Oligonucleotide; PD-1 exon 2; Set C
cauguggaagucacgcccguugggcaguug

SEQ ID NO: 5803 - RNA, 29 nt, Artificial Sequence
  Synthetic Oligonucleotide; PD-1 exon 2; Set C
cauguggaagucacgcccguugggcaguu

SEQ ID NO: 5804 - RNA, 33 nt, Artificial Sequence
  Synthetic Oligonucleotide; PD-1 exon 2; Set C
cucauguggaagucacgcccguugggcaguugu

SEQ ID NO: 5805 - RNA, 28 nt, Artificial Sequence
  Synthetic Oligonucleotide; PD-1 exon 2; Set C
cauguggaagucacgcccguugggcagu

SEQ ID NO: 5806 - RNA, 30 nt, Artificial Sequence
  Synthetic Oligonucleotide; PD-1 exon 2; Set C
ucauguggaagucacgcccguugggcaguu

SEQ ID NO: 5807 - RNA, 34 nt, Artificial Sequence
  Synthetic Oligonucleotide; PD-1 exon 2; Set C
gcucauguggaagucacgcccguugggcaguugu

SEQ ID NO: 5808 - RNA, 32 nt, Artificial Sequence
  Synthetic Oligonucleotide; PD-1 exon 2; Set C
cucauguggaagucacgcccguugggcaguug

SEQ ID NO: 5809 - RNA, 29 nt, Artificial Sequence
  Synthetic Oligonucleotide; PD-1 exon 2; Set C
ucauguggaagucacgcccguugggcagu

SEQ ID NO: 5810 - RNA, 31 nt, Artificial Sequence
  Synthetic Oligonucleotide; PD-1 exon 2; Set C
cucauguggaagucacgcccguugggcaguu

SEQ ID NO: 5811 - RNA, 33 nt, Artificial Sequence
  Synthetic Oligonucleotide; PD-1 exon 2; Set C
gcucauguggaagucacgcccguugggcaguug

SEQ ID NO: 5812 - RNA, 32 nt, Artificial Sequence
  Synthetic Oligonucleotide; PD-1 exon 2; Set C
gcucauguggaagucacgcccguugggcaguu

SEQ ID NO: 5813 - RNA, 30 nt, Artificial Sequence
  Synthetic Oligonucleotide; PD-1 exon 2; Set C
cucauguggaagucacgcccguugggcagu

SEQ ID NO: 5814 - RNA, 31 nt, Artificial Sequence
  Synthetic Oligonucleotide; PD-1 exon 2; Set C
gcucauguggaagucacgcccguugggcagu

SEQ ID NO: 5815 - RNA, 33 nt, Artificial Sequence
  Synthetic Oligonucleotide; PD-1 exon 2; Set C
ccugaccacgcucauguggaagucacgcccguu

SEQ ID NO: 5816 - RNA, 19 nt, Artificial Sequence
  Synthetic Oligonucleotide; PD-1 exon 2; Set A
ugaccacgcucauguggaa

SEQ ID NO: 5817 - RNA, 20 nt, Artificial Sequence
  Synthetic Oligonucleotide; PD-1 exon 2; Set A
cugaccacgcucauguggaa

SEQ ID NO: 5818 - RNA, 21 nt, Artificial Sequence
  Synthetic Oligonucleotide; PD-1 exon 2; Set A
ccugaccacgcucauguggaa

SEQ ID NO: 5819 - RNA, 19 nt, Artificial Sequence
  Synthetic Oligonucleotide; PD-1 exon 2; Set A
cugaccacgcucaugugga

SEQ ID NO: 5820 - RNA, 20 nt, Artificial Sequence
  Synthetic Oligonucleotide; PD-1 exon 2; Set A
ccugaccacgcucaugugga

SEQ ID NO: 5821 - RNA, 15 nt, Artificial Sequence
  Synthetic Oligonucleotide; PD-1 exon 2; Set C
ccugaccacgcucau

SEQ ID NO: 5822 - RNA, 29 nt, Artificial Sequence
  Synthetic Oligonucleotide; PD-1 exon 2; Set C
cgccgggcccugaccacgcucauguggaa

SEQ ID NO: 5823 - RNA, 31 nt, Artificial Sequence
  Synthetic Oligonucleotide; PD-1 exon 2; Set C
gcgccgggcccugaccacgcucauguggaag

SEQ ID NO: 5824 - RNA, 28 nt, Artificial Sequence
  Synthetic Oligonucleotide; PD-1 exon 2; Set C
cgccgggcccugaccacgcucaugugga

SEQ ID NO: 5825 - RNA, 30 nt, Artificial Sequence
  Synthetic Oligonucleotide; PD-1 exon 2; Set C
uugcgccgggcccugaccacgcucaugugg

SEQ ID NO: 5826 - RNA, 31 nt, Artificial Sequence
  Synthetic Oligonucleotide; PD-1 exon 2; Set C
auugcgccgggcccugaccacgcucaugugg

SEQ ID NO: 5827 - RNA, 24 nt, Artificial Sequence
  Synthetic Oligonucleotide; PD-1 exon 2; Set C
gcgccgggcccugaccacgcucau

SEQ ID NO: 5828 - RNA, 32 nt, Artificial Sequence
  Synthetic Oligonucleotide; PD-1 exon 2; Set C
cauugcgccgggcccugaccacgcucaugugg

SEQ ID NO: 5829 - RNA, 23 nt, Artificial Sequence
  Synthetic Oligonucleotide; PD-1 exon 2; Set C
gcgccgggcccugaccacgcuca

SEQ ID NO: 5830 - RNA, 22 nt, Artificial Sequence
  Synthetic Oligonucleotide; PD-1 exon 2; Set C
gcgccgggcccugaccacgcuc

SEQ ID NO: 5831 - RNA, 21 nt, Artificial Sequence
  Synthetic Oligonucleotide; PD-1 exon 2; Set C
gcgccgggcccugaccacgcu

SEQ ID NO: 5832 - RNA, 40 nt, Artificial Sequence
  Synthetic Oligonucleotide; PD-1 exon 2; Set C
ccgcugucauugcgccgggcccugaccacgcucaugugga

SEQ ID NO: 5833 - RNA, 34 nt, Artificial Sequence
  Synthetic Oligonucleotide; PD-1 exon 2; Set C
cgcugucauugcgccgggcccugaccacgcucau

SEQ ID NO: 5834 - RNA, 35 nt, Artificial Sequence
  Synthetic Oligonucleotide; PD-1 exon 2; Set C
ccgcugucauugcgccgggcccugaccacgcucau

SEQ ID NO: 5835 - RNA, 33 nt, Artificial Sequence
  Synthetic Oligonucleotide; PD-1 exon 2; Set C
cgcugucauugcgccgggcccugaccacgcuca

SEQ ID NO: 5836 - RNA, 36 nt, Artificial Sequence
  Synthetic Oligonucleotide; PD-1 exon 2; Set C
gccgcugucauugcgccgggcccugaccacgcucau

SEQ ID NO: 5837 - RNA, 34 nt, Artificial Sequence
  Synthetic Oligonucleotide; PD-1 exon 2; Set C
ccgcugucauugcgccgggcccugaccacgcuca

SEQ ID NO: 5838 - RNA, 32 nt, Artificial Sequence
  Synthetic Oligonucleotide; PD-1 exon 2; Set C
cgcugucauugcgccgggcccugaccacgcuc

SEQ ID NO: 5839 - RNA, 37 nt, Artificial Sequence
  Synthetic Oligonucleotide; PD-1 exon 2; Set C
ugccgcugucauugcgccgggcccugaccacgcucau

SEQ ID NO: 5840 - RNA, 31 nt, Artificial Sequence
  Synthetic Oligonucleotide; PD-1 exon 2; Set C
cgcugucauugcgccgggcccugaccacgcu

SEQ ID NO: 5841 - RNA, 15 nt, Artificial Sequence
  Synthetic Oligonucleotide; PD-1 exon 2; Set B
uugcgccgggcccug

SEQ ID NO: 5842 - RNA, 17 nt, Artificial Sequence
  Synthetic Oligonucleotide; PD-1 exon 2; Set C
auugcgccgggcccuga

SEQ ID NO: 5843 - RNA, 36 nt, Artificial Sequence
  Synthetic Oligonucleotide; PD-1 exon 2; Set C
ugccgcugucauugcgccgggcccugaccacgcuca

SEQ ID NO: 5844 - RNA, 16 nt, Artificial Sequence
  Synthetic Oligonucleotide; PD-1 exon 2; Set B
auugcgccgggcccug

SEQ ID NO: 5845 - RNA, 18 nt, Artificial Sequence
  Synthetic Oligonucleotide; PD-1 exon 2; Set C
cauugcgccgggcccuga

SEQ ID NO: 5846 - RNA, 17 nt, Artificial Sequence
  Synthetic Oligonucleotide; PD-1 exon 2; Set B
cauugcgccgggcccug

SEQ ID NO: 5847 - RNA, 18 nt, Artificial Sequence
  Synthetic Oligonucleotide; PD-1 exon 2; Set C
ucauugcgccgggcccug

SEQ ID NO: 5848 - RNA, 17 nt, Artificial Sequence
  Synthetic Oligonucleotide; PD-1 exon 2; Set C
ucauugcgccgggcccu

SEQ ID NO: 5849 - RNA, 19 nt, Artificial Sequence
  Synthetic Oligonucleotide; PD-1 exon 2; Set C
gucauugcgccgggcccug

SEQ ID NO: 5850 - RNA, 18 nt, Artificial Sequence
  Synthetic Oligonucleotide; PD-1 exon 2; Set C
gucauugcgccgggcccu

SEQ ID NO: 5851 - RNA, 20 nt, Artificial Sequence
  Synthetic Oligonucleotide; PD-1 exon 2; Set C
ugucauugcgccgggcccug

SEQ ID NO: 5852 - RNA, 19 nt, Artificial Sequence
  Synthetic Oligonucleotide; PD-1 exon 2; Set C
ugucauugcgccgggcccu

SEQ ID NO: 5853 - RNA, 21 nt, Artificial Sequence
  Synthetic Oligonucleotide; PD-1 exon 2; Set C
cugucauugcgccgggcccug

SEQ ID NO: 5854 - RNA, 20 nt, Artificial Sequence
  Synthetic Oligonucleotide; PD-1 exon 2; Set C
cugucauugcgccgggcccu

SEQ ID NO: 5855 - RNA, 22 nt, Artificial Sequence
  Synthetic Oligonucleotide; PD-1 exon 2; Set C
gcugucauugcgccgggcccug

SEQ ID NO: 5856 - RNA, 21 nt, Artificial Sequence
  Synthetic Oligonucleotide; PD-1 exon 2; Set C
gcugucauugcgccgggcccu

SEQ ID NO: 5857 - RNA, 40 nt, Artificial Sequence
  Synthetic Oligonucleotide; PD-1 exon 2; Set C
gguaggugccgcugucauugcgccgggcccugaccacgcu

SEQ ID NO: 5858 - RNA, 15 nt, Artificial Sequence
  Synthetic Oligonucleotide; PD-1 exon 2; Set C
ugucauugcgccggg

SEQ ID NO: 5859 - RNA, 27 nt, Artificial Sequence
  Synthetic Oligonucleotide; PD-1 exon 2; Set C
gugccgcugucauugcgccgggcccug

SEQ ID NO: 5860 - RNA, 26 nt, Artificial Sequence
  Synthetic Oligonucleotide; PD-1 exon 2; Set C
gugccgcugucauugcgccgggcccu

SEQ ID NO: 5861 - RNA, 28 nt, Artificial Sequence
  Synthetic Oligonucleotide; PD-1 exon 2; Set C
ggugccgcugucauugcgccgggcccug

SEQ ID NO: 5862 - RNA, 27 nt, Artificial Sequence
  Synthetic Oligonucleotide; PD-1 exon 2; Set C
ggugccgcugucauugcgccgggcccu

SEQ ID NO: 5863 - RNA, 29 nt, Artificial Sequence
  Synthetic Oligonucleotide; PD-1 exon 2; Set C
aggugccgcugucauugcgccgggcccug

SEQ ID NO: 5864 - RNA, 31 nt, Artificial Sequence
  Synthetic Oligonucleotide; PD-1 exon 2; Set C
uaggugccgcugucauugcgccgggcccuga

SEQ ID NO: 5865 - RNA, 28 nt, Artificial Sequence
  Synthetic Oligonucleotide; PD-1 exon 2; Set C
aggugccgcugucauugcgccgggcccu

SEQ ID NO: 5866 - RNA, 32 nt, Artificial Sequence
  Synthetic Oligonucleotide; PD-1 exon 2; Set C
guaggugccgcugucauugcgccgggcccuga

SEQ ID NO: 5867 - RNA, 15 nt, Artificial Sequence
  Synthetic Oligonucleotide; PD-1 exon 2; Set C
gccgcugucauugcg

SEQ ID NO: 5868 - RNA, 33 nt, Artificial Sequence
  Synthetic Oligonucleotide; PD-1 exon 2; Set C
gagguaggugccgcugucauugcgccgggcccu

SEQ ID NO: 5869 - RNA, 25 nt, Artificial Sequence
  Synthetic Oligonucleotide; PD-1 exon 2; Set C
uaggugccgcugucauugcgccggg

SEQ ID NO: 5870 - RNA, 16 nt, Artificial Sequence
  Synthetic Oligonucleotide; PD-1 exon 2; Set C
ugccgcugucauugcg

SEQ ID NO: 5871 - RNA, 18 nt, Artificial Sequence
  Synthetic Oligonucleotide; PD-1 exon 2; Set B
gugccgcugucauugcgc

SEQ ID NO: 5872 - RNA, 26 nt, Artificial Sequence
  Synthetic Oligonucleotide; PD-1 exon 2; Set C
guaggugccgcugucauugcgccggg

SEQ ID NO: 5873 - RNA, 19 nt, Artificial Sequence
  Synthetic Oligonucleotide; PD-1 exon 2; Set C
ggugccgcugucauugcgc

SEQ ID NO: 5874 - RNA, 20 nt, Artificial Sequence
  Synthetic Oligonucleotide; PD-1 exon 2; Set C
aggugccgcugucauugcgc

SEQ ID NO: 5875 - RNA, 24 nt, Artificial Sequence
  Synthetic Oligonucleotide; PD-1 exon 2; Set C
agguaggugccgcugucauugcgc

SEQ ID NO: 5876 - RNA, 25 nt, Artificial Sequence
  Synthetic Oligonucleotide; PD-1 exon 2; Set C
gagguaggugccgcugucauugcgc

SEQ ID NO: 5877 - RNA, 38 nt, Artificial Sequence
  Synthetic Oligonucleotide; PD-1 exon 2; Set C
agauggccccacagagguaggugccgcugucauugcgc

SEQ ID NO: 5878 - RNA, 39 nt, Artificial Sequence
  Synthetic Oligonucleotide; PD-1 exon 2; Set C
gagauggccccacagagguaggugccgcugucauugcgc

SEQ ID NO: 5879 - RNA, 40 nt, Artificial Sequence
  Synthetic Oligonucleotide; PD-1 exon 2; Set C
ggagauggccccacagagguaggugccgcugucauugcgc

SEQ ID NO: 5880 - RNA, 27 nt, Artificial Sequence
  Synthetic Oligonucleotide; PD-1 exon 2; Set C
agauggccccacagagguaggugccgc

SEQ ID NO: 5881 - RNA, 28 nt, Artificial Sequence
  Synthetic Oligonucleotide; PD-1 exon 2; Set C
gagauggccccacagagguaggugccgc

SEQ ID NO: 5882 - RNA, 29 nt, Artificial Sequence
  Synthetic Oligonucleotide; PD-1 exon 2; Set C
ggagauggccccacagagguaggugccgc

SEQ ID NO: 5883 - RNA, 30 nt, Artificial Sequence
  Synthetic Oligonucleotide; PD-1 exon 2; Set C
gggagauggccccacagagguaggugccgc

SEQ ID NO: 5884 - RNA, 28 nt, Artificial Sequence
  Synthetic Oligonucleotide; PD-1 exon 2; Set C
ggagauggccccacagagguaggugccg

SEQ ID NO: 5885 - RNA, 23 nt, Artificial Sequence
  Synthetic Oligonucleotide; PD-1 exon 2; Set C
agauggccccacagagguaggug

SEQ ID NO: 5886 - RNA, 29 nt, Artificial Sequence
  Synthetic Oligonucleotide; PD-1 exon 2; Set C
gggagauggccccacagagguaggugccg

SEQ ID NO: 5887 - RNA, 22 nt, Artificial Sequence
  Synthetic Oligonucleotide; PD-1 exon 2; Set C
agauggccccacagagguaggu

SEQ ID NO: 5888 - RNA, 21 nt, Artificial Sequence
  Synthetic Oligonucleotide; PD-1 exon 2; Set B
agauggccccacagagguagg

SEQ ID NO: 5889 - RNA, 23 nt, Artificial Sequence
  Synthetic Oligonucleotide; PD-1 exon 2; Set C
gagauggccccacagagguaggu

SEQ ID NO: 5890 - RNA, 22 nt, Artificial Sequence
  Synthetic Oligonucleotide; PD-1 exon 2; Set B
gagauggccccacagagguagg

SEQ ID NO: 5891 - RNA, 23 nt, Artificial Sequence
  Synthetic Oligonucleotide; PD-1 exon 2; Set C
ggagauggccccacagagguagg

SEQ ID NO: 5892 - RNA, 21 nt, Artificial Sequence
  Synthetic Oligonucleotide; PD-1 exon 2; Set C
gggagauggccccacagaggu

SEQ ID NO: 5893 - RNA, 36 nt, Artificial Sequence
  Synthetic Oligonucleotide; PD-1 exon 2; Set C
uugggggccagggagauggccccacagagguaggug

SEQ ID NO: 5894 - RNA, 35 nt, Artificial Sequence
  Synthetic Oligonucleotide; PD-1 exon 2; Set C
uugggggccagggagauggccccacagagguaggu

SEQ ID NO: 5895 - RNA, 37 nt, Artificial Sequence
  Synthetic Oligonucleotide; PD-1 exon 2; Set C
cuugggggccagggagauggccccacagagguaggug

SEQ ID NO: 5896 - RNA, 34 nt, Artificial Sequence
  Synthetic Oligonucleotide; PD-1 exon 2; Set C
uugggggccagggagauggccccacagagguagg

SEQ ID NO: 5897 - RNA, 36 nt, Artificial Sequence
  Synthetic Oligonucleotide; PD-1 exon 2; Set C
cuugggggccagggagauggccccacagagguaggu

SEQ ID NO: 5898 - RNA, 33 nt, Artificial Sequence
  Synthetic Oligonucleotide; PD-1 exon 2; Set C
uugggggccagggagauggccccacagagguag

SEQ ID NO: 5899 - RNA, 35 nt, Artificial Sequence
  Synthetic Oligonucleotide; PD-1 exon 2; Set C
cuugggggccagggagauggccccacagagguagg

SEQ ID NO: 5900 - RNA, 32 nt, Artificial Sequence
  Synthetic Oligonucleotide; PD-1 exon 2; Set C
uugggggccagggagauggccccacagaggua

SEQ ID NO: 5901 - RNA, 34 nt, Artificial Sequence
  Synthetic Oligonucleotide; PD-1 exon 2; Set C
cuugggggccagggagauggccccacagagguag

SEQ ID NO: 5902 - RNA, 33 nt, Artificial Sequence
  Synthetic Oligonucleotide; PD-1 exon 2; Set C
cuugggggccagggagauggccccacagaggua

SEQ ID NO: 5903 - RNA, 40 nt, Artificial Sequence
  Synthetic Oligonucleotide; PD-1 exon 2; Set C
ucugcgccuugggggccagggagauggccccacagaggua

SEQ ID NO: 5904 - RNA, 18 nt, Artificial Sequence
  Synthetic Oligonucleotide; PD-1 exon 2; Set B
ccuugggggccagggaga

SEQ ID NO: 5905 - RNA, 19 nt, Artificial Sequence
  Synthetic Oligonucleotide; PD-1 exon 2; Set C
gccuugggggccagggaga

SEQ ID NO: 5906 - RNA, 17 nt, Artificial Sequence
  Synthetic Oligonucleotide; PD-1 exon 2; Set B
ccuugggggccagggag

SEQ ID NO: 5907 - RNA, 15 nt, Artificial Sequence
  Synthetic Oligonucleotide; PD-1 exon 2; Set B
cuugggggccaggga

SEQ ID NO: 5908 - RNA, 32 nt, Artificial Sequence
  Synthetic Oligonucleotide; PD-1 exon 2; Set C
ucugcccgcaggcucucuuugaucugcgccuu

SEQ ID NO: 5909 - RNA, 21 nt, Artificial Sequence
  Synthetic Oligonucleotide; PD-1 exon 2; Set B
ccgcaggcucucuuugaucug

SEQ ID NO: 5910 - RNA, 22 nt, Artificial Sequence
  Synthetic Oligonucleotide; PD-1 exon 2; Set B
cccgcaggcucucuuugaucug

SEQ ID NO: 5911 - RNA, 39 nt, Artificial Sequence
  Synthetic Oligonucleotide; PD-1 exon 2; Set C
cugagcucugcccgcaggcucucuuugaucugcgccuug

SEQ ID NO: 5912 - RNA, 35 nt, Artificial Sequence
  Synthetic Oligonucleotide; PD-1 exon 2; Set C
gagcucugcccgcaggcucucuuugaucugcgccu

SEQ ID NO: 5913 - RNA, 40 nt, Artificial Sequence
  Synthetic Oligonucleotide; PD-1 exon 2; Set C
ccugagcucugcccgcaggcucucuuugaucugcgccuug

SEQ ID NO: 5914 - RNA, 38 nt, Artificial Sequence
  Synthetic Oligonucleotide; PD-1 exon 2; Set C
cugagcucugcccgcaggcucucuuugaucugcgccuu

SEQ ID NO: 5915 - RNA, 36 nt, Artificial Sequence
  Synthetic Oligonucleotide; PD-1 exon 2; Set C
ugagcucugcccgcaggcucucuuugaucugcgccu

SEQ ID NO: 5916 - RNA, 34 nt, Artificial Sequence
  Synthetic Oligonucleotide; PD-1 exon 2; Set C
gagcucugcccgcaggcucucuuugaucugcgcc

SEQ ID NO: 5917 - RNA, 39 nt, Artificial Sequence
  Synthetic Oligonucleotide; PD-1 exon 2; Set C
ccugagcucugcccgcaggcucucuuugaucugcgccuu

SEQ ID NO: 5918 - RNA, 25 nt, Artificial Sequence
  Synthetic Oligonucleotide; PD-1 exon 2; Set C
ucugcccgcaggcucucuuugaucu

SEQ ID NO: 5919 - RNA, 35 nt, Artificial Sequence
  Synthetic Oligonucleotide; PD-1 exon 2; Set C
ugagcucugcccgcaggcucucuuugaucugcgcc

SEQ ID NO: 5920 - RNA, 24 nt, Artificial Sequence
  Synthetic Oligonucleotide; PD-1 exon 2; Set C
ucugcccgcaggcucucuuugauc

SEQ ID NO: 5921 - RNA, 23 nt, Artificial Sequence
  Synthetic Oligonucleotide; PD-1 exon 2; Set C
ucugcccgcaggcucucuuugau

SEQ ID NO: 5922 - RNA, 22 nt, Artificial Sequence
  Synthetic Oligonucleotide; PD-1 exon 2; Set C
ucugcccgcaggcucucuuuga

SEQ ID NO: 5923 - RNA, 21 nt, Artificial Sequence
  Synthetic Oligonucleotide; PD-1 exon 2; Set B
ucugcccgcaggcucucuuug

SEQ ID NO: 5924 - RNA, 20 nt, Artificial Sequence
  Synthetic Oligonucleotide; PD-1 exon 2; Set B
ucugcccgcaggcucucuuu

SEQ ID NO: 5925 - RNA, 19 nt, Artificial Sequence
  Synthetic Oligonucleotide; PD-1 exon 2; Set B
ucugcccgcaggcucucuu

SEQ ID NO: 5926 - RNA, 31 nt, Artificial Sequence
  Synthetic Oligonucleotide; PD-1 exon 2; Set C
cugagcucugcccgcaggcucucuuugaucu

SEQ ID NO: 5927 - RNA, 18 nt, Artificial Sequence
  Synthetic Oligonucleotide; PD-1 exon 2; Set B
ucugcccgcaggcucucu

SEQ ID NO: 5928 - RNA, 30 nt, Artificial Sequence
  Synthetic Oligonucleotide; PD-1 exon 2; Set C
cugagcucugcccgcaggcucucuuugauc

SEQ ID NO: 5929 - RNA, 32 nt, Artificial Sequence
  Synthetic Oligonucleotide; PD-1 exon 2; Set C
ccugagcucugcccgcaggcucucuuugaucu

SEQ ID NO: 5930 - RNA, 29 nt, Artificial Sequence
  Synthetic Oligonucleotide; PD-1 exon 2; Set C
cugagcucugcccgcaggcucucuuugau

SEQ ID NO: 5931 - RNA, 31 nt, Artificial Sequence
  Synthetic Oligonucleotide; PD-1 exon 2; Set C
ccugagcucugcccgcaggcucucuuugauc

SEQ ID NO: 5932 - RNA, 30 nt, Artificial Sequence
  Synthetic Oligonucleotide; PD-1 exon 2; Set C
ccugagcucugcccgcaggcucucuuugau

SEQ ID NO: 5933 - RNA, 28 nt, Artificial Sequence
  Synthetic Oligonucleotide; PD-1 exon 2; Set C
cugagcucugcccgcaggcucucuuuga

SEQ ID NO: 5934 - RNA, 27 nt, Artificial Sequence
  Synthetic Oligonucleotide; PD-1 exon 2; Set C
cugagcucugcccgcaggcucucuuug

SEQ ID NO: 5935 - RNA, 29 nt, Artificial Sequence
  Synthetic Oligonucleotide; PD-1 exon 2; Set C
ccugagcucugcccgcaggcucucuuuga

SEQ ID NO: 5936 - RNA, 26 nt, Artificial Sequence
  Synthetic Oligonucleotide; PD-1 exon 2; Set C
cugagcucugcccgcaggcucucuuu

SEQ ID NO: 5937 - RNA, 28 nt, Artificial Sequence
  Synthetic Oligonucleotide; PD-1 exon 2; Set C
ccugagcucugcccgcaggcucucuuug

SEQ ID NO: 5938 - RNA, 27 nt, Artificial Sequence
  Synthetic Oligonucleotide; PD-1 exon 2; Set C
ccugagcucugcccgcaggcucucuuu

SEQ ID NO: 5939 - RNA, 25 nt, Artificial Sequence
  Synthetic Oligonucleotide; PD-1 exon 2; Set C
cugagcucugcccgcaggcucucuu

SEQ ID NO: 5940 - RNA, 21 nt, Artificial Sequence
  Synthetic Oligonucleotide; PD-1 exon 2; Set C
gagcucugcccgcaggcucuc

SEQ ID NO: 5941 - RNA, 26 nt, Artificial Sequence
  Synthetic Oligonucleotide; PD-1 exon 2; Set C
ccugagcucugcccgcaggcucucuu

SEQ ID NO: 5942 - RNA, 24 nt, Artificial Sequence
  Synthetic Oligonucleotide; PD-1 exon 2; Set C
cugagcucugcccgcaggcucucu

SEQ ID NO: 5943 - RNA, 22 nt, Artificial Sequence
  Synthetic Oligonucleotide; PD-1 exon 2; Set C
ugagcucugcccgcaggcucuc

SEQ ID NO: 5944 - RNA, 20 nt, Artificial Sequence
  Synthetic Oligonucleotide; PD-1 exon 2; Set C
gagcucugcccgcaggcucu

SEQ ID NO: 5945 - RNA, 25 nt, Artificial Sequence
  Synthetic Oligonucleotide; PD-1 exon 2; Set C
ccugagcucugcccgcaggcucucu

SEQ ID NO: 5946 - RNA, 21 nt, Artificial Sequence
  Synthetic Oligonucleotide; PD-1 exon 2; Set C
ugagcucugcccgcaggcucu

SEQ ID NO: 5947 - RNA, 20 nt, Artificial Sequence
  Synthetic Oligonucleotide; PD-1 exon 2; Set C
ugagcucugcccgcaggcuc

SEQ ID NO: 5948 - RNA, 19 nt, Artificial Sequence
  Synthetic Oligonucleotide; PD-1 exon 2; Set C
ugagcucugcccgcaggcu

SEQ ID NO: 5949 - RNA, 28 nt, Artificial Sequence
  Synthetic Oligonucleotide; PD-1 exon 2; Set C
ucacccugagcucugcccgcaggcucuc

SEQ ID NO: 5950 - RNA, 27 nt, Artificial Sequence
  Synthetic Oligonucleotide; PD-1 exon 2; Set C
ucacccugagcucugcccgcaggcucu

SEQ ID NO: 5951 - RNA, 40 nt, Artificial Sequence
  Synthetic Oligonucleotide; PD-1 exon 2; Set C
gcaccugucacccugagcucugcccgcaggcucucuuuga

SEQ ID NO: 5952 - RNA, 28 nt, Artificial Sequence
  Synthetic Oligonucleotide; PD-1 exon 2; Set C
gucacccugagcucugcccgcaggcucu

SEQ ID NO: 5953 - RNA, 26 nt, Artificial Sequence
  Synthetic Oligonucleotide; PD-1 exon 2; Set C
ucacccugagcucugcccgcaggcuc

SEQ ID NO: 5954 - RNA, 39 nt, Artificial Sequence
  Synthetic Oligonucleotide; PD-1 exon 2; Set C
gcaccugucacccugagcucugcccgcaggcucucuuug

SEQ ID NO: 5955 - RNA, 25 nt, Artificial Sequence
  Synthetic Oligonucleotide; PD-1 exon 2; Set C
ucacccugagcucugcccgcaggcu

SEQ ID NO: 5956 - RNA, 27 nt, Artificial Sequence
  Synthetic Oligonucleotide; PD-1 exon 2; Set C
gucacccugagcucugcccgcaggcuc

SEQ ID NO: 5957 - RNA, 38 nt, Artificial Sequence
  Synthetic Oligonucleotide; PD-1 exon 2; Set C
gcaccugucacccugagcucugcccgcaggcucucuuu

SEQ ID NO: 5958 - RNA, 26 nt, Artificial Sequence
  Synthetic Oligonucleotide; PD-1 exon 2; Set C
gucacccugagcucugcccgcaggcu

SEQ ID NO: 5959 - RNA, 28 nt, Artificial Sequence
  Synthetic Oligonucleotide; PD-1 exon 2; Set C
ugucacccugagcucugcccgcaggcuc

SEQ ID NO: 5960 - RNA, 37 nt, Artificial Sequence
  Synthetic Oligonucleotide; PD-1 exon 2; Set C
gcaccugucacccugagcucugcccgcaggcucucuu

SEQ ID NO: 5961 - RNA, 15 nt, Artificial Sequence
  Synthetic Oligonucleotide; PD-1 exon 2; Set C
ccugagcucugcccg

SEQ ID NO: 5962 - RNA, 40 nt, Artificial Sequence
  Synthetic Oligonucleotide; PD-1 exon 2; Set C
aggccgcaccugucacccugagcucugcccgcaggcucuc

SEQ ID NO: 5963 - RNA, 39 nt, Artificial Sequence
  Synthetic Oligonucleotide; PD-1 exon 2; Set C
aggccgcaccugucacccugagcucugcccgcaggcucu

SEQ ID NO: 5964 - RNA, 40 nt, Artificial Sequence
  Synthetic Oligonucleotide; PD-1 exon 2; Set C
gaggccgcaccugucacccugagcucugcccgcaggcucu

SEQ ID NO: 5965 - RNA, 38 nt, Artificial Sequence
  Synthetic Oligonucleotide; PD-1 exon 2; Set C
aggccgcaccugucacccugagcucugcccgcaggcuc

SEQ ID NO: 5966 - RNA, 37 nt, Artificial Sequence
  Synthetic Oligonucleotide; PD-1 exon 2; Set C
aggccgcaccugucacccugagcucugcccgcaggcu

SEQ ID NO: 5967 - RNA, 39 nt, Artificial Sequence
  Synthetic Oligonucleotide; PD-1 exon 2; Set C
gaggccgcaccugucacccugagcucugcccgcaggcuc

SEQ ID NO: 5968 - RNA, 15 nt, Artificial Sequence
  Synthetic Oligonucleotide; PD-1 exon 2; Set C
gucacccugagcucu

SEQ ID NO: 5969 - RNA, 38 nt, Artificial Sequence
  Synthetic Oligonucleotide; PD-1 exon 2; Set C
gaggccgcaccugucacccugagcucugcccgcaggcu

SEQ ID NO: 5970 - RNA, 16 nt, Artificial Sequence
  Synthetic Oligonucleotide; PD-1 exon 2; Set C
ugucacccugagcucu

SEQ ID NO: 5971 - RNA, 22 nt, Artificial Sequence
  Synthetic Oligonucleotide; PD-1 exon 2; Set C
aggccgcaccugucacccugag

SEQ ID NO: 5972 - RNA, 21 nt, Artificial Sequence
  Synthetic Oligonucleotide; PD-1 exon 2; Set C
aggccgcaccugucacccuga

SEQ ID NO: 5973 - RNA, 23 nt, Artificial Sequence
  Synthetic Oligonucleotide; PD-1 exon 2; Set C
gaggccgcaccugucacccugag

SEQ ID NO: 5974 - RNA, 40 nt, Artificial Sequence
  Synthetic Oligonucleotide; PD-1 exon 2; Set C
ggggccuccgaggccgcaccugucacccugagcucugccc

SEQ ID NO: 5975 - RNA, 22 nt, Artificial Sequence
  Synthetic Oligonucleotide; PD-1 exon 2; Set C
gaggccgcaccugucacccuga

SEQ ID NO: 5976 - RNA, 35 nt, Artificial Sequence
  Synthetic Oligonucleotide; PD-1 exon 2; Set C
gggccuccgaggccgcaccugucacccugagcucu

SEQ ID NO: 5977 - RNA, 25 nt, Artificial Sequence
  Synthetic Oligonucleotide; PD-1 exon 2; Set C
ggggccuccgaggccgcaccuguca

SEQ ID NO: 5978 - RNA, 24 nt, Artificial Sequence
  Synthetic Oligonucleotide; PD-1 exon 2; Set C
ggggccuccgaggccgcaccuguc

SEQ ID NO: 5979 - RNA, 23 nt, Artificial Sequence
  Synthetic Oligonucleotide; PD-1 exon 2; Set C
ggggccuccgaggccgcaccugu

SEQ ID NO: 5980 - RNA, 17 nt, Artificial Sequence
  Synthetic Oligonucleotide; PD-1 exon 2; Set C
gggccuccgaggccgca

SEQ ID NO: 5981 - RNA, 40 nt, Artificial Sequence
  Synthetic Oligonucleotide; PD-1 exon 2; Set C
cagcucaccccugccccggggccuccgaggccgcaccugu

SEQ ID NO: 5982 - RNA, 30 nt, Artificial Sequence
  Synthetic Oligonucleotide; PD-1 exon 2; Set C
cagcucaccccugccccggggccuccgagg

SEQ ID NO: 5983 - RNA, 29 nt, Artificial Sequence
  Synthetic Oligonucleotide; PD-1 exon 2; Set C
cagcucaccccugccccggggccuccgag

SEQ ID NO: 5984 - RNA, 31 nt, Artificial Sequence
  Synthetic Oligonucleotide; PD-1 exon 2; Set C
ucagcucaccccugccccggggccuccgagg

SEQ ID NO: 5985 - RNA, 30 nt, Artificial Sequence
  Synthetic Oligonucleotide; PD-1 exon 2; Set C
ucagcucaccccugccccggggccuccgag

SEQ ID NO: 5986 - RNA, 39 nt, Artificial Sequence
  Synthetic Oligonucleotide; PD-1 exon 2; Set C
ggaccggcucagcucaccccugccccggggccuccgagg

SEQ ID NO: 5987 - RNA, 22 nt, Artificial Sequence
  Synthetic Oligonucleotide; PD-1 exon 2; Set C
ucagcucaccccugccccgggg

SEQ ID NO: 5988 - RNA, 38 nt, Artificial Sequence
  Synthetic Oligonucleotide; PD-1 exon 2; Set C
ggaccggcucagcucaccccugccccggggccuccgag

SEQ ID NO: 5989 - RNA, 40 nt, Artificial Sequence
  Synthetic Oligonucleotide; PD-1 exon 2; Set C
aggaccggcucagcucaccccugccccggggccuccgagg

SEQ ID NO: 5990 - RNA, 39 nt, Artificial Sequence
  Synthetic Oligonucleotide; PD-1 exon 2; Set C
aggaccggcucagcucaccccugccccggggccuccgag

SEQ ID NO: 5991 - RNA, 30 nt, Artificial Sequence
  Synthetic Oligonucleotide; PD-1 exon 2; Set C
ggaccggcucagcucaccccugccccgggg

SEQ ID NO: 5992 - RNA, 31 nt, Artificial Sequence
  Synthetic Oligonucleotide; PD-1 exon 2; Set C
aggaccggcucagcucaccccugccccgggg

SEQ ID NO: 5993 - RNA, 18 nt, Artificial Sequence
  Synthetic Oligonucleotide; PD-1 exon 3; Set A
guuaggacggggucaggg

SEQ ID NO: 5994 - RNA, 17 nt, Artificial Sequence
  Synthetic Oligonucleotide; PD-1 exon 3; Set C
guuaggacggggucagg

SEQ ID NO: 5995 - RNA, 15 nt, Artificial Sequence
  Synthetic Oligonucleotide; PD-1 exon 3; Set C
ggcugggaugacguu

SEQ ID NO: 5996 - RNA, 26 nt, Artificial Sequence
  Synthetic Oligonucleotide; PD-1 exon 3; Set C
guuaggacggggucaggguggagggu

SEQ ID NO: 5997 - RNA, 15 nt, Artificial Sequence
  Synthetic Oligonucleotide; PD-1 exon 3; Set C
aggacggggucaggg

SEQ ID NO: 5998 - RNA, 17 nt, Artificial Sequence
  Synthetic Oligonucleotide; PD-1 exon 3; Set A
uaggacggggucagggu

SEQ ID NO: 5999 - RNA, 16 nt, Artificial Sequence
  Synthetic Oligonucleotide; PD-1 exon 3; Set C
uaggacggggucaggg

SEQ ID NO: 6000 - RNA, 18 nt, Artificial Sequence
  Synthetic Oligonucleotide; PD-1 exon 3; Set A
uuaggacggggucagggu

SEQ ID NO: 6001 - RNA, 17 nt, Artificial Sequence
  Synthetic Oligonucleotide; PD-1 exon 3; Set A
uuaggacggggucaggg

SEQ ID NO: 6002 - RNA, 15 nt, Artificial Sequence
  Synthetic Oligonucleotide; PD-1 exon 3; Set C
uaggacggggucagg

SEQ ID NO: 6003 - RNA, 19 nt, Artificial Sequence
  Synthetic Oligonucleotide; PD-1 exon 3; Set A
guuaggacggggucagggu

SEQ ID NO: 6004 - RNA, 16 nt, Artificial Sequence
  Synthetic Oligonucleotide; PD-1 exon 3; Set C
uuaggacggggucagg

SEQ ID NO: 6005 - RNA, 31 nt, Artificial Sequence
  Synthetic Oligonucleotide; PD-1 exon 3; Set C
acguuaccucgugcggcccgggagcagauga

SEQ ID NO: 6006 - RNA, 32 nt, Artificial Sequence
  Synthetic Oligonucleotide; PD-1 exon 3; Set C
gacguuaccucgugcggcccgggagcagauga

SEQ ID NO: 6007 - RNA, 33 nt, Artificial Sequence
  Synthetic Oligonucleotide; PD-1 exon 3; Set C
ugacguuaccucgugcggcccgggagcagauga

SEQ ID NO: 6008 - RNA, 31 nt, Artificial Sequence
  Synthetic Oligonucleotide; PD-1 exon 3; Set C
gacguuaccucgugcggcccgggagcagaug

SEQ ID NO: 6009 - RNA, 32 nt, Artificial Sequence
  Synthetic Oligonucleotide; PD-1 exon 3; Set C
ugacguuaccucgugcggcccgggagcagaug

SEQ ID NO: 6010 - RNA, 34 nt, Artificial Sequence
  Synthetic Oligonucleotide; PD-1 exon 3; Set C
augacguuaccucgugcggcccgggagcagauga

SEQ ID NO: 6011 - RNA, 35 nt, Artificial Sequence
  Synthetic Oligonucleotide; PD-1 exon 3; Set C
gaugacguuaccucgugcggcccgggagcagauga

SEQ ID NO: 6012 - RNA, 33 nt, Artificial Sequence
  Synthetic Oligonucleotide; PD-1 exon 3; Set C
augacguuaccucgugcggcccgggagcagaug

SEQ ID NO: 6013 - RNA, 31 nt, Artificial Sequence
  Synthetic Oligonucleotide; PD-1 exon 3; Set C
ugacguuaccucgugcggcccgggagcagau

SEQ ID NO: 6014 - RNA, 34 nt, Artificial Sequence
  Synthetic Oligonucleotide; PD-1 exon 3; Set C
gaugacguuaccucgugcggcccgggagcagaug

SEQ ID NO: 6015 - RNA, 36 nt, Artificial Sequence
  Synthetic Oligonucleotide; PD-1 exon 3; Set C
ggaugacguuaccucgugcggcccgggagcagauga

SEQ ID NO: 6016 - RNA, 30 nt, Artificial Sequence
  Synthetic Oligonucleotide; PD-1 exon 3; Set C
ugacguuaccucgugcggcccgggagcaga

SEQ ID NO: 6017 - RNA, 32 nt, Artificial Sequence
  Synthetic Oligonucleotide; PD-1 exon 3; Set C
augacguuaccucgugcggcccgggagcagau

SEQ ID NO: 6018 - RNA, 35 nt, Artificial Sequence
  Synthetic Oligonucleotide; PD-1 exon 3; Set C
ggaugacguuaccucgugcggcccgggagcagaug

SEQ ID NO: 6019 - RNA, 33 nt, Artificial Sequence
  Synthetic Oligonucleotide; PD-1 exon 3; Set C
gaugacguuaccucgugcggcccgggagcagau

SEQ ID NO: 6020 - RNA, 31 nt, Artificial Sequence
  Synthetic Oligonucleotide; PD-1 exon 3; Set C
augacguuaccucgugcggcccgggagcaga

SEQ ID NO: 6021 - RNA, 32 nt, Artificial Sequence
  Synthetic Oligonucleotide; PD-1 exon 3; Set C
gaugacguuaccucgugcggcccgggagcaga

SEQ ID NO: 6022 - RNA, 34 nt, Artificial Sequence
  Synthetic Oligonucleotide; PD-1 exon 3; Set C
ggaugacguuaccucgugcggcccgggagcagau

SEQ ID NO: 6023 - RNA, 33 nt, Artificial Sequence
  Synthetic Oligonucleotide; PD-1 exon 3; Set C
ggaugacguuaccucgugcggcccgggagcaga

SEQ ID NO: 6024 - RNA, 15 nt, Artificial Sequence
  Synthetic Oligonucleotide; PD-1 exon 3; Set C
gcugggaugacguua

SEQ ID NO: 6025 - RNA, 16 nt, Artificial Sequence
  Synthetic Oligonucleotide; PD-1 exon 3; Set C
ggcugggaugacguua

SEQ ID NO: 6026 - RNA, 33 nt, Artificial Sequence
  Synthetic Oligonucleotide; PD-1 exon 3; Set C
gggcagggcaggccgaggggcugggaugacguu

SEQ ID NO: 6027 - RNA, 35 nt, Artificial Sequence
  Synthetic Oligonucleotide; PD-1 exon 3; Set C
agggcagggcaggccgaggggcugggaugacguua

SEQ ID NO: 6028 - RNA, 34 nt, Artificial Sequence
  Synthetic Oligonucleotide; PD-1 exon 3; Set C
agggcagggcaggccgaggggcugggaugacguu

SEQ ID NO: 6029 - RNA, 32 nt, Artificial Sequence
  Synthetic Oligonucleotide; PD-1 exon 3; Set C
gggcagggcaggccgaggggcugggaugacgu

SEQ ID NO: 6030 - RNA, 36 nt, Artificial Sequence
  Synthetic Oligonucleotide; PD-1 exon 3; Set C
uagggcagggcaggccgaggggcugggaugacguua

SEQ ID NO: 6031 - RNA, 35 nt, Artificial Sequence
  Synthetic Oligonucleotide; PD-1 exon 3; Set C
uagggcagggcaggccgaggggcugggaugacguu

SEQ ID NO: 6032 - RNA, 33 nt, Artificial Sequence
  Synthetic Oligonucleotide; PD-1 exon 3; Set C
agggcagggcaggccgaggggcugggaugacgu

SEQ ID NO: 6033 - RNA, 37 nt, Artificial Sequence
  Synthetic Oligonucleotide; PD-1 exon 3; Set C
uuagggcagggcaggccgaggggcugggaugacguua

SEQ ID NO: 6034 - RNA, 36 nt, Artificial Sequence
  Synthetic Oligonucleotide; PD-1 exon 3; Set C
uuagggcagggcaggccgaggggcugggaugacguu

SEQ ID NO: 6035 - RNA, 34 nt, Artificial Sequence
  Synthetic Oligonucleotide; PD-1 exon 3; Set C
uagggcagggcaggccgaggggcugggaugacgu

SEQ ID NO: 6036 - RNA, 32 nt, Artificial Sequence
  Synthetic Oligonucleotide; PD-1 exon 3; Set C
agggcagggcaggccgaggggcugggaugacg

SEQ ID NO: 6037 - RNA, 38 nt, Artificial Sequence
  Synthetic Oligonucleotide; PD-1 exon 3; Set C
guuagggcagggcaggccgaggggcugggaugacguua

SEQ ID NO: 6038 - RNA, 37 nt, Artificial Sequence
  Synthetic Oligonucleotide; PD-1 exon 3; Set C
guuagggcagggcaggccgaggggcugggaugacguu

SEQ ID NO: 6039 - RNA, 31 nt, Artificial Sequence
  Synthetic Oligonucleotide; PD-1 exon 3; Set C
agggcagggcaggccgaggggcugggaugac

SEQ ID NO: 6040 - RNA, 35 nt, Artificial Sequence
  Synthetic Oligonucleotide; PD-1 exon 3; Set C
uuagggcagggcaggccgaggggcugggaugacgu

SEQ ID NO: 6041 - RNA, 33 nt, Artificial Sequence
  Synthetic Oligonucleotide; PD-1 exon 3; Set C
uagggcagggcaggccgaggggcugggaugacg

SEQ ID NO: 6042 - RNA, 30 nt, Artificial Sequence
  Synthetic Oligonucleotide; PD-1 exon 3; Set C
agggcagggcaggccgaggggcugggauga

SEQ ID NO: 6043 - RNA, 32 nt, Artificial Sequence
  Synthetic Oligonucleotide; PD-1 exon 3; Set C
uagggcagggcaggccgaggggcugggaugac

SEQ ID NO: 6044 - RNA, 36 nt, Artificial Sequence
  Synthetic Oligonucleotide; PD-1 exon 3; Set C
guuagggcagggcaggccgaggggcugggaugacgu

SEQ ID NO: 6045 - RNA, 34 nt, Artificial Sequence
  Synthetic Oligonucleotide; PD-1 exon 3; Set C
uuagggcagggcaggccgaggggcugggaugacg

SEQ ID NO: 6046 - RNA, 31 nt, Artificial Sequence
  Synthetic Oligonucleotide; PD-1 exon 3; Set C
uagggcagggcaggccgaggggcugggauga

SEQ ID NO: 6047 - RNA, 29 nt, Artificial Sequence
  Synthetic Oligonucleotide; PD-1 exon 3; Set C
agggcagggcaggccgaggggcugggaug

SEQ ID NO: 6048 - RNA, 33 nt, Artificial Sequence
  Synthetic Oligonucleotide; PD-1 exon 3; Set C
uuagggcagggcaggccgaggggcugggaugac

SEQ ID NO: 6049 - RNA, 35 nt, Artificial Sequence
  Synthetic Oligonucleotide; PD-1 exon 3; Set C
guuagggcagggcaggccgaggggcugggaugacg

SEQ ID NO: 6050 - RNA, 32 nt, Artificial Sequence
  Synthetic Oligonucleotide; PD-1 exon 3; Set C
uuagggcagggcaggccgaggggcugggauga

SEQ ID NO: 6051 - RNA, 30 nt, Artificial Sequence
  Synthetic Oligonucleotide; PD-1 exon 3; Set C
uagggcagggcaggccgaggggcugggaug

SEQ ID NO: 6052 - RNA, 34 nt, Artificial Sequence
  Synthetic Oligonucleotide; PD-1 exon 3; Set C
guuagggcagggcaggccgaggggcugggaugac

SEQ ID NO: 6053 - RNA, 33 nt, Artificial Sequence
  Synthetic Oligonucleotide; PD-1 exon 3; Set C
guuagggcagggcaggccgaggggcugggauga

SEQ ID NO: 6054 - RNA, 29 nt, Artificial Sequence
  Synthetic Oligonucleotide; PD-1 exon 3; Set C
uagggcagggcaggccgaggggcugggau

SEQ ID NO: 6055 - RNA, 31 nt, Artificial Sequence
  Synthetic Oligonucleotide; PD-1 exon 3; Set C
uuagggcagggcaggccgaggggcugggaug

SEQ ID NO: 6056 - RNA, 30 nt, Artificial Sequence
  Synthetic Oligonucleotide; PD-1 exon 3; Set C
uuagggcagggcaggccgaggggcugggau

SEQ ID NO: 6057 - RNA, 32 nt, Artificial Sequence
  Synthetic Oligonucleotide; PD-1 exon 3; Set C
guuagggcagggcaggccgaggggcugggaug

SEQ ID NO: 6058 - RNA, 31 nt, Artificial Sequence
  Synthetic Oligonucleotide; PD-1 exon 3; Set C
guuagggcagggcaggccgaggggcugggau

SEQ ID NO: 6059 - RNA, 16 nt, Artificial Sequence
  Synthetic Oligonucleotide; PD-1 exon 3; Set A
ggucaggguggagggu

SEQ ID NO: 6060 - RNA, 17 nt, Artificial Sequence
  Synthetic Oligonucleotide; PD-1 exon 3; Set A
gggucaggguggagggu

SEQ ID NO: 6061 - RNA, 18 nt, Artificial Sequence
  Synthetic Oligonucleotide; PD-1 exon 3; Set A
ggggucaggguggagggu

SEQ ID NO: 6062 - RNA, 23 nt, Artificial Sequence
  Synthetic Oligonucleotide; PD-1 exon 3; Set C
aggacggggucaggguggagggu

SEQ ID NO: 6063 - RNA, 24 nt, Artificial Sequence
  Synthetic Oligonucleotide; PD-1 exon 3; Set C
uaggacggggucaggguggagggu

SEQ ID NO: 6064 - RNA, 25 nt, Artificial Sequence
  Synthetic Oligonucleotide; PD-1 exon 3; Set C
uuaggacggggucaggguggagggu

SEQ ID NO: 6065 - RNA, 16 nt, Artificial Sequence
  Synthetic Oligonucleotide; PD-1 exon 3; Set A
aggacggggucagggu

SEQ ID NO: 6066 - RNA, 19 nt, Artificial Sequence
  Synthetic Oligonucleotide; PD-1 exon 3; Set A
gguuaggacggggucaggg

SEQ ID NO: 6067 - RNA, 15 nt, Artificial Sequence
  Synthetic Oligonucleotide; PD-1 exon 3; Set C
uuaggacggggucag

SEQ ID NO: 6068 - RNA, 20 nt, Artificial Sequence
  Synthetic Oligonucleotide; PD-1 exon 3; Set C
ggguuaggacggggucaggg

SEQ ID NO: 6069 - RNA, 18 nt, Artificial Sequence
  Synthetic Oligonucleotide; PD-1 exon 3; Set A
gguuaggacggggucagg

SEQ ID NO: 6070 - RNA, 16 nt, Artificial Sequence
  Synthetic Oligonucleotide; PD-1 exon 3; Set C
guuaggacggggucag

SEQ ID NO: 6071 - RNA, 19 nt, Artificial Sequence
  Synthetic Oligonucleotide; PD-1 exon 3; Set A
ggguuaggacggggucagg

SEQ ID NO: 6072 - RNA, 15 nt, Artificial Sequence
  Synthetic Oligonucleotide; PD-1 exon 3; Set C
guuaggacgggguca

SEQ ID NO: 6073 - RNA, 26 nt, Artificial Sequence
  Synthetic Oligonucleotide; PD-1 exon 3; Set C
ggucagggguuaggacggggucaggg

SEQ ID NO: 6074 - RNA, 27 nt, Artificial Sequence
  Synthetic Oligonucleotide; PD-1 exon 3; Set C
aggucagggguuaggacggggucaggg

SEQ ID NO: 6075 - RNA, 25 nt, Artificial Sequence
  Synthetic Oligonucleotide; PD-1 exon 3; Set C
ggucagggguuaggacggggucagg

SEQ ID NO: 6076 - RNA, 40 nt, Artificial Sequence
  Synthetic Oligonucleotide; PD-1 exon 3; Set C
cuggaagggcacaaaggucagggguuaggacggggucagg

SEQ ID NO: 6077 - RNA, 38 nt, Artificial Sequence
  Synthetic Oligonucleotide; PD-1 exon 3; Set C
ucucuggaagggcacaaaggucagggguuaggacgggg

SEQ ID NO: 6078 - RNA, 29 nt, Artificial Sequence
  Synthetic Oligonucleotide; PD-1 exon 3; Set C
ucucuggaagggcacaaaggucagggguu

SEQ ID NO: 6079 - RNA, 30 nt, Artificial Sequence
  Synthetic Oligonucleotide; PD-1 exon 3; Set C
uuaccucgugcggcccgggagcagaugacg

SEQ ID NO: 6080 - RNA, 31 nt, Artificial Sequence
  Synthetic Oligonucleotide; PD-1 exon 3; Set C
guuaccucgugcggcccgggagcagaugacg

SEQ ID NO: 6081 - RNA, 28 nt, Artificial Sequence
  Synthetic Oligonucleotide; PD-1 exon 3; Set C
uuaccucgugcggcccgggagcagauga

SEQ ID NO: 6082 - RNA, 32 nt, Artificial Sequence
  Synthetic Oligonucleotide; PD-1 exon 3; Set C
cguuaccucgugcggcccgggagcagaugacg

SEQ ID NO: 6083 - RNA, 30 nt, Artificial Sequence
  Synthetic Oligonucleotide; PD-1 exon 3; Set C
guuaccucgugcggcccgggagcagaugac

SEQ ID NO: 6084 - RNA, 29 nt, Artificial Sequence
  Synthetic Oligonucleotide; PD-1 exon 3; Set C
guuaccucgugcggcccgggagcagauga

SEQ ID NO: 6085 - RNA, 27 nt, Artificial Sequence
  Synthetic Oligonucleotide; PD-1 exon 3; Set C
uuaccucgugcggcccgggagcagaug

SEQ ID NO: 6086 - RNA, 33 nt, Artificial Sequence
  Synthetic Oligonucleotide; PD-1 exon 3; Set C
acguuaccucgugcggcccgggagcagaugacg

SEQ ID NO: 6087 - RNA, 31 nt, Artificial Sequence
  Synthetic Oligonucleotide; PD-1 exon 3; Set C
cguuaccucgugcggcccgggagcagaugac

SEQ ID NO: 6088 - RNA, 28 nt, Artificial Sequence
  Synthetic Oligonucleotide; PD-1 exon 3; Set C
guuaccucgugcggcccgggagcagaug

SEQ ID NO: 6089 - RNA, 30 nt, Artificial Sequence
  Synthetic Oligonucleotide; PD-1 exon 3; Set C
cguuaccucgugcggcccgggagcagauga

SEQ ID NO: 6090 - RNA, 26 nt, Artificial Sequence
  Synthetic Oligonucleotide; PD-1 exon 3; Set C
uuaccucgugcggcccgggagcagau

SEQ ID NO: 6091 - RNA, 34 nt, Artificial Sequence
  Synthetic Oligonucleotide; PD-1 exon 3; Set C
gacguuaccucgugcggcccgggagcagaugacg

SEQ ID NO: 6092 - RNA, 32 nt, Artificial Sequence
  Synthetic Oligonucleotide; PD-1 exon 3; Set C
acguuaccucgugcggcccgggagcagaugac

SEQ ID NO: 6093 - RNA, 29 nt, Artificial Sequence
  Synthetic Oligonucleotide; PD-1 exon 3; Set C
cguuaccucgugcggcccgggagcagaug

SEQ ID NO: 6094 - RNA, 27 nt, Artificial Sequence
  Synthetic Oligonucleotide; PD-1 exon 3; Set C
guuaccucgugcggcccgggagcagau

SEQ ID NO: 6095 - RNA, 25 nt, Artificial Sequence
  Synthetic Oligonucleotide; PD-1 exon 3; Set C
uuaccucgugcggcccgggagcaga

SEQ ID NO: 6096 - RNA, 35 nt, Artificial Sequence
  Synthetic Oligonucleotide; PD-1 exon 3; Set C
ugacguuaccucgugcggcccgggagcagaugacg

SEQ ID NO: 6097 - RNA, 33 nt, Artificial Sequence
  Synthetic Oligonucleotide; PD-1 exon 3; Set C
gacguuaccucgugcggcccgggagcagaugac

SEQ ID NO: 6098 - RNA, 30 nt, Artificial Sequence
  Synthetic Oligonucleotide; PD-1 exon 3; Set C
acguuaccucgugcggcccgggagcagaug

SEQ ID NO: 6099 - RNA, 26 nt, Artificial Sequence
  Synthetic Oligonucleotide; PD-1 exon 3; Set C
guuaccucgugcggcccgggagcaga

SEQ ID NO: 6100 - RNA, 28 nt, Artificial Sequence
  Synthetic Oligonucleotide; PD-1 exon 3; Set C
cguuaccucgugcggcccgggagcagau

SEQ ID NO: 6101 - RNA, 36 nt, Artificial Sequence
  Synthetic Oligonucleotide; PD-1 exon 3; Set C
augacguuaccucgugcggcccgggagcagaugacg

SEQ ID NO: 6102 - RNA, 34 nt, Artificial Sequence
  Synthetic Oligonucleotide; PD-1 exon 3; Set C
ugacguuaccucgugcggcccgggagcagaugac

SEQ ID NO: 6103 - RNA, 29 nt, Artificial Sequence
  Synthetic Oligonucleotide; PD-1 exon 3; Set C
acguuaccucgugcggcccgggagcagau

SEQ ID NO: 6104 - RNA, 27 nt, Artificial Sequence
  Synthetic Oligonucleotide; PD-1 exon 3; Set C
cguuaccucgugcggcccgggagcaga

SEQ ID NO: 6105 - RNA, 25 nt, Artificial Sequence
  Synthetic Oligonucleotide; PD-1 exon 3; Set C
guuaccucgugcggcccgggagcag

SEQ ID NO: 6106 - RNA, 37 nt, Artificial Sequence
  Synthetic Oligonucleotide; PD-1 exon 3; Set C
gaugacguuaccucgugcggcccgggagcagaugacg

SEQ ID NO: 6107 - RNA, 35 nt, Artificial Sequence
  Synthetic Oligonucleotide; PD-1 exon 3; Set C
augacguuaccucgugcggcccgggagcagaugac

SEQ ID NO: 6108 - RNA, 30 nt, Artificial Sequence
  Synthetic Oligonucleotide; PD-1 exon 3; Set C
gacguuaccucgugcggcccgggagcagau

SEQ ID NO: 6109 - RNA, 28 nt, Artificial Sequence
  Synthetic Oligonucleotide; PD-1 exon 3; Set C
acguuaccucgugcggcccgggagcaga

SEQ ID NO: 6110 - RNA, 26 nt, Artificial Sequence
  Synthetic Oligonucleotide; PD-1 exon 3; Set C
cguuaccucgugcggcccgggagcag

SEQ ID NO: 6111 - RNA, 24 nt, Artificial Sequence
  Synthetic Oligonucleotide; PD-1 exon 3; Set C
guuaccucgugcggcccgggagca

SEQ ID NO: 6112 - RNA, 38 nt, Artificial Sequence
  Synthetic Oligonucleotide; PD-1 exon 3; Set C
ggaugacguuaccucgugcggcccgggagcagaugacg

SEQ ID NO: 6113 - RNA, 36 nt, Artificial Sequence
  Synthetic Oligonucleotide; PD-1 exon 3; Set C
gaugacguuaccucgugcggcccgggagcagaugac

SEQ ID NO: 6114 - RNA, 29 nt, Artificial Sequence
  Synthetic Oligonucleotide; PD-1 exon 3; Set C
gacguuaccucgugcggcccgggagcaga

SEQ ID NO: 6115 - RNA, 27 nt, Artificial Sequence
  Synthetic Oligonucleotide; PD-1 exon 3; Set C
acguuaccucgugcggcccgggagcag

SEQ ID NO: 6116 - RNA, 23 nt, Artificial Sequence
  Synthetic Oligonucleotide; PD-1 exon 3; Set C
guuaccucgugcggcccgggagc

SEQ ID NO: 6117 - RNA, 25 nt, Artificial Sequence
  Synthetic Oligonucleotide; PD-1 exon 3; Set C
cguuaccucgugcggcccgggagca

SEQ ID NO: 6118 - RNA, 39 nt, Artificial Sequence
  Synthetic Oligonucleotide; PD-1 exon 3; Set C
gggaugacguuaccucgugcggcccgggagcagaugacg

SEQ ID NO: 6119 - RNA, 37 nt, Artificial Sequence
  Synthetic Oligonucleotide; PD-1 exon 3; Set C
ggaugacguuaccucgugcggcccgggagcagaugac

SEQ ID NO: 6120 - RNA, 28 nt, Artificial Sequence
  Synthetic Oligonucleotide; PD-1 exon 3; Set C
gacguuaccucgugcggcccgggagcag

SEQ ID NO: 6121 - RNA, 26 nt, Artificial Sequence
  Synthetic Oligonucleotide; PD-1 exon 3; Set C
acguuaccucgugcggcccgggagca

SEQ ID NO: 6122 - RNA, 24 nt, Artificial Sequence
  Synthetic Oligonucleotide; PD-1 exon 3; Set C
cguuaccucgugcggcccgggagc

SEQ ID NO: 6123 - RNA, 22 nt, Artificial Sequence
  Synthetic Oligonucleotide; PD-1 exon 3; Set C
guuaccucgugcggcccgggag

SEQ ID NO: 6124 - RNA, 40 nt, Artificial Sequence
  Synthetic Oligonucleotide; PD-1 exon 3; Set C
ugggaugacguuaccucgugcggcccgggagcagaugacg

SEQ ID NO: 6125 - RNA, 38 nt, Artificial Sequence
  Synthetic Oligonucleotide; PD-1 exon 3; Set C
gggaugacguuaccucgugcggcccgggagcagaugac

SEQ ID NO: 6126 - RNA, 37 nt, Artificial Sequence
  Synthetic Oligonucleotide; PD-1 exon 3; Set C
gggaugacguuaccucgugcggcccgggagcagauga

SEQ ID NO: 6127 - RNA, 29 nt, Artificial Sequence
  Synthetic Oligonucleotide; PD-1 exon 3; Set C
ugacguuaccucgugcggcccgggagcag

SEQ ID NO: 6128 - RNA, 27 nt, Artificial Sequence
  Synthetic Oligonucleotide; PD-1 exon 3; Set C
gacguuaccucgugcggcccgggagca

SEQ ID NO: 6129 - RNA, 25 nt, Artificial Sequence
  Synthetic Oligonucleotide; PD-1 exon 3; Set C
acguuaccucgugcggcccgggagc

SEQ ID NO: 6130 - RNA, 23 nt, Artificial Sequence
  Synthetic Oligonucleotide; PD-1 exon 3; Set C
cguuaccucgugcggcccgggag

SEQ ID NO: 6131 - RNA, 39 nt, Artificial Sequence
  Synthetic Oligonucleotide; PD-1 exon 3; Set C
ugggaugacguuaccucgugcggcccgggagcagaugac

SEQ ID NO: 6132 - RNA, 36 nt, Artificial Sequence
  Synthetic Oligonucleotide; PD-1 exon 3; Set C
gggaugacguuaccucgugcggcccgggagcagaug

SEQ ID NO: 6133 - RNA, 38 nt, Artificial Sequence
  Synthetic Oligonucleotide; PD-1 exon 3; Set C
ugggaugacguuaccucgugcggcccgggagcagauga

SEQ ID NO: 6134 - RNA, 22 nt, Artificial Sequence
  Synthetic Oligonucleotide; PD-1 exon 3; Set C
cguuaccucgugcggcccggga

SEQ ID NO: 6135 - RNA, 30 nt, Artificial Sequence
  Synthetic Oligonucleotide; PD-1 exon 3; Set C
augacguuaccucgugcggcccgggagcag

SEQ ID NO: 6136 - RNA, 28 nt, Artificial Sequence
  Synthetic Oligonucleotide; PD-1 exon 3; Set C
ugacguuaccucgugcggcccgggagca

SEQ ID NO: 6137 - RNA, 26 nt, Artificial Sequence
  Synthetic Oligonucleotide; PD-1 exon 3; Set C
gacguuaccucgugcggcccgggagc

SEQ ID NO: 6138 - RNA, 24 nt, Artificial Sequence
  Synthetic Oligonucleotide; PD-1 exon 3; Set C
acguuaccucgugcggcccgggag

SEQ ID NO: 6139 - RNA, 40 nt, Artificial Sequence
  Synthetic Oligonucleotide; PD-1 exon 3; Set C
cugggaugacguuaccucgugcggcccgggagcagaugac

SEQ ID NO: 6140 - RNA, 37 nt, Artificial Sequence
  Synthetic Oligonucleotide; PD-1 exon 3; Set C
ugggaugacguuaccucgugcggcccgggagcagaug

SEQ ID NO: 6141 - RNA, 39 nt, Artificial Sequence
  Synthetic Oligonucleotide; PD-1 exon 3; Set C
cugggaugacguuaccucgugcggcccgggagcagauga

SEQ ID NO: 6142 - RNA, 35 nt, Artificial Sequence
  Synthetic Oligonucleotide; PD-1 exon 3; Set C
gggaugacguuaccucgugcggcccgggagcagau

SEQ ID NO: 6143 - RNA, 23 nt, Artificial Sequence
  Synthetic Oligonucleotide; PD-1 exon 3; Set C
acguuaccucgugcggcccggga

SEQ ID NO: 6144 - RNA, 31 nt, Artificial Sequence
  Synthetic Oligonucleotide; PD-1 exon 3; Set C
gaugacguuaccucgugcggcccgggagcag

SEQ ID NO: 6145 - RNA, 27 nt, Artificial Sequence
  Synthetic Oligonucleotide; PD-1 exon 3; Set C
ugacguuaccucgugcggcccgggagc

SEQ ID NO: 6146 - RNA, 29 nt, Artificial Sequence
  Synthetic Oligonucleotide; PD-1 exon 3; Set C
augacguuaccucgugcggcccgggagca

SEQ ID NO: 6147 - RNA, 25 nt, Artificial Sequence
  Synthetic Oligonucleotide; PD-1 exon 3; Set C
gacguuaccucgugcggcccgggag

SEQ ID NO: 6148 - RNA, 38 nt, Artificial Sequence
  Synthetic Oligonucleotide; PD-1 exon 3; Set C
cugggaugacguuaccucgugcggcccgggagcagaug

SEQ ID NO: 6149 - RNA, 40 nt, Artificial Sequence
  Synthetic Oligonucleotide; PD-1 exon 3; Set C
gcugggaugacguuaccucgugcggcccgggagcagauga

SEQ ID NO: 6150 - RNA, 34 nt, Artificial Sequence
  Synthetic Oligonucleotide; PD-1 exon 3; Set C
gggaugacguuaccucgugcggcccgggagcaga

SEQ ID NO: 6151 - RNA, 36 nt, Artificial Sequence
  Synthetic Oligonucleotide; PD-1 exon 3; Set C
ugggaugacguuaccucgugcggcccgggagcagau

SEQ ID NO: 6152 - RNA, 22 nt, Artificial Sequence
  Synthetic Oligonucleotide; PD-1 exon 3; Set C
acguuaccucgugcggcccggg

SEQ ID NO: 6153 - RNA, 24 nt, Artificial Sequence
  Synthetic Oligonucleotide; PD-1 exon 3; Set C
gacguuaccucgugcggcccggga

SEQ ID NO: 6154 - RNA, 32 nt, Artificial Sequence
  Synthetic Oligonucleotide; PD-1 exon 3; Set C
ggaugacguuaccucgugcggcccgggagcag

SEQ ID NO: 6155 - RNA, 30 nt, Artificial Sequence
  Synthetic Oligonucleotide; PD-1 exon 3; Set C
gaugacguuaccucgugcggcccgggagca

SEQ ID NO: 6156 - RNA, 28 nt, Artificial Sequence
  Synthetic Oligonucleotide; PD-1 exon 3; Set C
augacguuaccucgugcggcccgggagc

SEQ ID NO: 6157 - RNA, 26 nt, Artificial Sequence
  Synthetic Oligonucleotide; PD-1 exon 3; Set C
ugacguuaccucgugcggcccgggag

SEQ ID NO: 6158 - RNA, 39 nt, Artificial Sequence
  Synthetic Oligonucleotide; PD-1 exon 3; Set C
gcugggaugacguuaccucgugcggcccgggagcagaug

SEQ ID NO: 6159 - RNA, 35 nt, Artificial Sequence
  Synthetic Oligonucleotide; PD-1 exon 3; Set C
ugggaugacguuaccucgugcggcccgggagcaga

SEQ ID NO: 6160 - RNA, 37 nt, Artificial Sequence
  Synthetic Oligonucleotide; PD-1 exon 3; Set C
cugggaugacguuaccucgugcggcccgggagcagau

SEQ ID NO: 6161 - RNA, 23 nt, Artificial Sequence
  Synthetic Oligonucleotide; PD-1 exon 3; Set C
gacguuaccucgugcggcccggg

SEQ ID NO: 6162 - RNA, 25 nt, Artificial Sequence
  Synthetic Oligonucleotide; PD-1 exon 3; Set C
ugacguuaccucgugcggcccggga

SEQ ID NO: 6163 - RNA, 33 nt, Artificial Sequence
  Synthetic Oligonucleotide; PD-1 exon 3; Set C
gggaugacguuaccucgugcggcccgggagcag

SEQ ID NO: 6164 - RNA, 29 nt, Artificial Sequence
  Synthetic Oligonucleotide; PD-1 exon 3; Set C
gaugacguuaccucgugcggcccgggagc

SEQ ID NO: 6165 - RNA, 31 nt, Artificial Sequence
  Synthetic Oligonucleotide; PD-1 exon 3; Set C
ggaugacguuaccucgugcggcccgggagca

SEQ ID NO: 6166 - RNA, 27 nt, Artificial Sequence
  Synthetic Oligonucleotide; PD-1 exon 3; Set C
augacguuaccucgugcggcccgggag

SEQ ID NO: 6167 - RNA, 40 nt, Artificial Sequence
  Synthetic Oligonucleotide; PD-1 exon 3; Set C
ggcugggaugacguuaccucgugcggcccgggagcagaug

SEQ ID NO: 6168 - RNA, 36 nt, Artificial Sequence
  Synthetic Oligonucleotide; PD-1 exon 3; Set C
cugggaugacguuaccucgugcggcccgggagcaga

SEQ ID NO: 6169 - RNA, 38 nt, Artificial Sequence
  Synthetic Oligonucleotide; PD-1 exon 3; Set C
gcugggaugacguuaccucgugcggcccgggagcagau

SEQ ID NO: 6170 - RNA, 24 nt, Artificial Sequence
  Synthetic Oligonucleotide; PD-1 exon 3; Set C
ugacguuaccucgugcggcccggg

SEQ ID NO: 6171 - RNA, 26 nt, Artificial Sequence
  Synthetic Oligonucleotide; PD-1 exon 3; Set C
augacguuaccucgugcggcccggga

SEQ ID NO: 6172 - RNA, 34 nt, Artificial Sequence
  Synthetic Oligonucleotide; PD-1 exon 3; Set C
ugggaugacguuaccucgugcggcccgggagcag

SEQ ID NO: 6173 - RNA, 30 nt, Artificial Sequence
  Synthetic Oligonucleotide; PD-1 exon 3; Set C
ggaugacguuaccucgugcggcccgggagc

SEQ ID NO: 6174 - RNA, 32 nt, Artificial Sequence
  Synthetic Oligonucleotide; PD-1 exon 3; Set C
gggaugacguuaccucgugcggcccgggagca

SEQ ID NO: 6175 - RNA, 28 nt, Artificial Sequence
  Synthetic Oligonucleotide; PD-1 exon 3; Set C
gaugacguuaccucgugcggcccgggag

SEQ ID NO: 6176 - RNA, 39 nt, Artificial Sequence
  Synthetic Oligonucleotide; PD-1 exon 3; Set C
ggcugggaugacguuaccucgugcggcccgggagcagau

SEQ ID NO: 6177 - RNA, 37 nt, Artificial Sequence
  Synthetic Oligonucleotide; PD-1 exon 3; Set C
gcugggaugacguuaccucgugcggcccgggagcaga

SEQ ID NO: 6178 - RNA, 25 nt, Artificial Sequence
  Synthetic Oligonucleotide; PD-1 exon 3; Set C
augacguuaccucgugcggcccggg

SEQ ID NO: 6179 - RNA, 27 nt, Artificial Sequence
  Synthetic Oligonucleotide; PD-1 exon 3; Set C
gaugacguuaccucgugcggcccggga

SEQ ID NO: 6180 - RNA, 35 nt, Artificial Sequence
  Synthetic Oligonucleotide; PD-1 exon 3; Set C
cugggaugacguuaccucgugcggcccgggagcag

SEQ ID NO: 6181 - RNA, 31 nt, Artificial Sequence
  Synthetic Oligonucleotide; PD-1 exon 3; Set C
gggaugacguuaccucgugcggcccgggagc

SEQ ID NO: 6182 - RNA, 33 nt, Artificial Sequence
  Synthetic Oligonucleotide; PD-1 exon 3; Set C
ugggaugacguuaccucgugcggcccgggagca

SEQ ID NO: 6183 - RNA, 29 nt, Artificial Sequence
  Synthetic Oligonucleotide; PD-1 exon 3; Set C
ggaugacguuaccucgugcggcccgggag

SEQ ID NO: 6184 - RNA, 38 nt, Artificial Sequence
  Synthetic Oligonucleotide; PD-1 exon 3; Set C
ggcugggaugacguuaccucgugcggcccgggagcaga

SEQ ID NO: 6185 - RNA, 26 nt, Artificial Sequence
  Synthetic Oligonucleotide; PD-1 exon 3; Set C
gaugacguuaccucgugcggcccggg

SEQ ID NO: 6186 - RNA, 28 nt, Artificial Sequence
  Synthetic Oligonucleotide; PD-1 exon 3; Set C
ggaugacguuaccucgugcggcccggga

SEQ ID NO: 6187 - RNA, 36 nt, Artificial Sequence
  Synthetic Oligonucleotide; PD-1 exon 3; Set C
gcugggaugacguuaccucgugcggcccgggagcag

SEQ ID NO: 6188 - RNA, 32 nt, Artificial Sequence
  Synthetic Oligonucleotide; PD-1 exon 3; Set C
ugggaugacguuaccucgugcggcccgggagc

SEQ ID NO: 6189 - RNA, 34 nt, Artificial Sequence
  Synthetic Oligonucleotide; PD-1 exon 3; Set C
cugggaugacguuaccucgugcggcccgggagca

SEQ ID NO: 6190 - RNA, 30 nt, Artificial Sequence
  Synthetic Oligonucleotide; PD-1 exon 3; Set C
gggaugacguuaccucgugcggcccgggag

SEQ ID NO: 6191 - RNA, 27 nt, Artificial Sequence
  Synthetic Oligonucleotide; PD-1 exon 3; Set C
ggaugacguuaccucgugcggcccggg

SEQ ID NO: 6192 - RNA, 29 nt, Artificial Sequence
  Synthetic Oligonucleotide; PD-1 exon 3; Set C
gggaugacguuaccucgugcggcccggga

SEQ ID NO: 6193 - RNA, 37 nt, Artificial Sequence
  Synthetic Oligonucleotide; PD-1 exon 3; Set C
ggcugggaugacguuaccucgugcggcccgggagcag

SEQ ID NO: 6194 - RNA, 33 nt, Artificial Sequence
  Synthetic Oligonucleotide; PD-1 exon 3; Set C
cugggaugacguuaccucgugcggcccgggagc

SEQ ID NO: 6195 - RNA, 35 nt, Artificial Sequence
  Synthetic Oligonucleotide; PD-1 exon 3; Set C
gcugggaugacguuaccucgugcggcccgggagca

SEQ ID NO: 6196 - RNA, 31 nt, Artificial Sequence
  Synthetic Oligonucleotide; PD-1 exon 3; Set C
ugggaugacguuaccucgugcggcccgggag

SEQ ID NO: 6197 - RNA, 28 nt, Artificial Sequence
  Synthetic Oligonucleotide; PD-1 exon 3; Set C
gggaugacguuaccucgugcggcccggg

SEQ ID NO: 6198 - RNA, 30 nt, Artificial Sequence
  Synthetic Oligonucleotide; PD-1 exon 3; Set C
ugggaugacguuaccucgugcggcccggga

SEQ ID NO: 6199 - RNA, 36 nt, Artificial Sequence
  Synthetic Oligonucleotide; PD-1 exon 3; Set C
ggcugggaugacguuaccucgugcggcccgggagca

SEQ ID NO: 6200 - RNA, 34 nt, Artificial Sequence
  Synthetic Oligonucleotide; PD-1 exon 3; Set C
gcugggaugacguuaccucgugcggcccgggagc

SEQ ID NO: 6201 - RNA, 32 nt, Artificial Sequence
  Synthetic Oligonucleotide; PD-1 exon 3; Set C
cugggaugacguuaccucgugcggcccgggag

SEQ ID NO: 6202 - RNA, 29 nt, Artificial Sequence
  Synthetic Oligonucleotide; PD-1 exon 3; Set C
ugggaugacguuaccucgugcggcccggg

SEQ ID NO: 6203 - RNA, 31 nt, Artificial Sequence
  Synthetic Oligonucleotide; PD-1 exon 3; Set C
cugggaugacguuaccucgugcggcccggga

SEQ ID NO: 6204 - RNA, 35 nt, Artificial Sequence
  Synthetic Oligonucleotide; PD-1 exon 3; Set C
ggcugggaugacguuaccucgugcggcccgggagc

SEQ ID NO: 6205 - RNA, 33 nt, Artificial Sequence
  Synthetic Oligonucleotide; PD-1 exon 3; Set C
gcugggaugacguuaccucgugcggcccgggag

SEQ ID NO: 6206 - RNA, 30 nt, Artificial Sequence
  Synthetic Oligonucleotide; PD-1 exon 3; Set C
cugggaugacguuaccucgugcggcccggg

SEQ ID NO: 6207 - RNA, 32 nt, Artificial Sequence
  Synthetic Oligonucleotide; PD-1 exon 3; Set C
gcugggaugacguuaccucgugcggcccggga

SEQ ID NO: 6208 - RNA, 34 nt, Artificial Sequence
  Synthetic Oligonucleotide; PD-1 exon 3; Set C
ggcugggaugacguuaccucgugcggcccgggag

SEQ ID NO: 6209 - RNA, 31 nt, Artificial Sequence
  Synthetic Oligonucleotide; PD-1 exon 3; Set C
gcugggaugacguuaccucgugcggcccggg

SEQ ID NO: 6210 - RNA, 33 nt, Artificial Sequence
  Synthetic Oligonucleotide; PD-1 exon 3; Set C
ggcugggaugacguuaccucgugcggcccggga

SEQ ID NO: 6211 - RNA, 32 nt, Artificial Sequence
  Synthetic Oligonucleotide; PD-1 exon 3; Set C
ggcugggaugacguuaccucgugcggcccggg

SEQ ID NO: 6212 - RNA, 18 nt, Artificial Sequence
  Synthetic Oligonucleotide; PD-1 exon 3; Set B
aggggcugggaugacguu

SEQ ID NO: 6213 - RNA, 19 nt, Artificial Sequence
  Synthetic Oligonucleotide; PD-1 exon 3; Set B
gaggggcugggaugacguu

SEQ ID NO: 6214 - RNA, 18 nt, Artificial Sequence
  Synthetic Oligonucleotide; PD-1 exon 3; Set B
gaggggcugggaugacgu

SEQ ID NO: 6215 - RNA, 17 nt, Artificial Sequence
  Synthetic Oligonucleotide; PD-1 exon 3; Set B
gaggggcugggaugacg

SEQ ID NO: 6216 - RNA, 16 nt, Artificial Sequence
  Synthetic Oligonucleotide; PD-1 exon 3; Set B
gaggggcugggaugac

SEQ ID NO: 6217 - RNA, 15 nt, Artificial Sequence
  Synthetic Oligonucleotide; PD-1 exon 3; Set C
gaggggcugggauga

SEQ ID NO: 6218 - RNA, 32 nt, Artificial Sequence
  Synthetic Oligonucleotide; PD-1 exon 3; Set C
gcagggcaggccgaggggcugggaugacguua

SEQ ID NO: 6219 - RNA, 31 nt, Artificial Sequence
  Synthetic Oligonucleotide; PD-1 exon 3; Set C
gcagggcaggccgaggggcugggaugacguu

SEQ ID NO: 6220 - RNA, 33 nt, Artificial Sequence
  Synthetic Oligonucleotide; PD-1 exon 3; Set C
ggcagggcaggccgaggggcugggaugacguua

SEQ ID NO: 6221 - RNA, 32 nt, Artificial Sequence
  Synthetic Oligonucleotide; PD-1 exon 3; Set C
ggcagggcaggccgaggggcugggaugacguu

SEQ ID NO: 6222 - RNA, 30 nt, Artificial Sequence
  Synthetic Oligonucleotide; PD-1 exon 3; Set C
gcagggcaggccgaggggcugggaugacgu

SEQ ID NO: 6223 - RNA, 34 nt, Artificial Sequence
  Synthetic Oligonucleotide; PD-1 exon 3; Set C
gggcagggcaggccgaggggcugggaugacguua

SEQ ID NO: 6224 - RNA, 31 nt, Artificial Sequence
  Synthetic Oligonucleotide; PD-1 exon 3; Set C
ggcagggcaggccgaggggcugggaugacgu

SEQ ID NO: 6225 - RNA, 29 nt, Artificial Sequence
  Synthetic Oligonucleotide; PD-1 exon 3; Set C
gcagggcaggccgaggggcugggaugacg

SEQ ID NO: 6226 - RNA, 28 nt, Artificial Sequence
  Synthetic Oligonucleotide; PD-1 exon 3; Set C
gcagggcaggccgaggggcugggaugac

SEQ ID NO: 6227 - RNA, 30 nt, Artificial Sequence
  Synthetic Oligonucleotide; PD-1 exon 3; Set C
ggcagggcaggccgaggggcugggaugacg

SEQ ID NO: 6228 - RNA, 27 nt, Artificial Sequence
  Synthetic Oligonucleotide; PD-1 exon 3; Set C
gcagggcaggccgaggggcugggauga

SEQ ID NO: 6229 - RNA, 29 nt, Artificial Sequence
  Synthetic Oligonucleotide; PD-1 exon 3; Set C
ggcagggcaggccgaggggcugggaugac

SEQ ID NO: 6230 - RNA, 31 nt, Artificial Sequence
  Synthetic Oligonucleotide; PD-1 exon 3; Set C
gggcagggcaggccgaggggcugggaugacg

SEQ ID NO: 6231 - RNA, 28 nt, Artificial Sequence
  Synthetic Oligonucleotide; PD-1 exon 3; Set C
ggcagggcaggccgaggggcugggauga

SEQ ID NO: 6232 - RNA, 26 nt, Artificial Sequence
  Synthetic Oligonucleotide; PD-1 exon 3; Set C
gcagggcaggccgaggggcugggaug

SEQ ID NO: 6233 - RNA, 30 nt, Artificial Sequence
  Synthetic Oligonucleotide; PD-1 exon 3; Set C
gggcagggcaggccgaggggcugggaugac

SEQ ID NO: 6234 - RNA, 29 nt, Artificial Sequence
  Synthetic Oligonucleotide; PD-1 exon 3; Set C
gggcagggcaggccgaggggcugggauga

SEQ ID NO: 6235 - RNA, 25 nt, Artificial Sequence
  Synthetic Oligonucleotide; PD-1 exon 3; Set C
gcagggcaggccgaggggcugggau

SEQ ID NO: 6236 - RNA, 27 nt, Artificial Sequence
  Synthetic Oligonucleotide; PD-1 exon 3; Set C
ggcagggcaggccgaggggcugggaug

SEQ ID NO: 6237 - RNA, 39 nt, Artificial Sequence
  Synthetic Oligonucleotide; PD-1 exon 3; Set C
gguuagggcagggcaggccgaggggcugggaugacguua

SEQ ID NO: 6238 - RNA, 38 nt, Artificial Sequence
  Synthetic Oligonucleotide; PD-1 exon 3; Set C
gguuagggcagggcaggccgaggggcugggaugacguu

SEQ ID NO: 6239 - RNA, 26 nt, Artificial Sequence
  Synthetic Oligonucleotide; PD-1 exon 3; Set C
ggcagggcaggccgaggggcugggau

SEQ ID NO: 6240 - RNA, 28 nt, Artificial Sequence
  Synthetic Oligonucleotide; PD-1 exon 3; Set C
gggcagggcaggccgaggggcugggaug

SEQ ID NO: 6241 - RNA, 40 nt, Artificial Sequence
  Synthetic Oligonucleotide; PD-1 exon 3; Set C
ggguuagggcagggcaggccgaggggcugggaugacguua

SEQ ID NO: 6242 - RNA, 39 nt, Artificial Sequence
  Synthetic Oligonucleotide; PD-1 exon 3; Set C
ggguuagggcagggcaggccgaggggcugggaugacguu

SEQ ID NO: 6243 - RNA, 27 nt, Artificial Sequence
  Synthetic Oligonucleotide; PD-1 exon 3; Set C
gggcagggcaggccgaggggcugggau

SEQ ID NO: 6244 - RNA, 37 nt, Artificial Sequence
  Synthetic Oligonucleotide; PD-1 exon 3; Set C
gguuagggcagggcaggccgaggggcugggaugacgu

SEQ ID NO: 6245 - RNA, 40 nt, Artificial Sequence
  Synthetic Oligonucleotide; PD-1 exon 3; Set C
aggguuagggcagggcaggccgaggggcugggaugacguu

SEQ ID NO: 6246 - RNA, 28 nt, Artificial Sequence
  Synthetic Oligonucleotide; PD-1 exon 3; Set C
agggcagggcaggccgaggggcugggau

SEQ ID NO: 6247 - RNA, 36 nt, Artificial Sequence
  Synthetic Oligonucleotide; PD-1 exon 3; Set C
gguuagggcagggcaggccgaggggcugggaugacg

SEQ ID NO: 6248 - RNA, 38 nt, Artificial Sequence
  Synthetic Oligonucleotide; PD-1 exon 3; Set C
ggguuagggcagggcaggccgaggggcugggaugacgu

SEQ ID NO: 6249 - RNA, 26 nt, Artificial Sequence
  Synthetic Oligonucleotide; PD-1 exon 3; Set C
gggcagggcaggccgaggggcuggga

SEQ ID NO: 6250 - RNA, 35 nt, Artificial Sequence
  Synthetic Oligonucleotide; PD-1 exon 3; Set C
gguuagggcagggcaggccgaggggcugggaugac

SEQ ID NO: 6251 - RNA, 37 nt, Artificial Sequence
  Synthetic Oligonucleotide; PD-1 exon 3; Set C
ggguuagggcagggcaggccgaggggcugggaugacg

SEQ ID NO: 6252 - RNA, 39 nt, Artificial Sequence
  Synthetic Oligonucleotide; PD-1 exon 3; Set C
aggguuagggcagggcaggccgaggggcugggaugacgu

SEQ ID NO: 6253 - RNA, 27 nt, Artificial Sequence
  Synthetic Oligonucleotide; PD-1 exon 3; Set C
agggcagggcaggccgaggggcuggga

SEQ ID NO: 6254 - RNA, 25 nt, Artificial Sequence
  Synthetic Oligonucleotide; PD-1 exon 3; Set C
gggcagggcaggccgaggggcuggg

SEQ ID NO: 6255 - RNA, 34 nt, Artificial Sequence
  Synthetic Oligonucleotide; PD-1 exon 3; Set C
gguuagggcagggcaggccgaggggcugggauga

SEQ ID NO: 6256 - RNA, 36 nt, Artificial Sequence
  Synthetic Oligonucleotide; PD-1 exon 3; Set C
ggguuagggcagggcaggccgaggggcugggaugac

SEQ ID NO: 6257 - RNA, 28 nt, Artificial Sequence
  Synthetic Oligonucleotide; PD-1 exon 3; Set C
uagggcagggcaggccgaggggcuggga

SEQ ID NO: 6258 - RNA, 26 nt, Artificial Sequence
  Synthetic Oligonucleotide; PD-1 exon 3; Set C
agggcagggcaggccgaggggcuggg

SEQ ID NO: 6259 - RNA, 24 nt, Artificial Sequence
  Synthetic Oligonucleotide; PD-1 exon 3; Set C
gggcagggcaggccgaggggcugg

SEQ ID NO: 6260 - RNA, 35 nt, Artificial Sequence
  Synthetic Oligonucleotide; PD-1 exon 3; Set C
ggguuagggcagggcaggccgaggggcugggauga

SEQ ID NO: 6261 - RNA, 33 nt, Artificial Sequence
  Synthetic Oligonucleotide; PD-1 exon 3; Set C
gguuagggcagggcaggccgaggggcugggaug

SEQ ID NO: 6262 - RNA, 29 nt, Artificial Sequence
  Synthetic Oligonucleotide; PD-1 exon 3; Set C
uuagggcagggcaggccgaggggcuggga

SEQ ID NO: 6263 - RNA, 27 nt, Artificial Sequence
  Synthetic Oligonucleotide; PD-1 exon 3; Set C
uagggcagggcaggccgaggggcuggg

SEQ ID NO: 6264 - RNA, 25 nt, Artificial Sequence
  Synthetic Oligonucleotide; PD-1 exon 3; Set C
agggcagggcaggccgaggggcugg

SEQ ID NO: 6265 - RNA, 32 nt, Artificial Sequence
  Synthetic Oligonucleotide; PD-1 exon 3; Set C
gguuagggcagggcaggccgaggggcugggau

SEQ ID NO: 6266 - RNA, 34 nt, Artificial Sequence
  Synthetic Oligonucleotide; PD-1 exon 3; Set C
ggguuagggcagggcaggccgaggggcugggaug

SEQ ID NO: 6267 - RNA, 30 nt, Artificial Sequence
  Synthetic Oligonucleotide; PD-1 exon 3; Set C
guuagggcagggcaggccgaggggcuggga

SEQ ID NO: 6268 - RNA, 28 nt, Artificial Sequence
  Synthetic Oligonucleotide; PD-1 exon 3; Set C
uuagggcagggcaggccgaggggcuggg

SEQ ID NO: 6269 - RNA, 26 nt, Artificial Sequence
  Synthetic Oligonucleotide; PD-1 exon 3; Set C
uagggcagggcaggccgaggggcugg

SEQ ID NO: 6270 - RNA, 24 nt, Artificial Sequence
  Synthetic Oligonucleotide; PD-1 exon 3; Set C
agggcagggcaggccgaggggcug

SEQ ID NO: 6271 - RNA, 33 nt, Artificial Sequence
  Synthetic Oligonucleotide; PD-1 exon 3; Set C
ggguuagggcagggcaggccgaggggcugggau

SEQ ID NO: 6272 - RNA, 29 nt, Artificial Sequence
  Synthetic Oligonucleotide; PD-1 exon 3; Set C
guuagggcagggcaggccgaggggcuggg

SEQ ID NO: 6273 - RNA, 27 nt, Artificial Sequence
  Synthetic Oligonucleotide; PD-1 exon 3; Set C
uuagggcagggcaggccgaggggcugg

SEQ ID NO: 6274 - RNA, 25 nt, Artificial Sequence
  Synthetic Oligonucleotide; PD-1 exon 3; Set C
uagggcagggcaggccgaggggcug

SEQ ID NO: 6275 - RNA, 28 nt, Artificial Sequence
  Synthetic Oligonucleotide; PD-1 exon 3; Set C
guuagggcagggcaggccgaggggcugg

SEQ ID NO: 6276 - RNA, 26 nt, Artificial Sequence
  Synthetic Oligonucleotide; PD-1 exon 3; Set C
uuagggcagggcaggccgaggggcug

SEQ ID NO: 6277 - RNA, 24 nt, Artificial Sequence
  Synthetic Oligonucleotide; PD-1 exon 3; Set C
uagggcagggcaggccgaggggcu

SEQ ID NO: 6278 - RNA, 27 nt, Artificial Sequence
  Synthetic Oligonucleotide; PD-1 exon 3; Set C
guuagggcagggcaggccgaggggcug

SEQ ID NO: 6279 - RNA, 25 nt, Artificial Sequence
  Synthetic Oligonucleotide; PD-1 exon 3; Set C
uuagggcagggcaggccgaggggcu

SEQ ID NO: 6280 - RNA, 26 nt, Artificial Sequence
  Synthetic Oligonucleotide; PD-1 exon 3; Set C
guuagggcagggcaggccgaggggcu

SEQ ID NO: 6281 - RNA, 24 nt, Artificial Sequence
  Synthetic Oligonucleotide; PD-1 exon 3; Set C
uuagggcagggcaggccgaggggc

SEQ ID NO: 6282 - RNA, 25 nt, Artificial Sequence
  Synthetic Oligonucleotide; PD-1 exon 3; Set C
guuagggcagggcaggccgaggggc

SEQ ID NO: 6283 - RNA, 27 nt, Artificial Sequence
  Synthetic Oligonucleotide; PD-1 exon 3; Set C
gguuaggacggggucaggguggagggu

SEQ ID NO: 6284 - RNA, 28 nt, Artificial Sequence
  Synthetic Oligonucleotide; PD-1 exon 3; Set C
ggguuaggacggggucaggguggagggu

SEQ ID NO: 6285 - RNA, 15 nt, Artificial Sequence
  Synthetic Oligonucleotide; PD-1 exon 3; Set A
ggacggggucagggu

SEQ ID NO: 6286 - RNA, 20 nt, Artificial Sequence
  Synthetic Oligonucleotide; PD-1 exon 3; Set C
gguuaggacggggucagggu

SEQ ID NO: 6287 - RNA, 34 nt, Artificial Sequence
  Synthetic Oligonucleotide; PD-1 exon 3; Set C
ggucagggguuaggacggggucaggguggagggu

SEQ ID NO: 6288 - RNA, 21 nt, Artificial Sequence
  Synthetic Oligonucleotide; PD-1 exon 3; Set C
ggguuaggacggggucagggu

SEQ ID NO: 6289 - RNA, 35 nt, Artificial Sequence
  Synthetic Oligonucleotide; PD-1 exon 3; Set C
aggucagggguuaggacggggucaggguggagggu

SEQ ID NO: 6290 - RNA, 21 nt, Artificial Sequence
  Synthetic Oligonucleotide; PD-1 exon 3; Set C
gggguuaggacggggucaggg

SEQ ID NO: 6291 - RNA, 23 nt, Artificial Sequence
  Synthetic Oligonucleotide; PD-1 exon 3; Set C
agggguuaggacggggucagggu

SEQ ID NO: 6292 - RNA, 22 nt, Artificial Sequence
  Synthetic Oligonucleotide; PD-1 exon 3; Set C
agggguuaggacggggucaggg

SEQ ID NO: 6293 - RNA, 20 nt, Artificial Sequence
  Synthetic Oligonucleotide; PD-1 exon 3; Set C
gggguuaggacggggucagg

SEQ ID NO: 6294 - RNA, 23 nt, Artificial Sequence
  Synthetic Oligonucleotide; PD-1 exon 3; Set C
cagggguuaggacggggucaggg

SEQ ID NO: 6295 - RNA, 21 nt, Artificial Sequence
  Synthetic Oligonucleotide; PD-1 exon 3; Set C
agggguuaggacggggucagg

SEQ ID NO: 6296 - RNA, 24 nt, Artificial Sequence
  Synthetic Oligonucleotide; PD-1 exon 3; Set C
ucagggguuaggacggggucaggg

SEQ ID NO: 6297 - RNA, 25 nt, Artificial Sequence
  Synthetic Oligonucleotide; PD-1 exon 3; Set C
gucagggguuaggacggggucaggg

SEQ ID NO: 6298 - RNA, 23 nt, Artificial Sequence
  Synthetic Oligonucleotide; PD-1 exon 3; Set C
ucagggguuaggacggggucagg

SEQ ID NO: 6299 - RNA, 27 nt, Artificial Sequence
  Synthetic Oligonucleotide; PD-1 exon 3; Set C
ggucagggguuaggacggggucagggu

SEQ ID NO: 6300 - RNA, 15 nt, Artificial Sequence
  Synthetic Oligonucleotide; PD-1 exon 3; Set C
ggguuaggacggggu

SEQ ID NO: 6301 - RNA, 24 nt, Artificial Sequence
  Synthetic Oligonucleotide; PD-1 exon 3; Set C
gucagggguuaggacggggucagg

SEQ ID NO: 6302 - RNA, 28 nt, Artificial Sequence
  Synthetic Oligonucleotide; PD-1 exon 3; Set C
aggucagggguuaggacggggucagggu

SEQ ID NO: 6303 - RNA, 29 nt, Artificial Sequence
  Synthetic Oligonucleotide; PD-1 exon 3; Set C
aaggucagggguuaggacggggucagggu

SEQ ID NO: 6304 - RNA, 28 nt, Artificial Sequence
  Synthetic Oligonucleotide; PD-1 exon 3; Set C
aaggucagggguuaggacggggucaggg

SEQ ID NO: 6305 - RNA, 26 nt, Artificial Sequence
  Synthetic Oligonucleotide; PD-1 exon 3; Set C
aggucagggguuaggacggggucagg

SEQ ID NO: 6306 - RNA, 16 nt, Artificial Sequence
  Synthetic Oligonucleotide; PD-1 exon 3; Set C
agggguuaggacgggg

SEQ ID NO: 6307 - RNA, 27 nt, Artificial Sequence
  Synthetic Oligonucleotide; PD-1 exon 3; Set C
aaggucagggguuaggacggggucagg

SEQ ID NO: 6308 - RNA, 15 nt, Artificial Sequence
  Synthetic Oligonucleotide; PD-1 exon 3; Set C
agggguuaggacggg

SEQ ID NO: 6309 - RNA, 21 nt, Artificial Sequence
  Synthetic Oligonucleotide; PD-1 exon 3; Set C
ggucagggguuaggacggggu

SEQ ID NO: 6310 - RNA, 20 nt, Artificial Sequence
  Synthetic Oligonucleotide; PD-1 exon 3; Set C
ggucagggguuaggacgggg

SEQ ID NO: 6311 - RNA, 22 nt, Artificial Sequence
  Synthetic Oligonucleotide; PD-1 exon 3; Set C
aggucagggguuaggacggggu

SEQ ID NO: 6312 - RNA, 19 nt, Artificial Sequence
  Synthetic Oligonucleotide; PD-1 exon 3; Set A
ggucagggguuaggacggg

SEQ ID NO: 6313 - RNA, 21 nt, Artificial Sequence
  Synthetic Oligonucleotide; PD-1 exon 3; Set C
aggucagggguuaggacgggg

SEQ ID NO: 6314 - RNA, 23 nt, Artificial Sequence
  Synthetic Oligonucleotide; PD-1 exon 3; Set C
aaggucagggguuaggacggggu

SEQ ID NO: 6315 - RNA, 20 nt, Artificial Sequence
  Synthetic Oligonucleotide; PD-1 exon 3; Set A
aggucagggguuaggacggg

SEQ ID NO: 6316 - RNA, 22 nt, Artificial Sequence
  Synthetic Oligonucleotide; PD-1 exon 3; Set A
aaggucagggguuaggacgggg

SEQ ID NO: 6317 - RNA, 21 nt, Artificial Sequence
  Synthetic Oligonucleotide; PD-1 exon 3; Set A
aaggucagggguuaggacggg

SEQ ID NO: 6318 - RNA, 15 nt, Artificial Sequence
  Synthetic Oligonucleotide; PD-1 exon 3; Set C
aggucagggguuagg

SEQ ID NO: 6319 - RNA, 16 nt, Artificial Sequence
  Synthetic Oligonucleotide; PD-1 exon 3; Set C
aaggucagggguuagg

SEQ ID NO: 6320 - RNA, 15 nt, Artificial Sequence
  Synthetic Oligonucleotide; PD-1 exon 3; Set C
aaggucagggguuag

SEQ ID NO: 6321 - RNA, 36 nt, Artificial Sequence
  Synthetic Oligonucleotide; PD-1 exon 3; Set C
cuggaagggcacaaaggucagggguuaggacggggu

SEQ ID NO: 6322 - RNA, 35 nt, Artificial Sequence
  Synthetic Oligonucleotide; PD-1 exon 3; Set C
cuggaagggcacaaaggucagggguuaggacgggg

SEQ ID NO: 6323 - RNA, 37 nt, Artificial Sequence
  Synthetic Oligonucleotide; PD-1 exon 3; Set C
ucuggaagggcacaaaggucagggguuaggacggggu

SEQ ID NO: 6324 - RNA, 34 nt, Artificial Sequence
  Synthetic Oligonucleotide; PD-1 exon 3; Set C
cuggaagggcacaaaggucagggguuaggacggg

SEQ ID NO: 6325 - RNA, 36 nt, Artificial Sequence
  Synthetic Oligonucleotide; PD-1 exon 3; Set C
ucuggaagggcacaaaggucagggguuaggacgggg

SEQ ID NO: 6326 - RNA, 38 nt, Artificial Sequence
  Synthetic Oligonucleotide; PD-1 exon 3; Set C
cucuggaagggcacaaaggucagggguuaggacggggu

SEQ ID NO: 6327 - RNA, 35 nt, Artificial Sequence
  Synthetic Oligonucleotide; PD-1 exon 3; Set C
ucuggaagggcacaaaggucagggguuaggacggg

SEQ ID NO: 6328 - RNA, 37 nt, Artificial Sequence
  Synthetic Oligonucleotide; PD-1 exon 3; Set C
cucuggaagggcacaaaggucagggguuaggacgggg

SEQ ID NO: 6329 - RNA, 39 nt, Artificial Sequence
  Synthetic Oligonucleotide; PD-1 exon 3; Set C
ucucuggaagggcacaaaggucagggguuaggacggggu

SEQ ID NO: 6330 - RNA, 36 nt, Artificial Sequence
  Synthetic Oligonucleotide; PD-1 exon 3; Set C
cucuggaagggcacaaaggucagggguuaggacggg

SEQ ID NO: 6331 - RNA, 37 nt, Artificial Sequence
  Synthetic Oligonucleotide; PD-1 exon 3; Set C
ucucuggaagggcacaaaggucagggguuaggacggg

SEQ ID NO: 6332 - RNA, 29 nt, Artificial Sequence
  Synthetic Oligonucleotide; PD-1 exon 3; Set C
cuggaagggcacaaaggucagggguuagg

SEQ ID NO: 6333 - RNA, 28 nt, Artificial Sequence
  Synthetic Oligonucleotide; PD-1 exon 3; Set C
cuggaagggcacaaaggucagggguuag

SEQ ID NO: 6334 - RNA, 30 nt, Artificial Sequence
  Synthetic Oligonucleotide; PD-1 exon 3; Set C
ucuggaagggcacaaaggucagggguuagg

SEQ ID NO: 6335 - RNA, 27 nt, Artificial Sequence
  Synthetic Oligonucleotide; PD-1 exon 3; Set C
cuggaagggcacaaaggucagggguua

SEQ ID NO: 6336 - RNA, 29 nt, Artificial Sequence
  Synthetic Oligonucleotide; PD-1 exon 3; Set C
ucuggaagggcacaaaggucagggguuag

SEQ ID NO: 6337 - RNA, 31 nt, Artificial Sequence
  Synthetic Oligonucleotide; PD-1 exon 3; Set C
cucuggaagggcacaaaggucagggguuagg

SEQ ID NO: 6338 - RNA, 26 nt, Artificial Sequence
  Synthetic Oligonucleotide; PD-1 exon 3; Set C
cuggaagggcacaaaggucagggguu

SEQ ID NO: 6339 - RNA, 28 nt, Artificial Sequence
  Synthetic Oligonucleotide; PD-1 exon 3; Set C
ucuggaagggcacaaaggucagggguua

SEQ ID NO: 6340 - RNA, 30 nt, Artificial Sequence
  Synthetic Oligonucleotide; PD-1 exon 3; Set C
cucuggaagggcacaaaggucagggguuag

SEQ ID NO: 6341 - RNA, 32 nt, Artificial Sequence
  Synthetic Oligonucleotide; PD-1 exon 3; Set C
ucucuggaagggcacaaaggucagggguuagg

SEQ ID NO: 6342 - RNA, 27 nt, Artificial Sequence
  Synthetic Oligonucleotide; PD-1 exon 3; Set C
ucuggaagggcacaaaggucagggguu

SEQ ID NO: 6343 - RNA, 29 nt, Artificial Sequence
  Synthetic Oligonucleotide; PD-1 exon 3; Set C
cucuggaagggcacaaaggucagggguua

SEQ ID NO: 6344 - RNA, 31 nt, Artificial Sequence
  Synthetic Oligonucleotide; PD-1 exon 3; Set C
ucucuggaagggcacaaaggucagggguuag

SEQ ID NO: 6345 - RNA, 28 nt, Artificial Sequence
  Synthetic Oligonucleotide; PD-1 exon 3; Set C
cucuggaagggcacaaaggucagggguu

SEQ ID NO: 6346 - RNA, 30 nt, Artificial Sequence
  Synthetic Oligonucleotide; PD-1 exon 3; Set C
ucucuggaagggcacaaaggucagggguua

SEQ ID NO: 6347 - RNA, 22 nt, Artificial Sequence
  Synthetic Oligonucleotide; PD-1 exon 3; Set C
uggaacuggccggcuggccugg

SEQ ID NO: 6348 - RNA, 23 nt, Artificial Sequence
  Synthetic Oligonucleotide; PD-1 exon 3; Set C
uuggaacuggccggcuggccugg

SEQ ID NO: 6349 - RNA, 24 nt, Artificial Sequence
  Synthetic Oligonucleotide; PD-1 exon 3; Set C
uuuggaacuggccggcuggccugg

SEQ ID NO: 6350 - RNA, 22 nt, Artificial Sequence
  Synthetic Oligonucleotide; PD-1 exon 3; Set C
uuggaacuggccggcuggccug

SEQ ID NO: 6351 - RNA, 25 nt, Artificial Sequence
  Synthetic Oligonucleotide; PD-1 exon 3; Set C
guuuggaacuggccggcuggccugg

SEQ ID NO: 6352 - RNA, 23 nt, Artificial Sequence
  Synthetic Oligonucleotide; PD-1 exon 3; Set C
uuuggaacuggccggcuggccug

SEQ ID NO: 6353 - RNA, 26 nt, Artificial Sequence
  Synthetic Oligonucleotide; PD-1 exon 3; Set C
gguuuggaacuggccggcuggccugg

SEQ ID NO: 6354 - RNA, 24 nt, Artificial Sequence
  Synthetic Oligonucleotide; PD-1 exon 3; Set C
guuuggaacuggccggcuggccug

SEQ ID NO: 6355 - RNA, 25 nt, Artificial Sequence
  Synthetic Oligonucleotide; PD-1 exon 3; Set C
gguuuggaacuggccggcuggccug

SEQ ID NO: 6356 - RNA, 31 nt, Artificial Sequence
  Synthetic Oligonucleotide; PD-1 exon 3; Set C
gggagcagaugacggccaggacccagacuag

SEQ ID NO: 6357 - RNA, 29 nt, Artificial Sequence
  Synthetic Oligonucleotide; PD-1 exon 3; Set C
uuaccucgugcggcccgggagcagaugac

SEQ ID NO: 6358 - RNA, 24 nt, Artificial Sequence
  Synthetic Oligonucleotide; PD-1 exon 3; Set C
uuaccucgugcggcccgggagcag

SEQ ID NO: 6359 - RNA, 23 nt, Artificial Sequence
  Synthetic Oligonucleotide; PD-1 exon 3; Set C
uuaccucgugcggcccgggagca

SEQ ID NO: 6360 - RNA, 22 nt, Artificial Sequence
  Synthetic Oligonucleotide; PD-1 exon 3; Set C
uuaccucgugcggcccgggagc

SEQ ID NO: 6361 - RNA, 21 nt, Artificial Sequence
  Synthetic Oligonucleotide; PD-1 exon 3; Set C
uuaccucgugcggcccgggag

SEQ ID NO: 6362 - RNA, 20 nt, Artificial Sequence
  Synthetic Oligonucleotide; PD-1 exon 3; Set C
uuaccucgugcggcccggga

SEQ ID NO: 6363 - RNA, 19 nt, Artificial Sequence
  Synthetic Oligonucleotide; PD-1 exon 3; Set C
uuaccucgugcggcccggg

SEQ ID NO: 6364 - RNA, 21 nt, Artificial Sequence
  Synthetic Oligonucleotide; PD-1 exon 3; Set C
guuaccucgugcggcccggga

SEQ ID NO: 6365 - RNA, 20 nt, Artificial Sequence
  Synthetic Oligonucleotide; PD-1 exon 3; Set C
guuaccucgugcggcccggg

SEQ ID NO: 6366 - RNA, 21 nt, Artificial Sequence
  Synthetic Oligonucleotide; PD-1 exon 3; Set C
cguuaccucgugcggcccggg

SEQ ID NO: 6367 - RNA, 17 nt, Artificial Sequence
  Synthetic Oligonucleotide; PD-1 exon 3; Set B
gggcugggaugacguua

SEQ ID NO: 6368 - RNA, 16 nt, Artificial Sequence
  Synthetic Oligonucleotide; PD-1 exon 3; Set C
gggcugggaugacguu

SEQ ID NO: 6369 - RNA, 18 nt, Artificial Sequence
  Synthetic Oligonucleotide; PD-1 exon 3; Set B
ggggcugggaugacguua

SEQ ID NO: 6370 - RNA, 17 nt, Artificial Sequence
  Synthetic Oligonucleotide; PD-1 exon 3; Set B
ggggcugggaugacguu

SEQ ID NO: 6371 - RNA, 15 nt, Artificial Sequence
  Synthetic Oligonucleotide; PD-1 exon 3; Set C
gggcugggaugacgu

SEQ ID NO: 6372 - RNA, 19 nt, Artificial Sequence
  Synthetic Oligonucleotide; PD-1 exon 3; Set B
aggggcugggaugacguua

SEQ ID NO: 6373 - RNA, 16 nt, Artificial Sequence
  Synthetic Oligonucleotide; PD-1 exon 3; Set B
ggggcugggaugacgu

SEQ ID NO: 6374 - RNA, 20 nt, Artificial Sequence
  Synthetic Oligonucleotide; PD-1 exon 3; Set B
gaggggcugggaugacguua

SEQ ID NO: 6375 - RNA, 17 nt, Artificial Sequence
  Synthetic Oligonucleotide; PD-1 exon 3; Set B
aggggcugggaugacgu

SEQ ID NO: 6376 - RNA, 15 nt, Artificial Sequence
  Synthetic Oligonucleotide; PD-1 exon 3; Set C
ggggcugggaugacg

SEQ ID NO: 6377 - RNA, 16 nt, Artificial Sequence
  Synthetic Oligonucleotide; PD-1 exon 3; Set B
aggggcugggaugacg

SEQ ID NO: 6378 - RNA, 15 nt, Artificial Sequence
  Synthetic Oligonucleotide; PD-1 exon 3; Set C
aggggcugggaugac

SEQ ID NO: 6379 - RNA, 24 nt, Artificial Sequence
  Synthetic Oligonucleotide; PD-1 exon 3; Set C
gcagggcaggccgaggggcuggga

SEQ ID NO: 6380 - RNA, 25 nt, Artificial Sequence
  Synthetic Oligonucleotide; PD-1 exon 3; Set C
ggcagggcaggccgaggggcuggga

SEQ ID NO: 6381 - RNA, 23 nt, Artificial Sequence
  Synthetic Oligonucleotide; PD-1 exon 3; Set C
gcagggcaggccgaggggcuggg

SEQ ID NO: 6382 - RNA, 24 nt, Artificial Sequence
  Synthetic Oligonucleotide; PD-1 exon 3; Set C
ggcagggcaggccgaggggcuggg

SEQ ID NO: 6383 - RNA, 22 nt, Artificial Sequence
  Synthetic Oligonucleotide; PD-1 exon 3; Set C
gcagggcaggccgaggggcugg

SEQ ID NO: 6384 - RNA, 23 nt, Artificial Sequence
  Synthetic Oligonucleotide; PD-1 exon 3; Set C
ggcagggcaggccgaggggcugg

SEQ ID NO: 6385 - RNA, 21 nt, Artificial Sequence
  Synthetic Oligonucleotide; PD-1 exon 3; Set C
gcagggcaggccgaggggcug

SEQ ID NO: 6386 - RNA, 38 nt, Artificial Sequence
  Synthetic Oligonucleotide; PD-1 exon 3; Set C
aggguuagggcagggcaggccgaggggcugggaugacg

SEQ ID NO: 6387 - RNA, 22 nt, Artificial Sequence
  Synthetic Oligonucleotide; PD-1 exon 3; Set C
ggcagggcaggccgaggggcug

SEQ ID NO: 6388 - RNA, 37 nt, Artificial Sequence
  Synthetic Oligonucleotide; PD-1 exon 3; Set C
aggguuagggcagggcaggccgaggggcugggaugac

SEQ ID NO: 6389 - RNA, 23 nt, Artificial Sequence
  Synthetic Oligonucleotide; PD-1 exon 3; Set C
gggcagggcaggccgaggggcug

SEQ ID NO: 6390 - RNA, 21 nt, Artificial Sequence
  Synthetic Oligonucleotide; PD-1 exon 3; Set C
ggcagggcaggccgaggggcu

SEQ ID NO: 6391 - RNA, 36 nt, Artificial Sequence
  Synthetic Oligonucleotide; PD-1 exon 3; Set C
aggguuagggcagggcaggccgaggggcugggauga

SEQ ID NO: 6392 - RNA, 22 nt, Artificial Sequence
  Synthetic Oligonucleotide; PD-1 exon 3; Set C
gggcagggcaggccgaggggcu

SEQ ID NO: 6393 - RNA, 35 nt, Artificial Sequence
  Synthetic Oligonucleotide; PD-1 exon 3; Set C
aggguuagggcagggcaggccgaggggcugggaug

SEQ ID NO: 6394 - RNA, 31 nt, Artificial Sequence
  Synthetic Oligonucleotide; PD-1 exon 3; Set C
gguuagggcagggcaggccgaggggcuggga

SEQ ID NO: 6395 - RNA, 23 nt, Artificial Sequence
  Synthetic Oligonucleotide; PD-1 exon 3; Set C
agggcagggcaggccgaggggcu

SEQ ID NO: 6396 - RNA, 21 nt, Artificial Sequence
  Synthetic Oligonucleotide; PD-1 exon 3; Set C
gggcagggcaggccgaggggc

SEQ ID NO: 6397 - RNA, 34 nt, Artificial Sequence
  Synthetic Oligonucleotide; PD-1 exon 3; Set C
aggguuagggcagggcaggccgaggggcugggau

SEQ ID NO: 6398 - RNA, 32 nt, Artificial Sequence
  Synthetic Oligonucleotide; PD-1 exon 3; Set C
ggguuagggcagggcaggccgaggggcuggga

SEQ ID NO: 6399 - RNA, 30 nt, Artificial Sequence
  Synthetic Oligonucleotide; PD-1 exon 3; Set C
gguuagggcagggcaggccgaggggcuggg

SEQ ID NO: 6400 - RNA, 22 nt, Artificial Sequence
  Synthetic Oligonucleotide; PD-1 exon 3; Set C
agggcagggcaggccgaggggc

SEQ ID NO: 6401 - RNA, 33 nt, Artificial Sequence
  Synthetic Oligonucleotide; PD-1 exon 3; Set C
aggguuagggcagggcaggccgaggggcuggga

SEQ ID NO: 6402 - RNA, 31 nt, Artificial Sequence
  Synthetic Oligonucleotide; PD-1 exon 3; Set C
ggguuagggcagggcaggccgaggggcuggg

SEQ ID NO: 6403 - RNA, 29 nt, Artificial Sequence
  Synthetic Oligonucleotide; PD-1 exon 3; Set C
gguuagggcagggcaggccgaggggcugg

SEQ ID NO: 6404 - RNA, 23 nt, Artificial Sequence
  Synthetic Oligonucleotide; PD-1 exon 3; Set C
uagggcagggcaggccgaggggc

SEQ ID NO: 6405 - RNA, 32 nt, Artificial Sequence
  Synthetic Oligonucleotide; PD-1 exon 3; Set C
aggguuagggcagggcaggccgaggggcuggg

SEQ ID NO: 6406 - RNA, 30 nt, Artificial Sequence
  Synthetic Oligonucleotide; PD-1 exon 3; Set C
ggguuagggcagggcaggccgaggggcugg

SEQ ID NO: 6407 - RNA, 28 nt, Artificial Sequence
  Synthetic Oligonucleotide; PD-1 exon 3; Set C
gguuagggcagggcaggccgaggggcug

SEQ ID NO: 6408 - RNA, 31 nt, Artificial Sequence
  Synthetic Oligonucleotide; PD-1 exon 3; Set C
aggguuagggcagggcaggccgaggggcugg

SEQ ID NO: 6409 - RNA, 29 nt, Artificial Sequence
  Synthetic Oligonucleotide; PD-1 exon 3; Set C
ggguuagggcagggcaggccgaggggcug

SEQ ID NO: 6410 - RNA, 27 nt, Artificial Sequence
  Synthetic Oligonucleotide; PD-1 exon 3; Set C
gguuagggcagggcaggccgaggggcu

SEQ ID NO: 6411 - RNA, 30 nt, Artificial Sequence
  Synthetic Oligonucleotide; PD-1 exon 3; Set C
aggguuagggcagggcaggccgaggggcug

SEQ ID NO: 6412 - RNA, 26 nt, Artificial Sequence
  Synthetic Oligonucleotide; PD-1 exon 3; Set C
gguuagggcagggcaggccgaggggc

SEQ ID NO: 6413 - RNA, 28 nt, Artificial Sequence
  Synthetic Oligonucleotide; PD-1 exon 3; Set C
ggguuagggcagggcaggccgaggggcu

SEQ ID NO: 6414 - RNA, 27 nt, Artificial Sequence
  Synthetic Oligonucleotide; PD-1 exon 3; Set C
ggguuagggcagggcaggccgaggggc

SEQ ID NO: 6415 - RNA, 15 nt, Artificial Sequence
  Synthetic Oligonucleotide; PD-1 exon 3; Set C
ccagcaggguuaggg

SEQ ID NO: 6416 - RNA, 16 nt, Artificial Sequence
  Synthetic Oligonucleotide; PD-1 exon 3; Set B
gccagcaggguuaggg

SEQ ID NO: 6417 - RNA, 15 nt, Artificial Sequence
  Synthetic Oligonucleotide; PD-1 exon 3; Set C
gccagcaggguuagg

SEQ ID NO: 6418 - RNA, 15 nt, Artificial Sequence
  Synthetic Oligonucleotide; PD-1 exon 3; Set C
gucaggguggagggu

SEQ ID NO: 6419 - RNA, 19 nt, Artificial Sequence
  Synthetic Oligonucleotide; PD-1 exon 3; Set C
cggggucaggguggagggu

SEQ ID NO: 6420 - RNA, 20 nt, Artificial Sequence
  Synthetic Oligonucleotide; PD-1 exon 3; Set C
acggggucaggguggagggu

SEQ ID NO: 6421 - RNA, 21 nt, Artificial Sequence
  Synthetic Oligonucleotide; PD-1 exon 3; Set C
gacggggucaggguggagggu

SEQ ID NO: 6422 - RNA, 22 nt, Artificial Sequence
  Synthetic Oligonucleotide; PD-1 exon 3; Set C
ggacggggucaggguggagggu

SEQ ID NO: 6423 - RNA, 21 nt, Artificial Sequence
  Synthetic Oligonucleotide; PD-1 exon 3; Set A
uaggacggggucaggguggag

SEQ ID NO: 6424 - RNA, 25 nt, Artificial Sequence
  Synthetic Oligonucleotide; PD-1 exon 3; Set C
guuaggacggggucaggguggaggg

SEQ ID NO: 6425 - RNA, 22 nt, Artificial Sequence
  Synthetic Oligonucleotide; PD-1 exon 3; Set A
uuaggacggggucaggguggag

SEQ ID NO: 6426 - RNA, 24 nt, Artificial Sequence
  Synthetic Oligonucleotide; PD-1 exon 3; Set C
guuaggacggggucaggguggagg

SEQ ID NO: 6427 - RNA, 29 nt, Artificial Sequence
  Synthetic Oligonucleotide; PD-1 exon 3; Set C
gggguuaggacggggucaggguggagggu

SEQ ID NO: 6428 - RNA, 23 nt, Artificial Sequence
  Synthetic Oligonucleotide; PD-1 exon 3; Set C
guuaggacggggucaggguggag

SEQ ID NO: 6429 - RNA, 30 nt, Artificial Sequence
  Synthetic Oligonucleotide; PD-1 exon 3; Set C
agggguuaggacggggucaggguggagggu

SEQ ID NO: 6430 - RNA, 31 nt, Artificial Sequence
  Synthetic Oligonucleotide; PD-1 exon 3; Set C
cagggguuaggacggggucaggguggagggu

SEQ ID NO: 6431 - RNA, 32 nt, Artificial Sequence
  Synthetic Oligonucleotide; PD-1 exon 3; Set C
ucagggguuaggacggggucaggguggagggu

SEQ ID NO: 6432 - RNA, 33 nt, Artificial Sequence
  Synthetic Oligonucleotide; PD-1 exon 3; Set C
gucagggguuaggacggggucaggguggagggu

SEQ ID NO: 6433 - RNA, 22 nt, Artificial Sequence
  Synthetic Oligonucleotide; PD-1 exon 3; Set C
gggguuaggacggggucagggu

SEQ ID NO: 6434 - RNA, 36 nt, Artificial Sequence
  Synthetic Oligonucleotide; PD-1 exon 3; Set C
aaggucagggguuaggacggggucaggguggagggu

SEQ ID NO: 6435 - RNA, 17 nt, Artificial Sequence
  Synthetic Oligonucleotide; PD-1 exon 3; Set C
gguuaggacggggucag

SEQ ID NO: 6436 - RNA, 24 nt, Artificial Sequence
  Synthetic Oligonucleotide; PD-1 exon 3; Set C
cagggguuaggacggggucagggu

SEQ ID NO: 6437 - RNA, 18 nt, Artificial Sequence
  Synthetic Oligonucleotide; PD-1 exon 3; Set A
ggguuaggacggggucag

SEQ ID NO: 6438 - RNA, 16 nt, Artificial Sequence
  Synthetic Oligonucleotide; PD-1 exon 3; Set C
gguuaggacgggguca

SEQ ID NO: 6439 - RNA, 25 nt, Artificial Sequence
  Synthetic Oligonucleotide; PD-1 exon 3; Set C
ucagggguuaggacggggucagggu

SEQ ID NO: 6440 - RNA, 17 nt, Artificial Sequence
  Synthetic Oligonucleotide; PD-1 exon 3; Set A
ggguuaggacgggguca

SEQ ID NO: 6441 - RNA, 15 nt, Artificial Sequence
  Synthetic Oligonucleotide; PD-1 exon 3; Set C
gguuaggacgggguc

SEQ ID NO: 6442 - RNA, 22 nt, Artificial Sequence
  Synthetic Oligonucleotide; PD-1 exon 3; Set C
cagggguuaggacggggucagg

SEQ ID NO: 6443 - RNA, 26 nt, Artificial Sequence
  Synthetic Oligonucleotide; PD-1 exon 3; Set C
gucagggguuaggacggggucagggu

SEQ ID NO: 6444 - RNA, 16 nt, Artificial Sequence
  Synthetic Oligonucleotide; PD-1 exon 3; Set A
ggguuaggacgggguc

SEQ ID NO: 6445 - RNA, 16 nt, Artificial Sequence
  Synthetic Oligonucleotide; PD-1 exon 3; Set A
gggguuaggacggggu

SEQ ID NO: 6446 - RNA, 15 nt, Artificial Sequence
  Synthetic Oligonucleotide; PD-1 exon 3; Set C
gggguuaggacgggg

SEQ ID NO: 6447 - RNA, 17 nt, Artificial Sequence
  Synthetic Oligonucleotide; PD-1 exon 3; Set A
agggguuaggacggggu

SEQ ID NO: 6448 - RNA, 18 nt, Artificial Sequence
  Synthetic Oligonucleotide; PD-1 exon 3; Set A
cagggguuaggacggggu

SEQ ID NO: 6449 - RNA, 24 nt, Artificial Sequence
  Synthetic Oligonucleotide; PD-1 exon 3; Set C
ggucagggguuaggacggggucag

SEQ ID NO: 6450 - RNA, 17 nt, Artificial Sequence
  Synthetic Oligonucleotide; PD-1 exon 3; Set A
cagggguuaggacgggg

SEQ ID NO: 6451 - RNA, 19 nt, Artificial Sequence
  Synthetic Oligonucleotide; PD-1 exon 3; Set A
ucagggguuaggacggggu

SEQ ID NO: 6452 - RNA, 25 nt, Artificial Sequence
  Synthetic Oligonucleotide; PD-1 exon 3; Set C
aggucagggguuaggacggggucag

SEQ ID NO: 6453 - RNA, 23 nt, Artificial Sequence
  Synthetic Oligonucleotide; PD-1 exon 3; Set C
ggucagggguuaggacgggguca

SEQ ID NO: 6454 - RNA, 16 nt, Artificial Sequence
  Synthetic Oligonucleotide; PD-1 exon 3; Set C
cagggguuaggacggg

SEQ ID NO: 6455 - RNA, 18 nt, Artificial Sequence
  Synthetic Oligonucleotide; PD-1 exon 3; Set A
ucagggguuaggacgggg

SEQ ID NO: 6456 - RNA, 20 nt, Artificial Sequence
  Synthetic Oligonucleotide; PD-1 exon 3; Set C
gucagggguuaggacggggu

SEQ ID NO: 6457 - RNA, 26 nt, Artificial Sequence
  Synthetic Oligonucleotide; PD-1 exon 3; Set C
aaggucagggguuaggacggggucag

SEQ ID NO: 6458 - RNA, 22 nt, Artificial Sequence
  Synthetic Oligonucleotide; PD-1 exon 3; Set C
ggucagggguuaggacgggguc

SEQ ID NO: 6459 - RNA, 17 nt, Artificial Sequence
  Synthetic Oligonucleotide; PD-1 exon 3; Set A
ucagggguuaggacggg

SEQ ID NO: 6460 - RNA, 19 nt, Artificial Sequence
  Synthetic Oligonucleotide; PD-1 exon 3; Set A
gucagggguuaggacgggg

SEQ ID NO: 6461 - RNA, 18 nt, Artificial Sequence
  Synthetic Oligonucleotide; PD-1 exon 3; Set A
gucagggguuaggacggg

SEQ ID NO: 6462 - RNA, 39 nt, Artificial Sequence
  Synthetic Oligonucleotide; PD-1 exon 3; Set C
cuggaagggcacaaaggucagggguuaggacggggucag

SEQ ID NO: 6463 - RNA, 40 nt, Artificial Sequence
  Synthetic Oligonucleotide; PD-1 exon 3; Set C
ucuggaagggcacaaaggucagggguuaggacggggucag

SEQ ID NO: 6464 - RNA, 38 nt, Artificial Sequence
  Synthetic Oligonucleotide; PD-1 exon 3; Set C
cuggaagggcacaaaggucagggguuaggacgggguca

SEQ ID NO: 6465 - RNA, 39 nt, Artificial Sequence
  Synthetic Oligonucleotide; PD-1 exon 3; Set C
ucuggaagggcacaaaggucagggguuaggacgggguca

SEQ ID NO: 6466 - RNA, 37 nt, Artificial Sequence
  Synthetic Oligonucleotide; PD-1 exon 3; Set C
cuggaagggcacaaaggucagggguuaggacgggguc

SEQ ID NO: 6467 - RNA, 40 nt, Artificial Sequence
  Synthetic Oligonucleotide; PD-1 exon 3; Set C
cucuggaagggcacaaaggucagggguuaggacgggguca

SEQ ID NO: 6468 - RNA, 38 nt, Artificial Sequence
  Synthetic Oligonucleotide; PD-1 exon 3; Set C
ucuggaagggcacaaaggucagggguuaggacgggguc

SEQ ID NO: 6469 - RNA, 39 nt, Artificial Sequence
  Synthetic Oligonucleotide; PD-1 exon 3; Set C
cucuggaagggcacaaaggucagggguuaggacgggguc

SEQ ID NO: 6470 - RNA, 40 nt, Artificial Sequence
  Synthetic Oligonucleotide; PD-1 exon 3; Set C
ucucuggaagggcacaaaggucagggguuaggacgggguc

SEQ ID NO: 6471 - RNA, 27 nt, Artificial Sequence
  Synthetic Oligonucleotide; PD-1 exon 3; Set C
cucuggaagggcacaaaggucaggggu

SEQ ID NO: 6472 - RNA, 28 nt, Artificial Sequence
  Synthetic Oligonucleotide; PD-1 exon 3; Set C
ucucuggaagggcacaaaggucaggggu

SEQ ID NO: 6473 - RNA, 22 nt, Artificial Sequence
  Synthetic Oligonucleotide; PD-1 exon 3; Set C
gaacuggccggcuggccugggu

SEQ ID NO: 6474 - RNA, 26 nt, Artificial Sequence
  Synthetic Oligonucleotide; PD-1 exon 3; Set C
uggaacuggccggcuggccuggguga

SEQ ID NO: 6475 - RNA, 28 nt, Artificial Sequence
  Synthetic Oligonucleotide; PD-1 exon 3; Set C
uuggaacuggccggcuggccugggugag

SEQ ID NO: 6476 - RNA, 23 nt, Artificial Sequence
  Synthetic Oligonucleotide; PD-1 exon 3; Set C
ggaacuggccggcuggccugggu

SEQ ID NO: 6477 - RNA, 21 nt, Artificial Sequence
  Synthetic Oligonucleotide; PD-1 exon 3; Set C
gaacuggccggcuggccuggg

SEQ ID NO: 6478 - RNA, 27 nt, Artificial Sequence
  Synthetic Oligonucleotide; PD-1 exon 3; Set C
uuggaacuggccggcuggccuggguga

SEQ ID NO: 6479 - RNA, 29 nt, Artificial Sequence
  Synthetic Oligonucleotide; PD-1 exon 3; Set C
uuuggaacuggccggcuggccugggugag

SEQ ID NO: 6480 - RNA, 20 nt, Artificial Sequence
  Synthetic Oligonucleotide; PD-1 exon 3; Set C
gaacuggccggcuggccugg

SEQ ID NO: 6481 - RNA, 24 nt, Artificial Sequence
  Synthetic Oligonucleotide; PD-1 exon 3; Set C
uggaacuggccggcuggccugggu

SEQ ID NO: 6482 - RNA, 22 nt, Artificial Sequence
  Synthetic Oligonucleotide; PD-1 exon 3; Set C
ggaacuggccggcuggccuggg

SEQ ID NO: 6483 - RNA, 28 nt, Artificial Sequence
  Synthetic Oligonucleotide; PD-1 exon 3; Set C
uuuggaacuggccggcuggccuggguga

SEQ ID NO: 6484 - RNA, 26 nt, Artificial Sequence
  Synthetic Oligonucleotide; PD-1 exon 3; Set C
uuggaacuggccggcuggccugggug

SEQ ID NO: 6485 - RNA, 30 nt, Artificial Sequence
  Synthetic Oligonucleotide; PD-1 exon 3; Set C
guuuggaacuggccggcuggccugggugag

SEQ ID NO: 6486 - RNA, 21 nt, Artificial Sequence
  Synthetic Oligonucleotide; PD-1 exon 3; Set C
ggaacuggccggcuggccugg

SEQ ID NO: 6487 - RNA, 19 nt, Artificial Sequence
  Synthetic Oligonucleotide; PD-1 exon 3; Set C
gaacuggccggcuggccug

SEQ ID NO: 6488 - RNA, 25 nt, Artificial Sequence
  Synthetic Oligonucleotide; PD-1 exon 3; Set C
uuggaacuggccggcuggccugggu

SEQ ID NO: 6489 - RNA, 23 nt, Artificial Sequence
  Synthetic Oligonucleotide; PD-1 exon 3; Set C
uggaacuggccggcuggccuggg

SEQ ID NO: 6490 - RNA, 29 nt, Artificial Sequence
  Synthetic Oligonucleotide; PD-1 exon 3; Set C
guuuggaacuggccggcuggccuggguga

SEQ ID NO: 6491 - RNA, 27 nt, Artificial Sequence
  Synthetic Oligonucleotide; PD-1 exon 3; Set C
uuuggaacuggccggcuggccugggug

SEQ ID NO: 6492 - RNA, 31 nt, Artificial Sequence
  Synthetic Oligonucleotide; PD-1 exon 3; Set C
gguuuggaacuggccggcuggccugggugag

SEQ ID NO: 6493 - RNA, 20 nt, Artificial Sequence
  Synthetic Oligonucleotide; PD-1 exon 3; Set C
ggaacuggccggcuggccug

SEQ ID NO: 6494 - RNA, 26 nt, Artificial Sequence
  Synthetic Oligonucleotide; PD-1 exon 3; Set C
uuuggaacuggccggcuggccugggu

SEQ ID NO: 6495 - RNA, 24 nt, Artificial Sequence
  Synthetic Oligonucleotide; PD-1 exon 3; Set C
uuggaacuggccggcuggccuggg

SEQ ID NO: 6496 - RNA, 30 nt, Artificial Sequence
  Synthetic Oligonucleotide; PD-1 exon 3; Set C
gguuuggaacuggccggcuggccuggguga

SEQ ID NO: 6497 - RNA, 28 nt, Artificial Sequence
  Synthetic Oligonucleotide; PD-1 exon 3; Set C
guuuggaacuggccggcuggccugggug

SEQ ID NO: 6498 - RNA, 21 nt, Artificial Sequence
  Synthetic Oligonucleotide; PD-1 exon 3; Set C
uggaacuggccggcuggccug

SEQ ID NO: 6499 - RNA, 25 nt, Artificial Sequence
  Synthetic Oligonucleotide; PD-1 exon 3; Set C
uuuggaacuggccggcuggccuggg

SEQ ID NO: 6500 - RNA, 27 nt, Artificial Sequence
  Synthetic Oligonucleotide; PD-1 exon 3; Set C
guuuggaacuggccggcuggccugggu

SEQ ID NO: 6501 - RNA, 29 nt, Artificial Sequence
  Synthetic Oligonucleotide; PD-1 exon 3; Set C
gguuuggaacuggccggcuggccugggug

SEQ ID NO: 6502 - RNA, 28 nt, Artificial Sequence
  Synthetic Oligonucleotide; PD-1 exon 3; Set C
gguuuggaacuggccggcuggccugggu

SEQ ID NO: 6503 - RNA, 26 nt, Artificial Sequence
  Synthetic Oligonucleotide; PD-1 exon 3; Set C
guuuggaacuggccggcuggccuggg

SEQ ID NO: 6504 - RNA, 27 nt, Artificial Sequence
  Synthetic Oligonucleotide; PD-1 exon 3; Set C
gguuuggaacuggccggcuggccuggg

SEQ ID NO: 6505 - RNA, 40 nt, Artificial Sequence
  Synthetic Oligonucleotide; PD-1 exon 3; Set C
gacaccaaccaccaggguuuggaacuggccggcuggccug

SEQ ID NO: 6506 - RNA, 24 nt, Artificial Sequence
  Synthetic Oligonucleotide; PD-1 exon 3; Set C
gacaccaaccaccaggguuuggaa

SEQ ID NO: 6507 - RNA, 23 nt, Artificial Sequence
  Synthetic Oligonucleotide; PD-1 exon 3; Set C
gacaccaaccaccaggguuugga

SEQ ID NO: 6508 - RNA, 22 nt, Artificial Sequence
  Synthetic Oligonucleotide; PD-1 exon 3; Set A
gacaccaaccaccaggguuugg

SEQ ID NO: 6509 - RNA, 21 nt, Artificial Sequence
  Synthetic Oligonucleotide; PD-1 exon 3; Set A
gacaccaaccaccaggguuug

SEQ ID NO: 6510 - RNA, 20 nt, Artificial Sequence
  Synthetic Oligonucleotide; PD-1 exon 3; Set A
gacaccaaccaccaggguuu

SEQ ID NO: 6511 - RNA, 22 nt, Artificial Sequence
  Synthetic Oligonucleotide; PD-1 exon 3; Set C
ugacggccaggacccagacuag

SEQ ID NO: 6512 - RNA, 23 nt, Artificial Sequence
  Synthetic Oligonucleotide; PD-1 exon 3; Set C
augacggccaggacccagacuag

SEQ ID NO: 6513 - RNA, 24 nt, Artificial Sequence
  Synthetic Oligonucleotide; PD-1 exon 3; Set C
gaugacggccaggacccagacuag

SEQ ID NO: 6514 - RNA, 25 nt, Artificial Sequence
  Synthetic Oligonucleotide; PD-1 exon 3; Set C
agaugacggccaggacccagacuag

SEQ ID NO: 6515 - RNA, 26 nt, Artificial Sequence
  Synthetic Oligonucleotide; PD-1 exon 3; Set C
cagaugacggccaggacccagacuag

SEQ ID NO: 6516 - RNA, 27 nt, Artificial Sequence
  Synthetic Oligonucleotide; PD-1 exon 3; Set C
gcagaugacggccaggacccagacuag

SEQ ID NO: 6517 - RNA, 28 nt, Artificial Sequence
  Synthetic Oligonucleotide; PD-1 exon 3; Set C
agcagaugacggccaggacccagacuag

SEQ ID NO: 6518 - RNA, 29 nt, Artificial Sequence
  Synthetic Oligonucleotide; PD-1 exon 3; Set C
gagcagaugacggccaggacccagacuag

SEQ ID NO: 6519 - RNA, 30 nt, Artificial Sequence
  Synthetic Oligonucleotide; PD-1 exon 3; Set C
ggagcagaugacggccaggacccagacuag

SEQ ID NO: 6520 - RNA, 15 nt, Artificial Sequence
  Synthetic Oligonucleotide; PD-1 exon 3; Set C
cagaugacggccagg

SEQ ID NO: 6521 - RNA, 16 nt, Artificial Sequence
  Synthetic Oligonucleotide; PD-1 exon 3; Set B
gcagaugacggccagg

SEQ ID NO: 6522 - RNA, 17 nt, Artificial Sequence
  Synthetic Oligonucleotide; PD-1 exon 3; Set B
agcagaugacggccagg

SEQ ID NO: 6523 - RNA, 18 nt, Artificial Sequence
  Synthetic Oligonucleotide; PD-1 exon 3; Set B
gagcagaugacggccagg

SEQ ID NO: 6524 - RNA, 19 nt, Artificial Sequence
  Synthetic Oligonucleotide; PD-1 exon 3; Set B
ggagcagaugacggccagg

SEQ ID NO: 6525 - RNA, 20 nt, Artificial Sequence
  Synthetic Oligonucleotide; PD-1 exon 3; Set C
gggagcagaugacggccagg

SEQ ID NO: 6526 - RNA, 37 nt, Artificial Sequence
  Synthetic Oligonucleotide; PD-1 exon 3; Set C
guuaccucgugcggcccgggagcagaugacggccagg

SEQ ID NO: 6527 - RNA, 38 nt, Artificial Sequence
  Synthetic Oligonucleotide; PD-1 exon 3; Set C
cguuaccucgugcggcccgggagcagaugacggccagg

SEQ ID NO: 6528 - RNA, 39 nt, Artificial Sequence
  Synthetic Oligonucleotide; PD-1 exon 3; Set C
acguuaccucgugcggcccgggagcagaugacggccagg

SEQ ID NO: 6529 - RNA, 40 nt, Artificial Sequence
  Synthetic Oligonucleotide; PD-1 exon 3; Set C
gacguuaccucgugcggcccgggagcagaugacggccagg

SEQ ID NO: 6530 - RNA, 40 nt, Artificial Sequence
  Synthetic Oligonucleotide; PD-1 exon 3; Set C
gggcugggaugacguuaccucgugcggcccgggagcagau

SEQ ID NO: 6531 - RNA, 39 nt, Artificial Sequence
  Synthetic Oligonucleotide; PD-1 exon 3; Set C
gggcugggaugacguuaccucgugcggcccgggagcaga

SEQ ID NO: 6532 - RNA, 40 nt, Artificial Sequence
  Synthetic Oligonucleotide; PD-1 exon 3; Set C
ggggcugggaugacguuaccucgugcggcccgggagcaga

SEQ ID NO: 6533 - RNA, 38 nt, Artificial Sequence
  Synthetic Oligonucleotide; PD-1 exon 3; Set C
gggcugggaugacguuaccucgugcggcccgggagcag

SEQ ID NO: 6534 - RNA, 39 nt, Artificial Sequence
  Synthetic Oligonucleotide; PD-1 exon 3; Set C
ggggcugggaugacguuaccucgugcggcccgggagcag

SEQ ID NO: 6535 - RNA, 37 nt, Artificial Sequence
  Synthetic Oligonucleotide; PD-1 exon 3; Set C
gggcugggaugacguuaccucgugcggcccgggagca

SEQ ID NO: 6536 - RNA, 40 nt, Artificial Sequence
  Synthetic Oligonucleotide; PD-1 exon 3; Set C
aggggcugggaugacguuaccucgugcggcccgggagcag

SEQ ID NO: 6537 - RNA, 38 nt, Artificial Sequence
  Synthetic Oligonucleotide; PD-1 exon 3; Set C
ggggcugggaugacguuaccucgugcggcccgggagca

SEQ ID NO: 6538 - RNA, 36 nt, Artificial Sequence
  Synthetic Oligonucleotide; PD-1 exon 3; Set C
gggcugggaugacguuaccucgugcggcccgggagc

SEQ ID NO: 6539 - RNA, 39 nt, Artificial Sequence
  Synthetic Oligonucleotide; PD-1 exon 3; Set C
aggggcugggaugacguuaccucgugcggcccgggagca

SEQ ID NO: 6540 - RNA, 37 nt, Artificial Sequence
  Synthetic Oligonucleotide; PD-1 exon 3; Set C
ggggcugggaugacguuaccucgugcggcccgggagc

SEQ ID NO: 6541 - RNA, 35 nt, Artificial Sequence
  Synthetic Oligonucleotide; PD-1 exon 3; Set C
gggcugggaugacguuaccucgugcggcccgggag

SEQ ID NO: 6542 - RNA, 34 nt, Artificial Sequence
  Synthetic Oligonucleotide; PD-1 exon 3; Set C
gggcugggaugacguuaccucgugcggcccggga

SEQ ID NO: 6543 - RNA, 40 nt, Artificial Sequence
  Synthetic Oligonucleotide; PD-1 exon 3; Set C
gaggggcugggaugacguuaccucgugcggcccgggagca

SEQ ID NO: 6544 - RNA, 38 nt, Artificial Sequence
  Synthetic Oligonucleotide; PD-1 exon 3; Set C
aggggcugggaugacguuaccucgugcggcccgggagc

SEQ ID NO: 6545 - RNA, 36 nt, Artificial Sequence
  Synthetic Oligonucleotide; PD-1 exon 3; Set C
ggggcugggaugacguuaccucgugcggcccgggag

SEQ ID NO: 6546 - RNA, 33 nt, Artificial Sequence
  Synthetic Oligonucleotide; PD-1 exon 3; Set C
gggcugggaugacguuaccucgugcggcccggg

SEQ ID NO: 6547 - RNA, 35 nt, Artificial Sequence
  Synthetic Oligonucleotide; PD-1 exon 3; Set C
ggggcugggaugacguuaccucgugcggcccggga

SEQ ID NO: 6548 - RNA, 39 nt, Artificial Sequence
  Synthetic Oligonucleotide; PD-1 exon 3; Set C
gaggggcugggaugacguuaccucgugcggcccgggagc

SEQ ID NO: 6549 - RNA, 37 nt, Artificial Sequence
  Synthetic Oligonucleotide; PD-1 exon 3; Set C
aggggcugggaugacguuaccucgugcggcccgggag

SEQ ID NO: 6550 - RNA, 34 nt, Artificial Sequence
  Synthetic Oligonucleotide; PD-1 exon 3; Set C
ggggcugggaugacguuaccucgugcggcccggg

SEQ ID NO: 6551 - RNA, 36 nt, Artificial Sequence
  Synthetic Oligonucleotide; PD-1 exon 3; Set C
aggggcugggaugacguuaccucgugcggcccggga

SEQ ID NO: 6552 - RNA, 38 nt, Artificial Sequence
  Synthetic Oligonucleotide; PD-1 exon 3; Set C
gaggggcugggaugacguuaccucgugcggcccgggag

SEQ ID NO: 6553 - RNA, 35 nt, Artificial Sequence
  Synthetic Oligonucleotide; PD-1 exon 3; Set C
aggggcugggaugacguuaccucgugcggcccggg

SEQ ID NO: 6554 - RNA, 37 nt, Artificial Sequence
  Synthetic Oligonucleotide; PD-1 exon 3; Set C
gaggggcugggaugacguuaccucgugcggcccggga

SEQ ID NO: 6555 - RNA, 36 nt, Artificial Sequence
  Synthetic Oligonucleotide; PD-1 exon 3; Set C
gaggggcugggaugacguuaccucgugcggcccggg

SEQ ID NO: 6556 - RNA, 15 nt, Artificial Sequence
  Synthetic Oligonucleotide; PD-1 exon 3; Set C
cugggaugacguuac

SEQ ID NO: 6557 - RNA, 16 nt, Artificial Sequence
  Synthetic Oligonucleotide; PD-1 exon 3; Set C
gcugggaugacguuac

SEQ ID NO: 6558 - RNA, 17 nt, Artificial Sequence
  Synthetic Oligonucleotide; PD-1 exon 3; Set C
ggcugggaugacguuac

SEQ ID NO: 6559 - RNA, 31 nt, Artificial Sequence
  Synthetic Oligonucleotide; PD-1 exon 3; Set C
cagggcaggccgaggggcugggaugacguua

SEQ ID NO: 6560 - RNA, 30 nt, Artificial Sequence
  Synthetic Oligonucleotide; PD-1 exon 3; Set C
cagggcaggccgaggggcugggaugacguu

SEQ ID NO: 6561 - RNA, 29 nt, Artificial Sequence
  Synthetic Oligonucleotide; PD-1 exon 3; Set C
cagggcaggccgaggggcugggaugacgu

SEQ ID NO: 6562 - RNA, 28 nt, Artificial Sequence
  Synthetic Oligonucleotide; PD-1 exon 3; Set C
cagggcaggccgaggggcugggaugacg

SEQ ID NO: 6563 - RNA, 27 nt, Artificial Sequence
  Synthetic Oligonucleotide; PD-1 exon 3; Set C
cagggcaggccgaggggcugggaugac

SEQ ID NO: 6564 - RNA, 26 nt, Artificial Sequence
  Synthetic Oligonucleotide; PD-1 exon 3; Set C
cagggcaggccgaggggcugggauga

SEQ ID NO: 6565 - RNA, 20 nt, Artificial Sequence
  Synthetic Oligonucleotide; PD-1 exon 3; Set C
gcagggcaggccgaggggcu

SEQ ID NO: 6566 - RNA, 19 nt, Artificial Sequence
  Synthetic Oligonucleotide; PD-1 exon 3; Set C
gcagggcaggccgaggggc

SEQ ID NO: 6567 - RNA, 20 nt, Artificial Sequence
  Synthetic Oligonucleotide; PD-1 exon 3; Set C
ggcagggcaggccgaggggc

SEQ ID NO: 6568 - RNA, 40 nt, Artificial Sequence
  Synthetic Oligonucleotide; PD-1 exon 3; Set C
ccagcaggguuagggcagggcaggccgaggggcugggaug

SEQ ID NO: 6569 - RNA, 39 nt, Artificial Sequence
  Synthetic Oligonucleotide; PD-1 exon 3; Set C
ccagcaggguuagggcagggcaggccgaggggcugggau

SEQ ID NO: 6570 - RNA, 29 nt, Artificial Sequence
  Synthetic Oligonucleotide; PD-1 exon 3; Set C
aggguuagggcagggcaggccgaggggcu

SEQ ID NO: 6571 - RNA, 40 nt, Artificial Sequence
  Synthetic Oligonucleotide; PD-1 exon 3; Set C
gccagcaggguuagggcagggcaggccgaggggcugggau

SEQ ID NO: 6572 - RNA, 38 nt, Artificial Sequence
  Synthetic Oligonucleotide; PD-1 exon 3; Set C
ccagcaggguuagggcagggcaggccgaggggcuggga

SEQ ID NO: 6573 - RNA, 28 nt, Artificial Sequence
  Synthetic Oligonucleotide; PD-1 exon 3; Set C
aggguuagggcagggcaggccgaggggc

SEQ ID NO: 6574 - RNA, 20 nt, Artificial Sequence
  Synthetic Oligonucleotide; PD-1 exon 3; Set C
uuagggcagggcaggccgag

SEQ ID NO: 6575 - RNA, 22 nt, Artificial Sequence
  Synthetic Oligonucleotide; PD-1 exon 3; Set C
guuagggcagggcaggccgagg

SEQ ID NO: 6576 - RNA, 39 nt, Artificial Sequence
  Synthetic Oligonucleotide; PD-1 exon 3; Set C
gccagcaggguuagggcagggcaggccgaggggcuggga

SEQ ID NO: 6577 - RNA, 37 nt, Artificial Sequence
  Synthetic Oligonucleotide; PD-1 exon 3; Set C
ccagcaggguuagggcagggcaggccgaggggcuggg

SEQ ID NO: 6578 - RNA, 21 nt, Artificial Sequence
  Synthetic Oligonucleotide; PD-1 exon 3; Set C
guuagggcagggcaggccgag

SEQ ID NO: 6579 - RNA, 38 nt, Artificial Sequence
  Synthetic Oligonucleotide; PD-1 exon 3; Set C
gccagcaggguuagggcagggcaggccgaggggcuggg

SEQ ID NO: 6580 - RNA, 36 nt, Artificial Sequence
  Synthetic Oligonucleotide; PD-1 exon 3; Set C
ccagcaggguuagggcagggcaggccgaggggcugg

SEQ ID NO: 6581 - RNA, 37 nt, Artificial Sequence
  Synthetic Oligonucleotide; PD-1 exon 3; Set C
gccagcaggguuagggcagggcaggccgaggggcugg

SEQ ID NO: 6582 - RNA, 17 nt, Artificial Sequence
  Synthetic Oligonucleotide; PD-1 exon 3; Set B
ccagcaggguuagggca

SEQ ID NO: 6583 - RNA, 16 nt, Artificial Sequence
  Synthetic Oligonucleotide; PD-1 exon 3; Set B
ccagcaggguuagggc

SEQ ID NO: 6584 - RNA, 18 nt, Artificial Sequence
  Synthetic Oligonucleotide; PD-1 exon 3; Set B
gccagcaggguuagggca

SEQ ID NO: 6585 - RNA, 17 nt, Artificial Sequence
  Synthetic Oligonucleotide; PD-1 exon 3; Set B
gccagcaggguuagggc

SEQ ID NO: 6586 - RNA, 15 nt, Artificial Sequence
  Synthetic Oligonucleotide; PD-1 exon 4; Set C
uuggggucaccaggc

SEQ ID NO: 6587 - RNA, 16 nt, Artificial Sequence
  Synthetic Oligonucleotide; PD-1 exon 4; Set A
cuuggggucaccaggc

SEQ ID NO: 6588 - RNA, 15 nt, Artificial Sequence
  Synthetic Oligonucleotide; PD-1 exon 4; Set C
cuuggggucaccagg

SEQ ID NO: 6589 - RNA, 17 nt, Artificial Sequence
  Synthetic Oligonucleotide; PD-1 exon 4; Set A
acuuggggucaccaggc

SEQ ID NO: 6590 - RNA, 16 nt, Artificial Sequence
  Synthetic Oligonucleotide; PD-1 exon 4; Set C
acuuggggucaccagg

SEQ ID NO: 6591 - RNA, 15 nt, Artificial Sequence
  Synthetic Oligonucleotide; PD-1 exon 4; Set C
acuuggggucaccag

SEQ ID NO: 6592 - RNA, 19 nt, Artificial Sequence
  Synthetic Oligonucleotide; PD-1 exon 4; Set C
caggccgacccugagccgu

SEQ ID NO: 6593 - RNA, 20 nt, Artificial Sequence
  Synthetic Oligonucleotide; PD-1 exon 4; Set C
ccaggccgacccugagccgu

SEQ ID NO: 6594 - RNA, 25 nt, Artificial Sequence
  Synthetic Oligonucleotide; PD-1 exon 4; Set C
ggucaccaggccgacccugagccgu

SEQ ID NO: 6595 - RNA, 26 nt, Artificial Sequence
  Synthetic Oligonucleotide; PD-1 exon 4; Set C
gggucaccaggccgacccugagccgu

SEQ ID NO: 6596 - RNA, 24 nt, Artificial Sequence
  Synthetic Oligonucleotide; PD-1 exon 4; Set C
ggucaccaggccgacccugagccg

SEQ ID NO: 6597 - RNA, 27 nt, Artificial Sequence
  Synthetic Oligonucleotide; PD-1 exon 4; Set C
ggggucaccaggccgacccugagccgu

SEQ ID NO: 6598 - RNA, 25 nt, Artificial Sequence
  Synthetic Oligonucleotide; PD-1 exon 4; Set C
gggucaccaggccgacccugagccg

SEQ ID NO: 6599 - RNA, 28 nt, Artificial Sequence
  Synthetic Oligonucleotide; PD-1 exon 4; Set C
uggggucaccaggccgacccugagccgu

SEQ ID NO: 6600 - RNA, 26 nt, Artificial Sequence
  Synthetic Oligonucleotide; PD-1 exon 4; Set C
ggggucaccaggccgacccugagccg

SEQ ID NO: 6601 - RNA, 24 nt, Artificial Sequence
  Synthetic Oligonucleotide; PD-1 exon 4; Set C
gggucaccaggccgacccugagcc

SEQ ID NO: 6602 - RNA, 29 nt, Artificial Sequence
  Synthetic Oligonucleotide; PD-1 exon 4; Set C
uuggggucaccaggccgacccugagccgu

SEQ ID NO: 6603 - RNA, 27 nt, Artificial Sequence
  Synthetic Oligonucleotide; PD-1 exon 4; Set C
uggggucaccaggccgacccugagccg

SEQ ID NO: 6604 - RNA, 25 nt, Artificial Sequence
  Synthetic Oligonucleotide; PD-1 exon 4; Set C
ggggucaccaggccgacccugagcc

SEQ ID NO: 6605 - RNA, 30 nt, Artificial Sequence
  Synthetic Oligonucleotide; PD-1 exon 4; Set C
cuuggggucaccaggccgacccugagccgu

SEQ ID NO: 6606 - RNA, 28 nt, Artificial Sequence
  Synthetic Oligonucleotide; PD-1 exon 4; Set C
uuggggucaccaggccgacccugagccg

SEQ ID NO: 6607 - RNA, 26 nt, Artificial Sequence
  Synthetic Oligonucleotide; PD-1 exon 4; Set C
uggggucaccaggccgacccugagcc

SEQ ID NO: 6608 - RNA, 31 nt, Artificial Sequence
  Synthetic Oligonucleotide; PD-1 exon 4; Set C
acuuggggucaccaggccgacccugagccgu

SEQ ID NO: 6609 - RNA, 29 nt, Artificial Sequence
  Synthetic Oligonucleotide; PD-1 exon 4; Set C
cuuggggucaccaggccgacccugagccg

SEQ ID NO: 6610 - RNA, 27 nt, Artificial Sequence
  Synthetic Oligonucleotide; PD-1 exon 4; Set C
uuggggucaccaggccgacccugagcc

SEQ ID NO: 6611 - RNA, 30 nt, Artificial Sequence
  Synthetic Oligonucleotide; PD-1 exon 4; Set C
acuuggggucaccaggccgacccugagccg

SEQ ID NO: 6612 - RNA, 28 nt, Artificial Sequence
  Synthetic Oligonucleotide; PD-1 exon 4; Set C
cuuggggucaccaggccgacccugagcc

SEQ ID NO: 6613 - RNA, 29 nt, Artificial Sequence
  Synthetic Oligonucleotide; PD-1 exon 4; Set C
acuuggggucaccaggccgacccugagcc

SEQ ID NO: 6614 - RNA, 37 nt, Artificial Sequence
  Synthetic Oligonucleotide; PD-1 exon 4; Set C
uugucccugcagagaaacacacuuggggucaccaggc

SEQ ID NO: 6615 - RNA, 36 nt, Artificial Sequence
  Synthetic Oligonucleotide; PD-1 exon 4; Set C
uugucccugcagagaaacacacuuggggucaccagg

SEQ ID NO: 6616 - RNA, 38 nt, Artificial Sequence
  Synthetic Oligonucleotide; PD-1 exon 4; Set C
auugucccugcagagaaacacacuuggggucaccaggc

SEQ ID NO: 6617 - RNA, 35 nt, Artificial Sequence
  Synthetic Oligonucleotide; PD-1 exon 4; Set C
uugucccugcagagaaacacacuuggggucaccag

SEQ ID NO: 6618 - RNA, 37 nt, Artificial Sequence
  Synthetic Oligonucleotide; PD-1 exon 4; Set C
auugucccugcagagaaacacacuuggggucaccagg

SEQ ID NO: 6619 - RNA, 36 nt, Artificial Sequence
  Synthetic Oligonucleotide; PD-1 exon 4; Set C
auugucccugcagagaaacacacuuggggucaccag

SEQ ID NO: 6620 - RNA, 34 nt, Artificial Sequence
  Synthetic Oligonucleotide; PD-1 exon 4; Set C
uugucccugcagagaaacacacuuggggucacca

SEQ ID NO: 6621 - RNA, 35 nt, Artificial Sequence
  Synthetic Oligonucleotide; PD-1 exon 4; Set C
auugucccugcagagaaacacacuuggggucacca

SEQ ID NO: 6622 - RNA, 29 nt, Artificial Sequence
  Synthetic Oligonucleotide; PD-1 exon 4; Set C
uugucccugcagagaaacacacuuggggu

SEQ ID NO: 6623 - RNA, 30 nt, Artificial Sequence
  Synthetic Oligonucleotide; PD-1 exon 4; Set C
auugucccugcagagaaacacacuuggggu

SEQ ID NO: 6624 - RNA, 28 nt, Artificial Sequence
  Synthetic Oligonucleotide; PD-1 exon 4; Set C
uugucccugcagagaaacacacuugggg

SEQ ID NO: 6625 - RNA, 27 nt, Artificial Sequence
  Synthetic Oligonucleotide; PD-1 exon 4; Set A
uugucccugcagagaaacacacuuggg

SEQ ID NO: 6626 - RNA, 29 nt, Artificial Sequence
  Synthetic Oligonucleotide; PD-1 exon 4; Set C
auugucccugcagagaaacacacuugggg

SEQ ID NO: 6627 - RNA, 26 nt, Artificial Sequence
  Synthetic Oligonucleotide; PD-1 exon 4; Set A
uugucccugcagagaaacacacuugg

SEQ ID NO: 6628 - RNA, 28 nt, Artificial Sequence
  Synthetic Oligonucleotide; PD-1 exon 4; Set A
auugucccugcagagaaacacacuuggg

SEQ ID NO: 6629 - RNA, 27 nt, Artificial Sequence
  Synthetic Oligonucleotide; PD-1 exon 4; Set A
auugucccugcagagaaacacacuugg

SEQ ID NO: 6630 - RNA, 26 nt, Artificial Sequence
  Synthetic Oligonucleotide; PD-1 exon 4; Set A
auugucccugcagagaaacacacuug

SEQ ID NO: 6631 - RNA, 22 nt, Artificial Sequence
  Synthetic Oligonucleotide; PD-1 exon 4; Set B
ggaaggaaggcacaguggauca

SEQ ID NO: 6632 - RNA, 23 nt, Artificial Sequence
  Synthetic Oligonucleotide; PD-1 exon 4; Set B
aggaaggaaggcacaguggauca

SEQ ID NO: 6633 - RNA, 17 nt, Artificial Sequence
  Synthetic Oligonucleotide; PD-1 exon 4; Set C
ggccgacccugagccgu

SEQ ID NO: 6634 - RNA, 18 nt, Artificial Sequence
  Synthetic Oligonucleotide; PD-1 exon 4; Set C
aggccgacccugagccgu

SEQ ID NO: 6635 - RNA, 16 nt, Artificial Sequence
  Synthetic Oligonucleotide; PD-1 exon 4; Set A
ggccgacccugagccg

SEQ ID NO: 6636 - RNA, 17 nt, Artificial Sequence
  Synthetic Oligonucleotide; PD-1 exon 4; Set A
aggccgacccugagccg

SEQ ID NO: 6637 - RNA, 15 nt, Artificial Sequence
  Synthetic Oligonucleotide; PD-1 exon 4; Set A
ggccgacccugagcc

SEQ ID NO: 6638 - RNA, 18 nt, Artificial Sequence
  Synthetic Oligonucleotide; PD-1 exon 4; Set C
caggccgacccugagccg

SEQ ID NO: 6639 - RNA, 16 nt, Artificial Sequence
  Synthetic Oligonucleotide; PD-1 exon 4; Set A
aggccgacccugagcc

SEQ ID NO: 6640 - RNA, 19 nt, Artificial Sequence
  Synthetic Oligonucleotide; PD-1 exon 4; Set C
ccaggccgacccugagccg

SEQ ID NO: 6641 - RNA, 17 nt, Artificial Sequence
  Synthetic Oligonucleotide; PD-1 exon 4; Set A
caggccgacccugagcc

SEQ ID NO: 6642 - RNA, 18 nt, Artificial Sequence
  Synthetic Oligonucleotide; PD-1 exon 4; Set C
ccaggccgacccugagcc

SEQ ID NO: 6643 - RNA, 23 nt, Artificial Sequence
  Synthetic Oligonucleotide; PD-1 exon 4; Set C
ggucaccaggccgacccugagcc

SEQ ID NO: 6644 - RNA, 25 nt, Artificial Sequence
  Synthetic Oligonucleotide; PD-1 exon 4; Set A
uugucccugcagagaaacacacuug

SEQ ID NO: 6645 - RNA, 24 nt, Artificial Sequence
  Synthetic Oligonucleotide; PD-1 exon 4; Set A
uugucccugcagagaaacacacuu

SEQ ID NO: 6646 - RNA, 23 nt, Artificial Sequence
  Synthetic Oligonucleotide; PD-1 exon 4; Set A
uugucccugcagagaaacacacu

SEQ ID NO: 6647 - RNA, 25 nt, Artificial Sequence
  Synthetic Oligonucleotide; PD-1 exon 4; Set A
auugucccugcagagaaacacacuu

SEQ ID NO: 6648 - RNA, 24 nt, Artificial Sequence
  Synthetic Oligonucleotide; PD-1 exon 4; Set A
auugucccugcagagaaacacacu

SEQ ID NO: 6649 - RNA, 17 nt, Artificial Sequence
  Synthetic Oligonucleotide; PD-1 exon 4; Set C
gaaggcacaguggauca

SEQ ID NO: 6650 - RNA, 18 nt, Artificial Sequence
  Synthetic Oligonucleotide; PD-1 exon 4; Set C
ggaaggcacaguggauca

SEQ ID NO: 6651 - RNA, 19 nt, Artificial Sequence
  Synthetic Oligonucleotide; PD-1 exon 4; Set C
aggaaggcacaguggauca

SEQ ID NO: 6652 - RNA, 20 nt, Artificial Sequence
  Synthetic Oligonucleotide; PD-1 exon 4; Set C
aaggaaggcacaguggauca

SEQ ID NO: 6653 - RNA, 21 nt, Artificial Sequence
  Synthetic Oligonucleotide; PD-1 exon 4; Set B
gaaggaaggcacaguggauca

SEQ ID NO: 6654 - RNA, 20 nt, Artificial Sequence
  Synthetic Oligonucleotide; PD-1 exon 4; Set C
gaaggaaggcacaguggauc

SEQ ID NO: 6655 - RNA, 19 nt, Artificial Sequence
  Synthetic Oligonucleotide; PD-1 exon 4; Set C
gaaggaaggcacaguggau

SEQ ID NO: 6656 - RNA, 21 nt, Artificial Sequence
  Synthetic Oligonucleotide; PD-1 exon 4; Set B
ggaaggaaggcacaguggauc

SEQ ID NO: 6657 - RNA, 20 nt, Artificial Sequence
  Synthetic Oligonucleotide; PD-1 exon 4; Set B
ggaaggaaggcacaguggau

SEQ ID NO: 6658 - RNA, 22 nt, Artificial Sequence
  Synthetic Oligonucleotide; PD-1 exon 4; Set B
aggaaggaaggcacaguggauc

SEQ ID NO: 6659 - RNA, 21 nt, Artificial Sequence
  Synthetic Oligonucleotide; PD-1 exon 4; Set B
aggaaggaaggcacaguggau

SEQ ID NO: 6660 - RNA, 25 nt, Artificial Sequence
  Synthetic Oligonucleotide; PD-1 exon 4; Set C
uggccggugcgccuggcuccuauug

SEQ ID NO: 6661 - RNA, 26 nt, Artificial Sequence
  Synthetic Oligonucleotide; PD-1 exon 4; Set C
cuggccggugcgccuggcuccuauug

SEQ ID NO: 6662 - RNA, 27 nt, Artificial Sequence
  Synthetic Oligonucleotide; PD-1 exon 4; Set C
gcuggccggugcgccuggcuccuauug

SEQ ID NO: 6663 - RNA, 25 nt, Artificial Sequence
  Synthetic Oligonucleotide; PD-1 exon 4; Set C
cuggccggugcgccuggcuccuauu

SEQ ID NO: 6664 - RNA, 28 nt, Artificial Sequence
  Synthetic Oligonucleotide; PD-1 exon 4; Set C
ggcuggccggugcgccuggcuccuauug

SEQ ID NO: 6665 - RNA, 26 nt, Artificial Sequence
  Synthetic Oligonucleotide; PD-1 exon 4; Set C
gcuggccggugcgccuggcuccuauu

SEQ ID NO: 6666 - RNA, 29 nt, Artificial Sequence
  Synthetic Oligonucleotide; PD-1 exon 4; Set C
gggcuggccggugcgccuggcuccuauug

SEQ ID NO: 6667 - RNA, 27 nt, Artificial Sequence
  Synthetic Oligonucleotide; PD-1 exon 4; Set C
ggcuggccggugcgccuggcuccuauu

SEQ ID NO: 6668 - RNA, 28 nt, Artificial Sequence
  Synthetic Oligonucleotide; PD-1 exon 4; Set C
gggcuggccggugcgccuggcuccuauu

SEQ ID NO: 6669 - RNA, 15 nt, Artificial Sequence
  Synthetic Oligonucleotide; PD-1 exon 4; Set C
aggcacaguggauca

SEQ ID NO: 6670 - RNA, 16 nt, Artificial Sequence
  Synthetic Oligonucleotide; PD-1 exon 4; Set C
aaggcacaguggauca

SEQ ID NO: 6671 - RNA, 15 nt, Artificial Sequence
  Synthetic Oligonucleotide; PD-1 exon 4; Set C
aaggcacaguggauc

SEQ ID NO: 6672 - RNA, 16 nt, Artificial Sequence
  Synthetic Oligonucleotide; PD-1 exon 4; Set C
gaaggcacaguggauc

SEQ ID NO: 6673 - RNA, 15 nt, Artificial Sequence
  Synthetic Oligonucleotide; PD-1 exon 4; Set C
gaaggcacaguggau

SEQ ID NO: 6674 - RNA, 17 nt, Artificial Sequence
  Synthetic Oligonucleotide; PD-1 exon 4; Set C
ggaaggcacaguggauc

SEQ ID NO: 6675 - RNA, 16 nt, Artificial Sequence
  Synthetic Oligonucleotide; PD-1 exon 4; Set C
ggaaggcacaguggau

SEQ ID NO: 6676 - RNA, 18 nt, Artificial Sequence
  Synthetic Oligonucleotide; PD-1 exon 4; Set C
aggaaggcacaguggauc

SEQ ID NO: 6677 - RNA, 17 nt, Artificial Sequence
  Synthetic Oligonucleotide; PD-1 exon 4; Set C
aggaaggcacaguggau

SEQ ID NO: 6678 - RNA, 19 nt, Artificial Sequence
  Synthetic Oligonucleotide; PD-1 exon 4; Set C
aaggaaggcacaguggauc

SEQ ID NO: 6679 - RNA, 18 nt, Artificial Sequence
  Synthetic Oligonucleotide; PD-1 exon 4; Set C
aaggaaggcacaguggau

SEQ ID NO: 6680 - RNA, 22 nt, Artificial Sequence
  Synthetic Oligonucleotide; IFNG exon 2; Set C
aauugguuuacaauuagcccau

SEQ ID NO: 6681 - RNA, 23 nt, Artificial Sequence
  Synthetic Oligonucleotide; IFNG exon 2; Set C
aaauugguuuacaauuagcccau

SEQ ID NO: 6682 - RNA, 24 nt, Artificial Sequence
  Synthetic Oligonucleotide; IFNG exon 2; Set C
aaaauugguuuacaauuagcccau

SEQ ID NO: 6683 - RNA, 18 nt, Artificial Sequence
  Synthetic Oligonucleotide; IFNG exon 2; Set C
aauugguuuacaauuagc

SEQ ID NO: 6684 - RNA, 19 nt, Artificial Sequence
  Synthetic Oligonucleotide; IFNG exon 2; Set C
aaauugguuuacaauuagc

SEQ ID NO: 6685 - RNA, 20 nt, Artificial Sequence
  Synthetic Oligonucleotide; IFNG exon 2; Set C
aaaauugguuuacaauuagc

SEQ ID NO: 6686 - RNA, 31 nt, Artificial Sequence
  Synthetic Oligonucleotide; IFNG exon 2; Set C
aaaagaaaaaauugguuuacaauuagcccau

SEQ ID NO: 6687 - RNA, 32 nt, Artificial Sequence
  Synthetic Oligonucleotide; IFNG exon 2; Set C
aaaaagaaaaaauugguuuacaauuagcccau

SEQ ID NO: 6688 - RNA, 33 nt, Artificial Sequence
  Synthetic Oligonucleotide; IFNG exon 2; Set C
aaaaaagaaaaaauugguuuacaauuagcccau

SEQ ID NO: 6689 - RNA, 34 nt, Artificial Sequence
  Synthetic Oligonucleotide; IFNG exon 2; Set C
aaaaaaagaaaaaauugguuuacaauuagcccau

SEQ ID NO: 6690 - RNA, 35 nt, Artificial Sequence
  Synthetic Oligonucleotide; IFNG exon 2; Set C
aaaaaaaagaaaaaauugguuuacaauuagcccau

SEQ ID NO: 6691 - RNA, 36 nt, Artificial Sequence
  Synthetic Oligonucleotide; IFNG exon 2; Set C
aaaaaaaaagaaaaaauugguuuacaauuagcccau

SEQ ID NO: 6692 - RNA, 28 nt, Artificial Sequence
  Synthetic Oligonucleotide; IFNG exon 2; Set C
aaaaagaaaaaauugguuuacaauuagc

SEQ ID NO: 6693 - RNA, 37 nt, Artificial Sequence
  Synthetic Oligonucleotide; IFNG exon 2; Set C
aaaaaaaaaagaaaaaauugguuuacaauuagcccau

SEQ ID NO: 6694 - RNA, 29 nt, Artificial Sequence
  Synthetic Oligonucleotide; IFNG exon 2; Set C
aaaaaagaaaaaauugguuuacaauuagc

SEQ ID NO: 6695 - RNA, 38 nt, Artificial Sequence
  Synthetic Oligonucleotide; IFNG exon 2; Set C
aaaaaaaaaaagaaaaaauugguuuacaauuagcccau

SEQ ID NO: 6696 - RNA, 30 nt, Artificial Sequence
  Synthetic Oligonucleotide; IFNG exon 2; Set C
aaaaaaagaaaaaauugguuuacaauuagc

SEQ ID NO: 6697 - RNA, 39 nt, Artificial Sequence
  Synthetic Oligonucleotide; IFNG exon 2; Set C
aaaaaaaaaaaagaaaaaauugguuuacaauuagcccau

SEQ ID NO: 6698 - RNA, 31 nt, Artificial Sequence
  Synthetic Oligonucleotide; IFNG exon 2; Set C
aaaaaaaagaaaaaauugguuuacaauuagc

SEQ ID NO: 6699 - RNA, 40 nt, Artificial Sequence
  Synthetic Oligonucleotide; IFNG exon 2; Set C
aaaaaaaaaaaaagaaaaaauugguuuacaauuagcccau

SEQ ID NO: 6700 - RNA, 32 nt, Artificial Sequence
  Synthetic Oligonucleotide; IFNG exon 2; Set C
aaaaaaaaagaaaaaauugguuuacaauuagc

SEQ ID NO: 6701 - RNA, 33 nt, Artificial Sequence
  Synthetic Oligonucleotide; IFNG exon 2; Set C
aaaaaaaaaagaaaaaauugguuuacaauuagc

SEQ ID NO: 6702 - RNA, 34 nt, Artificial Sequence
  Synthetic Oligonucleotide; IFNG exon 2; Set C
aaaaaaaaaaagaaaaaauugguuuacaauuagc

SEQ ID NO: 6703 - RNA, 15 nt, Artificial Sequence
  Synthetic Oligonucleotide; IFNG exon 2; Set C
aagaaaaaauugguu

SEQ ID NO: 6704 - RNA, 35 nt, Artificial Sequence
  Synthetic Oligonucleotide; IFNG exon 2; Set C
aaaaaaaaaaaagaaaaaauugguuuacaauuagc

SEQ ID NO: 6705 - RNA, 16 nt, Artificial Sequence
  Synthetic Oligonucleotide; IFNG exon 2; Set C
aaagaaaaaauugguu

SEQ ID NO: 6706 - RNA, 36 nt, Artificial Sequence
  Synthetic Oligonucleotide; IFNG exon 2; Set C
aaaaaaaaaaaaagaaaaaauugguuuacaauuagc

SEQ ID NO: 6707 - RNA, 17 nt, Artificial Sequence
  Synthetic Oligonucleotide; IFNG exon 2; Set C
aaaagaaaaaauugguu

SEQ ID NO: 6708 - RNA, 18 nt, Artificial Sequence
  Synthetic Oligonucleotide; IFNG exon 2; Set C
aaaaagaaaaaauugguu

SEQ ID NO: 6709 - RNA, 16 nt, Artificial Sequence
  Synthetic Oligonucleotide; IFNG exon 2; Set C
aaaagaaaaaauuggu

SEQ ID NO: 6710 - RNA, 19 nt, Artificial Sequence
  Synthetic Oligonucleotide; IFNG exon 2; Set C
aaaaaagaaaaaauugguu

SEQ ID NO: 6711 - RNA, 17 nt, Artificial Sequence
  Synthetic Oligonucleotide; IFNG exon 2; Set C
aaaaagaaaaaauuggu

SEQ ID NO: 6712 - RNA, 15 nt, Artificial Sequence
  Synthetic Oligonucleotide; IFNG exon 2; Set C
aaaagaaaaaauugg

SEQ ID NO: 6713 - RNA, 20 nt, Artificial Sequence
  Synthetic Oligonucleotide; IFNG exon 2; Set C
aaaaaaagaaaaaauugguu

SEQ ID NO: 6714 - RNA, 18 nt, Artificial Sequence
  Synthetic Oligonucleotide; IFNG exon 2; Set C
aaaaaagaaaaaauuggu

SEQ ID NO: 6715 - RNA, 16 nt, Artificial Sequence
  Synthetic Oligonucleotide; IFNG exon 2; Set C
aaaaagaaaaaauugg

SEQ ID NO: 6716 - RNA, 21 nt, Artificial Sequence
  Synthetic Oligonucleotide; IFNG exon 2; Set C
aaaaaaaagaaaaaauugguu

SEQ ID NO: 6717 - RNA, 19 nt, Artificial Sequence
  Synthetic Oligonucleotide; IFNG exon 2; Set C
aaaaaaagaaaaaauuggu

SEQ ID NO: 6718 - RNA, 17 nt, Artificial Sequence
  Synthetic Oligonucleotide; IFNG exon 2; Set C
aaaaaagaaaaaauugg

SEQ ID NO: 6719 - RNA, 15 nt, Artificial Sequence
  Synthetic Oligonucleotide; IFNG exon 2; Set C
aaaaagaaaaaauug

SEQ ID NO: 6720 - RNA, 22 nt, Artificial Sequence
  Synthetic Oligonucleotide; IFNG exon 2; Set C
aaaaaaaaagaaaaaauugguu

SEQ ID NO: 6721 - RNA, 20 nt, Artificial Sequence
  Synthetic Oligonucleotide; IFNG exon 2; Set C
aaaaaaaagaaaaaauuggu

SEQ ID NO: 6722 - RNA, 18 nt, Artificial Sequence
  Synthetic Oligonucleotide; IFNG exon 2; Set C
aaaaaaagaaaaaauugg

SEQ ID NO: 6723 - RNA, 16 nt, Artificial Sequence
  Synthetic Oligonucleotide; IFNG exon 2; Set C
aaaaaagaaaaaauug

SEQ ID NO: 6724 - RNA, 15 nt, Artificial Sequence
  Synthetic Oligonucleotide; IFNG exon 2; Set C
aaaaaagaaaaaauu

SEQ ID NO: 6725 - RNA, 23 nt, Artificial Sequence
  Synthetic Oligonucleotide; IFNG exon 2; Set C
aaaaaaaaaagaaaaaauugguu

SEQ ID NO: 6726 - RNA, 21 nt, Artificial Sequence
  Synthetic Oligonucleotide; IFNG exon 2; Set C
aaaaaaaaagaaaaaauuggu

SEQ ID NO: 6727 - RNA, 19 nt, Artificial Sequence
  Synthetic Oligonucleotide; IFNG exon 2; Set C
aaaaaaaagaaaaaauugg

SEQ ID NO: 6728 - RNA, 17 nt, Artificial Sequence
  Synthetic Oligonucleotide; IFNG exon 2; Set C
aaaaaaagaaaaaauug

SEQ ID NO: 6729 - RNA, 16 nt, Artificial Sequence
  Synthetic Oligonucleotide; IFNG exon 2; Set C
aaaaaaagaaaaaauu

SEQ ID NO: 6730 - RNA, 24 nt, Artificial Sequence
  Synthetic Oligonucleotide; IFNG exon 2; Set C
aaaaaaaaaaagaaaaaauugguu

SEQ ID NO: 6731 - RNA, 22 nt, Artificial Sequence
  Synthetic Oligonucleotide; IFNG exon 2; Set C
aaaaaaaaaagaaaaaauuggu

SEQ ID NO: 6732 - RNA, 20 nt, Artificial Sequence
  Synthetic Oligonucleotide; IFNG exon 2; Set C
aaaaaaaaagaaaaaauugg

SEQ ID NO: 6733 - RNA, 18 nt, Artificial Sequence
  Synthetic Oligonucleotide; IFNG exon 2; Set C
aaaaaaaagaaaaaauug

SEQ ID NO: 6734 - RNA, 15 nt, Artificial Sequence
  Synthetic Oligonucleotide; IFNG exon 2; Set C
aaaaaaagaaaaaau

SEQ ID NO: 6735 - RNA, 17 nt, Artificial Sequence
  Synthetic Oligonucleotide; IFNG exon 2; Set C
aaaaaaaagaaaaaauu

SEQ ID NO: 6736 - RNA, 25 nt, Artificial Sequence
  Synthetic Oligonucleotide; IFNG exon 2; Set C
aaaaaaaaaaaagaaaaaauugguu

SEQ ID NO: 6737 - RNA, 23 nt, Artificial Sequence
  Synthetic Oligonucleotide; IFNG exon 2; Set C
aaaaaaaaaaagaaaaaauuggu

SEQ ID NO: 6738 - RNA, 21 nt, Artificial Sequence
  Synthetic Oligonucleotide; IFNG exon 2; Set C
aaaaaaaaaagaaaaaauugg

SEQ ID NO: 6739 - RNA, 19 nt, Artificial Sequence
  Synthetic Oligonucleotide; IFNG exon 2; Set C
aaaaaaaaagaaaaaauug

SEQ ID NO: 6740 - RNA, 16 nt, Artificial Sequence
  Synthetic Oligonucleotide; IFNG exon 2; Set C
aaaaaaaagaaaaaau

SEQ ID NO: 6741 - RNA, 18 nt, Artificial Sequence
  Synthetic Oligonucleotide; IFNG exon 2; Set C
aaaaaaaaagaaaaaauu

SEQ ID NO: 6742 - RNA, 26 nt, Artificial Sequence
  Synthetic Oligonucleotide; IFNG exon 2; Set C
aaaaaaaaaaaaagaaaaaauugguu

SEQ ID NO: 6743 - RNA, 24 nt, Artificial Sequence
  Synthetic Oligonucleotide; IFNG exon 2; Set C
aaaaaaaaaaaagaaaaaauuggu

SEQ ID NO: 6744 - RNA, 22 nt, Artificial Sequence
  Synthetic Oligonucleotide; IFNG exon 2; Set C
aaaaaaaaaaagaaaaaauugg

SEQ ID NO: 6745 - RNA, 20 nt, Artificial Sequence
  Synthetic Oligonucleotide; IFNG exon 2; Set C
aaaaaaaaaagaaaaaauug

SEQ ID NO: 6746 - RNA, 15 nt, Artificial Sequence
  Synthetic Oligonucleotide; IFNG exon 2; Set C
aaaaaaaagaaaaaa

SEQ ID NO: 6747 - RNA, 17 nt, Artificial Sequence
  Synthetic Oligonucleotide; IFNG exon 2; Set C
aaaaaaaaagaaaaaau

SEQ ID NO: 6748 - RNA, 19 nt, Artificial Sequence
  Synthetic Oligonucleotide; IFNG exon 2; Set C
aaaaaaaaaagaaaaaauu

SEQ ID NO: 6749 - RNA, 27 nt, Artificial Sequence
  Synthetic Oligonucleotide; IFNG exon 2; Set C
uaaaaaaaaaaaaagaaaaaauugguu

SEQ ID NO: 6750 - RNA, 25 nt, Artificial Sequence
  Synthetic Oligonucleotide; IFNG exon 2; Set C
aaaaaaaaaaaaagaaaaaauuggu

SEQ ID NO: 6751 - RNA, 23 nt, Artificial Sequence
  Synthetic Oligonucleotide; IFNG exon 2; Set C
aaaaaaaaaaaagaaaaaauugg

SEQ ID NO: 6752 - RNA, 21 nt, Artificial Sequence
  Synthetic Oligonucleotide; IFNG exon 2; Set C
aaaaaaaaaaagaaaaaauug

SEQ ID NO: 6753 - RNA, 16 nt, Artificial Sequence
  Synthetic Oligonucleotide; IFNG exon 2; Set C
aaaaaaaaagaaaaaa

SEQ ID NO: 6754 - RNA, 18 nt, Artificial Sequence
  Synthetic Oligonucleotide; IFNG exon 2; Set C
aaaaaaaaaagaaaaaau

SEQ ID NO: 6755 - RNA, 20 nt, Artificial Sequence
  Synthetic Oligonucleotide; IFNG exon 2; Set C
aaaaaaaaaaagaaaaaauu

SEQ ID NO: 6756 - RNA, 24 nt, Artificial Sequence
  Synthetic Oligonucleotide; IFNG exon 2; Set C
aaaaaaaaaaaaagaaaaaauugg

SEQ ID NO: 6757 - RNA, 22 nt, Artificial Sequence
  Synthetic Oligonucleotide; IFNG exon 2; Set C
aaaaaaaaaaaagaaaaaauug

SEQ ID NO: 6758 - RNA, 26 nt, Artificial Sequence
  Synthetic Oligonucleotide; IFNG exon 2; Set C
uaaaaaaaaaaaaagaaaaaauuggu

SEQ ID NO: 6759 - RNA, 17 nt, Artificial Sequence
  Synthetic Oligonucleotide; IFNG exon 2; Set C
aaaaaaaaaagaaaaaa

SEQ ID NO: 6760 - RNA, 15 nt, Artificial Sequence
  Synthetic Oligonucleotide; IFNG exon 2; Set C
aaaaaaaaagaaaaa

SEQ ID NO: 6761 - RNA, 19 nt, Artificial Sequence
  Synthetic Oligonucleotide; IFNG exon 2; Set C
aaaaaaaaaaagaaaaaau

SEQ ID NO: 6762 - RNA, 21 nt, Artificial Sequence
  Synthetic Oligonucleotide; IFNG exon 2; Set C
aaaaaaaaaaaagaaaaaauu

SEQ ID NO: 6763 - RNA, 23 nt, Artificial Sequence
  Synthetic Oligonucleotide; IFNG exon 2; Set C
aaaaaaaaaaaaagaaaaaauug

SEQ ID NO: 6764 - RNA, 25 nt, Artificial Sequence
  Synthetic Oligonucleotide; IFNG exon 2; Set C
uaaaaaaaaaaaaagaaaaaauugg

SEQ ID NO: 6765 - RNA, 18 nt, Artificial Sequence
  Synthetic Oligonucleotide; IFNG exon 2; Set C
aaaaaaaaaaagaaaaaa

SEQ ID NO: 6766 - RNA, 16 nt, Artificial Sequence
  Synthetic Oligonucleotide; IFNG exon 2; Set C
aaaaaaaaaagaaaaa

SEQ ID NO: 6767 - RNA, 20 nt, Artificial Sequence
  Synthetic Oligonucleotide; IFNG exon 2; Set C
aaaaaaaaaaaagaaaaaau

SEQ ID NO: 6768 - RNA, 22 nt, Artificial Sequence
  Synthetic Oligonucleotide; IFNG exon 2; Set C
aaaaaaaaaaaaagaaaaaauu

SEQ ID NO: 6769 - RNA, 24 nt, Artificial Sequence
  Synthetic Oligonucleotide; IFNG exon 2; Set C
uaaaaaaaaaaaaagaaaaaauug

SEQ ID NO: 6770 - RNA, 19 nt, Artificial Sequence
  Synthetic Oligonucleotide; IFNG exon 2; Set C
aaaaaaaaaaaagaaaaaa

SEQ ID NO: 6771 - RNA, 17 nt, Artificial Sequence
  Synthetic Oligonucleotide; IFNG exon 2; Set C
aaaaaaaaaaagaaaaa

SEQ ID NO: 6772 - RNA, 21 nt, Artificial Sequence
  Synthetic Oligonucleotide; IFNG exon 2; Set C
aaaaaaaaaaaaagaaaaaau

SEQ ID NO: 6773 - RNA, 23 nt, Artificial Sequence
  Synthetic Oligonucleotide; IFNG exon 2; Set C
uaaaaaaaaaaaaagaaaaaauu

SEQ ID NO: 6774 - RNA, 15 nt, Artificial Sequence
  Synthetic Oligonucleotide; IFNG exon 2; Set C
aaaaaaaaaagaaaa

SEQ ID NO: 6775 - RNA, 20 nt, Artificial Sequence
  Synthetic Oligonucleotide; IFNG exon 2; Set C
aaaaaaaaaaaaagaaaaaa

SEQ ID NO: 6776 - RNA, 18 nt, Artificial Sequence
  Synthetic Oligonucleotide; IFNG exon 2; Set C
aaaaaaaaaaaagaaaaa

SEQ ID NO: 6777 - RNA, 22 nt, Artificial Sequence
  Synthetic Oligonucleotide; IFNG exon 2; Set C
uaaaaaaaaaaaaagaaaaaau

SEQ ID NO: 6778 - RNA, 16 nt, Artificial Sequence
  Synthetic Oligonucleotide; IFNG exon 2; Set C
aaaaaaaaaaagaaaa

SEQ ID NO: 6779 - RNA, 19 nt, Artificial Sequence
  Synthetic Oligonucleotide; IFNG exon 2; Set C
aaaaaaaaaaaaagaaaaa

SEQ ID NO: 6780 - RNA, 21 nt, Artificial Sequence
  Synthetic Oligonucleotide; IFNG exon 2; Set C
uaaaaaaaaaaaaagaaaaaa

SEQ ID NO: 6781 - RNA, 17 nt, Artificial Sequence
  Synthetic Oligonucleotide; IFNG exon 2; Set C
aaaaaaaaaaaagaaaa

SEQ ID NO: 6782 - RNA, 20 nt, Artificial Sequence
  Synthetic Oligonucleotide; IFNG exon 2; Set C
uaaaaaaaaaaaaagaaaaa

SEQ ID NO: 6783 - RNA, 18 nt, Artificial Sequence
  Synthetic Oligonucleotide; IFNG exon 2; Set C
aaaaaaaaaaaaagaaaa

SEQ ID NO: 6784 - RNA, 15 nt, Artificial Sequence
  Synthetic Oligonucleotide; IFNG exon 2; Set C
cuucaaaaugccuaa

SEQ ID NO: 6785 - RNA, 16 nt, Artificial Sequence
  Synthetic Oligonucleotide; IFNG exon 2; Set C
ucuucaaaaugccuaa

SEQ ID NO: 6786 - RNA, 15 nt, Artificial Sequence
  Synthetic Oligonucleotide; IFNG exon 2; Set C
ucuucaaaaugccua

SEQ ID NO: 6787 - RNA, 17 nt, Artificial Sequence
  Synthetic Oligonucleotide; IFNG exon 2; Set C
uucuucaaaaugccuaa

SEQ ID NO: 6788 - RNA, 16 nt, Artificial Sequence
  Synthetic Oligonucleotide; IFNG exon 2; Set C
uucuucaaaaugccua

SEQ ID NO: 6789 - RNA, 18 nt, Artificial Sequence
  Synthetic Oligonucleotide; IFNG exon 2; Set C
auucuucaaaaugccuaa

SEQ ID NO: 6790 - RNA, 17 nt, Artificial Sequence
  Synthetic Oligonucleotide; IFNG exon 2; Set C
auucuucaaaaugccua

SEQ ID NO: 6791 - RNA, 15 nt, Artificial Sequence
  Synthetic Oligonucleotide; IFNG exon 2; Set C
uucuucaaaaugccu

SEQ ID NO: 6792 - RNA, 19 nt, Artificial Sequence
  Synthetic Oligonucleotide; IFNG exon 2; Set C
aauucuucaaaaugccuaa

SEQ ID NO: 6793 - RNA, 18 nt, Artificial Sequence
  Synthetic Oligonucleotide; IFNG exon 2; Set C
aauucuucaaaaugccua

SEQ ID NO: 6794 - RNA, 16 nt, Artificial Sequence
  Synthetic Oligonucleotide; IFNG exon 2; Set C
auucuucaaaaugccu

SEQ ID NO: 6795 - RNA, 20 nt, Artificial Sequence
  Synthetic Oligonucleotide; IFNG exon 2; Set C
caauucuucaaaaugccuaa

SEQ ID NO: 6796 - RNA, 19 nt, Artificial Sequence
  Synthetic Oligonucleotide; IFNG exon 2; Set C
caauucuucaaaaugccua

SEQ ID NO: 6797 - RNA, 17 nt, Artificial Sequence
  Synthetic Oligonucleotide; IFNG exon 2; Set C
aauucuucaaaaugccu

SEQ ID NO: 6798 - RNA, 15 nt, Artificial Sequence
  Synthetic Oligonucleotide; IFNG exon 2; Set C
auucuucaaaaugcc

SEQ ID NO: 6799 - RNA, 18 nt, Artificial Sequence
  Synthetic Oligonucleotide; IFNG exon 2; Set C
caauucuucaaaaugccu

SEQ ID NO: 6800 - RNA, 16 nt, Artificial Sequence
  Synthetic Oligonucleotide; IFNG exon 2; Set C
aauucuucaaaaugcc

SEQ ID NO: 6801 - RNA, 15 nt, Artificial Sequence
  Synthetic Oligonucleotide; IFNG exon 2; Set C
aauucuucaaaaugc

SEQ ID NO: 6802 - RNA, 17 nt, Artificial Sequence
  Synthetic Oligonucleotide; IFNG exon 2; Set C
caauucuucaaaaugcc

SEQ ID NO: 6803 - RNA, 16 nt, Artificial Sequence
  Synthetic Oligonucleotide; IFNG exon 2; Set C
caauucuucaaaaugc

SEQ ID NO: 6804 - RNA, 15 nt, Artificial Sequence
  Synthetic Oligonucleotide; IFNG exon 2; Set C
caauucuucaaaaug

SEQ ID NO: 6805 - RNA, 23 nt, Artificial Sequence
  Synthetic Oligonucleotide; IFNG exon 2; Set C
guuuacaauuagcccauaaauug

SEQ ID NO: 6806 - RNA, 24 nt, Artificial Sequence
  Synthetic Oligonucleotide; IFNG exon 2; Set C
gguuuacaauuagcccauaaauug

SEQ ID NO: 6807 - RNA, 25 nt, Artificial Sequence
  Synthetic Oligonucleotide; IFNG exon 2; Set C
ugguuuacaauuagcccauaaauug

SEQ ID NO: 6808 - RNA, 26 nt, Artificial Sequence
  Synthetic Oligonucleotide; IFNG exon 2; Set C
uugguuuacaauuagcccauaaauug

SEQ ID NO: 6809 - RNA, 27 nt, Artificial Sequence
  Synthetic Oligonucleotide; IFNG exon 2; Set C
auugguuuacaauuagcccauaaauug

SEQ ID NO: 6810 - RNA, 28 nt, Artificial Sequence
  Synthetic Oligonucleotide; IFNG exon 2; Set C
aauugguuuacaauuagcccauaaauug

SEQ ID NO: 6811 - RNA, 17 nt, Artificial Sequence
  Synthetic Oligonucleotide; IFNG exon 2; Set C
guuuacaauuagcccau

SEQ ID NO: 6812 - RNA, 29 nt, Artificial Sequence
  Synthetic Oligonucleotide; IFNG exon 2; Set C
aaauugguuuacaauuagcccauaaauug

SEQ ID NO: 6813 - RNA, 18 nt, Artificial Sequence
  Synthetic Oligonucleotide; IFNG exon 2; Set C
gguuuacaauuagcccau

SEQ ID NO: 6814 - RNA, 30 nt, Artificial Sequence
  Synthetic Oligonucleotide; IFNG exon 2; Set C
aaaauugguuuacaauuagcccauaaauug

SEQ ID NO: 6815 - RNA, 19 nt, Artificial Sequence
  Synthetic Oligonucleotide; IFNG exon 2; Set C
ugguuuacaauuagcccau

SEQ ID NO: 6816 - RNA, 20 nt, Artificial Sequence
  Synthetic Oligonucleotide; IFNG exon 2; Set C
uugguuuacaauuagcccau

SEQ ID NO: 6817 - RNA, 21 nt, Artificial Sequence
  Synthetic Oligonucleotide; IFNG exon 2; Set C
auugguuuacaauuagcccau

SEQ ID NO: 6818 - RNA, 15 nt, Artificial Sequence
  Synthetic Oligonucleotide; IFNG exon 2; Set C
ugguuuacaauuagc

SEQ ID NO: 6819 - RNA, 16 nt, Artificial Sequence
  Synthetic Oligonucleotide; IFNG exon 2; Set C
uugguuuacaauuagc

SEQ ID NO: 6820 - RNA, 25 nt, Artificial Sequence
  Synthetic Oligonucleotide; IFNG exon 2; Set C
aaaaauugguuuacaauuagcccau

SEQ ID NO: 6821 - RNA, 17 nt, Artificial Sequence
  Synthetic Oligonucleotide; IFNG exon 2; Set C
auugguuuacaauuagc

SEQ ID NO: 6822 - RNA, 15 nt, Artificial Sequence
  Synthetic Oligonucleotide; IFNG exon 2; Set C
uugguuuacaauuag

SEQ ID NO: 6823 - RNA, 37 nt, Artificial Sequence
  Synthetic Oligonucleotide; IFNG exon 2; Set C
aaaagaaaaaauugguuuacaauuagcccauaaauug

SEQ ID NO: 6824 - RNA, 26 nt, Artificial Sequence
  Synthetic Oligonucleotide; IFNG exon 2; Set C
aaaaaauugguuuacaauuagcccau

SEQ ID NO: 6825 - RNA, 16 nt, Artificial Sequence
  Synthetic Oligonucleotide; IFNG exon 2; Set C
auugguuuacaauuag

SEQ ID NO: 6826 - RNA, 38 nt, Artificial Sequence
  Synthetic Oligonucleotide; IFNG exon 2; Set C
aaaaagaaaaaauugguuuacaauuagcccauaaauug

SEQ ID NO: 6827 - RNA, 27 nt, Artificial Sequence
  Synthetic Oligonucleotide; IFNG exon 2; Set C
gaaaaaauugguuuacaauuagcccau

SEQ ID NO: 6828 - RNA, 17 nt, Artificial Sequence
  Synthetic Oligonucleotide; IFNG exon 2; Set C
aauugguuuacaauuag

SEQ ID NO: 6829 - RNA, 15 nt, Artificial Sequence
  Synthetic Oligonucleotide; IFNG exon 2; Set C
auugguuuacaauua

SEQ ID NO: 6830 - RNA, 39 nt, Artificial Sequence
  Synthetic Oligonucleotide; IFNG exon 2; Set C
aaaaaagaaaaaauugguuuacaauuagcccauaaauug

SEQ ID NO: 6831 - RNA, 28 nt, Artificial Sequence
  Synthetic Oligonucleotide; IFNG exon 2; Set C
agaaaaaauugguuuacaauuagcccau

SEQ ID NO: 6832 - RNA, 18 nt, Artificial Sequence
  Synthetic Oligonucleotide; IFNG exon 2; Set C
aaauugguuuacaauuag

SEQ ID NO: 6833 - RNA, 16 nt, Artificial Sequence
  Synthetic Oligonucleotide; IFNG exon 2; Set C
aauugguuuacaauua

SEQ ID NO: 6834 - RNA, 40 nt, Artificial Sequence
  Synthetic Oligonucleotide; IFNG exon 2; Set C
aaaaaaagaaaaaauugguuuacaauuagcccauaaauug

SEQ ID NO: 6835 - RNA, 29 nt, Artificial Sequence
  Synthetic Oligonucleotide; IFNG exon 2; Set C
aagaaaaaauugguuuacaauuagcccau

SEQ ID NO: 6836 - RNA, 21 nt, Artificial Sequence
  Synthetic Oligonucleotide; IFNG exon 2; Set C
aaaaauugguuuacaauuagc

SEQ ID NO: 6837 - RNA, 19 nt, Artificial Sequence
  Synthetic Oligonucleotide; IFNG exon 2; Set C
aaaauugguuuacaauuag

SEQ ID NO: 6838 - RNA, 17 nt, Artificial Sequence
  Synthetic Oligonucleotide; IFNG exon 2; Set C
aaauugguuuacaauua

SEQ ID NO: 6839 - RNA, 30 nt, Artificial Sequence
  Synthetic Oligonucleotide; IFNG exon 2; Set C
aaagaaaaaauugguuuacaauuagcccau

SEQ ID NO: 6840 - RNA, 22 nt, Artificial Sequence
  Synthetic Oligonucleotide; IFNG exon 2; Set C
aaaaaauugguuuacaauuagc

SEQ ID NO: 6841 - RNA, 18 nt, Artificial Sequence
  Synthetic Oligonucleotide; IFNG exon 2; Set C
aaaauugguuuacaauua

SEQ ID NO: 6842 - RNA, 20 nt, Artificial Sequence
  Synthetic Oligonucleotide; IFNG exon 2; Set C
aaaaauugguuuacaauuag

SEQ ID NO: 6843 - RNA, 23 nt, Artificial Sequence
  Synthetic Oligonucleotide; IFNG exon 2; Set C
gaaaaaauugguuuacaauuagc

SEQ ID NO: 6844 - RNA, 19 nt, Artificial Sequence
  Synthetic Oligonucleotide; IFNG exon 2; Set C
aaaaauugguuuacaauua

SEQ ID NO: 6845 - RNA, 21 nt, Artificial Sequence
  Synthetic Oligonucleotide; IFNG exon 2; Set C
aaaaaauugguuuacaauuag

SEQ ID NO: 6846 - RNA, 24 nt, Artificial Sequence
  Synthetic Oligonucleotide; IFNG exon 2; Set C
agaaaaaauugguuuacaauuagc

SEQ ID NO: 6847 - RNA, 22 nt, Artificial Sequence
  Synthetic Oligonucleotide; IFNG exon 2; Set C
gaaaaaauugguuuacaauuag

SEQ ID NO: 6848 - RNA, 20 nt, Artificial Sequence
  Synthetic Oligonucleotide; IFNG exon 2; Set C
aaaaaauugguuuacaauua

SEQ ID NO: 6849 - RNA, 25 nt, Artificial Sequence
  Synthetic Oligonucleotide; IFNG exon 2; Set C
aagaaaaaauugguuuacaauuagc

SEQ ID NO: 6850 - RNA, 21 nt, Artificial Sequence
  Synthetic Oligonucleotide; IFNG exon 2; Set C
gaaaaaauugguuuacaauua

SEQ ID NO: 6851 - RNA, 23 nt, Artificial Sequence
  Synthetic Oligonucleotide; IFNG exon 2; Set C
agaaaaaauugguuuacaauuag

SEQ ID NO: 6852 - RNA, 26 nt, Artificial Sequence
  Synthetic Oligonucleotide; IFNG exon 2; Set C
aaagaaaaaauugguuuacaauuagc

SEQ ID NO: 6853 - RNA, 24 nt, Artificial Sequence
  Synthetic Oligonucleotide; IFNG exon 2; Set C
aagaaaaaauugguuuacaauuag

SEQ ID NO: 6854 - RNA, 22 nt, Artificial Sequence
  Synthetic Oligonucleotide; IFNG exon 2; Set C
agaaaaaauugguuuacaauua

SEQ ID NO: 6855 - RNA, 27 nt, Artificial Sequence
  Synthetic Oligonucleotide; IFNG exon 2; Set C
aaaagaaaaaauugguuuacaauuagc

SEQ ID NO: 6856 - RNA, 25 nt, Artificial Sequence
  Synthetic Oligonucleotide; IFNG exon 2; Set C
aaagaaaaaauugguuuacaauuag

SEQ ID NO: 6857 - RNA, 23 nt, Artificial Sequence
  Synthetic Oligonucleotide; IFNG exon 2; Set C
aagaaaaaauugguuuacaauua

SEQ ID NO: 6858 - RNA, 26 nt, Artificial Sequence
  Synthetic Oligonucleotide; IFNG exon 2; Set C
aaaagaaaaaauugguuuacaauuag

SEQ ID NO: 6859 - RNA, 24 nt, Artificial Sequence
  Synthetic Oligonucleotide; IFNG exon 2; Set C
aaagaaaaaauugguuuacaauua

SEQ ID NO: 6860 - RNA, 27 nt, Artificial Sequence
  Synthetic Oligonucleotide; IFNG exon 2; Set C
aaaaagaaaaaauugguuuacaauuag

SEQ ID NO: 6861 - RNA, 25 nt, Artificial Sequence
  Synthetic Oligonucleotide; IFNG exon 2; Set C
aaaagaaaaaauugguuuacaauua

SEQ ID NO: 6862 - RNA, 28 nt, Artificial Sequence
  Synthetic Oligonucleotide; IFNG exon 2; Set C
aaaaaagaaaaaauugguuuacaauuag

SEQ ID NO: 6863 - RNA, 26 nt, Artificial Sequence
  Synthetic Oligonucleotide; IFNG exon 2; Set C
aaaaagaaaaaauugguuuacaauua

SEQ ID NO: 6864 - RNA, 29 nt, Artificial Sequence
  Synthetic Oligonucleotide; IFNG exon 2; Set C
aaaaaaagaaaaaauugguuuacaauuag

SEQ ID NO: 6865 - RNA, 27 nt, Artificial Sequence
  Synthetic Oligonucleotide; IFNG exon 2; Set C
aaaaaagaaaaaauugguuuacaauua

SEQ ID NO: 6866 - RNA, 30 nt, Artificial Sequence
  Synthetic Oligonucleotide; IFNG exon 2; Set C
aaaaaaaagaaaaaauugguuuacaauuag

SEQ ID NO: 6867 - RNA, 28 nt, Artificial Sequence
  Synthetic Oligonucleotide; IFNG exon 2; Set C
aaaaaaagaaaaaauugguuuacaauua

SEQ ID NO: 6868 - RNA, 31 nt, Artificial Sequence
  Synthetic Oligonucleotide; IFNG exon 2; Set C
aaaaaaaaagaaaaaauugguuuacaauuag

SEQ ID NO: 6869 - RNA, 29 nt, Artificial Sequence
  Synthetic Oligonucleotide; IFNG exon 2; Set C
aaaaaaaagaaaaaauugguuuacaauua

SEQ ID NO: 6870 - RNA, 32 nt, Artificial Sequence
  Synthetic Oligonucleotide; IFNG exon 2; Set C
aaaaaaaaaagaaaaaauugguuuacaauuag

SEQ ID NO: 6871 - RNA, 30 nt, Artificial Sequence
  Synthetic Oligonucleotide; IFNG exon 2; Set C
aaaaaaaaagaaaaaauugguuuacaauua

SEQ ID NO: 6872 - RNA, 33 nt, Artificial Sequence
  Synthetic Oligonucleotide; IFNG exon 2; Set C
aaaaaaaaaaagaaaaaauugguuuacaauuag

SEQ ID NO: 6873 - RNA, 31 nt, Artificial Sequence
  Synthetic Oligonucleotide; IFNG exon 2; Set C
aaaaaaaaaagaaaaaauugguuuacaauua

SEQ ID NO: 6874 - RNA, 34 nt, Artificial Sequence
  Synthetic Oligonucleotide; IFNG exon 2; Set C
aaaaaaaaaaaagaaaaaauugguuuacaauuag

SEQ ID NO: 6875 - RNA, 32 nt, Artificial Sequence
  Synthetic Oligonucleotide; IFNG exon 2; Set C
aaaaaaaaaaagaaaaaauugguuuacaauua

SEQ ID NO: 6876 - RNA, 15 nt, Artificial Sequence
  Synthetic Oligonucleotide; IFNG exon 2; Set C
aaagaaaaaauuggu

SEQ ID NO: 6877 - RNA, 37 nt, Artificial Sequence
  Synthetic Oligonucleotide; IFNG exon 2; Set C
uaaaaaaaaaaaaagaaaaaauugguuuacaauuagc

SEQ ID NO: 6878 - RNA, 35 nt, Artificial Sequence
  Synthetic Oligonucleotide; IFNG exon 2; Set C
aaaaaaaaaaaaagaaaaaauugguuuacaauuag

SEQ ID NO: 6879 - RNA, 33 nt, Artificial Sequence
  Synthetic Oligonucleotide; IFNG exon 2; Set C
aaaaaaaaaaaagaaaaaauugguuuacaauua

SEQ ID NO: 6880 - RNA, 34 nt, Artificial Sequence
  Synthetic Oligonucleotide; IFNG exon 2; Set C
aaaaaaaaaaaaagaaaaaauugguuuacaauua

SEQ ID NO: 6881 - RNA, 36 nt, Artificial Sequence
  Synthetic Oligonucleotide; IFNG exon 2; Set C
uaaaaaaaaaaaaagaaaaaauugguuuacaauuag

SEQ ID NO: 6882 - RNA, 35 nt, Artificial Sequence
  Synthetic Oligonucleotide; IFNG exon 2; Set C
uaaaaaaaaaaaaagaaaaaauugguuuacaauua

SEQ ID NO: 6883 - RNA, 15 nt, Artificial Sequence
  Synthetic Oligonucleotide; IFNG exon 2; Set C
aaaaaaaaaaagaaa

SEQ ID NO: 6884 - RNA, 16 nt, Artificial Sequence
  Synthetic Oligonucleotide; IFNG exon 2; Set C
aaaaaaaaaaaagaaa

SEQ ID NO: 6885 - RNA, 19 nt, Artificial Sequence
  Synthetic Oligonucleotide; IFNG exon 2; Set C
uaaaaaaaaaaaaagaaaa

SEQ ID NO: 6886 - RNA, 17 nt, Artificial Sequence
  Synthetic Oligonucleotide; IFNG exon 2; Set C
aaaaaaaaaaaaagaaa

SEQ ID NO: 6887 - RNA, 15 nt, Artificial Sequence
  Synthetic Oligonucleotide; IFNG exon 2; Set C
aaaaaaaaaaaagaa

SEQ ID NO: 6888 - RNA, 16 nt, Artificial Sequence
  Synthetic Oligonucleotide; IFNG exon 2; Set C
aaaaaaaaaaaaagaa

SEQ ID NO: 6889 - RNA, 18 nt, Artificial Sequence
  Synthetic Oligonucleotide; IFNG exon 2; Set C
uaaaaaaaaaaaaagaaa

SEQ ID NO: 6890 - RNA, 17 nt, Artificial Sequence
  Synthetic Oligonucleotide; IFNG exon 2; Set C
uaaaaaaaaaaaaagaa

SEQ ID NO: 6891 - RNA, 15 nt, Artificial Sequence
  Synthetic Oligonucleotide; IFNG exon 2; Set C
aaaaaaaaaaaaaga

SEQ ID NO: 6892 - RNA, 16 nt, Artificial Sequence
  Synthetic Oligonucleotide; IFNG exon 2; Set C
uaaaaaaaaaaaaaga

SEQ ID NO: 6893 - RNA, 15 nt, Artificial Sequence
  Synthetic Oligonucleotide; IFNG exon 2; Set C
uaaaaaaaaaaaaag

SEQ ID NO: 6894 - RNA, 40 nt, Artificial Sequence
  Synthetic Oligonucleotide; IFNG exon 2; Set C
aaugaccugcauucuaaaaaaaaaaaaagaaaaaauuggu

SEQ ID NO: 6895 - RNA, 39 nt, Artificial Sequence
  Synthetic Oligonucleotide; IFNG exon 2; Set C
aaugaccugcauucuaaaaaaaaaaaaagaaaaaauugg

SEQ ID NO: 6896 - RNA, 38 nt, Artificial Sequence
  Synthetic Oligonucleotide; IFNG exon 2; Set C
aaugaccugcauucuaaaaaaaaaaaaagaaaaaauug

SEQ ID NO: 6897 - RNA, 40 nt, Artificial Sequence
  Synthetic Oligonucleotide; IFNG exon 2; Set C
gaaugaccugcauucuaaaaaaaaaaaaagaaaaaauugg

SEQ ID NO: 6898 - RNA, 37 nt, Artificial Sequence
  Synthetic Oligonucleotide; IFNG exon 2; Set C
aaugaccugcauucuaaaaaaaaaaaaagaaaaaauu

SEQ ID NO: 6899 - RNA, 39 nt, Artificial Sequence
  Synthetic Oligonucleotide; IFNG exon 2; Set C
gaaugaccugcauucuaaaaaaaaaaaaagaaaaaauug

SEQ ID NO: 6900 - RNA, 36 nt, Artificial Sequence
  Synthetic Oligonucleotide; IFNG exon 2; Set C
aaugaccugcauucuaaaaaaaaaaaaagaaaaaau

SEQ ID NO: 6901 - RNA, 38 nt, Artificial Sequence
  Synthetic Oligonucleotide; IFNG exon 2; Set C
gaaugaccugcauucuaaaaaaaaaaaaagaaaaaauu

SEQ ID NO: 6902 - RNA, 40 nt, Artificial Sequence
  Synthetic Oligonucleotide; IFNG exon 2; Set C
ugaaugaccugcauucuaaaaaaaaaaaaagaaaaaauug

SEQ ID NO: 6903 - RNA, 35 nt, Artificial Sequence
  Synthetic Oligonucleotide; IFNG exon 2; Set C
aaugaccugcauucuaaaaaaaaaaaaagaaaaaa

SEQ ID NO: 6904 - RNA, 37 nt, Artificial Sequence
  Synthetic Oligonucleotide; IFNG exon 2; Set C
gaaugaccugcauucuaaaaaaaaaaaaagaaaaaau

SEQ ID NO: 6905 - RNA, 39 nt, Artificial Sequence
  Synthetic Oligonucleotide; IFNG exon 2; Set C
ugaaugaccugcauucuaaaaaaaaaaaaagaaaaaauu

SEQ ID NO: 6906 - RNA, 34 nt, Artificial Sequence
  Synthetic Oligonucleotide; IFNG exon 2; Set C
aaugaccugcauucuaaaaaaaaaaaaagaaaaa

SEQ ID NO: 6907 - RNA, 36 nt, Artificial Sequence
  Synthetic Oligonucleotide; IFNG exon 2; Set C
gaaugaccugcauucuaaaaaaaaaaaaagaaaaaa

SEQ ID NO: 6908 - RNA, 38 nt, Artificial Sequence
  Synthetic Oligonucleotide; IFNG exon 2; Set C
ugaaugaccugcauucuaaaaaaaaaaaaagaaaaaau

SEQ ID NO: 6909 - RNA, 35 nt, Artificial Sequence
  Synthetic Oligonucleotide; IFNG exon 2; Set C
gaaugaccugcauucuaaaaaaaaaaaaagaaaaa

SEQ ID NO: 6910 - RNA, 37 nt, Artificial Sequence
  Synthetic Oligonucleotide; IFNG exon 2; Set C
ugaaugaccugcauucuaaaaaaaaaaaaagaaaaaa

SEQ ID NO: 6911 - RNA, 36 nt, Artificial Sequence
  Synthetic Oligonucleotide; IFNG exon 2; Set C
ugaaugaccugcauucuaaaaaaaaaaaaagaaaaa

SEQ ID NO: 6912 - RNA, 27 nt, Artificial Sequence
  Synthetic Oligonucleotide; IFNG exon 2; Set C
aaugaccugcauucuaaaaaaaaaaaa

SEQ ID NO: 6913 - RNA, 28 nt, Artificial Sequence
  Synthetic Oligonucleotide; IFNG exon 2; Set C
gaaugaccugcauucuaaaaaaaaaaaa

SEQ ID NO: 6914 - RNA, 27 nt, Artificial Sequence
  Synthetic Oligonucleotide; IFNG exon 2; Set C
gaaugaccugcauucuaaaaaaaaaaa

SEQ ID NO: 6915 - RNA, 29 nt, Artificial Sequence
  Synthetic Oligonucleotide; IFNG exon 2; Set C
ugaaugaccugcauucuaaaaaaaaaaaa

SEQ ID NO: 6916 - RNA, 28 nt, Artificial Sequence
  Synthetic Oligonucleotide; IFNG exon 2; Set C
ugaaugaccugcauucuaaaaaaaaaaa

SEQ ID NO: 6917 - RNA, 27 nt, Artificial Sequence
  Synthetic Oligonucleotide; IFNG exon 2; Set C
ugaaugaccugcauucuaaaaaaaaaa

SEQ ID NO: 6918 - RNA, 36 nt, Artificial Sequence
  Synthetic Oligonucleotide; IFNG exon 2; Set C
cuacaucugaaugaccugcauucuaaaaaaaaaaaa

SEQ ID NO: 6919 - RNA, 37 nt, Artificial Sequence
  Synthetic Oligonucleotide; IFNG exon 2; Set C
gcuacaucugaaugaccugcauucuaaaaaaaaaaaa

SEQ ID NO: 6920 - RNA, 35 nt, Artificial Sequence
  Synthetic Oligonucleotide; IFNG exon 2; Set C
cuacaucugaaugaccugcauucuaaaaaaaaaaa

SEQ ID NO: 6921 - RNA, 36 nt, Artificial Sequence
  Synthetic Oligonucleotide; IFNG exon 2; Set C
gcuacaucugaaugaccugcauucuaaaaaaaaaaa

SEQ ID NO: 6922 - RNA, 35 nt, Artificial Sequence
  Synthetic Oligonucleotide; IFNG exon 2; Set C
gcuacaucugaaugaccugcauucuaaaaaaaaaa

SEQ ID NO: 6923 - RNA, 34 nt, Artificial Sequence
  Synthetic Oligonucleotide; IFNG exon 2; Set C
gcuacaucugaaugaccugcauucuaaaaaaaaa

SEQ ID NO: 6924 - RNA, 33 nt, Artificial Sequence
  Synthetic Oligonucleotide; IFNG exon 2; Set A
gcuacaucugaaugaccugcauucuaaaaaaaa

SEQ ID NO: 6925 - RNA, 40 nt, Artificial Sequence
  Synthetic Oligonucleotide; IFNG exon 2; Set A
uuauccgcuacaucugaaugaccugcauucuaaaaaaaaa

SEQ ID NO: 6926 - RNA, 39 nt, Artificial Sequence
  Synthetic Oligonucleotide; IFNG exon 2; Set A
uuauccgcuacaucugaaugaccugcauucuaaaaaaaa

SEQ ID NO: 6927 - RNA, 40 nt, Artificial Sequence
  Synthetic Oligonucleotide; IFNG exon 2; Set A
auuauccgcuacaucugaaugaccugcauucuaaaaaaaa

SEQ ID NO: 6928 - RNA, 38 nt, Artificial Sequence
  Synthetic Oligonucleotide; IFNG exon 2; Set A
uuauccgcuacaucugaaugaccugcauucuaaaaaaa

SEQ ID NO: 6929 - RNA, 39 nt, Artificial Sequence
  Synthetic Oligonucleotide; IFNG exon 2; Set A
auuauccgcuacaucugaaugaccugcauucuaaaaaaa

SEQ ID NO: 6930 - RNA, 37 nt, Artificial Sequence
  Synthetic Oligonucleotide; IFNG exon 2; Set A
uuauccgcuacaucugaaugaccugcauucuaaaaaa

SEQ ID NO: 6931 - RNA, 38 nt, Artificial Sequence
  Synthetic Oligonucleotide; IFNG exon 2; Set A
auuauccgcuacaucugaaugaccugcauucuaaaaaa

SEQ ID NO: 6932 - RNA, 36 nt, Artificial Sequence
  Synthetic Oligonucleotide; IFNG exon 2; Set A
uuauccgcuacaucugaaugaccugcauucuaaaaa

SEQ ID NO: 6933 - RNA, 37 nt, Artificial Sequence
  Synthetic Oligonucleotide; IFNG exon 2; Set A
auuauccgcuacaucugaaugaccugcauucuaaaaa

SEQ ID NO: 6934 - RNA, 35 nt, Artificial Sequence
  Synthetic Oligonucleotide; IFNG exon 2; Set A
uuauccgcuacaucugaaugaccugcauucuaaaa

SEQ ID NO: 6935 - RNA, 36 nt, Artificial Sequence
  Synthetic Oligonucleotide; IFNG exon 2; Set A
auuauccgcuacaucugaaugaccugcauucuaaaa

SEQ ID NO: 6936 - RNA, 35 nt, Artificial Sequence
  Synthetic Oligonucleotide; IFNG exon 2; Set A
auuauccgcuacaucugaaugaccugcauucuaaa

SEQ ID NO: 6937 - RNA, 18 nt, Artificial Sequence
  Synthetic Oligonucleotide; IFNG exon 2; Set C
uauccgcuacaucugaau

SEQ ID NO: 6938 - RNA, 19 nt, Artificial Sequence
  Synthetic Oligonucleotide; IFNG exon 2; Set C
uuauccgcuacaucugaau

SEQ ID NO: 6939 - RNA, 17 nt, Artificial Sequence
  Synthetic Oligonucleotide; IFNG exon 2; Set C
uauccgcuacaucugaa

SEQ ID NO: 6940 - RNA, 20 nt, Artificial Sequence
  Synthetic Oligonucleotide; IFNG exon 2; Set C
auuauccgcuacaucugaau

SEQ ID NO: 6941 - RNA, 18 nt, Artificial Sequence
  Synthetic Oligonucleotide; IFNG exon 2; Set C
uuauccgcuacaucugaa

SEQ ID NO: 6942 - RNA, 16 nt, Artificial Sequence
  Synthetic Oligonucleotide; IFNG exon 2; Set C
uauccgcuacaucuga

SEQ ID NO: 6943 - RNA, 19 nt, Artificial Sequence
  Synthetic Oligonucleotide; IFNG exon 2; Set C
auuauccgcuacaucugaa

SEQ ID NO: 6944 - RNA, 17 nt, Artificial Sequence
  Synthetic Oligonucleotide; IFNG exon 2; Set C
uuauccgcuacaucuga

SEQ ID NO: 6945 - RNA, 18 nt, Artificial Sequence
  Synthetic Oligonucleotide; IFNG exon 2; Set C
auuauccgcuacaucuga

SEQ ID NO: 6946 - RNA, 25 nt, Artificial Sequence
  Synthetic Oligonucleotide; IFNG exon 2; Set A
guuccauuauccgcuacaucugaau

SEQ ID NO: 6947 - RNA, 26 nt, Artificial Sequence
  Synthetic Oligonucleotide; IFNG exon 2; Set A
aguuccauuauccgcuacaucugaau

SEQ ID NO: 6948 - RNA, 24 nt, Artificial Sequence
  Synthetic Oligonucleotide; IFNG exon 2; Set A
guuccauuauccgcuacaucugaa

SEQ ID NO: 6949 - RNA, 25 nt, Artificial Sequence
  Synthetic Oligonucleotide; IFNG exon 2; Set A
aguuccauuauccgcuacaucugaa

SEQ ID NO: 6950 - RNA, 23 nt, Artificial Sequence
  Synthetic Oligonucleotide; IFNG exon 2; Set A
guuccauuauccgcuacaucuga

SEQ ID NO: 6951 - RNA, 24 nt, Artificial Sequence
  Synthetic Oligonucleotide; IFNG exon 2; Set A
aguuccauuauccgcuacaucuga

SEQ ID NO: 6952 - RNA, 18 nt, Artificial Sequence
  Synthetic Oligonucleotide; IFNG exon 2; Set C
guuccauuauccgcuaca

SEQ ID NO: 6953 - RNA, 17 nt, Artificial Sequence
  Synthetic Oligonucleotide; IFNG exon 2; Set C
guuccauuauccgcuac

SEQ ID NO: 6954 - RNA, 19 nt, Artificial Sequence
  Synthetic Oligonucleotide; IFNG exon 2; Set C
aguuccauuauccgcuaca

SEQ ID NO: 6955 - RNA, 16 nt, Artificial Sequence
  Synthetic Oligonucleotide; IFNG exon 2; Set C
guuccauuauccgcua

SEQ ID NO: 6956 - RNA, 18 nt, Artificial Sequence
  Synthetic Oligonucleotide; IFNG exon 2; Set C
aguuccauuauccgcuac

SEQ ID NO: 6957 - RNA, 15 nt, Artificial Sequence
  Synthetic Oligonucleotide; IFNG exon 2; Set C
guuccauuauccgcu

SEQ ID NO: 6958 - RNA, 17 nt, Artificial Sequence
  Synthetic Oligonucleotide; IFNG exon 2; Set C
aguuccauuauccgcua

SEQ ID NO: 6959 - RNA, 16 nt, Artificial Sequence
  Synthetic Oligonucleotide; IFNG exon 2; Set C
aguuccauuauccgcu

SEQ ID NO: 6960 - RNA, 36 nt, Artificial Sequence
  Synthetic Oligonucleotide; IFNG exon 2; Set A
cuaagaaaagaguuccauuauccgcuacaucugaau

SEQ ID NO: 6961 - RNA, 40 nt, Artificial Sequence
  Synthetic Oligonucleotide; IFNG exon 2; Set A
augccuaagaaaagaguuccauuauccgcuacaucugaau

SEQ ID NO: 6962 - RNA, 40 nt, Artificial Sequence
  Synthetic Oligonucleotide; IFNG exon 2; Set A
aaugccuaagaaaagaguuccauuauccgcuacaucugaa

SEQ ID NO: 6963 - RNA, 28 nt, Artificial Sequence
  Synthetic Oligonucleotide; IFNG exon 2; Set C
cuaagaaaagaguuccauuauccgcuac

SEQ ID NO: 6964 - RNA, 40 nt, Artificial Sequence
  Synthetic Oligonucleotide; IFNG exon 2; Set A
aaaugccuaagaaaagaguuccauuauccgcuacaucuga

SEQ ID NO: 6965 - RNA, 27 nt, Artificial Sequence
  Synthetic Oligonucleotide; IFNG exon 2; Set C
cuaagaaaagaguuccauuauccgcua

SEQ ID NO: 6966 - RNA, 26 nt, Artificial Sequence
  Synthetic Oligonucleotide; IFNG exon 2; Set C
cuaagaaaagaguuccauuauccgcu

SEQ ID NO: 6967 - RNA, 28 nt, Artificial Sequence
  Synthetic Oligonucleotide; IFNG exon 2; Set A
ccuaagaaaagaguuccauuauccgcua

SEQ ID NO: 6968 - RNA, 27 nt, Artificial Sequence
  Synthetic Oligonucleotide; IFNG exon 2; Set C
ccuaagaaaagaguuccauuauccgcu

SEQ ID NO: 6969 - RNA, 31 nt, Artificial Sequence
  Synthetic Oligonucleotide; IFNG exon 2; Set A
ugccuaagaaaagaguuccauuauccgcuac

SEQ ID NO: 6970 - RNA, 30 nt, Artificial Sequence
  Synthetic Oligonucleotide; IFNG exon 2; Set A
ugccuaagaaaagaguuccauuauccgcua

SEQ ID NO: 6971 - RNA, 32 nt, Artificial Sequence
  Synthetic Oligonucleotide; IFNG exon 2; Set A
augccuaagaaaagaguuccauuauccgcuac

SEQ ID NO: 6972 - RNA, 29 nt, Artificial Sequence
  Synthetic Oligonucleotide; IFNG exon 2; Set A
ugccuaagaaaagaguuccauuauccgcu

SEQ ID NO: 6973 - RNA, 31 nt, Artificial Sequence
  Synthetic Oligonucleotide; IFNG exon 2; Set A
augccuaagaaaagaguuccauuauccgcua

SEQ ID NO: 6974 - RNA, 33 nt, Artificial Sequence
  Synthetic Oligonucleotide; IFNG exon 2; Set A
aaugccuaagaaaagaguuccauuauccgcuac

SEQ ID NO: 6975 - RNA, 30 nt, Artificial Sequence
  Synthetic Oligonucleotide; IFNG exon 2; Set A
augccuaagaaaagaguuccauuauccgcu

SEQ ID NO: 6976 - RNA, 32 nt, Artificial Sequence
  Synthetic Oligonucleotide; IFNG exon 2; Set A
aaugccuaagaaaagaguuccauuauccgcua

SEQ ID NO: 6977 - RNA, 34 nt, Artificial Sequence
  Synthetic Oligonucleotide; IFNG exon 2; Set A
aaaugccuaagaaaagaguuccauuauccgcuac

SEQ ID NO: 6978 - RNA, 31 nt, Artificial Sequence
  Synthetic Oligonucleotide; IFNG exon 2; Set A
aaugccuaagaaaagaguuccauuauccgcu

SEQ ID NO: 6979 - RNA, 33 nt, Artificial Sequence
  Synthetic Oligonucleotide; IFNG exon 2; Set A
aaaugccuaagaaaagaguuccauuauccgcua

SEQ ID NO: 6980 - RNA, 35 nt, Artificial Sequence
  Synthetic Oligonucleotide; IFNG exon 2; Set A
aaaaugccuaagaaaagaguuccauuauccgcuac

SEQ ID NO: 6981 - RNA, 32 nt, Artificial Sequence
  Synthetic Oligonucleotide; IFNG exon 2; Set A
aaaugccuaagaaaagaguuccauuauccgcu

SEQ ID NO: 6982 - RNA, 34 nt, Artificial Sequence
  Synthetic Oligonucleotide; IFNG exon 2; Set A
aaaaugccuaagaaaagaguuccauuauccgcua

SEQ ID NO: 6983 - RNA, 36 nt, Artificial Sequence
  Synthetic Oligonucleotide; IFNG exon 2; Set A
caaaaugccuaagaaaagaguuccauuauccgcuac

SEQ ID NO: 6984 - RNA, 33 nt, Artificial Sequence
  Synthetic Oligonucleotide; IFNG exon 2; Set A
aaaaugccuaagaaaagaguuccauuauccgcu

SEQ ID NO: 6985 - RNA, 35 nt, Artificial Sequence
  Synthetic Oligonucleotide; IFNG exon 2; Set A
caaaaugccuaagaaaagaguuccauuauccgcua

SEQ ID NO: 6986 - RNA, 37 nt, Artificial Sequence
  Synthetic Oligonucleotide; IFNG exon 2; Set A
ucaaaaugccuaagaaaagaguuccauuauccgcuac

SEQ ID NO: 6987 - RNA, 34 nt, Artificial Sequence
  Synthetic Oligonucleotide; IFNG exon 2; Set A
caaaaugccuaagaaaagaguuccauuauccgcu

SEQ ID NO: 6988 - RNA, 36 nt, Artificial Sequence
  Synthetic Oligonucleotide; IFNG exon 2; Set A
ucaaaaugccuaagaaaagaguuccauuauccgcua

SEQ ID NO: 6989 - RNA, 38 nt, Artificial Sequence
  Synthetic Oligonucleotide; IFNG exon 2; Set A
uucaaaaugccuaagaaaagaguuccauuauccgcuac

SEQ ID NO: 6990 - RNA, 35 nt, Artificial Sequence
  Synthetic Oligonucleotide; IFNG exon 2; Set A
ucaaaaugccuaagaaaagaguuccauuauccgcu

SEQ ID NO: 6991 - RNA, 37 nt, Artificial Sequence
  Synthetic Oligonucleotide; IFNG exon 2; Set A
uucaaaaugccuaagaaaagaguuccauuauccgcua

SEQ ID NO: 6992 - RNA, 39 nt, Artificial Sequence
  Synthetic Oligonucleotide; IFNG exon 2; Set A
cuucaaaaugccuaagaaaagaguuccauuauccgcuac

SEQ ID NO: 6993 - RNA, 24 nt, Artificial Sequence
  Synthetic Oligonucleotide; IFNG exon 2; Set C
augccuaagaaaagaguuccauua

SEQ ID NO: 6994 - RNA, 36 nt, Artificial Sequence
  Synthetic Oligonucleotide; IFNG exon 2; Set A
uucaaaaugccuaagaaaagaguuccauuauccgcu

SEQ ID NO: 6995 - RNA, 38 nt, Artificial Sequence
  Synthetic Oligonucleotide; IFNG exon 2; Set A
cuucaaaaugccuaagaaaagaguuccauuauccgcua

SEQ ID NO: 6996 - RNA, 40 nt, Artificial Sequence
  Synthetic Oligonucleotide; IFNG exon 2; Set A
ucuucaaaaugccuaagaaaagaguuccauuauccgcuac

SEQ ID NO: 6997 - RNA, 25 nt, Artificial Sequence
  Synthetic Oligonucleotide; IFNG exon 2; Set C
aaugccuaagaaaagaguuccauua

SEQ ID NO: 6998 - RNA, 37 nt, Artificial Sequence
  Synthetic Oligonucleotide; IFNG exon 2; Set A
cuucaaaaugccuaagaaaagaguuccauuauccgcu

SEQ ID NO: 6999 - RNA, 39 nt, Artificial Sequence
  Synthetic Oligonucleotide; IFNG exon 2; Set A
ucuucaaaaugccuaagaaaagaguuccauuauccgcua

SEQ ID NO: 7000 - RNA, 24 nt, Artificial Sequence
  Synthetic Oligonucleotide; IFNG exon 2; Set C
aaugccuaagaaaagaguuccauu

SEQ ID NO: 7001 - RNA, 26 nt, Artificial Sequence
  Synthetic Oligonucleotide; IFNG exon 2; Set C
aaaugccuaagaaaagaguuccauua

SEQ ID NO: 7002 - RNA, 38 nt, Artificial Sequence
  Synthetic Oligonucleotide; IFNG exon 2; Set A
ucuucaaaaugccuaagaaaagaguuccauuauccgcu

SEQ ID NO: 7003 - RNA, 40 nt, Artificial Sequence
  Synthetic Oligonucleotide; IFNG exon 2; Set A
uucuucaaaaugccuaagaaaagaguuccauuauccgcua

SEQ ID NO: 7004 - RNA, 25 nt, Artificial Sequence
  Synthetic Oligonucleotide; IFNG exon 2; Set C
aaaugccuaagaaaagaguuccauu

SEQ ID NO: 7005 - RNA, 27 nt, Artificial Sequence
  Synthetic Oligonucleotide; IFNG exon 2; Set C
aaaaugccuaagaaaagaguuccauua

SEQ ID NO: 7006 - RNA, 39 nt, Artificial Sequence
  Synthetic Oligonucleotide; IFNG exon 2; Set A
uucuucaaaaugccuaagaaaagaguuccauuauccgcu

SEQ ID NO: 7007 - RNA, 26 nt, Artificial Sequence
  Synthetic Oligonucleotide; IFNG exon 2; Set C
aaaaugccuaagaaaagaguuccauu

SEQ ID NO: 7008 - RNA, 28 nt, Artificial Sequence
  Synthetic Oligonucleotide; IFNG exon 2; Set C
caaaaugccuaagaaaagaguuccauua

SEQ ID NO: 7009 - RNA, 40 nt, Artificial Sequence
  Synthetic Oligonucleotide; IFNG exon 2; Set A
auucuucaaaaugccuaagaaaagaguuccauuauccgcu

SEQ ID NO: 7010 - RNA, 30 nt, Artificial Sequence
  Synthetic Oligonucleotide; IFNG exon 2; Set C
ucaaaaugccuaagaaaagaguuccauuau

SEQ ID NO: 7011 - RNA, 29 nt, Artificial Sequence
  Synthetic Oligonucleotide; IFNG exon 2; Set C
ucaaaaugccuaagaaaagaguuccauua

SEQ ID NO: 7012 - RNA, 27 nt, Artificial Sequence
  Synthetic Oligonucleotide; IFNG exon 2; Set C
caaaaugccuaagaaaagaguuccauu

SEQ ID NO: 7013 - RNA, 31 nt, Artificial Sequence
  Synthetic Oligonucleotide; IFNG exon 2; Set C
uucaaaaugccuaagaaaagaguuccauuau

SEQ ID NO: 7014 - RNA, 30 nt, Artificial Sequence
  Synthetic Oligonucleotide; IFNG exon 2; Set C
uucaaaaugccuaagaaaagaguuccauua

SEQ ID NO: 7015 - RNA, 28 nt, Artificial Sequence
  Synthetic Oligonucleotide; IFNG exon 2; Set C
ucaaaaugccuaagaaaagaguuccauu

SEQ ID NO: 7016 - RNA, 32 nt, Artificial Sequence
  Synthetic Oligonucleotide; IFNG exon 2; Set C
cuucaaaaugccuaagaaaagaguuccauuau

SEQ ID NO: 7017 - RNA, 34 nt, Artificial Sequence
  Synthetic Oligonucleotide; IFNG exon 2; Set C
ucuucaaaaugccuaagaaaagaguuccauuauc

SEQ ID NO: 7018 - RNA, 29 nt, Artificial Sequence
  Synthetic Oligonucleotide; IFNG exon 2; Set C
uucaaaaugccuaagaaaagaguuccauu

SEQ ID NO: 7019 - RNA, 31 nt, Artificial Sequence
  Synthetic Oligonucleotide; IFNG exon 2; Set C
cuucaaaaugccuaagaaaagaguuccauua

SEQ ID NO: 7020 - RNA, 19 nt, Artificial Sequence
  Synthetic Oligonucleotide; IFNG exon 2; Set C
aaugccuaagaaaagaguu

SEQ ID NO: 7021 - RNA, 33 nt, Artificial Sequence
  Synthetic Oligonucleotide; IFNG exon 2; Set C
ucuucaaaaugccuaagaaaagaguuccauuau

SEQ ID NO: 7022 - RNA, 35 nt, Artificial Sequence
  Synthetic Oligonucleotide; IFNG exon 2; Set C
uucuucaaaaugccuaagaaaagaguuccauuauc

SEQ ID NO: 7023 - RNA, 32 nt, Artificial Sequence
  Synthetic Oligonucleotide; IFNG exon 2; Set C
ucuucaaaaugccuaagaaaagaguuccauua

SEQ ID NO: 7024 - RNA, 30 nt, Artificial Sequence
  Synthetic Oligonucleotide; IFNG exon 2; Set C
cuucaaaaugccuaagaaaagaguuccauu

SEQ ID NO: 7025 - RNA, 20 nt, Artificial Sequence
  Synthetic Oligonucleotide; IFNG exon 2; Set C
aaaugccuaagaaaagaguu

SEQ ID NO: 7026 - RNA, 34 nt, Artificial Sequence
  Synthetic Oligonucleotide; IFNG exon 2; Set C
uucuucaaaaugccuaagaaaagaguuccauuau

SEQ ID NO: 7027 - RNA, 36 nt, Artificial Sequence
  Synthetic Oligonucleotide; IFNG exon 2; Set C
auucuucaaaaugccuaagaaaagaguuccauuauc

SEQ ID NO: 7028 - RNA, 33 nt, Artificial Sequence
  Synthetic Oligonucleotide; IFNG exon 2; Set C
uucuucaaaaugccuaagaaaagaguuccauua

SEQ ID NO: 7029 - RNA, 31 nt, Artificial Sequence
  Synthetic Oligonucleotide; IFNG exon 2; Set C
ucuucaaaaugccuaagaaaagaguuccauu

SEQ ID NO: 7030 - RNA, 21 nt, Artificial Sequence
  Synthetic Oligonucleotide; IFNG exon 2; Set C
aaaaugccuaagaaaagaguu

SEQ ID NO: 7031 - RNA, 19 nt, Artificial Sequence
  Synthetic Oligonucleotide; IFNG exon 2; Set C
aaaugccuaagaaaagagu

SEQ ID NO: 7032 - RNA, 35 nt, Artificial Sequence
  Synthetic Oligonucleotide; IFNG exon 2; Set C
auucuucaaaaugccuaagaaaagaguuccauuau

SEQ ID NO: 7033 - RNA, 37 nt, Artificial Sequence
  Synthetic Oligonucleotide; IFNG exon 2; Set C
aauucuucaaaaugccuaagaaaagaguuccauuauc

SEQ ID NO: 7034 - RNA, 34 nt, Artificial Sequence
  Synthetic Oligonucleotide; IFNG exon 2; Set C
auucuucaaaaugccuaagaaaagaguuccauua

SEQ ID NO: 7035 - RNA, 32 nt, Artificial Sequence
  Synthetic Oligonucleotide; IFNG exon 2; Set C
uucuucaaaaugccuaagaaaagaguuccauu

SEQ ID NO: 7036 - RNA, 22 nt, Artificial Sequence
  Synthetic Oligonucleotide; IFNG exon 2; Set C
caaaaugccuaagaaaagaguu

SEQ ID NO: 7037 - RNA, 20 nt, Artificial Sequence
  Synthetic Oligonucleotide; IFNG exon 2; Set C
aaaaugccuaagaaaagagu

SEQ ID NO: 7038 - RNA, 36 nt, Artificial Sequence
  Synthetic Oligonucleotide; IFNG exon 2; Set C
aauucuucaaaaugccuaagaaaagaguuccauuau

SEQ ID NO: 7039 - RNA, 35 nt, Artificial Sequence
  Synthetic Oligonucleotide; IFNG exon 2; Set C
aauucuucaaaaugccuaagaaaagaguuccauua

SEQ ID NO: 7040 - RNA, 33 nt, Artificial Sequence
  Synthetic Oligonucleotide; IFNG exon 2; Set C
auucuucaaaaugccuaagaaaagaguuccauu

SEQ ID NO: 7041 - RNA, 23 nt, Artificial Sequence
  Synthetic Oligonucleotide; IFNG exon 2; Set C
ucaaaaugccuaagaaaagaguu

SEQ ID NO: 7042 - RNA, 21 nt, Artificial Sequence
  Synthetic Oligonucleotide; IFNG exon 2; Set C
caaaaugccuaagaaaagagu

SEQ ID NO: 7043 - RNA, 37 nt, Artificial Sequence
  Synthetic Oligonucleotide; IFNG exon 2; Set C
caauucuucaaaaugccuaagaaaagaguuccauuau

SEQ ID NO: 7044 - RNA, 34 nt, Artificial Sequence
  Synthetic Oligonucleotide; IFNG exon 2; Set C
aauucuucaaaaugccuaagaaaagaguuccauu

SEQ ID NO: 7045 - RNA, 36 nt, Artificial Sequence
  Synthetic Oligonucleotide; IFNG exon 2; Set C
caauucuucaaaaugccuaagaaaagaguuccauua

SEQ ID NO: 7046 - RNA, 24 nt, Artificial Sequence
  Synthetic Oligonucleotide; IFNG exon 2; Set C
uucaaaaugccuaagaaaagaguu

SEQ ID NO: 7047 - RNA, 22 nt, Artificial Sequence
  Synthetic Oligonucleotide; IFNG exon 2; Set C
ucaaaaugccuaagaaaagagu

SEQ ID NO: 7048 - RNA, 35 nt, Artificial Sequence
  Synthetic Oligonucleotide; IFNG exon 2; Set C
caauucuucaaaaugccuaagaaaagaguuccauu

SEQ ID NO: 7049 - RNA, 25 nt, Artificial Sequence
  Synthetic Oligonucleotide; IFNG exon 2; Set C
cuucaaaaugccuaagaaaagaguu

SEQ ID NO: 7050 - RNA, 23 nt, Artificial Sequence
  Synthetic Oligonucleotide; IFNG exon 2; Set C
uucaaaaugccuaagaaaagagu

SEQ ID NO: 7051 - RNA, 26 nt, Artificial Sequence
  Synthetic Oligonucleotide; IFNG exon 2; Set C
ucuucaaaaugccuaagaaaagaguu

SEQ ID NO: 7052 - RNA, 24 nt, Artificial Sequence
  Synthetic Oligonucleotide; IFNG exon 2; Set C
cuucaaaaugccuaagaaaagagu

SEQ ID NO: 7053 - RNA, 27 nt, Artificial Sequence
  Synthetic Oligonucleotide; IFNG exon 2; Set C
uucuucaaaaugccuaagaaaagaguu

SEQ ID NO: 7054 - RNA, 25 nt, Artificial Sequence
  Synthetic Oligonucleotide; IFNG exon 2; Set C
ucuucaaaaugccuaagaaaagagu

SEQ ID NO: 7055 - RNA, 28 nt, Artificial Sequence
  Synthetic Oligonucleotide; IFNG exon 2; Set C
auucuucaaaaugccuaagaaaagaguu

SEQ ID NO: 7056 - RNA, 26 nt, Artificial Sequence
  Synthetic Oligonucleotide; IFNG exon 2; Set C
uucuucaaaaugccuaagaaaagagu

SEQ ID NO: 7057 - RNA, 29 nt, Artificial Sequence
  Synthetic Oligonucleotide; IFNG exon 2; Set C
aauucuucaaaaugccuaagaaaagaguu

SEQ ID NO: 7058 - RNA, 27 nt, Artificial Sequence
  Synthetic Oligonucleotide; IFNG exon 2; Set C
auucuucaaaaugccuaagaaaagagu

SEQ ID NO: 7059 - RNA, 30 nt, Artificial Sequence
  Synthetic Oligonucleotide; IFNG exon 2; Set C
caauucuucaaaaugccuaagaaaagaguu

SEQ ID NO: 7060 - RNA, 28 nt, Artificial Sequence
  Synthetic Oligonucleotide; IFNG exon 2; Set C
aauucuucaaaaugccuaagaaaagagu

SEQ ID NO: 7061 - RNA, 29 nt, Artificial Sequence
  Synthetic Oligonucleotide; IFNG exon 2; Set C
caauucuucaaaaugccuaagaaaagagu

SEQ ID NO: 7062 - RNA, 30 nt, Artificial Sequence
  Synthetic Oligonucleotide; IFNG exon 2; Set A
uaccucuuuccaauucuucaaaaugccuaa

SEQ ID NO: 7063 - RNA, 29 nt, Artificial Sequence
  Synthetic Oligonucleotide; IFNG exon 2; Set A
uaccucuuuccaauucuucaaaaugccua

SEQ ID NO: 7064 - RNA, 28 nt, Artificial Sequence
  Synthetic Oligonucleotide; IFNG exon 2; Set A
uaccucuuuccaauucuucaaaaugccu

SEQ ID NO: 7065 - RNA, 27 nt, Artificial Sequence
  Synthetic Oligonucleotide; IFNG exon 2; Set C
uaccucuuuccaauucuucaaaaugcc

SEQ ID NO: 7066 - RNA, 40 nt, Artificial Sequence
  Synthetic Oligonucleotide; IFNG exon 2; Set A
aauauucagcuuaccucuuuccaauucuucaaaaugccua

SEQ ID NO: 7067 - RNA, 17 nt, Artificial Sequence
  Synthetic Oligonucleotide; IFNG exon 2; Set C
gggaauauucagcuuac

SEQ ID NO: 7068 - RNA, 29 nt, Artificial Sequence
  Synthetic Oligonucleotide; IFNG exon 2; Set C
aauuagccaaaugggaauauucagcuuac

SEQ ID NO: 7069 - RNA, 17 nt, Artificial Sequence
  Synthetic Oligonucleotide; IFNG exon 2; Set C
auuagccaaaugggaau

SEQ ID NO: 7070 - RNA, 18 nt, Artificial Sequence
  Synthetic Oligonucleotide; IFNG exon 2; Set C
aauuagccaaaugggaau

SEQ ID NO: 7071 - RNA, 16 nt, Artificial Sequence
  Synthetic Oligonucleotide; IFNG exon 2; Set C
auuagccaaaugggaa

SEQ ID NO: 7072 - RNA, 17 nt, Artificial Sequence
  Synthetic Oligonucleotide; IFNG exon 2; Set C
aauuagccaaaugggaa

SEQ ID NO: 7073 - RNA, 15 nt, Artificial Sequence
  Synthetic Oligonucleotide; IFNG exon 2; Set C
auuagccaaauggga

SEQ ID NO: 7074 - RNA, 19 nt, Artificial Sequence
  Synthetic Oligonucleotide; IFNG exon 2; Set C
aaauuagccaaaugggaau

SEQ ID NO: 7075 - RNA, 16 nt, Artificial Sequence
  Synthetic Oligonucleotide; IFNG exon 2; Set C
aauuagccaaauggga

SEQ ID NO: 7076 - RNA, 20 nt, Artificial Sequence
  Synthetic Oligonucleotide; IFNG exon 2; Set C
aaaauuagccaaaugggaau

SEQ ID NO: 7077 - RNA, 18 nt, Artificial Sequence
  Synthetic Oligonucleotide; IFNG exon 2; Set C
aaauuagccaaaugggaa

SEQ ID NO: 7078 - RNA, 15 nt, Artificial Sequence
  Synthetic Oligonucleotide; IFNG exon 2; Set C
aauuagccaaauggg

SEQ ID NO: 7079 - RNA, 19 nt, Artificial Sequence
  Synthetic Oligonucleotide; IFNG exon 2; Set C
aaaauuagccaaaugggaa

SEQ ID NO: 7080 - RNA, 17 nt, Artificial Sequence
  Synthetic Oligonucleotide; IFNG exon 2; Set C
aaauuagccaaauggga

SEQ ID NO: 7081 - RNA, 18 nt, Artificial Sequence
  Synthetic Oligonucleotide; IFNG exon 2; Set C
aaaauuagccaaauggga

SEQ ID NO: 7082 - RNA, 16 nt, Artificial Sequence
  Synthetic Oligonucleotide; IFNG exon 2; Set C
aaauuagccaaauggg

SEQ ID NO: 7083 - RNA, 17 nt, Artificial Sequence
  Synthetic Oligonucleotide; IFNG exon 2; Set C
aaaauuagccaaauggg

SEQ ID NO: 7084 - RNA, 30 nt, Artificial Sequence
  Synthetic Oligonucleotide; IFNG exon 2; Set C
aagcaacaggaaaauuagccaaaugggaau

SEQ ID NO: 7085 - RNA, 29 nt, Artificial Sequence
  Synthetic Oligonucleotide; IFNG exon 2; Set C
aagcaacaggaaaauuagccaaaugggaa

SEQ ID NO: 7086 - RNA, 28 nt, Artificial Sequence
  Synthetic Oligonucleotide; IFNG exon 2; Set C
aagcaacaggaaaauuagccaaauggga

SEQ ID NO: 7087 - RNA, 27 nt, Artificial Sequence
  Synthetic Oligonucleotide; IFNG exon 2; Set C
aagcaacaggaaaauuagccaaauggg

SEQ ID NO: 7088 - RNA, 15 nt, Artificial Sequence
  Synthetic Oligonucleotide; IFNG exon 2; Set C
agcaacaggaaaauu

SEQ ID NO: 7089 - RNA, 16 nt, Artificial Sequence
  Synthetic Oligonucleotide; IFNG exon 2; Set C
aagcaacaggaaaauu

SEQ ID NO: 7090 - RNA, 15 nt, Artificial Sequence
  Synthetic Oligonucleotide; IFNG exon 2; Set C
aagcaacaggaaaau

SEQ ID NO: 7091 - RNA, 17 nt, Artificial Sequence
  Synthetic Oligonucleotide; IFNG exon 2; Set C
caagcaacaggaaaauu

SEQ ID NO: 7092 - RNA, 16 nt, Artificial Sequence
  Synthetic Oligonucleotide; IFNG exon 2; Set C
caagcaacaggaaaau

SEQ ID NO: 7093 - RNA, 22 nt, Artificial Sequence
  Synthetic Oligonucleotide; IFNG exon 2; Set C
gaaagcaagcaacaggaaaauu

SEQ ID NO: 7094 - RNA, 21 nt, Artificial Sequence
  Synthetic Oligonucleotide; IFNG exon 2; Set C
gaaagcaagcaacaggaaaau

SEQ ID NO: 7095 - RNA, 15 nt, Artificial Sequence
  Synthetic Oligonucleotide; IFNG exon 2; Set C
uuagcccauaaauug

SEQ ID NO: 7096 - RNA, 18 nt, Artificial Sequence
  Synthetic Oligonucleotide; IFNG exon 2; Set C
guuuacaauuagcccaua

SEQ ID NO: 7097 - RNA, 19 nt, Artificial Sequence
  Synthetic Oligonucleotide; IFNG exon 2; Set C
gguuuacaauuagcccaua

SEQ ID NO: 7098 - RNA, 20 nt, Artificial Sequence
  Synthetic Oligonucleotide; IFNG exon 2; Set C
ugguuuacaauuagcccaua

SEQ ID NO: 7099 - RNA, 31 nt, Artificial Sequence
  Synthetic Oligonucleotide; IFNG exon 2; Set C
aaaaauugguuuacaauuagcccauaaauug

SEQ ID NO: 7100 - RNA, 21 nt, Artificial Sequence
  Synthetic Oligonucleotide; IFNG exon 2; Set C
uugguuuacaauuagcccaua

SEQ ID NO: 7101 - RNA, 32 nt, Artificial Sequence
  Synthetic Oligonucleotide; IFNG exon 2; Set C
aaaaaauugguuuacaauuagcccauaaauug

SEQ ID NO: 7102 - RNA, 22 nt, Artificial Sequence
  Synthetic Oligonucleotide; IFNG exon 2; Set C
auugguuuacaauuagcccaua

SEQ ID NO: 7103 - RNA, 33 nt, Artificial Sequence
  Synthetic Oligonucleotide; IFNG exon 2; Set C
gaaaaaauugguuuacaauuagcccauaaauug

SEQ ID NO: 7104 - RNA, 23 nt, Artificial Sequence
  Synthetic Oligonucleotide; IFNG exon 2; Set C
aauugguuuacaauuagcccaua

SEQ ID NO: 7105 - RNA, 34 nt, Artificial Sequence
  Synthetic Oligonucleotide; IFNG exon 2; Set C
agaaaaaauugguuuacaauuagcccauaaauug

SEQ ID NO: 7106 - RNA, 24 nt, Artificial Sequence
  Synthetic Oligonucleotide; IFNG exon 2; Set C
aaauugguuuacaauuagcccaua

SEQ ID NO: 7107 - RNA, 35 nt, Artificial Sequence
  Synthetic Oligonucleotide; IFNG exon 2; Set C
aagaaaaaauugguuuacaauuagcccauaaauug

SEQ ID NO: 7108 - RNA, 25 nt, Artificial Sequence
  Synthetic Oligonucleotide; IFNG exon 2; Set C
aaaauugguuuacaauuagcccaua

SEQ ID NO: 7109 - RNA, 36 nt, Artificial Sequence
  Synthetic Oligonucleotide; IFNG exon 2; Set C
aaagaaaaaauugguuuacaauuagcccauaaauug

SEQ ID NO: 7110 - RNA, 32 nt, Artificial Sequence
  Synthetic Oligonucleotide; IFNG exon 2; Set C
aaaagaaaaaauugguuuacaauuagcccaua

SEQ ID NO: 7111 - RNA, 33 nt, Artificial Sequence
  Synthetic Oligonucleotide; IFNG exon 2; Set C
aaaaagaaaaaauugguuuacaauuagcccaua

SEQ ID NO: 7112 - RNA, 34 nt, Artificial Sequence
  Synthetic Oligonucleotide; IFNG exon 2; Set C
aaaaaagaaaaaauugguuuacaauuagcccaua

SEQ ID NO: 7113 - RNA, 35 nt, Artificial Sequence
  Synthetic Oligonucleotide; IFNG exon 2; Set C
aaaaaaagaaaaaauugguuuacaauuagcccaua

SEQ ID NO: 7114 - RNA, 36 nt, Artificial Sequence
  Synthetic Oligonucleotide; IFNG exon 2; Set C
aaaaaaaagaaaaaauugguuuacaauuagcccaua

SEQ ID NO: 7115 - RNA, 37 nt, Artificial Sequence
  Synthetic Oligonucleotide; IFNG exon 2; Set C
aaaaaaaaagaaaaaauugguuuacaauuagcccaua

SEQ ID NO: 7116 - RNA, 38 nt, Artificial Sequence
  Synthetic Oligonucleotide; IFNG exon 2; Set C
aaaaaaaaaagaaaaaauugguuuacaauuagcccaua

SEQ ID NO: 7117 - RNA, 39 nt, Artificial Sequence
  Synthetic Oligonucleotide; IFNG exon 2; Set C
aaaaaaaaaaagaaaaaauugguuuacaauuagcccaua

SEQ ID NO: 7118 - RNA, 40 nt, Artificial Sequence
  Synthetic Oligonucleotide; IFNG exon 2; Set C
aaaaaaaaaaaagaaaaaauugguuuacaauuagcccaua

SEQ ID NO: 7119 - RNA, 18 nt, Artificial Sequence
  Synthetic Oligonucleotide; IFNG exon 2; Set C
aaaagaaaaaauugguuu

SEQ ID NO: 7120 - RNA, 19 nt, Artificial Sequence
  Synthetic Oligonucleotide; IFNG exon 2; Set C
aaaaagaaaaaauugguuu

SEQ ID NO: 7121 - RNA, 20 nt, Artificial Sequence
  Synthetic Oligonucleotide; IFNG exon 2; Set C
aaaaaagaaaaaauugguuu

SEQ ID NO: 7122 - RNA, 21 nt, Artificial Sequence
  Synthetic Oligonucleotide; IFNG exon 2; Set C
aaaaaaagaaaaaauugguuu

SEQ ID NO: 7123 - RNA, 22 nt, Artificial Sequence
  Synthetic Oligonucleotide; IFNG exon 2; Set C
aaaaaaaagaaaaaauugguuu

SEQ ID NO: 7124 - RNA, 23 nt, Artificial Sequence
  Synthetic Oligonucleotide; IFNG exon 2; Set C
aaaaaaaaagaaaaaauugguuu

SEQ ID NO: 7125 - RNA, 24 nt, Artificial Sequence
  Synthetic Oligonucleotide; IFNG exon 2; Set C
aaaaaaaaaagaaaaaauugguuu

SEQ ID NO: 7126 - RNA, 25 nt, Artificial Sequence
  Synthetic Oligonucleotide; IFNG exon 2; Set C
aaaaaaaaaaagaaaaaauugguuu

SEQ ID NO: 7127 - RNA, 26 nt, Artificial Sequence
  Synthetic Oligonucleotide; IFNG exon 2; Set C
aaaaaaaaaaaagaaaaaauugguuu

SEQ ID NO: 7128 - RNA, 27 nt, Artificial Sequence
  Synthetic Oligonucleotide; IFNG exon 2; Set C
aaaaaaaaaaaaagaaaaaauugguuu

SEQ ID NO: 7129 - RNA, 34 nt, Artificial Sequence
  Synthetic Oligonucleotide; IFNG exon 2; Set C
ugcauucuaaaaaaaaaaaaagaaaaaauugguu

SEQ ID NO: 7130 - RNA, 35 nt, Artificial Sequence
  Synthetic Oligonucleotide; IFNG exon 2; Set C
cugcauucuaaaaaaaaaaaaagaaaaaauugguu

SEQ ID NO: 7131 - RNA, 33 nt, Artificial Sequence
  Synthetic Oligonucleotide; IFNG exon 2; Set C
ugcauucuaaaaaaaaaaaaagaaaaaauuggu

SEQ ID NO: 7132 - RNA, 34 nt, Artificial Sequence
  Synthetic Oligonucleotide; IFNG exon 2; Set C
cugcauucuaaaaaaaaaaaaagaaaaaauuggu

SEQ ID NO: 7133 - RNA, 32 nt, Artificial Sequence
  Synthetic Oligonucleotide; IFNG exon 2; Set C
ugcauucuaaaaaaaaaaaaagaaaaaauugg

SEQ ID NO: 7134 - RNA, 33 nt, Artificial Sequence
  Synthetic Oligonucleotide; IFNG exon 2; Set C
cugcauucuaaaaaaaaaaaaagaaaaaauugg

SEQ ID NO: 7135 - RNA, 31 nt, Artificial Sequence
  Synthetic Oligonucleotide; IFNG exon 2; Set C
ugcauucuaaaaaaaaaaaaagaaaaaauug

SEQ ID NO: 7136 - RNA, 30 nt, Artificial Sequence
  Synthetic Oligonucleotide; IFNG exon 2; Set C
ugcauucuaaaaaaaaaaaaagaaaaaauu

SEQ ID NO: 7137 - RNA, 32 nt, Artificial Sequence
  Synthetic Oligonucleotide; IFNG exon 2; Set C
cugcauucuaaaaaaaaaaaaagaaaaaauug

SEQ ID NO: 7138 - RNA, 29 nt, Artificial Sequence
  Synthetic Oligonucleotide; IFNG exon 2; Set C
ugcauucuaaaaaaaaaaaaagaaaaaau

SEQ ID NO: 7139 - RNA, 31 nt, Artificial Sequence
  Synthetic Oligonucleotide; IFNG exon 2; Set C
cugcauucuaaaaaaaaaaaaagaaaaaauu

SEQ ID NO: 7140 - RNA, 28 nt, Artificial Sequence
  Synthetic Oligonucleotide; IFNG exon 2; Set C
ugcauucuaaaaaaaaaaaaagaaaaaa

SEQ ID NO: 7141 - RNA, 30 nt, Artificial Sequence
  Synthetic Oligonucleotide; IFNG exon 2; Set C
cugcauucuaaaaaaaaaaaaagaaaaaau

SEQ ID NO: 7142 - RNA, 29 nt, Artificial Sequence
  Synthetic Oligonucleotide; IFNG exon 2; Set C
cugcauucuaaaaaaaaaaaaagaaaaaa

SEQ ID NO: 7143 - RNA, 27 nt, Artificial Sequence
  Synthetic Oligonucleotide; IFNG exon 2; Set C
ugcauucuaaaaaaaaaaaaagaaaaa

SEQ ID NO: 7144 - RNA, 28 nt, Artificial Sequence
  Synthetic Oligonucleotide; IFNG exon 2; Set C
cugcauucuaaaaaaaaaaaaagaaaaa

SEQ ID NO: 7145 - RNA, 27 nt, Artificial Sequence
  Synthetic Oligonucleotide; IFNG exon 2; Set C
cugcauucuaaaaaaaaaaaaagaaaa

SEQ ID NO: 7146 - RNA, 20 nt, Artificial Sequence
  Synthetic Oligonucleotide; IFNG exon 2; Set C
ugcauucuaaaaaaaaaaaa

SEQ ID NO: 7147 - RNA, 21 nt, Artificial Sequence
  Synthetic Oligonucleotide; IFNG exon 2; Set C
cugcauucuaaaaaaaaaaaa

SEQ ID NO: 7148 - RNA, 33 nt, Artificial Sequence
  Synthetic Oligonucleotide; IFNG exon 2; Set C
aaugaccugcauucuaaaaaaaaaaaaagaaaa

SEQ ID NO: 7149 - RNA, 20 nt, Artificial Sequence
  Synthetic Oligonucleotide; IFNG exon 2; Set C
cugcauucuaaaaaaaaaaa

SEQ ID NO: 7150 - RNA, 34 nt, Artificial Sequence
  Synthetic Oligonucleotide; IFNG exon 2; Set C
gaaugaccugcauucuaaaaaaaaaaaaagaaaa

SEQ ID NO: 7151 - RNA, 32 nt, Artificial Sequence
  Synthetic Oligonucleotide; IFNG exon 2; Set C
aaugaccugcauucuaaaaaaaaaaaaagaaa

SEQ ID NO: 7152 - RNA, 19 nt, Artificial Sequence
  Synthetic Oligonucleotide; IFNG exon 2; Set C
cugcauucuaaaaaaaaaa

SEQ ID NO: 7153 - RNA, 35 nt, Artificial Sequence
  Synthetic Oligonucleotide; IFNG exon 2; Set C
ugaaugaccugcauucuaaaaaaaaaaaaagaaaa

SEQ ID NO: 7154 - RNA, 31 nt, Artificial Sequence
  Synthetic Oligonucleotide; IFNG exon 2; Set C
aaugaccugcauucuaaaaaaaaaaaaagaa

SEQ ID NO: 7155 - RNA, 33 nt, Artificial Sequence
  Synthetic Oligonucleotide; IFNG exon 2; Set C
gaaugaccugcauucuaaaaaaaaaaaaagaaa

SEQ ID NO: 7156 - RNA, 18 nt, Artificial Sequence
  Synthetic Oligonucleotide; IFNG exon 2; Set C
cugcauucuaaaaaaaaa

SEQ ID NO: 7157 - RNA, 32 nt, Artificial Sequence
  Synthetic Oligonucleotide; IFNG exon 2; Set C
gaaugaccugcauucuaaaaaaaaaaaaagaa

SEQ ID NO: 7158 - RNA, 34 nt, Artificial Sequence
  Synthetic Oligonucleotide; IFNG exon 2; Set C
ugaaugaccugcauucuaaaaaaaaaaaaagaaa

SEQ ID NO: 7159 - RNA, 30 nt, Artificial Sequence
  Synthetic Oligonucleotide; IFNG exon 2; Set C
aaugaccugcauucuaaaaaaaaaaaaaga

SEQ ID NO: 7160 - RNA, 33 nt, Artificial Sequence
  Synthetic Oligonucleotide; IFNG exon 2; Set C
ugaaugaccugcauucuaaaaaaaaaaaaagaa

SEQ ID NO: 7161 - RNA, 29 nt, Artificial Sequence
  Synthetic Oligonucleotide; IFNG exon 2; Set C
aaugaccugcauucuaaaaaaaaaaaaag

SEQ ID NO: 7162 - RNA, 31 nt, Artificial Sequence
  Synthetic Oligonucleotide; IFNG exon 2; Set C
gaaugaccugcauucuaaaaaaaaaaaaaga

SEQ ID NO: 7163 - RNA, 28 nt, Artificial Sequence
  Synthetic Oligonucleotide; IFNG exon 2; Set C
aaugaccugcauucuaaaaaaaaaaaaa

SEQ ID NO: 7164 - RNA, 30 nt, Artificial Sequence
  Synthetic Oligonucleotide; IFNG exon 2; Set C
gaaugaccugcauucuaaaaaaaaaaaaag

SEQ ID NO: 7165 - RNA, 32 nt, Artificial Sequence
  Synthetic Oligonucleotide; IFNG exon 2; Set C
ugaaugaccugcauucuaaaaaaaaaaaaaga

SEQ ID NO: 7166 - RNA, 29 nt, Artificial Sequence
  Synthetic Oligonucleotide; IFNG exon 2; Set C
gaaugaccugcauucuaaaaaaaaaaaaa

SEQ ID NO: 7167 - RNA, 31 nt, Artificial Sequence
  Synthetic Oligonucleotide; IFNG exon 2; Set C
ugaaugaccugcauucuaaaaaaaaaaaaag

SEQ ID NO: 7168 - RNA, 26 nt, Artificial Sequence
  Synthetic Oligonucleotide; IFNG exon 2; Set C
aaugaccugcauucuaaaaaaaaaaa

SEQ ID NO: 7169 - RNA, 40 nt, Artificial Sequence
  Synthetic Oligonucleotide; IFNG exon 2; Set C
acaucugaaugaccugcauucuaaaaaaaaaaaaagaaaa

SEQ ID NO: 7170 - RNA, 30 nt, Artificial Sequence
  Synthetic Oligonucleotide; IFNG exon 2; Set C
ugaaugaccugcauucuaaaaaaaaaaaaa

SEQ ID NO: 7171 - RNA, 25 nt, Artificial Sequence
  Synthetic Oligonucleotide; IFNG exon 2; Set C
aaugaccugcauucuaaaaaaaaaa

SEQ ID NO: 7172 - RNA, 39 nt, Artificial Sequence
  Synthetic Oligonucleotide; IFNG exon 2; Set C
acaucugaaugaccugcauucuaaaaaaaaaaaaagaaa

SEQ ID NO: 7173 - RNA, 24 nt, Artificial Sequence
  Synthetic Oligonucleotide; IFNG exon 2; Set C
aaugaccugcauucuaaaaaaaaa

SEQ ID NO: 7174 - RNA, 26 nt, Artificial Sequence
  Synthetic Oligonucleotide; IFNG exon 2; Set C
gaaugaccugcauucuaaaaaaaaaa

SEQ ID NO: 7175 - RNA, 40 nt, Artificial Sequence
  Synthetic Oligonucleotide; IFNG exon 2; Set C
uacaucugaaugaccugcauucuaaaaaaaaaaaaagaaa

SEQ ID NO: 7176 - RNA, 38 nt, Artificial Sequence
  Synthetic Oligonucleotide; IFNG exon 2; Set C
acaucugaaugaccugcauucuaaaaaaaaaaaaagaa

SEQ ID NO: 7177 - RNA, 23 nt, Artificial Sequence
  Synthetic Oligonucleotide; IFNG exon 2; Set C
aaugaccugcauucuaaaaaaaa

SEQ ID NO: 7178 - RNA, 25 nt, Artificial Sequence
  Synthetic Oligonucleotide; IFNG exon 2; Set C
gaaugaccugcauucuaaaaaaaaa

SEQ ID NO: 7179 - RNA, 39 nt, Artificial Sequence
  Synthetic Oligonucleotide; IFNG exon 2; Set C
uacaucugaaugaccugcauucuaaaaaaaaaaaaagaa

SEQ ID NO: 7180 - RNA, 22 nt, Artificial Sequence
  Synthetic Oligonucleotide; IFNG exon 2; Set C
aaugaccugcauucuaaaaaaa

SEQ ID NO: 7181 - RNA, 24 nt, Artificial Sequence
  Synthetic Oligonucleotide; IFNG exon 2; Set C
gaaugaccugcauucuaaaaaaaa

SEQ ID NO: 7182 - RNA, 26 nt, Artificial Sequence
  Synthetic Oligonucleotide; IFNG exon 2; Set C
ugaaugaccugcauucuaaaaaaaaa

SEQ ID NO: 7183 - RNA, 40 nt, Artificial Sequence
  Synthetic Oligonucleotide; IFNG exon 2; Set C
cuacaucugaaugaccugcauucuaaaaaaaaaaaaagaa

SEQ ID NO: 7184 - RNA, 38 nt, Artificial Sequence
  Synthetic Oligonucleotide; IFNG exon 2; Set C
uacaucugaaugaccugcauucuaaaaaaaaaaaaaga

SEQ ID NO: 7185 - RNA, 21 nt, Artificial Sequence
  Synthetic Oligonucleotide; IFNG exon 2; Set C
aaugaccugcauucuaaaaaa

SEQ ID NO: 7186 - RNA, 23 nt, Artificial Sequence
  Synthetic Oligonucleotide; IFNG exon 2; Set C
gaaugaccugcauucuaaaaaaa

SEQ ID NO: 7187 - RNA, 25 nt, Artificial Sequence
  Synthetic Oligonucleotide; IFNG exon 2; Set C
ugaaugaccugcauucuaaaaaaaa

SEQ ID NO: 7188 - RNA, 37 nt, Artificial Sequence
  Synthetic Oligonucleotide; IFNG exon 2; Set C
uacaucugaaugaccugcauucuaaaaaaaaaaaaag

SEQ ID NO: 7189 - RNA, 39 nt, Artificial Sequence
  Synthetic Oligonucleotide; IFNG exon 2; Set C
cuacaucugaaugaccugcauucuaaaaaaaaaaaaaga

SEQ ID NO: 7190 - RNA, 20 nt, Artificial Sequence
  Synthetic Oligonucleotide; IFNG exon 2; Set C
aaugaccugcauucuaaaaa

SEQ ID NO: 7191 - RNA, 22 nt, Artificial Sequence
  Synthetic Oligonucleotide; IFNG exon 2; Set C
gaaugaccugcauucuaaaaaa

SEQ ID NO: 7192 - RNA, 24 nt, Artificial Sequence
  Synthetic Oligonucleotide; IFNG exon 2; Set C
ugaaugaccugcauucuaaaaaaa

SEQ ID NO: 7193 - RNA, 34 nt, Artificial Sequence
  Synthetic Oligonucleotide; IFNG exon 2; Set C
acaucugaaugaccugcauucuaaaaaaaaaaaa

SEQ ID NO: 7194 - RNA, 36 nt, Artificial Sequence
  Synthetic Oligonucleotide; IFNG exon 2; Set C
uacaucugaaugaccugcauucuaaaaaaaaaaaaa

SEQ ID NO: 7195 - RNA, 38 nt, Artificial Sequence
  Synthetic Oligonucleotide; IFNG exon 2; Set C
cuacaucugaaugaccugcauucuaaaaaaaaaaaaag

SEQ ID NO: 7196 - RNA, 40 nt, Artificial Sequence
  Synthetic Oligonucleotide; IFNG exon 2; Set C
gcuacaucugaaugaccugcauucuaaaaaaaaaaaaaga

SEQ ID NO: 7197 - RNA, 19 nt, Artificial Sequence
  Synthetic Oligonucleotide; IFNG exon 2; Set C
aaugaccugcauucuaaaa

SEQ ID NO: 7198 - RNA, 21 nt, Artificial Sequence
  Synthetic Oligonucleotide; IFNG exon 2; Set C
gaaugaccugcauucuaaaaa

SEQ ID NO: 7199 - RNA, 35 nt, Artificial Sequence
  Synthetic Oligonucleotide; IFNG exon 2; Set C
uacaucugaaugaccugcauucuaaaaaaaaaaaa

SEQ ID NO: 7200 - RNA, 23 nt, Artificial Sequence
  Synthetic Oligonucleotide; IFNG exon 2; Set C
ugaaugaccugcauucuaaaaaa

SEQ ID NO: 7201 - RNA, 33 nt, Artificial Sequence
  Synthetic Oligonucleotide; IFNG exon 2; Set C
acaucugaaugaccugcauucuaaaaaaaaaaa

SEQ ID NO: 7202 - RNA, 37 nt, Artificial Sequence
  Synthetic Oligonucleotide; IFNG exon 2; Set C
cuacaucugaaugaccugcauucuaaaaaaaaaaaaa

SEQ ID NO: 7203 - RNA, 39 nt, Artificial Sequence
  Synthetic Oligonucleotide; IFNG exon 2; Set C
gcuacaucugaaugaccugcauucuaaaaaaaaaaaaag

SEQ ID NO: 7204 - RNA, 18 nt, Artificial Sequence
  Synthetic Oligonucleotide; IFNG exon 2; Set C
aaugaccugcauucuaaa

SEQ ID NO: 7205 - RNA, 20 nt, Artificial Sequence
  Synthetic Oligonucleotide; IFNG exon 2; Set C
gaaugaccugcauucuaaaa

SEQ ID NO: 7206 - RNA, 34 nt, Artificial Sequence
  Synthetic Oligonucleotide; IFNG exon 2; Set C
uacaucugaaugaccugcauucuaaaaaaaaaaa

SEQ ID NO: 7207 - RNA, 22 nt, Artificial Sequence
  Synthetic Oligonucleotide; IFNG exon 2; Set C
ugaaugaccugcauucuaaaaa

SEQ ID NO: 7208 - RNA, 32 nt, Artificial Sequence
  Synthetic Oligonucleotide; IFNG exon 2; Set C
acaucugaaugaccugcauucuaaaaaaaaaa

SEQ ID NO: 7209 - RNA, 38 nt, Artificial Sequence
  Synthetic Oligonucleotide; IFNG exon 2; Set C
gcuacaucugaaugaccugcauucuaaaaaaaaaaaaa

SEQ ID NO: 7210 - RNA, 19 nt, Artificial Sequence
  Synthetic Oligonucleotide; IFNG exon 2; Set C
gaaugaccugcauucuaaa

SEQ ID NO: 7211 - RNA, 33 nt, Artificial Sequence
  Synthetic Oligonucleotide; IFNG exon 2; Set C
uacaucugaaugaccugcauucuaaaaaaaaaa

SEQ ID NO: 7212 - RNA, 21 nt, Artificial Sequence
  Synthetic Oligonucleotide; IFNG exon 2; Set C
ugaaugaccugcauucuaaaa

SEQ ID NO: 7213 - RNA, 31 nt, Artificial Sequence
  Synthetic Oligonucleotide; IFNG exon 2; Set C
acaucugaaugaccugcauucuaaaaaaaaa

SEQ ID NO: 7214 - RNA, 34 nt, Artificial Sequence
  Synthetic Oligonucleotide; IFNG exon 2; Set C
cuacaucugaaugaccugcauucuaaaaaaaaaa

SEQ ID NO: 7215 - RNA, 32 nt, Artificial Sequence
  Synthetic Oligonucleotide; IFNG exon 2; Set C
uacaucugaaugaccugcauucuaaaaaaaaa

SEQ ID NO: 7216 - RNA, 20 nt, Artificial Sequence
  Synthetic Oligonucleotide; IFNG exon 2; Set C
ugaaugaccugcauucuaaa

SEQ ID NO: 7217 - RNA, 30 nt, Artificial Sequence
  Synthetic Oligonucleotide; IFNG exon 2; Set C
acaucugaaugaccugcauucuaaaaaaaa

SEQ ID NO: 7218 - RNA, 18 nt, Artificial Sequence
  Synthetic Oligonucleotide; IFNG exon 2; Set C
gaaugaccugcauucuaa

SEQ ID NO: 7219 - RNA, 33 nt, Artificial Sequence
  Synthetic Oligonucleotide; IFNG exon 2; Set C
cuacaucugaaugaccugcauucuaaaaaaaaa

SEQ ID NO: 7220 - RNA, 31 nt, Artificial Sequence
  Synthetic Oligonucleotide; IFNG exon 2; Set C
uacaucugaaugaccugcauucuaaaaaaaa

SEQ ID NO: 7221 - RNA, 29 nt, Artificial Sequence
  Synthetic Oligonucleotide; IFNG exon 2; Set C
acaucugaaugaccugcauucuaaaaaaa

SEQ ID NO: 7222 - RNA, 19 nt, Artificial Sequence
  Synthetic Oligonucleotide; IFNG exon 2; Set C
ugaaugaccugcauucuaa

SEQ ID NO: 7223 - RNA, 32 nt, Artificial Sequence
  Synthetic Oligonucleotide; IFNG exon 2; Set C
cuacaucugaaugaccugcauucuaaaaaaaa

SEQ ID NO: 7224 - RNA, 30 nt, Artificial Sequence
  Synthetic Oligonucleotide; IFNG exon 2; Set C
uacaucugaaugaccugcauucuaaaaaaa

SEQ ID NO: 7225 - RNA, 28 nt, Artificial Sequence
  Synthetic Oligonucleotide; IFNG exon 2; Set C
acaucugaaugaccugcauucuaaaaaa

SEQ ID NO: 7226 - RNA, 31 nt, Artificial Sequence
  Synthetic Oligonucleotide; IFNG exon 2; Set C
cuacaucugaaugaccugcauucuaaaaaaa

SEQ ID NO: 7227 - RNA, 29 nt, Artificial Sequence
  Synthetic Oligonucleotide; IFNG exon 2; Set C
uacaucugaaugaccugcauucuaaaaaa

SEQ ID NO: 7228 - RNA, 32 nt, Artificial Sequence
  Synthetic Oligonucleotide; IFNG exon 2; Set A
gcuacaucugaaugaccugcauucuaaaaaaa

SEQ ID NO: 7229 - RNA, 30 nt, Artificial Sequence
  Synthetic Oligonucleotide; IFNG exon 2; Set C
cuacaucugaaugaccugcauucuaaaaaa

SEQ ID NO: 7230 - RNA, 28 nt, Artificial Sequence
  Synthetic Oligonucleotide; IFNG exon 2; Set C
uacaucugaaugaccugcauucuaaaaa

SEQ ID NO: 7231 - RNA, 40 nt, Artificial Sequence
  Synthetic Oligonucleotide; IFNG exon 2; Set A
auccgcuacaucugaaugaccugcauucuaaaaaaaaaaa

SEQ ID NO: 7232 - RNA, 31 nt, Artificial Sequence
  Synthetic Oligonucleotide; IFNG exon 2; Set A
gcuacaucugaaugaccugcauucuaaaaaa

SEQ ID NO: 7233 - RNA, 29 nt, Artificial Sequence
  Synthetic Oligonucleotide; IFNG exon 2; Set C
cuacaucugaaugaccugcauucuaaaaa

SEQ ID NO: 7234 - RNA, 27 nt, Artificial Sequence
  Synthetic Oligonucleotide; IFNG exon 2; Set C
uacaucugaaugaccugcauucuaaaa

SEQ ID NO: 7235 - RNA, 39 nt, Artificial Sequence
  Synthetic Oligonucleotide; IFNG exon 2; Set A
auccgcuacaucugaaugaccugcauucuaaaaaaaaaa

SEQ ID NO: 7236 - RNA, 30 nt, Artificial Sequence
  Synthetic Oligonucleotide; IFNG exon 2; Set A
gcuacaucugaaugaccugcauucuaaaaa

SEQ ID NO: 7237 - RNA, 28 nt, Artificial Sequence
  Synthetic Oligonucleotide; IFNG exon 2; Set C
cuacaucugaaugaccugcauucuaaaa

SEQ ID NO: 7238 - RNA, 26 nt, Artificial Sequence
  Synthetic Oligonucleotide; IFNG exon 2; Set C
uacaucugaaugaccugcauucuaaa

SEQ ID NO: 7239 - RNA, 40 nt, Artificial Sequence
  Synthetic Oligonucleotide; IFNG exon 2; Set A
uauccgcuacaucugaaugaccugcauucuaaaaaaaaaa

SEQ ID NO: 7240 - RNA, 38 nt, Artificial Sequence
  Synthetic Oligonucleotide; IFNG exon 2; Set A
auccgcuacaucugaaugaccugcauucuaaaaaaaaa

SEQ ID NO: 7241 - RNA, 29 nt, Artificial Sequence
  Synthetic Oligonucleotide; IFNG exon 2; Set A
gcuacaucugaaugaccugcauucuaaaa

SEQ ID NO: 7242 - RNA, 27 nt, Artificial Sequence
  Synthetic Oligonucleotide; IFNG exon 2; Set A
cuacaucugaaugaccugcauucuaaa

SEQ ID NO: 7243 - RNA, 39 nt, Artificial Sequence
  Synthetic Oligonucleotide; IFNG exon 2; Set A
uauccgcuacaucugaaugaccugcauucuaaaaaaaaa

SEQ ID NO: 7244 - RNA, 37 nt, Artificial Sequence
  Synthetic Oligonucleotide; IFNG exon 2; Set A
auccgcuacaucugaaugaccugcauucuaaaaaaaa

SEQ ID NO: 7245 - RNA, 25 nt, Artificial Sequence
  Synthetic Oligonucleotide; IFNG exon 2; Set C
uacaucugaaugaccugcauucuaa

SEQ ID NO: 7246 - RNA, 28 nt, Artificial Sequence
  Synthetic Oligonucleotide; IFNG exon 2; Set A
gcuacaucugaaugaccugcauucuaaa

SEQ ID NO: 7247 - RNA, 38 nt, Artificial Sequence
  Synthetic Oligonucleotide; IFNG exon 2; Set A
uauccgcuacaucugaaugaccugcauucuaaaaaaaa

SEQ ID NO: 7248 - RNA, 36 nt, Artificial Sequence
  Synthetic Oligonucleotide; IFNG exon 2; Set A
auccgcuacaucugaaugaccugcauucuaaaaaaa

SEQ ID NO: 7249 - RNA, 26 nt, Artificial Sequence
  Synthetic Oligonucleotide; IFNG exon 2; Set A
cuacaucugaaugaccugcauucuaa

SEQ ID NO: 7250 - RNA, 37 nt, Artificial Sequence
  Synthetic Oligonucleotide; IFNG exon 2; Set A
uauccgcuacaucugaaugaccugcauucuaaaaaaa

SEQ ID NO: 7251 - RNA, 35 nt, Artificial Sequence
  Synthetic Oligonucleotide; IFNG exon 2; Set A
auccgcuacaucugaaugaccugcauucuaaaaaa

SEQ ID NO: 7252 - RNA, 27 nt, Artificial Sequence
  Synthetic Oligonucleotide; IFNG exon 2; Set A
gcuacaucugaaugaccugcauucuaa

SEQ ID NO: 7253 - RNA, 36 nt, Artificial Sequence
  Synthetic Oligonucleotide; IFNG exon 2; Set A
uauccgcuacaucugaaugaccugcauucuaaaaaa

SEQ ID NO: 7254 - RNA, 34 nt, Artificial Sequence
  Synthetic Oligonucleotide; IFNG exon 2; Set A
auccgcuacaucugaaugaccugcauucuaaaaa

SEQ ID NO: 7255 - RNA, 35 nt, Artificial Sequence
  Synthetic Oligonucleotide; IFNG exon 2; Set A
uauccgcuacaucugaaugaccugcauucuaaaaa

SEQ ID NO: 7256 - RNA, 33 nt, Artificial Sequence
  Synthetic Oligonucleotide; IFNG exon 2; Set A
auccgcuacaucugaaugaccugcauucuaaaa

SEQ ID NO: 7257 - RNA, 34 nt, Artificial Sequence
  Synthetic Oligonucleotide; IFNG exon 2; Set A
uauccgcuacaucugaaugaccugcauucuaaaa

SEQ ID NO: 7258 - RNA, 32 nt, Artificial Sequence
  Synthetic Oligonucleotide; IFNG exon 2; Set A
auccgcuacaucugaaugaccugcauucuaaa

SEQ ID NO: 7259 - RNA, 33 nt, Artificial Sequence
  Synthetic Oligonucleotide; IFNG exon 2; Set A
uauccgcuacaucugaaugaccugcauucuaaa

SEQ ID NO: 7260 - RNA, 34 nt, Artificial Sequence
  Synthetic Oligonucleotide; IFNG exon 2; Set A
uuauccgcuacaucugaaugaccugcauucuaaa

SEQ ID NO: 7261 - RNA, 32 nt, Artificial Sequence
  Synthetic Oligonucleotide; IFNG exon 2; Set C
uauccgcuacaucugaaugaccugcauucuaa

SEQ ID NO: 7262 - RNA, 33 nt, Artificial Sequence
  Synthetic Oligonucleotide; IFNG exon 2; Set C
uuauccgcuacaucugaaugaccugcauucuaa

SEQ ID NO: 7263 - RNA, 34 nt, Artificial Sequence
  Synthetic Oligonucleotide; IFNG exon 2; Set C
auuauccgcuacaucugaaugaccugcauucuaa

SEQ ID NO: 7264 - RNA, 19 nt, Artificial Sequence
  Synthetic Oligonucleotide; IFNG exon 2; Set C
gcuacaucugaaugaccug

SEQ ID NO: 7265 - RNA, 40 nt, Artificial Sequence
  Synthetic Oligonucleotide; IFNG exon 2; Set C
guuccauuauccgcuacaucugaaugaccugcauucuaaa

SEQ ID NO: 7266 - RNA, 39 nt, Artificial Sequence
  Synthetic Oligonucleotide; IFNG exon 2; Set C
guuccauuauccgcuacaucugaaugaccugcauucuaa

SEQ ID NO: 7267 - RNA, 40 nt, Artificial Sequence
  Synthetic Oligonucleotide; IFNG exon 2; Set C
aguuccauuauccgcuacaucugaaugaccugcauucuaa

SEQ ID NO: 7268 - RNA, 26 nt, Artificial Sequence
  Synthetic Oligonucleotide; IFNG exon 2; Set A
uuauccgcuacaucugaaugaccugc

SEQ ID NO: 7269 - RNA, 25 nt, Artificial Sequence
  Synthetic Oligonucleotide; IFNG exon 2; Set A
uuauccgcuacaucugaaugaccug

SEQ ID NO: 7270 - RNA, 27 nt, Artificial Sequence
  Synthetic Oligonucleotide; IFNG exon 2; Set A
auuauccgcuacaucugaaugaccugc

SEQ ID NO: 7271 - RNA, 26 nt, Artificial Sequence
  Synthetic Oligonucleotide; IFNG exon 2; Set A
auuauccgcuacaucugaaugaccug

SEQ ID NO: 7272 - RNA, 17 nt, Artificial Sequence
  Synthetic Oligonucleotide; IFNG exon 2; Set C
auccgcuacaucugaau

SEQ ID NO: 7273 - RNA, 16 nt, Artificial Sequence
  Synthetic Oligonucleotide; IFNG exon 2; Set C
auccgcuacaucugaa

SEQ ID NO: 7274 - RNA, 32 nt, Artificial Sequence
  Synthetic Oligonucleotide; IFNG exon 2; Set C
guuccauuauccgcuacaucugaaugaccugc

SEQ ID NO: 7275 - RNA, 15 nt, Artificial Sequence
  Synthetic Oligonucleotide; IFNG exon 2; Set C
auccgcuacaucuga

SEQ ID NO: 7276 - RNA, 31 nt, Artificial Sequence
  Synthetic Oligonucleotide; IFNG exon 2; Set C
guuccauuauccgcuacaucugaaugaccug

SEQ ID NO: 7277 - RNA, 33 nt, Artificial Sequence
  Synthetic Oligonucleotide; IFNG exon 2; Set C
aguuccauuauccgcuacaucugaaugaccugc

SEQ ID NO: 7278 - RNA, 32 nt, Artificial Sequence
  Synthetic Oligonucleotide; IFNG exon 2; Set C
aguuccauuauccgcuacaucugaaugaccug

SEQ ID NO: 7279 - RNA, 35 nt, Artificial Sequence
  Synthetic Oligonucleotide; IFNG exon 2; Set A
uaagaaaagaguuccauuauccgcuacaucugaau

SEQ ID NO: 7280 - RNA, 34 nt, Artificial Sequence
  Synthetic Oligonucleotide; IFNG exon 2; Set A
uaagaaaagaguuccauuauccgcuacaucugaa

SEQ ID NO: 7281 - RNA, 37 nt, Artificial Sequence
  Synthetic Oligonucleotide; IFNG exon 2; Set A
ccuaagaaaagaguuccauuauccgcuacaucugaau

SEQ ID NO: 7282 - RNA, 35 nt, Artificial Sequence
  Synthetic Oligonucleotide; IFNG exon 2; Set A
cuaagaaaagaguuccauuauccgcuacaucugaa

SEQ ID NO: 7283 - RNA, 33 nt, Artificial Sequence
  Synthetic Oligonucleotide; IFNG exon 2; Set A
uaagaaaagaguuccauuauccgcuacaucuga

SEQ ID NO: 7284 - RNA, 38 nt, Artificial Sequence
  Synthetic Oligonucleotide; IFNG exon 2; Set A
gccuaagaaaagaguuccauuauccgcuacaucugaau

SEQ ID NO: 7285 - RNA, 36 nt, Artificial Sequence
  Synthetic Oligonucleotide; IFNG exon 2; Set A
ccuaagaaaagaguuccauuauccgcuacaucugaa

SEQ ID NO: 7286 - RNA, 34 nt, Artificial Sequence
  Synthetic Oligonucleotide; IFNG exon 2; Set A
cuaagaaaagaguuccauuauccgcuacaucuga

SEQ ID NO: 7287 - RNA, 39 nt, Artificial Sequence
  Synthetic Oligonucleotide; IFNG exon 2; Set A
ugccuaagaaaagaguuccauuauccgcuacaucugaau

SEQ ID NO: 7288 - RNA, 37 nt, Artificial Sequence
  Synthetic Oligonucleotide; IFNG exon 2; Set A
gccuaagaaaagaguuccauuauccgcuacaucugaa

SEQ ID NO: 7289 - RNA, 35 nt, Artificial Sequence
  Synthetic Oligonucleotide; IFNG exon 2; Set A
ccuaagaaaagaguuccauuauccgcuacaucuga

SEQ ID NO: 7290 - RNA, 38 nt, Artificial Sequence
  Synthetic Oligonucleotide; IFNG exon 2; Set C
ugccuaagaaaagaguuccauuauccgcuacaucugaa

SEQ ID NO: 7291 - RNA, 36 nt, Artificial Sequence
  Synthetic Oligonucleotide; IFNG exon 2; Set C
gccuaagaaaagaguuccauuauccgcuacaucuga

SEQ ID NO: 7292 - RNA, 39 nt, Artificial Sequence
  Synthetic Oligonucleotide; IFNG exon 2; Set A
augccuaagaaaagaguuccauuauccgcuacaucugaa

SEQ ID NO: 7293 - RNA, 37 nt, Artificial Sequence
  Synthetic Oligonucleotide; IFNG exon 2; Set C
ugccuaagaaaagaguuccauuauccgcuacaucuga

SEQ ID NO: 7294 - RNA, 38 nt, Artificial Sequence
  Synthetic Oligonucleotide; IFNG exon 2; Set C
augccuaagaaaagaguuccauuauccgcuacaucuga

SEQ ID NO: 7295 - RNA, 28 nt, Artificial Sequence
  Synthetic Oligonucleotide; IFNG exon 2; Set C
uaagaaaagaguuccauuauccgcuaca

SEQ ID NO: 7296 - RNA, 27 nt, Artificial Sequence
  Synthetic Oligonucleotide; IFNG exon 2; Set C
uaagaaaagaguuccauuauccgcuac

SEQ ID NO: 7297 - RNA, 39 nt, Artificial Sequence
  Synthetic Oligonucleotide; IFNG exon 2; Set A
aaugccuaagaaaagaguuccauuauccgcuacaucuga

SEQ ID NO: 7298 - RNA, 29 nt, Artificial Sequence
  Synthetic Oligonucleotide; IFNG exon 2; Set A
cuaagaaaagaguuccauuauccgcuaca

SEQ ID NO: 7299 - RNA, 26 nt, Artificial Sequence
  Synthetic Oligonucleotide; IFNG exon 2; Set C
uaagaaaagaguuccauuauccgcua

SEQ ID NO: 7300 - RNA, 30 nt, Artificial Sequence
  Synthetic Oligonucleotide; IFNG exon 2; Set A
ccuaagaaaagaguuccauuauccgcuaca

SEQ ID NO: 7301 - RNA, 25 nt, Artificial Sequence
  Synthetic Oligonucleotide; IFNG exon 2; Set C
uaagaaaagaguuccauuauccgcu

SEQ ID NO: 7302 - RNA, 29 nt, Artificial Sequence
  Synthetic Oligonucleotide; IFNG exon 2; Set A
ccuaagaaaagaguuccauuauccgcuac

SEQ ID NO: 7303 - RNA, 31 nt, Artificial Sequence
  Synthetic Oligonucleotide; IFNG exon 2; Set A
gccuaagaaaagaguuccauuauccgcuaca

SEQ ID NO: 7304 - RNA, 30 nt, Artificial Sequence
  Synthetic Oligonucleotide; IFNG exon 2; Set A
gccuaagaaaagaguuccauuauccgcuac

SEQ ID NO: 7305 - RNA, 32 nt, Artificial Sequence
  Synthetic Oligonucleotide; IFNG exon 2; Set A
ugccuaagaaaagaguuccauuauccgcuaca

SEQ ID NO: 7306 - RNA, 29 nt, Artificial Sequence
  Synthetic Oligonucleotide; IFNG exon 2; Set A
gccuaagaaaagaguuccauuauccgcua

SEQ ID NO: 7307 - RNA, 33 nt, Artificial Sequence
  Synthetic Oligonucleotide; IFNG exon 2; Set A
augccuaagaaaagaguuccauuauccgcuaca

SEQ ID NO: 7308 - RNA, 28 nt, Artificial Sequence
  Synthetic Oligonucleotide; IFNG exon 2; Set A
gccuaagaaaagaguuccauuauccgcu

SEQ ID NO: 7309 - RNA, 34 nt, Artificial Sequence
  Synthetic Oligonucleotide; IFNG exon 2; Set A
aaugccuaagaaaagaguuccauuauccgcuaca

SEQ ID NO: 7310 - RNA, 21 nt, Artificial Sequence
  Synthetic Oligonucleotide; IFNG exon 2; Set C
uaagaaaagaguuccauuauc

SEQ ID NO: 7311 - RNA, 35 nt, Artificial Sequence
  Synthetic Oligonucleotide; IFNG exon 2; Set A
aaaugccuaagaaaagaguuccauuauccgcuaca

SEQ ID NO: 7312 - RNA, 20 nt, Artificial Sequence
  Synthetic Oligonucleotide; IFNG exon 2; Set C
uaagaaaagaguuccauuau

SEQ ID NO: 7313 - RNA, 22 nt, Artificial Sequence
  Synthetic Oligonucleotide; IFNG exon 2; Set C
cuaagaaaagaguuccauuauc

SEQ ID NO: 7314 - RNA, 36 nt, Artificial Sequence
  Synthetic Oligonucleotide; IFNG exon 2; Set A
aaaaugccuaagaaaagaguuccauuauccgcuaca

SEQ ID NO: 7315 - RNA, 19 nt, Artificial Sequence
  Synthetic Oligonucleotide; IFNG exon 2; Set C
uaagaaaagaguuccauua

SEQ ID NO: 7316 - RNA, 21 nt, Artificial Sequence
  Synthetic Oligonucleotide; IFNG exon 2; Set C
cuaagaaaagaguuccauuau

SEQ ID NO: 7317 - RNA, 23 nt, Artificial Sequence
  Synthetic Oligonucleotide; IFNG exon 2; Set C
ccuaagaaaagaguuccauuauc

SEQ ID NO: 7318 - RNA, 37 nt, Artificial Sequence
  Synthetic Oligonucleotide; IFNG exon 2; Set A
caaaaugccuaagaaaagaguuccauuauccgcuaca

SEQ ID NO: 7319 - RNA, 20 nt, Artificial Sequence
  Synthetic Oligonucleotide; IFNG exon 2; Set C
cuaagaaaagaguuccauua

SEQ ID NO: 7320 - RNA, 18 nt, Artificial Sequence
  Synthetic Oligonucleotide; IFNG exon 2; Set C
uaagaaaagaguuccauu

SEQ ID NO: 7321 - RNA, 22 nt, Artificial Sequence
  Synthetic Oligonucleotide; IFNG exon 2; Set C
ccuaagaaaagaguuccauuau

SEQ ID NO: 7322 - RNA, 24 nt, Artificial Sequence
  Synthetic Oligonucleotide; IFNG exon 2; Set C
gccuaagaaaagaguuccauuauc

SEQ ID NO: 7323 - RNA, 38 nt, Artificial Sequence
  Synthetic Oligonucleotide; IFNG exon 2; Set A
ucaaaaugccuaagaaaagaguuccauuauccgcuaca

SEQ ID NO: 7324 - RNA, 19 nt, Artificial Sequence
  Synthetic Oligonucleotide; IFNG exon 2; Set C
cuaagaaaagaguuccauu

SEQ ID NO: 7325 - RNA, 21 nt, Artificial Sequence
  Synthetic Oligonucleotide; IFNG exon 2; Set C
ccuaagaaaagaguuccauua

SEQ ID NO: 7326 - RNA, 23 nt, Artificial Sequence
  Synthetic Oligonucleotide; IFNG exon 2; Set C
gccuaagaaaagaguuccauuau

SEQ ID NO: 7327 - RNA, 25 nt, Artificial Sequence
  Synthetic Oligonucleotide; IFNG exon 2; Set C
ugccuaagaaaagaguuccauuauc

SEQ ID NO: 7328 - RNA, 39 nt, Artificial Sequence
  Synthetic Oligonucleotide; IFNG exon 2; Set A
uucaaaaugccuaagaaaagaguuccauuauccgcuaca

SEQ ID NO: 7329 - RNA, 20 nt, Artificial Sequence
  Synthetic Oligonucleotide; IFNG exon 2; Set C
ccuaagaaaagaguuccauu

SEQ ID NO: 7330 - RNA, 22 nt, Artificial Sequence
  Synthetic Oligonucleotide; IFNG exon 2; Set C
gccuaagaaaagaguuccauua

SEQ ID NO: 7331 - RNA, 24 nt, Artificial Sequence
  Synthetic Oligonucleotide; IFNG exon 2; Set C
ugccuaagaaaagaguuccauuau

SEQ ID NO: 7332 - RNA, 26 nt, Artificial Sequence
  Synthetic Oligonucleotide; IFNG exon 2; Set C
augccuaagaaaagaguuccauuauc

SEQ ID NO: 7333 - RNA, 40 nt, Artificial Sequence
  Synthetic Oligonucleotide; IFNG exon 2; Set A
cuucaaaaugccuaagaaaagaguuccauuauccgcuaca

SEQ ID NO: 7334 - RNA, 23 nt, Artificial Sequence
  Synthetic Oligonucleotide; IFNG exon 2; Set C
ugccuaagaaaagaguuccauua

SEQ ID NO: 7335 - RNA, 21 nt, Artificial Sequence
  Synthetic Oligonucleotide; IFNG exon 2; Set C
gccuaagaaaagaguuccauu

SEQ ID NO: 7336 - RNA, 25 nt, Artificial Sequence
  Synthetic Oligonucleotide; IFNG exon 2; Set C
augccuaagaaaagaguuccauuau

SEQ ID NO: 7337 - RNA, 27 nt, Artificial Sequence
  Synthetic Oligonucleotide; IFNG exon 2; Set C
aaugccuaagaaaagaguuccauuauc

SEQ ID NO: 7338 - RNA, 22 nt, Artificial Sequence
  Synthetic Oligonucleotide; IFNG exon 2; Set C
ugccuaagaaaagaguuccauu

SEQ ID NO: 7339 - RNA, 26 nt, Artificial Sequence
  Synthetic Oligonucleotide; IFNG exon 2; Set C
aaugccuaagaaaagaguuccauuau

SEQ ID NO: 7340 - RNA, 28 nt, Artificial Sequence
  Synthetic Oligonucleotide; IFNG exon 2; Set C
aaaugccuaagaaaagaguuccauuauc

SEQ ID NO: 7341 - RNA, 23 nt, Artificial Sequence
  Synthetic Oligonucleotide; IFNG exon 2; Set C
augccuaagaaaagaguuccauu

SEQ ID NO: 7342 - RNA, 27 nt, Artificial Sequence
  Synthetic Oligonucleotide; IFNG exon 2; Set C
aaaugccuaagaaaagaguuccauuau

SEQ ID NO: 7343 - RNA, 29 nt, Artificial Sequence
  Synthetic Oligonucleotide; IFNG exon 2; Set C
aaaaugccuaagaaaagaguuccauuauc

SEQ ID NO: 7344 - RNA, 28 nt, Artificial Sequence
  Synthetic Oligonucleotide; IFNG exon 2; Set C
aaaaugccuaagaaaagaguuccauuau

SEQ ID NO: 7345 - RNA, 30 nt, Artificial Sequence
  Synthetic Oligonucleotide; IFNG exon 2; Set C
caaaaugccuaagaaaagaguuccauuauc

SEQ ID NO: 7346 - RNA, 15 nt, Artificial Sequence
  Synthetic Oligonucleotide; IFNG exon 2; Set C
ccuaagaaaagaguu

SEQ ID NO: 7347 - RNA, 29 nt, Artificial Sequence
  Synthetic Oligonucleotide; IFNG exon 2; Set C
caaaaugccuaagaaaagaguuccauuau

SEQ ID NO: 7348 - RNA, 31 nt, Artificial Sequence
  Synthetic Oligonucleotide; IFNG exon 2; Set C
ucaaaaugccuaagaaaagaguuccauuauc

SEQ ID NO: 7349 - RNA, 16 nt, Artificial Sequence
  Synthetic Oligonucleotide; IFNG exon 2; Set C
gccuaagaaaagaguu

SEQ ID NO: 7350 - RNA, 32 nt, Artificial Sequence
  Synthetic Oligonucleotide; IFNG exon 2; Set C
uucaaaaugccuaagaaaagaguuccauuauc

SEQ ID NO: 7351 - RNA, 17 nt, Artificial Sequence
  Synthetic Oligonucleotide; IFNG exon 2; Set C
ugccuaagaaaagaguu

SEQ ID NO: 7352 - RNA, 15 nt, Artificial Sequence
  Synthetic Oligonucleotide; IFNG exon 2; Set C
gccuaagaaaagagu

SEQ ID NO: 7353 - RNA, 33 nt, Artificial Sequence
  Synthetic Oligonucleotide; IFNG exon 2; Set C
cuucaaaaugccuaagaaaagaguuccauuauc

SEQ ID NO: 7354 - RNA, 18 nt, Artificial Sequence
  Synthetic Oligonucleotide; IFNG exon 2; Set C
augccuaagaaaagaguu

SEQ ID NO: 7355 - RNA, 16 nt, Artificial Sequence
  Synthetic Oligonucleotide; IFNG exon 2; Set C
ugccuaagaaaagagu

SEQ ID NO: 7356 - RNA, 17 nt, Artificial Sequence
  Synthetic Oligonucleotide; IFNG exon 2; Set C
augccuaagaaaagagu

SEQ ID NO: 7357 - RNA, 18 nt, Artificial Sequence
  Synthetic Oligonucleotide; IFNG exon 2; Set C
aaugccuaagaaaagagu

SEQ ID NO: 7358 - RNA, 38 nt, Artificial Sequence
  Synthetic Oligonucleotide; IFNG exon 2; Set C
caauucuucaaaaugccuaagaaaagaguuccauuauc

SEQ ID NO: 7359 - RNA, 40 nt, Artificial Sequence
  Synthetic Oligonucleotide; IFNG exon 2; Set A
uaccucuuuccaauucuucaaaaugccuaagaaaagaguu

SEQ ID NO: 7360 - RNA, 39 nt, Artificial Sequence
  Synthetic Oligonucleotide; IFNG exon 2; Set A
uaccucuuuccaauucuucaaaaugccuaagaaaagagu

SEQ ID NO: 7361 - RNA, 26 nt, Artificial Sequence
  Synthetic Oligonucleotide; IFNG exon 2; Set C
uaccucuuuccaauucuucaaaaugc

SEQ ID NO: 7362 - RNA, 25 nt, Artificial Sequence
  Synthetic Oligonucleotide; IFNG exon 2; Set C
uaccucuuuccaauucuucaaaaug

SEQ ID NO: 7363 - RNA, 24 nt, Artificial Sequence
  Synthetic Oligonucleotide; IFNG exon 2; Set C
uaccucuuuccaauucuucaaaau

SEQ ID NO: 7364 - RNA, 23 nt, Artificial Sequence
  Synthetic Oligonucleotide; IFNG exon 2; Set C
uaccucuuuccaauucuucaaaa

SEQ ID NO: 7365 - RNA, 22 nt, Artificial Sequence
  Synthetic Oligonucleotide; IFNG exon 2; Set C
uaccucuuuccaauucuucaaa

SEQ ID NO: 7366 - RNA, 21 nt, Artificial Sequence
  Synthetic Oligonucleotide; IFNG exon 2; Set C
uaccucuuuccaauucuucaa

SEQ ID NO: 7367 - RNA, 20 nt, Artificial Sequence
  Synthetic Oligonucleotide; IFNG exon 2; Set C
uaccucuuuccaauucuuca

SEQ ID NO: 7368 - RNA, 19 nt, Artificial Sequence
  Synthetic Oligonucleotide; IFNG exon 2; Set C
uaccucuuuccaauucuuc

SEQ ID NO: 7369 - RNA, 18 nt, Artificial Sequence
  Synthetic Oligonucleotide; IFNG exon 2; Set C
uaccucuuuccaauucuu

SEQ ID NO: 7370 - RNA, 17 nt, Artificial Sequence
  Synthetic Oligonucleotide; IFNG exon 2; Set C
uaccucuuuccaauucu

SEQ ID NO: 7371 - RNA, 39 nt, Artificial Sequence
  Synthetic Oligonucleotide; IFNG exon 2; Set A
aauauucagcuuaccucuuuccaauucuucaaaaugccu

SEQ ID NO: 7372 - RNA, 16 nt, Artificial Sequence
  Synthetic Oligonucleotide; IFNG exon 2; Set C
uaccucuuuccaauuc

SEQ ID NO: 7373 - RNA, 40 nt, Artificial Sequence
  Synthetic Oligonucleotide; IFNG exon 2; Set A
gaauauucagcuuaccucuuuccaauucuucaaaaugccu

SEQ ID NO: 7374 - RNA, 38 nt, Artificial Sequence
  Synthetic Oligonucleotide; IFNG exon 2; Set A
aauauucagcuuaccucuuuccaauucuucaaaaugcc

SEQ ID NO: 7375 - RNA, 39 nt, Artificial Sequence
  Synthetic Oligonucleotide; IFNG exon 2; Set A
gaauauucagcuuaccucuuuccaauucuucaaaaugcc

SEQ ID NO: 7376 - RNA, 37 nt, Artificial Sequence
  Synthetic Oligonucleotide; IFNG exon 2; Set A
aauauucagcuuaccucuuuccaauucuucaaaaugc

SEQ ID NO: 7377 - RNA, 40 nt, Artificial Sequence
  Synthetic Oligonucleotide; IFNG exon 2; Set A
ggaauauucagcuuaccucuuuccaauucuucaaaaugcc

SEQ ID NO: 7378 - RNA, 38 nt, Artificial Sequence
  Synthetic Oligonucleotide; IFNG exon 2; Set A
gaauauucagcuuaccucuuuccaauucuucaaaaugc

SEQ ID NO: 7379 - RNA, 36 nt, Artificial Sequence
  Synthetic Oligonucleotide; IFNG exon 2; Set A
aauauucagcuuaccucuuuccaauucuucaaaaug

SEQ ID NO: 7380 - RNA, 35 nt, Artificial Sequence
  Synthetic Oligonucleotide; IFNG exon 2; Set A
aauauucagcuuaccucuuuccaauucuucaaaau

SEQ ID NO: 7381 - RNA, 39 nt, Artificial Sequence
  Synthetic Oligonucleotide; IFNG exon 2; Set A
ggaauauucagcuuaccucuuuccaauucuucaaaaugc

SEQ ID NO: 7382 - RNA, 37 nt, Artificial Sequence
  Synthetic Oligonucleotide; IFNG exon 2; Set A
gaauauucagcuuaccucuuuccaauucuucaaaaug

SEQ ID NO: 7383 - RNA, 36 nt, Artificial Sequence
  Synthetic Oligonucleotide; IFNG exon 2; Set A
gaauauucagcuuaccucuuuccaauucuucaaaau

SEQ ID NO: 7384 - RNA, 34 nt, Artificial Sequence
  Synthetic Oligonucleotide; IFNG exon 2; Set A
aauauucagcuuaccucuuuccaauucuucaaaa

SEQ ID NO: 7385 - RNA, 40 nt, Artificial Sequence
  Synthetic Oligonucleotide; IFNG exon 2; Set A
gggaauauucagcuuaccucuuuccaauucuucaaaaugc

SEQ ID NO: 7386 - RNA, 38 nt, Artificial Sequence
  Synthetic Oligonucleotide; IFNG exon 2; Set A
ggaauauucagcuuaccucuuuccaauucuucaaaaug

SEQ ID NO: 7387 - RNA, 37 nt, Artificial Sequence
  Synthetic Oligonucleotide; IFNG exon 2; Set A
ggaauauucagcuuaccucuuuccaauucuucaaaau

SEQ ID NO: 7388 - RNA, 35 nt, Artificial Sequence
  Synthetic Oligonucleotide; IFNG exon 2; Set A
gaauauucagcuuaccucuuuccaauucuucaaaa

SEQ ID NO: 7389 - RNA, 33 nt, Artificial Sequence
  Synthetic Oligonucleotide; IFNG exon 2; Set A
aauauucagcuuaccucuuuccaauucuucaaa

SEQ ID NO: 7390 - RNA, 39 nt, Artificial Sequence
  Synthetic Oligonucleotide; IFNG exon 2; Set A
gggaauauucagcuuaccucuuuccaauucuucaaaaug

SEQ ID NO: 7391 - RNA, 38 nt, Artificial Sequence
  Synthetic Oligonucleotide; IFNG exon 2; Set A
gggaauauucagcuuaccucuuuccaauucuucaaaau

SEQ ID NO: 7392 - RNA, 36 nt, Artificial Sequence
  Synthetic Oligonucleotide; IFNG exon 2; Set A
ggaauauucagcuuaccucuuuccaauucuucaaaa

SEQ ID NO: 7393 - RNA, 34 nt, Artificial Sequence
  Synthetic Oligonucleotide; IFNG exon 2; Set A
gaauauucagcuuaccucuuuccaauucuucaaa

SEQ ID NO: 7394 - RNA, 32 nt, Artificial Sequence
  Synthetic Oligonucleotide; IFNG exon 2; Set A
aauauucagcuuaccucuuuccaauucuucaa

SEQ ID NO: 7395 - RNA, 37 nt, Artificial Sequence
  Synthetic Oligonucleotide; IFNG exon 2; Set A
gggaauauucagcuuaccucuuuccaauucuucaaaa

SEQ ID NO: 7396 - RNA, 31 nt, Artificial Sequence
  Synthetic Oligonucleotide; IFNG exon 2; Set A
aauauucagcuuaccucuuuccaauucuuca

SEQ ID NO: 7397 - RNA, 35 nt, Artificial Sequence
  Synthetic Oligonucleotide; IFNG exon 2; Set A
ggaauauucagcuuaccucuuuccaauucuucaaa

SEQ ID NO: 7398 - RNA, 33 nt, Artificial Sequence
  Synthetic Oligonucleotide; IFNG exon 2; Set A
gaauauucagcuuaccucuuuccaauucuucaa

SEQ ID NO: 7399 - RNA, 32 nt, Artificial Sequence
  Synthetic Oligonucleotide; IFNG exon 2; Set A
gaauauucagcuuaccucuuuccaauucuuca

SEQ ID NO: 7400 - RNA, 30 nt, Artificial Sequence
  Synthetic Oligonucleotide; IFNG exon 2; Set A
aauauucagcuuaccucuuuccaauucuuc

SEQ ID NO: 7401 - RNA, 36 nt, Artificial Sequence
  Synthetic Oligonucleotide; IFNG exon 2; Set A
gggaauauucagcuuaccucuuuccaauucuucaaa

SEQ ID NO: 7402 - RNA, 34 nt, Artificial Sequence
  Synthetic Oligonucleotide; IFNG exon 2; Set A
ggaauauucagcuuaccucuuuccaauucuucaa

SEQ ID NO: 7403 - RNA, 33 nt, Artificial Sequence
  Synthetic Oligonucleotide; IFNG exon 2; Set A
ggaauauucagcuuaccucuuuccaauucuuca

SEQ ID NO: 7404 - RNA, 31 nt, Artificial Sequence
  Synthetic Oligonucleotide; IFNG exon 2; Set A
gaauauucagcuuaccucuuuccaauucuuc

SEQ ID NO: 7405 - RNA, 29 nt, Artificial Sequence
  Synthetic Oligonucleotide; IFNG exon 2; Set C
aauauucagcuuaccucuuuccaauucuu

SEQ ID NO: 7406 - RNA, 35 nt, Artificial Sequence
  Synthetic Oligonucleotide; IFNG exon 2; Set A
gggaauauucagcuuaccucuuuccaauucuucaa

SEQ ID NO: 7407 - RNA, 28 nt, Artificial Sequence
  Synthetic Oligonucleotide; IFNG exon 2; Set C
aauauucagcuuaccucuuuccaauucu

SEQ ID NO: 7408 - RNA, 34 nt, Artificial Sequence
  Synthetic Oligonucleotide; IFNG exon 2; Set A
gggaauauucagcuuaccucuuuccaauucuuca

SEQ ID NO: 7409 - RNA, 32 nt, Artificial Sequence
  Synthetic Oligonucleotide; IFNG exon 2; Set A
ggaauauucagcuuaccucuuuccaauucuuc

SEQ ID NO: 7410 - RNA, 30 nt, Artificial Sequence
  Synthetic Oligonucleotide; IFNG exon 2; Set A
gaauauucagcuuaccucuuuccaauucuu

SEQ ID NO: 7411 - RNA, 29 nt, Artificial Sequence
  Synthetic Oligonucleotide; IFNG exon 2; Set A
gaauauucagcuuaccucuuuccaauucu

SEQ ID NO: 7412 - RNA, 27 nt, Artificial Sequence
  Synthetic Oligonucleotide; IFNG exon 2; Set C
aauauucagcuuaccucuuuccaauuc

SEQ ID NO: 7413 - RNA, 33 nt, Artificial Sequence
  Synthetic Oligonucleotide; IFNG exon 2; Set A
gggaauauucagcuuaccucuuuccaauucuuc

SEQ ID NO: 7414 - RNA, 31 nt, Artificial Sequence
  Synthetic Oligonucleotide; IFNG exon 2; Set A
ggaauauucagcuuaccucuuuccaauucuu

SEQ ID NO: 7415 - RNA, 30 nt, Artificial Sequence
  Synthetic Oligonucleotide; IFNG exon 2; Set A
ggaauauucagcuuaccucuuuccaauucu

SEQ ID NO: 7416 - RNA, 28 nt, Artificial Sequence
  Synthetic Oligonucleotide; IFNG exon 2; Set C
gaauauucagcuuaccucuuuccaauuc

SEQ ID NO: 7417 - RNA, 32 nt, Artificial Sequence
  Synthetic Oligonucleotide; IFNG exon 2; Set A
gggaauauucagcuuaccucuuuccaauucuu

SEQ ID NO: 7418 - RNA, 27 nt, Artificial Sequence
  Synthetic Oligonucleotide; IFNG exon 2; Set C
gaauauucagcuuaccucuuuccaauu

SEQ ID NO: 7419 - RNA, 31 nt, Artificial Sequence
  Synthetic Oligonucleotide; IFNG exon 2; Set A
gggaauauucagcuuaccucuuuccaauucu

SEQ ID NO: 7420 - RNA, 29 nt, Artificial Sequence
  Synthetic Oligonucleotide; IFNG exon 2; Set A
ggaauauucagcuuaccucuuuccaauuc

SEQ ID NO: 7421 - RNA, 26 nt, Artificial Sequence
  Synthetic Oligonucleotide; IFNG exon 2; Set C
gaauauucagcuuaccucuuuccaau

SEQ ID NO: 7422 - RNA, 28 nt, Artificial Sequence
  Synthetic Oligonucleotide; IFNG exon 2; Set A
ggaauauucagcuuaccucuuuccaauu

SEQ ID NO: 7423 - RNA, 30 nt, Artificial Sequence
  Synthetic Oligonucleotide; IFNG exon 2; Set A
gggaauauucagcuuaccucuuuccaauuc

SEQ ID NO: 7424 - RNA, 27 nt, Artificial Sequence
  Synthetic Oligonucleotide; IFNG exon 2; Set A
ggaauauucagcuuaccucuuuccaau

SEQ ID NO: 7425 - RNA, 29 nt, Artificial Sequence
  Synthetic Oligonucleotide; IFNG exon 2; Set A
gggaauauucagcuuaccucuuuccaauu

SEQ ID NO: 7426 - RNA, 28 nt, Artificial Sequence
  Synthetic Oligonucleotide; IFNG exon 2; Set A
gggaauauucagcuuaccucuuuccaau

SEQ ID NO: 7427 - RNA, 15 nt, Artificial Sequence
  Synthetic Oligonucleotide; IFNG exon 2; Set C
gaauauucagcuuac

SEQ ID NO: 7428 - RNA, 40 nt, Artificial Sequence
  Synthetic Oligonucleotide; IFNG exon 2; Set C
auuagccaaaugggaauauucagcuuaccucuuuccaauu

SEQ ID NO: 7429 - RNA, 16 nt, Artificial Sequence
  Synthetic Oligonucleotide; IFNG exon 2; Set C
ggaauauucagcuuac

SEQ ID NO: 7430 - RNA, 39 nt, Artificial Sequence
  Synthetic Oligonucleotide; IFNG exon 2; Set C
auuagccaaaugggaauauucagcuuaccucuuuccaau

SEQ ID NO: 7431 - RNA, 40 nt, Artificial Sequence
  Synthetic Oligonucleotide; IFNG exon 2; Set A
aauuagccaaaugggaauauucagcuuaccucuuuccaau

SEQ ID NO: 7432 - RNA, 39 nt, Artificial Sequence
  Synthetic Oligonucleotide; IFNG exon 2; Set A
aauuagccaaaugggaauauucagcuuaccucuuuccaa

SEQ ID NO: 7433 - RNA, 22 nt, Artificial Sequence
  Synthetic Oligonucleotide; IFNG exon 2; Set C
caaaugggaauauucagcuuac

SEQ ID NO: 7434 - RNA, 28 nt, Artificial Sequence
  Synthetic Oligonucleotide; IFNG exon 2; Set C
auuagccaaaugggaauauucagcuuac

SEQ ID NO: 7435 - RNA, 30 nt, Artificial Sequence
  Synthetic Oligonucleotide; IFNG exon 2; Set C
aaauuagccaaaugggaauauucagcuuac

SEQ ID NO: 7436 - RNA, 31 nt, Artificial Sequence
  Synthetic Oligonucleotide; IFNG exon 2; Set C
aaaauuagccaaaugggaauauucagcuuac

SEQ ID NO: 7437 - RNA, 32 nt, Artificial Sequence
  Synthetic Oligonucleotide; IFNG exon 2; Set C
gaaaauuagccaaaugggaauauucagcuuac

SEQ ID NO: 7438 - RNA, 39 nt, Artificial Sequence
  Synthetic Oligonucleotide; IFNG exon 2; Set B
gcaacaggaaaauuagccaaaugggaauauucagcuuac

SEQ ID NO: 7439 - RNA, 40 nt, Artificial Sequence
  Synthetic Oligonucleotide; IFNG exon 2; Set B
agcaacaggaaaauuagccaaaugggaauauucagcuuac

SEQ ID NO: 7440 - RNA, 21 nt, Artificial Sequence
  Synthetic Oligonucleotide; IFNG exon 2; Set C
gaaaauuagccaaaugggaau

SEQ ID NO: 7441 - RNA, 20 nt, Artificial Sequence
  Synthetic Oligonucleotide; IFNG exon 2; Set C
gaaaauuagccaaaugggaa

SEQ ID NO: 7442 - RNA, 19 nt, Artificial Sequence
  Synthetic Oligonucleotide; IFNG exon 2; Set C
gaaaauuagccaaauggga

SEQ ID NO: 7443 - RNA, 18 nt, Artificial Sequence
  Synthetic Oligonucleotide; IFNG exon 2; Set C
gaaaauuagccaaauggg

SEQ ID NO: 7444 - RNA, 28 nt, Artificial Sequence
  Synthetic Oligonucleotide; IFNG exon 2; Set C
gcaacaggaaaauuagccaaaugggaau

SEQ ID NO: 7445 - RNA, 27 nt, Artificial Sequence
  Synthetic Oligonucleotide; IFNG exon 2; Set C
gcaacaggaaaauuagccaaaugggaa

SEQ ID NO: 7446 - RNA, 29 nt, Artificial Sequence
  Synthetic Oligonucleotide; IFNG exon 2; Set C
agcaacaggaaaauuagccaaaugggaau

SEQ ID NO: 7447 - RNA, 26 nt, Artificial Sequence
  Synthetic Oligonucleotide; IFNG exon 2; Set B
gcaacaggaaaauuagccaaauggga

SEQ ID NO: 7448 - RNA, 28 nt, Artificial Sequence
  Synthetic Oligonucleotide; IFNG exon 2; Set C
agcaacaggaaaauuagccaaaugggaa

SEQ ID NO: 7449 - RNA, 25 nt, Artificial Sequence
  Synthetic Oligonucleotide; IFNG exon 2; Set C
gcaacaggaaaauuagccaaauggg

SEQ ID NO: 7450 - RNA, 31 nt, Artificial Sequence
  Synthetic Oligonucleotide; IFNG exon 2; Set B
caagcaacaggaaaauuagccaaaugggaau

SEQ ID NO: 7451 - RNA, 27 nt, Artificial Sequence
  Synthetic Oligonucleotide; IFNG exon 2; Set B
agcaacaggaaaauuagccaaauggga

SEQ ID NO: 7452 - RNA, 30 nt, Artificial Sequence
  Synthetic Oligonucleotide; IFNG exon 2; Set B
caagcaacaggaaaauuagccaaaugggaa

SEQ ID NO: 7453 - RNA, 26 nt, Artificial Sequence
  Synthetic Oligonucleotide; IFNG exon 2; Set C
agcaacaggaaaauuagccaaauggg

SEQ ID NO: 7454 - RNA, 29 nt, Artificial Sequence
  Synthetic Oligonucleotide; IFNG exon 2; Set B
caagcaacaggaaaauuagccaaauggga

SEQ ID NO: 7455 - RNA, 28 nt, Artificial Sequence
  Synthetic Oligonucleotide; IFNG exon 2; Set C
caagcaacaggaaaauuagccaaauggg

SEQ ID NO: 7456 - RNA, 36 nt, Artificial Sequence
  Synthetic Oligonucleotide; IFNG exon 2; Set B
gaaagcaagcaacaggaaaauuagccaaaugggaau

SEQ ID NO: 7457 - RNA, 35 nt, Artificial Sequence
  Synthetic Oligonucleotide; IFNG exon 2; Set B
gaaagcaagcaacaggaaaauuagccaaaugggaa

SEQ ID NO: 7458 - RNA, 37 nt, Artificial Sequence
  Synthetic Oligonucleotide; IFNG exon 2; Set B
agaaagcaagcaacaggaaaauuagccaaaugggaau

SEQ ID NO: 7459 - RNA, 34 nt, Artificial Sequence
  Synthetic Oligonucleotide; IFNG exon 2; Set B
gaaagcaagcaacaggaaaauuagccaaauggga

SEQ ID NO: 7460 - RNA, 36 nt, Artificial Sequence
  Synthetic Oligonucleotide; IFNG exon 2; Set B
agaaagcaagcaacaggaaaauuagccaaaugggaa

SEQ ID NO: 7461 - RNA, 33 nt, Artificial Sequence
  Synthetic Oligonucleotide; IFNG exon 2; Set B
gaaagcaagcaacaggaaaauuagccaaauggg

SEQ ID NO: 7462 - RNA, 35 nt, Artificial Sequence
  Synthetic Oligonucleotide; IFNG exon 2; Set B
agaaagcaagcaacaggaaaauuagccaaauggga

SEQ ID NO: 7463 - RNA, 34 nt, Artificial Sequence
  Synthetic Oligonucleotide; IFNG exon 2; Set B
agaaagcaagcaacaggaaaauuagccaaauggg

SEQ ID NO: 7464 - RNA, 15 nt, Artificial Sequence
  Synthetic Oligonucleotide; IFNG exon 2; Set C
caagcaacaggaaaa

SEQ ID NO: 7465 - RNA, 23 nt, Artificial Sequence
  Synthetic Oligonucleotide; IFNG exon 2; Set C
agaaagcaagcaacaggaaaauu

SEQ ID NO: 7466 - RNA, 22 nt, Artificial Sequence
  Synthetic Oligonucleotide; IFNG exon 2; Set C
agaaagcaagcaacaggaaaau

SEQ ID NO: 7467 - RNA, 20 nt, Artificial Sequence
  Synthetic Oligonucleotide; IFNG exon 2; Set C
gaaagcaagcaacaggaaaa

SEQ ID NO: 7468 - RNA, 19 nt, Artificial Sequence
  Synthetic Oligonucleotide; IFNG exon 2; Set C
gaaagcaagcaacaggaaa

SEQ ID NO: 7469 - RNA, 16 nt, Artificial Sequence
  Synthetic Oligonucleotide; IFNG exon 2; Set C
uuuacaauuagcccau

SEQ ID NO: 7470 - RNA, 23 nt, Artificial Sequence
  Synthetic Oligonucleotide; IFNG exon 2; Set C
auugguuuacaauuagcccauaa

SEQ ID NO: 7471 - RNA, 25 nt, Artificial Sequence
  Synthetic Oligonucleotide; IFNG exon 2; Set C
aauugguuuacaauuagcccauaaa

SEQ ID NO: 7472 - RNA, 24 nt, Artificial Sequence
  Synthetic Oligonucleotide; IFNG exon 2; Set C
aauugguuuacaauuagcccauaa

SEQ ID NO: 7473 - RNA, 26 nt, Artificial Sequence
  Synthetic Oligonucleotide; IFNG exon 2; Set C
aaauugguuuacaauuagcccauaaa

SEQ ID NO: 7474 - RNA, 28 nt, Artificial Sequence
  Synthetic Oligonucleotide; IFNG exon 2; Set C
aaaauugguuuacaauuagcccauaaau

SEQ ID NO: 7475 - RNA, 25 nt, Artificial Sequence
  Synthetic Oligonucleotide; IFNG exon 2; Set C
aaauugguuuacaauuagcccauaa

SEQ ID NO: 7476 - RNA, 27 nt, Artificial Sequence
  Synthetic Oligonucleotide; IFNG exon 2; Set C
aaaauugguuuacaauuagcccauaaa

SEQ ID NO: 7477 - RNA, 26 nt, Artificial Sequence
  Synthetic Oligonucleotide; IFNG exon 2; Set C
aaaauugguuuacaauuagcccauaa

SEQ ID NO: 7478 - RNA, 26 nt, Artificial Sequence
  Synthetic Oligonucleotide; IFNG exon 2; Set C
aaaaauugguuuacaauuagcccaua

SEQ ID NO: 7479 - RNA, 27 nt, Artificial Sequence
  Synthetic Oligonucleotide; IFNG exon 2; Set C
aaaaaauugguuuacaauuagcccaua

SEQ ID NO: 7480 - RNA, 28 nt, Artificial Sequence
  Synthetic Oligonucleotide; IFNG exon 2; Set C
gaaaaaauugguuuacaauuagcccaua

SEQ ID NO: 7481 - RNA, 29 nt, Artificial Sequence
  Synthetic Oligonucleotide; IFNG exon 2; Set C
agaaaaaauugguuuacaauuagcccaua

SEQ ID NO: 7482 - RNA, 30 nt, Artificial Sequence
  Synthetic Oligonucleotide; IFNG exon 2; Set C
aagaaaaaauugguuuacaauuagcccaua

SEQ ID NO: 7483 - RNA, 34 nt, Artificial Sequence
  Synthetic Oligonucleotide; IFNG exon 2; Set C
aaaagaaaaaauugguuuacaauuagcccauaaa

SEQ ID NO: 7484 - RNA, 31 nt, Artificial Sequence
  Synthetic Oligonucleotide; IFNG exon 2; Set C
aaagaaaaaauugguuuacaauuagcccaua

SEQ ID NO: 7485 - RNA, 33 nt, Artificial Sequence
  Synthetic Oligonucleotide; IFNG exon 2; Set C
aaaagaaaaaauugguuuacaauuagcccauaa

SEQ ID NO: 7486 - RNA, 35 nt, Artificial Sequence
  Synthetic Oligonucleotide; IFNG exon 2; Set C
aaaaagaaaaaauugguuuacaauuagcccauaaa

SEQ ID NO: 7487 - RNA, 34 nt, Artificial Sequence
  Synthetic Oligonucleotide; IFNG exon 2; Set C
aaaaagaaaaaauugguuuacaauuagcccauaa

SEQ ID NO: 7488 - RNA, 36 nt, Artificial Sequence
  Synthetic Oligonucleotide; IFNG exon 2; Set C
aaaaaagaaaaaauugguuuacaauuagcccauaaa

SEQ ID NO: 7489 - RNA, 35 nt, Artificial Sequence
  Synthetic Oligonucleotide; IFNG exon 2; Set C
aaaaaagaaaaaauugguuuacaauuagcccauaa

SEQ ID NO: 7490 - RNA, 37 nt, Artificial Sequence
  Synthetic Oligonucleotide; IFNG exon 2; Set C
aaaaaaagaaaaaauugguuuacaauuagcccauaaa

SEQ ID NO: 7491 - RNA, 39 nt, Artificial Sequence
  Synthetic Oligonucleotide; IFNG exon 2; Set C
aaaaaaaagaaaaaauugguuuacaauuagcccauaaau

SEQ ID NO: 7492 - RNA, 36 nt, Artificial Sequence
  Synthetic Oligonucleotide; IFNG exon 2; Set C
aaaaaaagaaaaaauugguuuacaauuagcccauaa

SEQ ID NO: 7493 - RNA, 38 nt, Artificial Sequence
  Synthetic Oligonucleotide; IFNG exon 2; Set C
aaaaaaaagaaaaaauugguuuacaauuagcccauaaa

SEQ ID NO: 7494 - RNA, 40 nt, Artificial Sequence
  Synthetic Oligonucleotide; IFNG exon 2; Set C
aaaaaaaaagaaaaaauugguuuacaauuagcccauaaau

SEQ ID NO: 7495 - RNA, 37 nt, Artificial Sequence
  Synthetic Oligonucleotide; IFNG exon 2; Set C
aaaaaaaagaaaaaauugguuuacaauuagcccauaa

SEQ ID NO: 7496 - RNA, 39 nt, Artificial Sequence
  Synthetic Oligonucleotide; IFNG exon 2; Set C
aaaaaaaaagaaaaaauugguuuacaauuagcccauaaa

SEQ ID NO: 7497 - RNA, 38 nt, Artificial Sequence
  Synthetic Oligonucleotide; IFNG exon 2; Set C
aaaaaaaaagaaaaaauugguuuacaauuagcccauaa

SEQ ID NO: 7498 - RNA, 40 nt, Artificial Sequence
  Synthetic Oligonucleotide; IFNG exon 2; Set C
aaaaaaaaaagaaaaaauugguuuacaauuagcccauaaa

SEQ ID NO: 7499 - RNA, 39 nt, Artificial Sequence
  Synthetic Oligonucleotide; IFNG exon 2; Set C
aaaaaaaaaagaaaaaauugguuuacaauuagcccauaa

SEQ ID NO: 7500 - RNA, 40 nt, Artificial Sequence
  Synthetic Oligonucleotide; IFNG exon 2; Set C
aaaaaaaaaaagaaaaaauugguuuacaauuagcccauaa

SEQ ID NO: 7501 - RNA, 15 nt, Artificial Sequence
  Synthetic Oligonucleotide; IFNG exon 2; Set C
agaaaaaauugguuu

SEQ ID NO: 7502 - RNA, 16 nt, Artificial Sequence
  Synthetic Oligonucleotide; IFNG exon 2; Set C
aagaaaaaauugguuu

SEQ ID NO: 7503 - RNA, 17 nt, Artificial Sequence
  Synthetic Oligonucleotide; IFNG exon 2; Set C
aaagaaaaaauugguuu

SEQ ID NO: 7504 - RNA, 28 nt, Artificial Sequence
  Synthetic Oligonucleotide; IFNG exon 2; Set C
uaaaaaaaaaaaaagaaaaaauugguuu

SEQ ID NO: 7505 - RNA, 26 nt, Artificial Sequence
  Synthetic Oligonucleotide; IFNG exon 2; Set C
ugcauucuaaaaaaaaaaaaagaaaa

SEQ ID NO: 7506 - RNA, 25 nt, Artificial Sequence
  Synthetic Oligonucleotide; IFNG exon 2; Set C
ugcauucuaaaaaaaaaaaaagaaa

SEQ ID NO: 7507 - RNA, 26 nt, Artificial Sequence
  Synthetic Oligonucleotide; IFNG exon 2; Set C
cugcauucuaaaaaaaaaaaaagaaa

SEQ ID NO: 7508 - RNA, 24 nt, Artificial Sequence
  Synthetic Oligonucleotide; IFNG exon 2; Set C
ugcauucuaaaaaaaaaaaaagaa

SEQ ID NO: 7509 - RNA, 25 nt, Artificial Sequence
  Synthetic Oligonucleotide; IFNG exon 2; Set C
cugcauucuaaaaaaaaaaaaagaa

SEQ ID NO: 7510 - RNA, 23 nt, Artificial Sequence
  Synthetic Oligonucleotide; IFNG exon 2; Set C
ugcauucuaaaaaaaaaaaaaga

SEQ ID NO: 7511 - RNA, 22 nt, Artificial Sequence
  Synthetic Oligonucleotide; IFNG exon 2; Set C
ugcauucuaaaaaaaaaaaaag

SEQ ID NO: 7512 - RNA, 24 nt, Artificial Sequence
  Synthetic Oligonucleotide; IFNG exon 2; Set C
cugcauucuaaaaaaaaaaaaaga

SEQ ID NO: 7513 - RNA, 21 nt, Artificial Sequence
  Synthetic Oligonucleotide; IFNG exon 2; Set C
ugcauucuaaaaaaaaaaaaa

SEQ ID NO: 7514 - RNA, 23 nt, Artificial Sequence
  Synthetic Oligonucleotide; IFNG exon 2; Set C
cugcauucuaaaaaaaaaaaaag

SEQ ID NO: 7515 - RNA, 22 nt, Artificial Sequence
  Synthetic Oligonucleotide; IFNG exon 2; Set C
cugcauucuaaaaaaaaaaaaa

SEQ ID NO: 7516 - RNA, 19 nt, Artificial Sequence
  Synthetic Oligonucleotide; IFNG exon 2; Set C
ugcauucuaaaaaaaaaaa

SEQ ID NO: 7517 - RNA, 18 nt, Artificial Sequence
  Synthetic Oligonucleotide; IFNG exon 2; Set C
ugcauucuaaaaaaaaaa

SEQ ID NO: 7518 - RNA, 17 nt, Artificial Sequence
  Synthetic Oligonucleotide; IFNG exon 2; Set C
ugcauucuaaaaaaaaa

SEQ ID NO: 7519 - RNA, 16 nt, Artificial Sequence
  Synthetic Oligonucleotide; IFNG exon 2; Set C
ugcauucuaaaaaaaa

SEQ ID NO: 7520 - RNA, 17 nt, Artificial Sequence
  Synthetic Oligonucleotide; IFNG exon 2; Set C
cugcauucuaaaaaaaa

SEQ ID NO: 7521 - RNA, 15 nt, Artificial Sequence
  Synthetic Oligonucleotide; IFNG exon 2; Set C
ugcauucuaaaaaaa

SEQ ID NO: 7522 - RNA, 16 nt, Artificial Sequence
  Synthetic Oligonucleotide; IFNG exon 2; Set C
cugcauucuaaaaaaa

SEQ ID NO: 7523 - RNA, 15 nt, Artificial Sequence
  Synthetic Oligonucleotide; IFNG exon 2; Set C
cugcauucuaaaaaa

SEQ ID NO: 7524 - RNA, 37 nt, Artificial Sequence
  Synthetic Oligonucleotide; IFNG exon 2; Set C
acaucugaaugaccugcauucuaaaaaaaaaaaaaga

SEQ ID NO: 7525 - RNA, 36 nt, Artificial Sequence
  Synthetic Oligonucleotide; IFNG exon 2; Set C
acaucugaaugaccugcauucuaaaaaaaaaaaaag

SEQ ID NO: 7526 - RNA, 35 nt, Artificial Sequence
  Synthetic Oligonucleotide; IFNG exon 2; Set C
acaucugaaugaccugcauucuaaaaaaaaaaaaa

SEQ ID NO: 7527 - RNA, 17 nt, Artificial Sequence
  Synthetic Oligonucleotide; IFNG exon 2; Set C
aaugaccugcauucuaa

SEQ ID NO: 7528 - RNA, 27 nt, Artificial Sequence
  Synthetic Oligonucleotide; IFNG exon 2; Set C
acaucugaaugaccugcauucuaaaaa

SEQ ID NO: 7529 - RNA, 26 nt, Artificial Sequence
  Synthetic Oligonucleotide; IFNG exon 2; Set C
acaucugaaugaccugcauucuaaaa

SEQ ID NO: 7530 - RNA, 25 nt, Artificial Sequence
  Synthetic Oligonucleotide; IFNG exon 2; Set C
acaucugaaugaccugcauucuaaa

SEQ ID NO: 7531 - RNA, 24 nt, Artificial Sequence
  Synthetic Oligonucleotide; IFNG exon 2; Set C
acaucugaaugaccugcauucuaa

SEQ ID NO: 7532 - RNA, 31 nt, Artificial Sequence
  Synthetic Oligonucleotide; IFNG exon 2; Set A
auccgcuacaucugaaugaccugcauucuaa

SEQ ID NO: 7533 - RNA, 16 nt, Artificial Sequence
  Synthetic Oligonucleotide; IFNG exon 2; Set C
acaucugaaugaccug

SEQ ID NO: 7534 - RNA, 18 nt, Artificial Sequence
  Synthetic Oligonucleotide; IFNG exon 2; Set C
uacaucugaaugaccugc

SEQ ID NO: 7535 - RNA, 17 nt, Artificial Sequence
  Synthetic Oligonucleotide; IFNG exon 2; Set C
uacaucugaaugaccug

SEQ ID NO: 7536 - RNA, 19 nt, Artificial Sequence
  Synthetic Oligonucleotide; IFNG exon 2; Set C
cuacaucugaaugaccugc

SEQ ID NO: 7537 - RNA, 18 nt, Artificial Sequence
  Synthetic Oligonucleotide; IFNG exon 2; Set C
cuacaucugaaugaccug

SEQ ID NO: 7538 - RNA, 20 nt, Artificial Sequence
  Synthetic Oligonucleotide; IFNG exon 2; Set C
gcuacaucugaaugaccugc

SEQ ID NO: 7539 - RNA, 24 nt, Artificial Sequence
  Synthetic Oligonucleotide; IFNG exon 2; Set A
auccgcuacaucugaaugaccugc

SEQ ID NO: 7540 - RNA, 23 nt, Artificial Sequence
  Synthetic Oligonucleotide; IFNG exon 2; Set A
auccgcuacaucugaaugaccug

SEQ ID NO: 7541 - RNA, 25 nt, Artificial Sequence
  Synthetic Oligonucleotide; IFNG exon 2; Set A
uauccgcuacaucugaaugaccugc

SEQ ID NO: 7542 - RNA, 24 nt, Artificial Sequence
  Synthetic Oligonucleotide; IFNG exon 2; Set A
uauccgcuacaucugaaugaccug

SEQ ID NO: 7543 - RNA, 39 nt, Artificial Sequence
  Synthetic Oligonucleotide; IFNG exon 2; Set A
auauucagcuuaccucuuuccaauucuucaaaaugccua

SEQ ID NO: 7544 - RNA, 15 nt, Artificial Sequence
  Synthetic Oligonucleotide; IFNG exon 2; Set C
uaccucuuuccaauu

SEQ ID NO: 7545 - RNA, 40 nt, Artificial Sequence
  Synthetic Oligonucleotide; IFNG exon 2; Set A
ugggaauauucagcuuaccucuuuccaauucuucaaaaug

SEQ ID NO: 7546 - RNA, 39 nt, Artificial Sequence
  Synthetic Oligonucleotide; IFNG exon 2; Set A
ugggaauauucagcuuaccucuuuccaauucuucaaaau

SEQ ID NO: 7547 - RNA, 40 nt, Artificial Sequence
  Synthetic Oligonucleotide; IFNG exon 2; Set A
augggaauauucagcuuaccucuuuccaauucuucaaaau

SEQ ID NO: 7548 - RNA, 38 nt, Artificial Sequence
  Synthetic Oligonucleotide; IFNG exon 2; Set A
ugggaauauucagcuuaccucuuuccaauucuucaaaa

SEQ ID NO: 7549 - RNA, 39 nt, Artificial Sequence
  Synthetic Oligonucleotide; IFNG exon 2; Set A
augggaauauucagcuuaccucuuuccaauucuucaaaa

SEQ ID NO: 7550 - RNA, 37 nt, Artificial Sequence
  Synthetic Oligonucleotide; IFNG exon 2; Set A
ugggaauauucagcuuaccucuuuccaauucuucaaa

SEQ ID NO: 7551 - RNA, 40 nt, Artificial Sequence
  Synthetic Oligonucleotide; IFNG exon 2; Set A
aaugggaauauucagcuuaccucuuuccaauucuucaaaa

SEQ ID NO: 7552 - RNA, 38 nt, Artificial Sequence
  Synthetic Oligonucleotide; IFNG exon 2; Set A
augggaauauucagcuuaccucuuuccaauucuucaaa

SEQ ID NO: 7553 - RNA, 36 nt, Artificial Sequence
  Synthetic Oligonucleotide; IFNG exon 2; Set A
ugggaauauucagcuuaccucuuuccaauucuucaa

SEQ ID NO: 7554 - RNA, 35 nt, Artificial Sequence
  Synthetic Oligonucleotide; IFNG exon 2; Set A
ugggaauauucagcuuaccucuuuccaauucuuca

SEQ ID NO: 7555 - RNA, 39 nt, Artificial Sequence
  Synthetic Oligonucleotide; IFNG exon 2; Set A
aaugggaauauucagcuuaccucuuuccaauucuucaaa

SEQ ID NO: 7556 - RNA, 37 nt, Artificial Sequence
  Synthetic Oligonucleotide; IFNG exon 2; Set A
augggaauauucagcuuaccucuuuccaauucuucaa

SEQ ID NO: 7557 - RNA, 26 nt, Artificial Sequence
  Synthetic Oligonucleotide; IFNG exon 2; Set C
aauauucagcuuaccucuuuccaauu

SEQ ID NO: 7558 - RNA, 34 nt, Artificial Sequence
  Synthetic Oligonucleotide; IFNG exon 2; Set A
ugggaauauucagcuuaccucuuuccaauucuuc

SEQ ID NO: 7559 - RNA, 36 nt, Artificial Sequence
  Synthetic Oligonucleotide; IFNG exon 2; Set A
augggaauauucagcuuaccucuuuccaauucuuca

SEQ ID NO: 7560 - RNA, 40 nt, Artificial Sequence
  Synthetic Oligonucleotide; IFNG exon 2; Set A
aaaugggaauauucagcuuaccucuuuccaauucuucaaa

SEQ ID NO: 7561 - RNA, 38 nt, Artificial Sequence
  Synthetic Oligonucleotide; IFNG exon 2; Set A
aaugggaauauucagcuuaccucuuuccaauucuucaa

SEQ ID NO: 7562 - RNA, 25 nt, Artificial Sequence
  Synthetic Oligonucleotide; IFNG exon 2; Set C
aauauucagcuuaccucuuuccaau

SEQ ID NO: 7563 - RNA, 35 nt, Artificial Sequence
  Synthetic Oligonucleotide; IFNG exon 2; Set A
augggaauauucagcuuaccucuuuccaauucuuc

SEQ ID NO: 7564 - RNA, 37 nt, Artificial Sequence
  Synthetic Oligonucleotide; IFNG exon 2; Set A
aaugggaauauucagcuuaccucuuuccaauucuuca

SEQ ID NO: 7565 - RNA, 33 nt, Artificial Sequence
  Synthetic Oligonucleotide; IFNG exon 2; Set A
ugggaauauucagcuuaccucuuuccaauucuu

SEQ ID NO: 7566 - RNA, 39 nt, Artificial Sequence
  Synthetic Oligonucleotide; IFNG exon 2; Set A
aaaugggaauauucagcuuaccucuuuccaauucuucaa

SEQ ID NO: 7567 - RNA, 32 nt, Artificial Sequence
  Synthetic Oligonucleotide; IFNG exon 2; Set A
ugggaauauucagcuuaccucuuuccaauucu

SEQ ID NO: 7568 - RNA, 38 nt, Artificial Sequence
  Synthetic Oligonucleotide; IFNG exon 2; Set A
aaaugggaauauucagcuuaccucuuuccaauucuuca

SEQ ID NO: 7569 - RNA, 36 nt, Artificial Sequence
  Synthetic Oligonucleotide; IFNG exon 2; Set A
aaugggaauauucagcuuaccucuuuccaauucuuc

SEQ ID NO: 7570 - RNA, 34 nt, Artificial Sequence
  Synthetic Oligonucleotide; IFNG exon 2; Set A
augggaauauucagcuuaccucuuuccaauucuu

SEQ ID NO: 7571 - RNA, 40 nt, Artificial Sequence
  Synthetic Oligonucleotide; IFNG exon 2; Set A
caaaugggaauauucagcuuaccucuuuccaauucuucaa

SEQ ID NO: 7572 - RNA, 24 nt, Artificial Sequence
  Synthetic Oligonucleotide; IFNG exon 2; Set C
aauauucagcuuaccucuuuccaa

SEQ ID NO: 7573 - RNA, 31 nt, Artificial Sequence
  Synthetic Oligonucleotide; IFNG exon 2; Set A
ugggaauauucagcuuaccucuuuccaauuc

SEQ ID NO: 7574 - RNA, 33 nt, Artificial Sequence
  Synthetic Oligonucleotide; IFNG exon 2; Set A
augggaauauucagcuuaccucuuuccaauucu

SEQ ID NO: 7575 - RNA, 39 nt, Artificial Sequence
  Synthetic Oligonucleotide; IFNG exon 2; Set A
caaaugggaauauucagcuuaccucuuuccaauucuuca

SEQ ID NO: 7576 - RNA, 37 nt, Artificial Sequence
  Synthetic Oligonucleotide; IFNG exon 2; Set A
aaaugggaauauucagcuuaccucuuuccaauucuuc

SEQ ID NO: 7577 - RNA, 35 nt, Artificial Sequence
  Synthetic Oligonucleotide; IFNG exon 2; Set A
aaugggaauauucagcuuaccucuuuccaauucuu

SEQ ID NO: 7578 - RNA, 25 nt, Artificial Sequence
  Synthetic Oligonucleotide; IFNG exon 2; Set C
gaauauucagcuuaccucuuuccaa

SEQ ID NO: 7579 - RNA, 30 nt, Artificial Sequence
  Synthetic Oligonucleotide; IFNG exon 2; Set A
ugggaauauucagcuuaccucuuuccaauu

SEQ ID NO: 7580 - RNA, 32 nt, Artificial Sequence
  Synthetic Oligonucleotide; IFNG exon 2; Set A
augggaauauucagcuuaccucuuuccaauuc

SEQ ID NO: 7581 - RNA, 34 nt, Artificial Sequence
  Synthetic Oligonucleotide; IFNG exon 2; Set A
aaugggaauauucagcuuaccucuuuccaauucu

SEQ ID NO: 7582 - RNA, 38 nt, Artificial Sequence
  Synthetic Oligonucleotide; IFNG exon 2; Set A
caaaugggaauauucagcuuaccucuuuccaauucuuc

SEQ ID NO: 7583 - RNA, 36 nt, Artificial Sequence
  Synthetic Oligonucleotide; IFNG exon 2; Set A
aaaugggaauauucagcuuaccucuuuccaauucuu

SEQ ID NO: 7584 - RNA, 26 nt, Artificial Sequence
  Synthetic Oligonucleotide; IFNG exon 2; Set A
ggaauauucagcuuaccucuuuccaa

SEQ ID NO: 7585 - RNA, 29 nt, Artificial Sequence
  Synthetic Oligonucleotide; IFNG exon 2; Set A
ugggaauauucagcuuaccucuuuccaau

SEQ ID NO: 7586 - RNA, 31 nt, Artificial Sequence
  Synthetic Oligonucleotide; IFNG exon 2; Set A
augggaauauucagcuuaccucuuuccaauu

SEQ ID NO: 7587 - RNA, 35 nt, Artificial Sequence
  Synthetic Oligonucleotide; IFNG exon 2; Set A
aaaugggaauauucagcuuaccucuuuccaauucu

SEQ ID NO: 7588 - RNA, 33 nt, Artificial Sequence
  Synthetic Oligonucleotide; IFNG exon 2; Set A
aaugggaauauucagcuuaccucuuuccaauuc

SEQ ID NO: 7589 - RNA, 37 nt, Artificial Sequence
  Synthetic Oligonucleotide; IFNG exon 2; Set A
caaaugggaauauucagcuuaccucuuuccaauucuu

SEQ ID NO: 7590 - RNA, 27 nt, Artificial Sequence
  Synthetic Oligonucleotide; IFNG exon 2; Set A
gggaauauucagcuuaccucuuuccaa

SEQ ID NO: 7591 - RNA, 30 nt, Artificial Sequence
  Synthetic Oligonucleotide; IFNG exon 2; Set A
augggaauauucagcuuaccucuuuccaau

SEQ ID NO: 7592 - RNA, 36 nt, Artificial Sequence
  Synthetic Oligonucleotide; IFNG exon 2; Set A
caaaugggaauauucagcuuaccucuuuccaauucu

SEQ ID NO: 7593 - RNA, 34 nt, Artificial Sequence
  Synthetic Oligonucleotide; IFNG exon 2; Set A
aaaugggaauauucagcuuaccucuuuccaauuc

SEQ ID NO: 7594 - RNA, 33 nt, Artificial Sequence
  Synthetic Oligonucleotide; IFNG exon 2; Set A
aaaugggaauauucagcuuaccucuuuccaauu

SEQ ID NO: 7595 - RNA, 35 nt, Artificial Sequence
  Synthetic Oligonucleotide; IFNG exon 2; Set A
caaaugggaauauucagcuuaccucuuuccaauuc

SEQ ID NO: 7596 - RNA, 32 nt, Artificial Sequence
  Synthetic Oligonucleotide; IFNG exon 2; Set A
aaaugggaauauucagcuuaccucuuuccaau

SEQ ID NO: 7597 - RNA, 34 nt, Artificial Sequence
  Synthetic Oligonucleotide; IFNG exon 2; Set A
caaaugggaauauucagcuuaccucuuuccaauu

SEQ ID NO: 7598 - RNA, 33 nt, Artificial Sequence
  Synthetic Oligonucleotide; IFNG exon 2; Set A
caaaugggaauauucagcuuaccucuuuccaau

SEQ ID NO: 7599 - RNA, 18 nt, Artificial Sequence
  Synthetic Oligonucleotide; IFNG exon 2; Set C
ugggaauauucagcuuac

SEQ ID NO: 7600 - RNA, 38 nt, Artificial Sequence
  Synthetic Oligonucleotide; IFNG exon 2; Set C
auuagccaaaugggaauauucagcuuaccucuuuccaa

SEQ ID NO: 7601 - RNA, 19 nt, Artificial Sequence
  Synthetic Oligonucleotide; IFNG exon 2; Set C
augggaauauucagcuuac

SEQ ID NO: 7602 - RNA, 20 nt, Artificial Sequence
  Synthetic Oligonucleotide; IFNG exon 2; Set C
aaugggaauauucagcuuac

SEQ ID NO: 7603 - RNA, 40 nt, Artificial Sequence
  Synthetic Oligonucleotide; IFNG exon 2; Set A
aaauuagccaaaugggaauauucagcuuaccucuuuccaa

SEQ ID NO: 7604 - RNA, 21 nt, Artificial Sequence
  Synthetic Oligonucleotide; IFNG exon 2; Set C
aaaugggaauauucagcuuac

SEQ ID NO: 7605 - RNA, 18 nt, Artificial Sequence
  Synthetic Oligonucleotide; IFNG exon 2; Set C
auuagccaaaugggaaua

SEQ ID NO: 7606 - RNA, 19 nt, Artificial Sequence
  Synthetic Oligonucleotide; IFNG exon 2; Set C
aauuagccaaaugggaaua

SEQ ID NO: 7607 - RNA, 20 nt, Artificial Sequence
  Synthetic Oligonucleotide; IFNG exon 2; Set C
aaauuagccaaaugggaaua

SEQ ID NO: 7608 - RNA, 21 nt, Artificial Sequence
  Synthetic Oligonucleotide; IFNG exon 2; Set C
aaaauuagccaaaugggaaua

SEQ ID NO: 7609 - RNA, 22 nt, Artificial Sequence
  Synthetic Oligonucleotide; IFNG exon 2; Set C
gaaaauuagccaaaugggaaua

SEQ ID NO: 7610 - RNA, 15 nt, Artificial Sequence
  Synthetic Oligonucleotide; IFNG exon 2; Set C
aaauuagccaaaugg

SEQ ID NO: 7611 - RNA, 16 nt, Artificial Sequence
  Synthetic Oligonucleotide; IFNG exon 2; Set C
aaaauuagccaaaugg

SEQ ID NO: 7612 - RNA, 17 nt, Artificial Sequence
  Synthetic Oligonucleotide; IFNG exon 2; Set C
gaaaauuagccaaaugg

SEQ ID NO: 7613 - RNA, 15 nt, Artificial Sequence
  Synthetic Oligonucleotide; IFNG exon 2; Set C
aaaauuagccaaaug

SEQ ID NO: 7614 - RNA, 16 nt, Artificial Sequence
  Synthetic Oligonucleotide; IFNG exon 2; Set C
gaaaauuagccaaaug

SEQ ID NO: 7615 - RNA, 15 nt, Artificial Sequence
  Synthetic Oligonucleotide; IFNG exon 2; Set C
gaaaauuagccaaau

SEQ ID NO: 7616 - RNA, 29 nt, Artificial Sequence
  Synthetic Oligonucleotide; IFNG exon 2; Set C
gcaacaggaaaauuagccaaaugggaaua

SEQ ID NO: 7617 - RNA, 31 nt, Artificial Sequence
  Synthetic Oligonucleotide; IFNG exon 2; Set C
aagcaacaggaaaauuagccaaaugggaaua

SEQ ID NO: 7618 - RNA, 32 nt, Artificial Sequence
  Synthetic Oligonucleotide; IFNG exon 2; Set B
caagcaacaggaaaauuagccaaaugggaaua

SEQ ID NO: 7619 - RNA, 24 nt, Artificial Sequence
  Synthetic Oligonucleotide; IFNG exon 2; Set C
gcaacaggaaaauuagccaaaugg

SEQ ID NO: 7620 - RNA, 25 nt, Artificial Sequence
  Synthetic Oligonucleotide; IFNG exon 2; Set C
agcaacaggaaaauuagccaaaugg

SEQ ID NO: 7621 - RNA, 23 nt, Artificial Sequence
  Synthetic Oligonucleotide; IFNG exon 2; Set C
gcaacaggaaaauuagccaaaug

SEQ ID NO: 7622 - RNA, 26 nt, Artificial Sequence
  Synthetic Oligonucleotide; IFNG exon 2; Set C
aagcaacaggaaaauuagccaaaugg

SEQ ID NO: 7623 - RNA, 24 nt, Artificial Sequence
  Synthetic Oligonucleotide; IFNG exon 2; Set C
agcaacaggaaaauuagccaaaug

SEQ ID NO: 7624 - RNA, 22 nt, Artificial Sequence
  Synthetic Oligonucleotide; IFNG exon 2; Set C
gcaacaggaaaauuagccaaau

SEQ ID NO: 7625 - RNA, 27 nt, Artificial Sequence
  Synthetic Oligonucleotide; IFNG exon 2; Set C
caagcaacaggaaaauuagccaaaugg

SEQ ID NO: 7626 - RNA, 25 nt, Artificial Sequence
  Synthetic Oligonucleotide; IFNG exon 2; Set C
aagcaacaggaaaauuagccaaaug

SEQ ID NO: 7627 - RNA, 21 nt, Artificial Sequence
  Synthetic Oligonucleotide; IFNG exon 2; Set C
gcaacaggaaaauuagccaaa

SEQ ID NO: 7628 - RNA, 23 nt, Artificial Sequence
  Synthetic Oligonucleotide; IFNG exon 2; Set C
agcaacaggaaaauuagccaaau

SEQ ID NO: 7629 - RNA, 37 nt, Artificial Sequence
  Synthetic Oligonucleotide; IFNG exon 2; Set B
gaaagcaagcaacaggaaaauuagccaaaugggaaua

SEQ ID NO: 7630 - RNA, 26 nt, Artificial Sequence
  Synthetic Oligonucleotide; IFNG exon 2; Set C
caagcaacaggaaaauuagccaaaug

SEQ ID NO: 7631 - RNA, 20 nt, Artificial Sequence
  Synthetic Oligonucleotide; IFNG exon 2; Set C
gcaacaggaaaauuagccaa

SEQ ID NO: 7632 - RNA, 22 nt, Artificial Sequence
  Synthetic Oligonucleotide; IFNG exon 2; Set C
agcaacaggaaaauuagccaaa

SEQ ID NO: 7633 - RNA, 24 nt, Artificial Sequence
  Synthetic Oligonucleotide; IFNG exon 2; Set C
aagcaacaggaaaauuagccaaau

SEQ ID NO: 7634 - RNA, 21 nt, Artificial Sequence
  Synthetic Oligonucleotide; IFNG exon 2; Set C
agcaacaggaaaauuagccaa

SEQ ID NO: 7635 - RNA, 23 nt, Artificial Sequence
  Synthetic Oligonucleotide; IFNG exon 2; Set C
aagcaacaggaaaauuagccaaa

SEQ ID NO: 7636 - RNA, 25 nt, Artificial Sequence
  Synthetic Oligonucleotide; IFNG exon 2; Set C
caagcaacaggaaaauuagccaaau

SEQ ID NO: 7637 - RNA, 22 nt, Artificial Sequence
  Synthetic Oligonucleotide; IFNG exon 2; Set C
aagcaacaggaaaauuagccaa

SEQ ID NO: 7638 - RNA, 24 nt, Artificial Sequence
  Synthetic Oligonucleotide; IFNG exon 2; Set C
caagcaacaggaaaauuagccaaa

SEQ ID NO: 7639 - RNA, 23 nt, Artificial Sequence
  Synthetic Oligonucleotide; IFNG exon 2; Set C
caagcaacaggaaaauuagccaa

SEQ ID NO: 7640 - RNA, 32 nt, Artificial Sequence
  Synthetic Oligonucleotide; IFNG exon 2; Set B
gaaagcaagcaacaggaaaauuagccaaaugg

SEQ ID NO: 7641 - RNA, 33 nt, Artificial Sequence
  Synthetic Oligonucleotide; IFNG exon 2; Set B
agaaagcaagcaacaggaaaauuagccaaaugg

SEQ ID NO: 7642 - RNA, 31 nt, Artificial Sequence
  Synthetic Oligonucleotide; IFNG exon 2; Set C
gaaagcaagcaacaggaaaauuagccaaaug

SEQ ID NO: 7643 - RNA, 32 nt, Artificial Sequence
  Synthetic Oligonucleotide; IFNG exon 2; Set C
agaaagcaagcaacaggaaaauuagccaaaug

SEQ ID NO: 7644 - RNA, 30 nt, Artificial Sequence
  Synthetic Oligonucleotide; IFNG exon 2; Set C
gaaagcaagcaacaggaaaauuagccaaau

SEQ ID NO: 7645 - RNA, 29 nt, Artificial Sequence
  Synthetic Oligonucleotide; IFNG exon 2; Set C
gaaagcaagcaacaggaaaauuagccaaa

SEQ ID NO: 7646 - RNA, 28 nt, Artificial Sequence
  Synthetic Oligonucleotide; IFNG exon 2; Set C
gaaagcaagcaacaggaaaauuagccaa

SEQ ID NO: 7647 - RNA, 21 nt, Artificial Sequence
  Synthetic Oligonucleotide; IFNG exon 2; Set C
agaaagcaagcaacaggaaaa

SEQ ID NO: 7648 - RNA, 20 nt, Artificial Sequence
  Synthetic Oligonucleotide; IFNG exon 2; Set C
agaaagcaagcaacaggaaa

SEQ ID NO: 7649 - RNA, 18 nt, Artificial Sequence
  Synthetic Oligonucleotide; IFNG exon 2; Set C
gaaagcaagcaacaggaa

SEQ ID NO: 7650 - RNA, 19 nt, Artificial Sequence
  Synthetic Oligonucleotide; IFNG exon 2; Set C
agaaagcaagcaacaggaa

SEQ ID NO: 7651 - RNA, 22 nt, Artificial Sequence
  Synthetic Oligonucleotide; IFNG exon 2; Set C
uuuacaauuagcccauaaauug

SEQ ID NO: 7652 - RNA, 22 nt, Artificial Sequence
  Synthetic Oligonucleotide; IFNG exon 2; Set C
guuuacaauuagcccauaaauu

SEQ ID NO: 7653 - RNA, 21 nt, Artificial Sequence
  Synthetic Oligonucleotide; IFNG exon 2; Set C
guuuacaauuagcccauaaau

SEQ ID NO: 7654 - RNA, 23 nt, Artificial Sequence
  Synthetic Oligonucleotide; IFNG exon 2; Set C
gguuuacaauuagcccauaaauu

SEQ ID NO: 7655 - RNA, 20 nt, Artificial Sequence
  Synthetic Oligonucleotide; IFNG exon 2; Set C
guuuacaauuagcccauaaa

SEQ ID NO: 7656 - RNA, 22 nt, Artificial Sequence
  Synthetic Oligonucleotide; IFNG exon 2; Set C
gguuuacaauuagcccauaaau

SEQ ID NO: 7657 - RNA, 24 nt, Artificial Sequence
  Synthetic Oligonucleotide; IFNG exon 2; Set C
ugguuuacaauuagcccauaaauu

SEQ ID NO: 7658 - RNA, 19 nt, Artificial Sequence
  Synthetic Oligonucleotide; IFNG exon 2; Set C
guuuacaauuagcccauaa

SEQ ID NO: 7659 - RNA, 21 nt, Artificial Sequence
  Synthetic Oligonucleotide; IFNG exon 2; Set C
gguuuacaauuagcccauaaa

SEQ ID NO: 7660 - RNA, 23 nt, Artificial Sequence
  Synthetic Oligonucleotide; IFNG exon 2; Set C
ugguuuacaauuagcccauaaau

SEQ ID NO: 7661 - RNA, 25 nt, Artificial Sequence
  Synthetic Oligonucleotide; IFNG exon 2; Set C
uugguuuacaauuagcccauaaauu

SEQ ID NO: 7662 - RNA, 20 nt, Artificial Sequence
  Synthetic Oligonucleotide; IFNG exon 2; Set C
gguuuacaauuagcccauaa

SEQ ID NO: 7663 - RNA, 22 nt, Artificial Sequence
  Synthetic Oligonucleotide; IFNG exon 2; Set C
ugguuuacaauuagcccauaaa

SEQ ID NO: 7664 - RNA, 24 nt, Artificial Sequence
  Synthetic Oligonucleotide; IFNG exon 2; Set C
uugguuuacaauuagcccauaaau

SEQ ID NO: 7665 - RNA, 26 nt, Artificial Sequence
  Synthetic Oligonucleotide; IFNG exon 2; Set C
auugguuuacaauuagcccauaaauu

SEQ ID NO: 7666 - RNA, 21 nt, Artificial Sequence
  Synthetic Oligonucleotide; IFNG exon 2; Set C
ugguuuacaauuagcccauaa

SEQ ID NO: 7667 - RNA, 23 nt, Artificial Sequence
  Synthetic Oligonucleotide; IFNG exon 2; Set C
uugguuuacaauuagcccauaaa

SEQ ID NO: 7668 - RNA, 25 nt, Artificial Sequence
  Synthetic Oligonucleotide; IFNG exon 2; Set C
auugguuuacaauuagcccauaaau

SEQ ID NO: 7669 - RNA, 27 nt, Artificial Sequence
  Synthetic Oligonucleotide; IFNG exon 2; Set C
aauugguuuacaauuagcccauaaauu

SEQ ID NO: 7670 - RNA, 22 nt, Artificial Sequence
  Synthetic Oligonucleotide; IFNG exon 2; Set C
uugguuuacaauuagcccauaa

SEQ ID NO: 7671 - RNA, 24 nt, Artificial Sequence
  Synthetic Oligonucleotide; IFNG exon 2; Set C
auugguuuacaauuagcccauaaa

SEQ ID NO: 7672 - RNA, 26 nt, Artificial Sequence
  Synthetic Oligonucleotide; IFNG exon 2; Set C
aauugguuuacaauuagcccauaaau

SEQ ID NO: 7673 - RNA, 28 nt, Artificial Sequence
  Synthetic Oligonucleotide; IFNG exon 2; Set C
aaauugguuuacaauuagcccauaaauu

SEQ ID NO: 7674 - RNA, 16 nt, Artificial Sequence
  Synthetic Oligonucleotide; IFNG exon 2; Set C
guuuacaauuagccca

SEQ ID NO: 7675 - RNA, 27 nt, Artificial Sequence
  Synthetic Oligonucleotide; IFNG exon 2; Set C
aaauugguuuacaauuagcccauaaau

SEQ ID NO: 7676 - RNA, 29 nt, Artificial Sequence
  Synthetic Oligonucleotide; IFNG exon 2; Set C
aaaauugguuuacaauuagcccauaaauu

SEQ ID NO: 7677 - RNA, 17 nt, Artificial Sequence
  Synthetic Oligonucleotide; IFNG exon 2; Set C
gguuuacaauuagccca

SEQ ID NO: 7678 - RNA, 15 nt, Artificial Sequence
  Synthetic Oligonucleotide; IFNG exon 2; Set C
guuuacaauuagccc

SEQ ID NO: 7679 - RNA, 30 nt, Artificial Sequence
  Synthetic Oligonucleotide; IFNG exon 2; Set C
aaaaauugguuuacaauuagcccauaaauu

SEQ ID NO: 7680 - RNA, 18 nt, Artificial Sequence
  Synthetic Oligonucleotide; IFNG exon 2; Set C
ugguuuacaauuagccca

SEQ ID NO: 7681 - RNA, 16 nt, Artificial Sequence
  Synthetic Oligonucleotide; IFNG exon 2; Set C
gguuuacaauuagccc

SEQ ID NO: 7682 - RNA, 29 nt, Artificial Sequence
  Synthetic Oligonucleotide; IFNG exon 2; Set C
aaaaauugguuuacaauuagcccauaaau

SEQ ID NO: 7683 - RNA, 15 nt, Artificial Sequence
  Synthetic Oligonucleotide; IFNG exon 2; Set C
gguuuacaauuagcc

SEQ ID NO: 7684 - RNA, 31 nt, Artificial Sequence
  Synthetic Oligonucleotide; IFNG exon 2; Set C
aaaaaauugguuuacaauuagcccauaaauu

SEQ ID NO: 7685 - RNA, 19 nt, Artificial Sequence
  Synthetic Oligonucleotide; IFNG exon 2; Set C
uugguuuacaauuagccca

SEQ ID NO: 7686 - RNA, 17 nt, Artificial Sequence
  Synthetic Oligonucleotide; IFNG exon 2; Set C
ugguuuacaauuagccc

SEQ ID NO: 7687 - RNA, 28 nt, Artificial Sequence
  Synthetic Oligonucleotide; IFNG exon 2; Set C
aaaaauugguuuacaauuagcccauaaa

SEQ ID NO: 7688 - RNA, 30 nt, Artificial Sequence
  Synthetic Oligonucleotide; IFNG exon 2; Set C
aaaaaauugguuuacaauuagcccauaaau

SEQ ID NO: 7689 - RNA, 16 nt, Artificial Sequence
  Synthetic Oligonucleotide; IFNG exon 2; Set C
ugguuuacaauuagcc

SEQ ID NO: 7690 - RNA, 32 nt, Artificial Sequence
  Synthetic Oligonucleotide; IFNG exon 2; Set C
gaaaaaauugguuuacaauuagcccauaaauu

SEQ ID NO: 7691 - RNA, 20 nt, Artificial Sequence
  Synthetic Oligonucleotide; IFNG exon 2; Set C
auugguuuacaauuagccca

SEQ ID NO: 7692 - RNA, 18 nt, Artificial Sequence
  Synthetic Oligonucleotide; IFNG exon 2; Set C
uugguuuacaauuagccc

SEQ ID NO: 7693 - RNA, 27 nt, Artificial Sequence
  Synthetic Oligonucleotide; IFNG exon 2; Set C
aaaaauugguuuacaauuagcccauaa

SEQ ID NO: 7694 - RNA, 29 nt, Artificial Sequence
  Synthetic Oligonucleotide; IFNG exon 2; Set C
aaaaaauugguuuacaauuagcccauaaa

SEQ ID NO: 7695 - RNA, 31 nt, Artificial Sequence
  Synthetic Oligonucleotide; IFNG exon 2; Set C
gaaaaaauugguuuacaauuagcccauaaau

SEQ ID NO: 7696 - RNA, 17 nt, Artificial Sequence
  Synthetic Oligonucleotide; IFNG exon 2; Set C
uugguuuacaauuagcc

SEQ ID NO: 7697 - RNA, 33 nt, Artificial Sequence
  Synthetic Oligonucleotide; IFNG exon 2; Set C
agaaaaaauugguuuacaauuagcccauaaauu

SEQ ID NO: 7698 - RNA, 21 nt, Artificial Sequence
  Synthetic Oligonucleotide; IFNG exon 2; Set C
aauugguuuacaauuagccca

SEQ ID NO: 7699 - RNA, 19 nt, Artificial Sequence
  Synthetic Oligonucleotide; IFNG exon 2; Set C
auugguuuacaauuagccc

SEQ ID NO: 7700 - RNA, 28 nt, Artificial Sequence
  Synthetic Oligonucleotide; IFNG exon 2; Set C
aaaaaauugguuuacaauuagcccauaa

SEQ ID NO: 7701 - RNA, 30 nt, Artificial Sequence
  Synthetic Oligonucleotide; IFNG exon 2; Set C
gaaaaaauugguuuacaauuagcccauaaa

SEQ ID NO: 7702 - RNA, 32 nt, Artificial Sequence
  Synthetic Oligonucleotide; IFNG exon 2; Set C
agaaaaaauugguuuacaauuagcccauaaau

SEQ ID NO: 7703 - RNA, 18 nt, Artificial Sequence
  Synthetic Oligonucleotide; IFNG exon 2; Set C
auugguuuacaauuagcc

SEQ ID NO: 7704 - RNA, 34 nt, Artificial Sequence
  Synthetic Oligonucleotide; IFNG exon 2; Set C
aagaaaaaauugguuuacaauuagcccauaaauu

SEQ ID NO: 7705 - RNA, 22 nt, Artificial Sequence
  Synthetic Oligonucleotide; IFNG exon 2; Set C
aaauugguuuacaauuagccca

SEQ ID NO: 7706 - RNA, 20 nt, Artificial Sequence
  Synthetic Oligonucleotide; IFNG exon 2; Set C
aauugguuuacaauuagccc

SEQ ID NO: 7707 - RNA, 29 nt, Artificial Sequence
  Synthetic Oligonucleotide; IFNG exon 2; Set C
gaaaaaauugguuuacaauuagcccauaa

SEQ ID NO: 7708 - RNA, 31 nt, Artificial Sequence
  Synthetic Oligonucleotide; IFNG exon 2; Set C
agaaaaaauugguuuacaauuagcccauaaa

SEQ ID NO: 7709 - RNA, 33 nt, Artificial Sequence
  Synthetic Oligonucleotide; IFNG exon 2; Set C
aagaaaaaauugguuuacaauuagcccauaaau

SEQ ID NO: 7710 - RNA, 19 nt, Artificial Sequence
  Synthetic Oligonucleotide; IFNG exon 2; Set C
aauugguuuacaauuagcc

SEQ ID NO: 7711 - RNA, 35 nt, Artificial Sequence
  Synthetic Oligonucleotide; IFNG exon 2; Set C
aaagaaaaaauugguuuacaauuagcccauaaauu

SEQ ID NO: 7712 - RNA, 23 nt, Artificial Sequence
  Synthetic Oligonucleotide; IFNG exon 2; Set C
aaaauugguuuacaauuagccca

SEQ ID NO: 7713 - RNA, 21 nt, Artificial Sequence
  Synthetic Oligonucleotide; IFNG exon 2; Set C
aaauugguuuacaauuagccc

SEQ ID NO: 7714 - RNA, 30 nt, Artificial Sequence
  Synthetic Oligonucleotide; IFNG exon 2; Set C
agaaaaaauugguuuacaauuagcccauaa

SEQ ID NO: 7715 - RNA, 32 nt, Artificial Sequence
  Synthetic Oligonucleotide; IFNG exon 2; Set C
aagaaaaaauugguuuacaauuagcccauaaa

SEQ ID NO: 7716 - RNA, 34 nt, Artificial Sequence
  Synthetic Oligonucleotide; IFNG exon 2; Set C
aaagaaaaaauugguuuacaauuagcccauaaau

SEQ ID NO: 7717 - RNA, 20 nt, Artificial Sequence
  Synthetic Oligonucleotide; IFNG exon 2; Set C
aaauugguuuacaauuagcc

SEQ ID NO: 7718 - RNA, 36 nt, Artificial Sequence
  Synthetic Oligonucleotide; IFNG exon 2; Set C
aaaagaaaaaauugguuuacaauuagcccauaaauu

SEQ ID NO: 7719 - RNA, 24 nt, Artificial Sequence
  Synthetic Oligonucleotide; IFNG exon 2; Set C
aaaaauugguuuacaauuagccca

SEQ ID NO: 7720 - RNA, 22 nt, Artificial Sequence
  Synthetic Oligonucleotide; IFNG exon 2; Set C
aaaauugguuuacaauuagccc

SEQ ID NO: 7721 - RNA, 31 nt, Artificial Sequence
  Synthetic Oligonucleotide; IFNG exon 2; Set C
aagaaaaaauugguuuacaauuagcccauaa

SEQ ID NO: 7722 - RNA, 33 nt, Artificial Sequence
  Synthetic Oligonucleotide; IFNG exon 2; Set C
aaagaaaaaauugguuuacaauuagcccauaaa

SEQ ID NO: 7723 - RNA, 35 nt, Artificial Sequence
  Synthetic Oligonucleotide; IFNG exon 2; Set C
aaaagaaaaaauugguuuacaauuagcccauaaau

SEQ ID NO: 7724 - RNA, 21 nt, Artificial Sequence
  Synthetic Oligonucleotide; IFNG exon 2; Set C
aaaauugguuuacaauuagcc

SEQ ID NO: 7725 - RNA, 37 nt, Artificial Sequence
  Synthetic Oligonucleotide; IFNG exon 2; Set C
aaaaagaaaaaauugguuuacaauuagcccauaaauu

SEQ ID NO: 7726 - RNA, 25 nt, Artificial Sequence
  Synthetic Oligonucleotide; IFNG exon 2; Set C
aaaaaauugguuuacaauuagccca

SEQ ID NO: 7727 - RNA, 23 nt, Artificial Sequence
  Synthetic Oligonucleotide; IFNG exon 2; Set C
aaaaauugguuuacaauuagccc

SEQ ID NO: 7728 - RNA, 32 nt, Artificial Sequence
  Synthetic Oligonucleotide; IFNG exon 2; Set C
aaagaaaaaauugguuuacaauuagcccauaa

SEQ ID NO: 7729 - RNA, 36 nt, Artificial Sequence
  Synthetic Oligonucleotide; IFNG exon 2; Set C
aaaaagaaaaaauugguuuacaauuagcccauaaau

SEQ ID NO: 7730 - RNA, 22 nt, Artificial Sequence
  Synthetic Oligonucleotide; IFNG exon 2; Set C
aaaaauugguuuacaauuagcc

SEQ ID NO: 7731 - RNA, 38 nt, Artificial Sequence
  Synthetic Oligonucleotide; IFNG exon 2; Set C
aaaaaagaaaaaauugguuuacaauuagcccauaaauu

SEQ ID NO: 7732 - RNA, 26 nt, Artificial Sequence
  Synthetic Oligonucleotide; IFNG exon 2; Set C
gaaaaaauugguuuacaauuagccca

SEQ ID NO: 7733 - RNA, 24 nt, Artificial Sequence
  Synthetic Oligonucleotide; IFNG exon 2; Set C
aaaaaauugguuuacaauuagccc

SEQ ID NO: 7734 - RNA, 37 nt, Artificial Sequence
  Synthetic Oligonucleotide; IFNG exon 2; Set C
aaaaaagaaaaaauugguuuacaauuagcccauaaau

SEQ ID NO: 7735 - RNA, 23 nt, Artificial Sequence
  Synthetic Oligonucleotide; IFNG exon 2; Set C
aaaaaauugguuuacaauuagcc

SEQ ID NO: 7736 - RNA, 39 nt, Artificial Sequence
  Synthetic Oligonucleotide; IFNG exon 2; Set C
aaaaaaagaaaaaauugguuuacaauuagcccauaaauu

SEQ ID NO: 7737 - RNA, 27 nt, Artificial Sequence
  Synthetic Oligonucleotide; IFNG exon 2; Set C
agaaaaaauugguuuacaauuagccca

SEQ ID NO: 7738 - RNA, 25 nt, Artificial Sequence
  Synthetic Oligonucleotide; IFNG exon 2; Set C
gaaaaaauugguuuacaauuagccc

SEQ ID NO: 7739 - RNA, 15 nt, Artificial Sequence
  Synthetic Oligonucleotide; IFNG exon 2; Set C
aauugguuuacaauu

SEQ ID NO: 7740 - RNA, 38 nt, Artificial Sequence
  Synthetic Oligonucleotide; IFNG exon 2; Set C
aaaaaaagaaaaaauugguuuacaauuagcccauaaau

SEQ ID NO: 7741 - RNA, 24 nt, Artificial Sequence
  Synthetic Oligonucleotide; IFNG exon 2; Set C
gaaaaaauugguuuacaauuagcc

SEQ ID NO: 7742 - RNA, 40 nt, Artificial Sequence
  Synthetic Oligonucleotide; IFNG exon 2; Set C
aaaaaaaagaaaaaauugguuuacaauuagcccauaaauu

SEQ ID NO: 7743 - RNA, 28 nt, Artificial Sequence
  Synthetic Oligonucleotide; IFNG exon 2; Set C
aagaaaaaauugguuuacaauuagccca

SEQ ID NO: 7744 - RNA, 26 nt, Artificial Sequence
  Synthetic Oligonucleotide; IFNG exon 2; Set C
agaaaaaauugguuuacaauuagccc

SEQ ID NO: 7745 - RNA, 16 nt, Artificial Sequence
  Synthetic Oligonucleotide; IFNG exon 2; Set C
aaauugguuuacaauu

SEQ ID NO: 7746 - RNA, 25 nt, Artificial Sequence
  Synthetic Oligonucleotide; IFNG exon 2; Set C
agaaaaaauugguuuacaauuagcc

SEQ ID NO: 7747 - RNA, 29 nt, Artificial Sequence
  Synthetic Oligonucleotide; IFNG exon 2; Set C
aaagaaaaaauugguuuacaauuagccca

SEQ ID NO: 7748 - RNA, 27 nt, Artificial Sequence
  Synthetic Oligonucleotide; IFNG exon 2; Set C
aagaaaaaauugguuuacaauuagccc

SEQ ID NO: 7749 - RNA, 15 nt, Artificial Sequence
  Synthetic Oligonucleotide; IFNG exon 2; Set C
aaauugguuuacaau

SEQ ID NO: 7750 - RNA, 17 nt, Artificial Sequence
  Synthetic Oligonucleotide; IFNG exon 2; Set C
aaaauugguuuacaauu

SEQ ID NO: 7751 - RNA, 26 nt, Artificial Sequence
  Synthetic Oligonucleotide; IFNG exon 2; Set C
aagaaaaaauugguuuacaauuagcc

SEQ ID NO: 7752 - RNA, 30 nt, Artificial Sequence
  Synthetic Oligonucleotide; IFNG exon 2; Set C
aaaagaaaaaauugguuuacaauuagccca

SEQ ID NO: 7753 - RNA, 28 nt, Artificial Sequence
  Synthetic Oligonucleotide; IFNG exon 2; Set C
aaagaaaaaauugguuuacaauuagccc

SEQ ID NO: 7754 - RNA, 16 nt, Artificial Sequence
  Synthetic Oligonucleotide; IFNG exon 2; Set C
aaaauugguuuacaau

SEQ ID NO: 7755 - RNA, 27 nt, Artificial Sequence
  Synthetic Oligonucleotide; IFNG exon 2; Set C
aaagaaaaaauugguuuacaauuagcc

SEQ ID NO: 7756 - RNA, 31 nt, Artificial Sequence
  Synthetic Oligonucleotide; IFNG exon 2; Set C
aaaaagaaaaaauugguuuacaauuagccca

SEQ ID NO: 7757 - RNA, 29 nt, Artificial Sequence
  Synthetic Oligonucleotide; IFNG exon 2; Set C
aaaagaaaaaauugguuuacaauuagccc

SEQ ID NO: 7758 - RNA, 15 nt, Artificial Sequence
  Synthetic Oligonucleotide; IFNG exon 2; Set C
aaaauugguuuacaa

SEQ ID NO: 7759 - RNA, 28 nt, Artificial Sequence
  Synthetic Oligonucleotide; IFNG exon 2; Set C
aaaagaaaaaauugguuuacaauuagcc

SEQ ID NO: 7760 - RNA, 32 nt, Artificial Sequence
  Synthetic Oligonucleotide; IFNG exon 2; Set C
aaaaaagaaaaaauugguuuacaauuagccca

SEQ ID NO: 7761 - RNA, 30 nt, Artificial Sequence
  Synthetic Oligonucleotide; IFNG exon 2; Set C
aaaaagaaaaaauugguuuacaauuagccc

SEQ ID NO: 7762 - RNA, 29 nt, Artificial Sequence
  Synthetic Oligonucleotide; IFNG exon 2; Set C
aaaaagaaaaaauugguuuacaauuagcc

SEQ ID NO: 7763 - RNA, 33 nt, Artificial Sequence
  Synthetic Oligonucleotide; IFNG exon 2; Set C
aaaaaaagaaaaaauugguuuacaauuagccca

SEQ ID NO: 7764 - RNA, 31 nt, Artificial Sequence
  Synthetic Oligonucleotide; IFNG exon 2; Set C
aaaaaagaaaaaauugguuuacaauuagccc

SEQ ID NO: 7765 - RNA, 30 nt, Artificial Sequence
  Synthetic Oligonucleotide; IFNG exon 2; Set C
aaaaaagaaaaaauugguuuacaauuagcc

SEQ ID NO: 7766 - RNA, 34 nt, Artificial Sequence
  Synthetic Oligonucleotide; IFNG exon 2; Set C
aaaaaaaagaaaaaauugguuuacaauuagccca

SEQ ID NO: 7767 - RNA, 32 nt, Artificial Sequence
  Synthetic Oligonucleotide; IFNG exon 2; Set C
aaaaaaagaaaaaauugguuuacaauuagccc

SEQ ID NO: 7768 - RNA, 31 nt, Artificial Sequence
  Synthetic Oligonucleotide; IFNG exon 2; Set C
aaaaaaagaaaaaauugguuuacaauuagcc

SEQ ID NO: 7769 - RNA, 35 nt, Artificial Sequence
  Synthetic Oligonucleotide; IFNG exon 2; Set C
aaaaaaaaagaaaaaauugguuuacaauuagccca

SEQ ID NO: 7770 - RNA, 33 nt, Artificial Sequence
  Synthetic Oligonucleotide; IFNG exon 2; Set C
aaaaaaaagaaaaaauugguuuacaauuagccc

SEQ ID NO: 7771 - RNA, 32 nt, Artificial Sequence
  Synthetic Oligonucleotide; IFNG exon 2; Set C
aaaaaaaagaaaaaauugguuuacaauuagcc

SEQ ID NO: 7772 - RNA, 36 nt, Artificial Sequence
  Synthetic Oligonucleotide; IFNG exon 2; Set C
aaaaaaaaaagaaaaaauugguuuacaauuagccca

SEQ ID NO: 7773 - RNA, 34 nt, Artificial Sequence
  Synthetic Oligonucleotide; IFNG exon 2; Set C
aaaaaaaaagaaaaaauugguuuacaauuagccc

SEQ ID NO: 7774 - RNA, 24 nt, Artificial Sequence
  Synthetic Oligonucleotide; IFNG exon 2; Set C
aaaagaaaaaauugguuuacaauu

SEQ ID NO: 7775 - RNA, 33 nt, Artificial Sequence
  Synthetic Oligonucleotide; IFNG exon 2; Set C
aaaaaaaaagaaaaaauugguuuacaauuagcc

SEQ ID NO: 7776 - RNA, 37 nt, Artificial Sequence
  Synthetic Oligonucleotide; IFNG exon 2; Set C
aaaaaaaaaaagaaaaaauugguuuacaauuagccca

SEQ ID NO: 7777 - RNA, 35 nt, Artificial Sequence
  Synthetic Oligonucleotide; IFNG exon 2; Set C
aaaaaaaaaagaaaaaauugguuuacaauuagccc

SEQ ID NO: 7778 - RNA, 23 nt, Artificial Sequence
  Synthetic Oligonucleotide; IFNG exon 2; Set C
aaaagaaaaaauugguuuacaau

SEQ ID NO: 7779 - RNA, 25 nt, Artificial Sequence
  Synthetic Oligonucleotide; IFNG exon 2; Set C
aaaaagaaaaaauugguuuacaauu

SEQ ID NO: 7780 - RNA, 34 nt, Artificial Sequence
  Synthetic Oligonucleotide; IFNG exon 2; Set C
aaaaaaaaaagaaaaaauugguuuacaauuagcc

SEQ ID NO: 7781 - RNA, 38 nt, Artificial Sequence
  Synthetic Oligonucleotide; IFNG exon 2; Set C
aaaaaaaaaaaagaaaaaauugguuuacaauuagccca

SEQ ID NO: 7782 - RNA, 36 nt, Artificial Sequence
  Synthetic Oligonucleotide; IFNG exon 2; Set C
aaaaaaaaaaagaaaaaauugguuuacaauuagccc

SEQ ID NO: 7783 - RNA, 24 nt, Artificial Sequence
  Synthetic Oligonucleotide; IFNG exon 2; Set C
aaaaagaaaaaauugguuuacaau

SEQ ID NO: 7784 - RNA, 22 nt, Artificial Sequence
  Synthetic Oligonucleotide; IFNG exon 2; Set C
aaaagaaaaaauugguuuacaa

SEQ ID NO: 7785 - RNA, 26 nt, Artificial Sequence
  Synthetic Oligonucleotide; IFNG exon 2; Set C
aaaaaagaaaaaauugguuuacaauu

SEQ ID NO: 7786 - RNA, 35 nt, Artificial Sequence
  Synthetic Oligonucleotide; IFNG exon 2; Set C
aaaaaaaaaaagaaaaaauugguuuacaauuagcc

SEQ ID NO: 7787 - RNA, 39 nt, Artificial Sequence
  Synthetic Oligonucleotide; IFNG exon 2; Set C
aaaaaaaaaaaaagaaaaaauugguuuacaauuagccca

SEQ ID NO: 7788 - RNA, 37 nt, Artificial Sequence
  Synthetic Oligonucleotide; IFNG exon 2; Set C
aaaaaaaaaaaagaaaaaauugguuuacaauuagccc

SEQ ID NO: 7789 - RNA, 25 nt, Artificial Sequence
  Synthetic Oligonucleotide; IFNG exon 2; Set C
aaaaaagaaaaaauugguuuacaau

SEQ ID NO: 7790 - RNA, 23 nt, Artificial Sequence
  Synthetic Oligonucleotide; IFNG exon 2; Set C
aaaaagaaaaaauugguuuacaa

SEQ ID NO: 7791 - RNA, 27 nt, Artificial Sequence
  Synthetic Oligonucleotide; IFNG exon 2; Set C
aaaaaaagaaaaaauugguuuacaauu

SEQ ID NO: 7792 - RNA, 21 nt, Artificial Sequence
  Synthetic Oligonucleotide; IFNG exon 2; Set C
aaaagaaaaaauugguuuaca

SEQ ID NO: 7793 - RNA, 36 nt, Artificial Sequence
  Synthetic Oligonucleotide; IFNG exon 2; Set C
aaaaaaaaaaaagaaaaaauugguuuacaauuagcc

SEQ ID NO: 7794 - RNA, 40 nt, Artificial Sequence
  Synthetic Oligonucleotide; IFNG exon 2; Set C
uaaaaaaaaaaaaagaaaaaauugguuuacaauuagccca

SEQ ID NO: 7795 - RNA, 38 nt, Artificial Sequence
  Synthetic Oligonucleotide; IFNG exon 2; Set C
aaaaaaaaaaaaagaaaaaauugguuuacaauuagccc

SEQ ID NO: 7796 - RNA, 26 nt, Artificial Sequence
  Synthetic Oligonucleotide; IFNG exon 2; Set C
aaaaaaagaaaaaauugguuuacaau

SEQ ID NO: 7797 - RNA, 24 nt, Artificial Sequence
  Synthetic Oligonucleotide; IFNG exon 2; Set C
aaaaaagaaaaaauugguuuacaa

SEQ ID NO: 7798 - RNA, 18 nt, Artificial Sequence
  Synthetic Oligonucleotide; IFNG exon 2; Set C
aaagaaaaaauugguuua

SEQ ID NO: 7799 - RNA, 28 nt, Artificial Sequence
  Synthetic Oligonucleotide; IFNG exon 2; Set C
aaaaaaaagaaaaaauugguuuacaauu

SEQ ID NO: 7800 - RNA, 20 nt, Artificial Sequence
  Synthetic Oligonucleotide; IFNG exon 2; Set C
aaaagaaaaaauugguuuac

SEQ ID NO: 7801 - RNA, 22 nt, Artificial Sequence
  Synthetic Oligonucleotide; IFNG exon 2; Set C
aaaaagaaaaaauugguuuaca

SEQ ID NO: 7802 - RNA, 37 nt, Artificial Sequence
  Synthetic Oligonucleotide; IFNG exon 2; Set C
aaaaaaaaaaaaagaaaaaauugguuuacaauuagcc

SEQ ID NO: 7803 - RNA, 39 nt, Artificial Sequence
  Synthetic Oligonucleotide; IFNG exon 2; Set C
uaaaaaaaaaaaaagaaaaaauugguuuacaauuagccc

SEQ ID NO: 7804 - RNA, 27 nt, Artificial Sequence
  Synthetic Oligonucleotide; IFNG exon 2; Set C
aaaaaaaagaaaaaauugguuuacaau

SEQ ID NO: 7805 - RNA, 25 nt, Artificial Sequence
  Synthetic Oligonucleotide; IFNG exon 2; Set C
aaaaaaagaaaaaauugguuuacaa

SEQ ID NO: 7806 - RNA, 19 nt, Artificial Sequence
  Synthetic Oligonucleotide; IFNG exon 2; Set C
aaaagaaaaaauugguuua

SEQ ID NO: 7807 - RNA, 29 nt, Artificial Sequence
  Synthetic Oligonucleotide; IFNG exon 2; Set C
aaaaaaaaagaaaaaauugguuuacaauu

SEQ ID NO: 7808 - RNA, 21 nt, Artificial Sequence
  Synthetic Oligonucleotide; IFNG exon 2; Set C
aaaaagaaaaaauugguuuac

SEQ ID NO: 7809 - RNA, 23 nt, Artificial Sequence
  Synthetic Oligonucleotide; IFNG exon 2; Set C
aaaaaagaaaaaauugguuuaca

SEQ ID NO: 7810 - RNA, 38 nt, Artificial Sequence
  Synthetic Oligonucleotide; IFNG exon 2; Set C
uaaaaaaaaaaaaagaaaaaauugguuuacaauuagcc

SEQ ID NO: 7811 - RNA, 28 nt, Artificial Sequence
  Synthetic Oligonucleotide; IFNG exon 2; Set C
aaaaaaaaagaaaaaauugguuuacaau

SEQ ID NO: 7812 - RNA, 26 nt, Artificial Sequence
  Synthetic Oligonucleotide; IFNG exon 2; Set C
aaaaaaaagaaaaaauugguuuacaa

SEQ ID NO: 7813 - RNA, 20 nt, Artificial Sequence
  Synthetic Oligonucleotide; IFNG exon 2; Set C
aaaaagaaaaaauugguuua

SEQ ID NO: 7814 - RNA, 30 nt, Artificial Sequence
  Synthetic Oligonucleotide; IFNG exon 2; Set C
aaaaaaaaaagaaaaaauugguuuacaauu

SEQ ID NO: 7815 - RNA, 22 nt, Artificial Sequence
  Synthetic Oligonucleotide; IFNG exon 2; Set C
aaaaaagaaaaaauugguuuac

SEQ ID NO: 7816 - RNA, 24 nt, Artificial Sequence
  Synthetic Oligonucleotide; IFNG exon 2; Set C
aaaaaaagaaaaaauugguuuaca

SEQ ID NO: 7817 - RNA, 29 nt, Artificial Sequence
  Synthetic Oligonucleotide; IFNG exon 2; Set C
aaaaaaaaaagaaaaaauugguuuacaau

SEQ ID NO: 7818 - RNA, 27 nt, Artificial Sequence
  Synthetic Oligonucleotide; IFNG exon 2; Set C
aaaaaaaaagaaaaaauugguuuacaa

SEQ ID NO: 7819 - RNA, 21 nt, Artificial Sequence
  Synthetic Oligonucleotide; IFNG exon 2; Set C
aaaaaagaaaaaauugguuua

SEQ ID NO: 7820 - RNA, 31 nt, Artificial Sequence
  Synthetic Oligonucleotide; IFNG exon 2; Set C
aaaaaaaaaaagaaaaaauugguuuacaauu

SEQ ID NO: 7821 - RNA, 23 nt, Artificial Sequence
  Synthetic Oligonucleotide; IFNG exon 2; Set C
aaaaaaagaaaaaauugguuuac

SEQ ID NO: 7822 - RNA, 25 nt, Artificial Sequence
  Synthetic Oligonucleotide; IFNG exon 2; Set C
aaaaaaaagaaaaaauugguuuaca

SEQ ID NO: 7823 - RNA, 30 nt, Artificial Sequence
  Synthetic Oligonucleotide; IFNG exon 2; Set C
aaaaaaaaaaagaaaaaauugguuuacaau

SEQ ID NO: 7824 - RNA, 28 nt, Artificial Sequence
  Synthetic Oligonucleotide; IFNG exon 2; Set C
aaaaaaaaaagaaaaaauugguuuacaa

SEQ ID NO: 7825 - RNA, 22 nt, Artificial Sequence
  Synthetic Oligonucleotide; IFNG exon 2; Set C
aaaaaaagaaaaaauugguuua

SEQ ID NO: 7826 - RNA, 32 nt, Artificial Sequence
  Synthetic Oligonucleotide; IFNG exon 2; Set C
aaaaaaaaaaaagaaaaaauugguuuacaauu

SEQ ID NO: 7827 - RNA, 24 nt, Artificial Sequence
  Synthetic Oligonucleotide; IFNG exon 2; Set C
aaaaaaaagaaaaaauugguuuac

SEQ ID NO: 7828 - RNA, 26 nt, Artificial Sequence
  Synthetic Oligonucleotide; IFNG exon 2; Set C
aaaaaaaaagaaaaaauugguuuaca

SEQ ID NO: 7829 - RNA, 31 nt, Artificial Sequence
  Synthetic Oligonucleotide; IFNG exon 2; Set C
aaaaaaaaaaaagaaaaaauugguuuacaau

SEQ ID NO: 7830 - RNA, 29 nt, Artificial Sequence
  Synthetic Oligonucleotide; IFNG exon 2; Set C
aaaaaaaaaaagaaaaaauugguuuacaa

SEQ ID NO: 7831 - RNA, 23 nt, Artificial Sequence
  Synthetic Oligonucleotide; IFNG exon 2; Set C
aaaaaaaagaaaaaauugguuua

SEQ ID NO: 7832 - RNA, 33 nt, Artificial Sequence
  Synthetic Oligonucleotide; IFNG exon 2; Set C
aaaaaaaaaaaaagaaaaaauugguuuacaauu

SEQ ID NO: 7833 - RNA, 25 nt, Artificial Sequence
  Synthetic Oligonucleotide; IFNG exon 2; Set C
aaaaaaaaagaaaaaauugguuuac

SEQ ID NO: 7834 - RNA, 27 nt, Artificial Sequence
  Synthetic Oligonucleotide; IFNG exon 2; Set C
aaaaaaaaaagaaaaaauugguuuaca

SEQ ID NO: 7835 - RNA, 32 nt, Artificial Sequence
  Synthetic Oligonucleotide; IFNG exon 2; Set C
aaaaaaaaaaaaagaaaaaauugguuuacaau

SEQ ID NO: 7836 - RNA, 30 nt, Artificial Sequence
  Synthetic Oligonucleotide; IFNG exon 2; Set C
aaaaaaaaaaaagaaaaaauugguuuacaa

SEQ ID NO: 7837 - RNA, 24 nt, Artificial Sequence
  Synthetic Oligonucleotide; IFNG exon 2; Set C
aaaaaaaaagaaaaaauugguuua

SEQ ID NO: 7838 - RNA, 34 nt, Artificial Sequence
  Synthetic Oligonucleotide; IFNG exon 2; Set C
uaaaaaaaaaaaaagaaaaaauugguuuacaauu

SEQ ID NO: 7839 - RNA, 26 nt, Artificial Sequence
  Synthetic Oligonucleotide; IFNG exon 2; Set C
aaaaaaaaaagaaaaaauugguuuac

SEQ ID NO: 7840 - RNA, 28 nt, Artificial Sequence
  Synthetic Oligonucleotide; IFNG exon 2; Set C
aaaaaaaaaaagaaaaaauugguuuaca

SEQ ID NO: 7841 - RNA, 33 nt, Artificial Sequence
  Synthetic Oligonucleotide; IFNG exon 2; Set C
uaaaaaaaaaaaaagaaaaaauugguuuacaau

SEQ ID NO: 7842 - RNA, 31 nt, Artificial Sequence
  Synthetic Oligonucleotide; IFNG exon 2; Set C
aaaaaaaaaaaaagaaaaaauugguuuacaa

SEQ ID NO: 7843 - RNA, 25 nt, Artificial Sequence
  Synthetic Oligonucleotide; IFNG exon 2; Set C
aaaaaaaaaagaaaaaauugguuua

SEQ ID NO: 7844 - RNA, 27 nt, Artificial Sequence
  Synthetic Oligonucleotide; IFNG exon 2; Set C
aaaaaaaaaaagaaaaaauugguuuac

SEQ ID NO: 7845 - RNA, 29 nt, Artificial Sequence
  Synthetic Oligonucleotide; IFNG exon 2; Set C
aaaaaaaaaaaagaaaaaauugguuuaca

SEQ ID NO: 7846 - RNA, 32 nt, Artificial Sequence
  Synthetic Oligonucleotide; IFNG exon 2; Set C
uaaaaaaaaaaaaagaaaaaauugguuuacaa

SEQ ID NO: 7847 - RNA, 26 nt, Artificial Sequence
  Synthetic Oligonucleotide; IFNG exon 2; Set C
aaaaaaaaaaagaaaaaauugguuua

SEQ ID NO: 7848 - RNA, 28 nt, Artificial Sequence
  Synthetic Oligonucleotide; IFNG exon 2; Set C
aaaaaaaaaaaagaaaaaauugguuuac

SEQ ID NO: 7849 - RNA, 30 nt, Artificial Sequence
  Synthetic Oligonucleotide; IFNG exon 2; Set C
aaaaaaaaaaaaagaaaaaauugguuuaca

SEQ ID NO: 7850 - RNA, 27 nt, Artificial Sequence
  Synthetic Oligonucleotide; IFNG exon 2; Set C
aaaaaaaaaaaagaaaaaauugguuua

SEQ ID NO: 7851 - RNA, 29 nt, Artificial Sequence
  Synthetic Oligonucleotide; IFNG exon 2; Set C
aaaaaaaaaaaaagaaaaaauugguuuac

SEQ ID NO: 7852 - RNA, 31 nt, Artificial Sequence
  Synthetic Oligonucleotide; IFNG exon 2; Set C
uaaaaaaaaaaaaagaaaaaauugguuuaca

SEQ ID NO: 7853 - RNA, 28 nt, Artificial Sequence
  Synthetic Oligonucleotide; IFNG exon 2; Set C
aaaaaaaaaaaaagaaaaaauugguuua

SEQ ID NO: 7854 - RNA, 30 nt, Artificial Sequence
  Synthetic Oligonucleotide; IFNG exon 2; Set C
uaaaaaaaaaaaaagaaaaaauugguuuac

SEQ ID NO: 7855 - RNA, 29 nt, Artificial Sequence
  Synthetic Oligonucleotide; IFNG exon 2; Set C
uaaaaaaaaaaaaagaaaaaauugguuua

SEQ ID NO: 7856 - RNA, 35 nt, Artificial Sequence
  Synthetic Oligonucleotide; IFNG exon 2; Set C
ugcauucuaaaaaaaaaaaaagaaaaaauugguuu

SEQ ID NO: 7857 - RNA, 36 nt, Artificial Sequence
  Synthetic Oligonucleotide; IFNG exon 2; Set C
cugcauucuaaaaaaaaaaaaagaaaaaauugguuu

SEQ ID NO: 7858 - RNA, 17 nt, Artificial Sequence
  Synthetic Oligonucleotide; IFNG exon 2; Set C
acaucugaaugaccugc

SEQ ID NO: 7859 - RNA, 40 nt, Artificial Sequence
  Synthetic Oligonucleotide; IFNG exon 2; Set A
auauucagcuuaccucuuuccaauucuucaaaaugccuaa

SEQ ID NO: 7860 - RNA, 38 nt, Artificial Sequence
  Synthetic Oligonucleotide; IFNG exon 2; Set A
auauucagcuuaccucuuuccaauucuucaaaaugccu

SEQ ID NO: 7861 - RNA, 37 nt, Artificial Sequence
  Synthetic Oligonucleotide; IFNG exon 2; Set A
auauucagcuuaccucuuuccaauucuucaaaaugcc

SEQ ID NO: 7862 - RNA, 36 nt, Artificial Sequence
  Synthetic Oligonucleotide; IFNG exon 2; Set A
auauucagcuuaccucuuuccaauucuucaaaaugc

SEQ ID NO: 7863 - RNA, 35 nt, Artificial Sequence
  Synthetic Oligonucleotide; IFNG exon 2; Set A
auauucagcuuaccucuuuccaauucuucaaaaug

SEQ ID NO: 7864 - RNA, 34 nt, Artificial Sequence
  Synthetic Oligonucleotide; IFNG exon 2; Set A
auauucagcuuaccucuuuccaauucuucaaaau

SEQ ID NO: 7865 - RNA, 33 nt, Artificial Sequence
  Synthetic Oligonucleotide; IFNG exon 2; Set A
auauucagcuuaccucuuuccaauucuucaaaa

SEQ ID NO: 7866 - RNA, 32 nt, Artificial Sequence
  Synthetic Oligonucleotide; IFNG exon 2; Set A
auauucagcuuaccucuuuccaauucuucaaa

SEQ ID NO: 7867 - RNA, 31 nt, Artificial Sequence
  Synthetic Oligonucleotide; IFNG exon 2; Set A
auauucagcuuaccucuuuccaauucuucaa

SEQ ID NO: 7868 - RNA, 30 nt, Artificial Sequence
  Synthetic Oligonucleotide; IFNG exon 2; Set A
auauucagcuuaccucuuuccaauucuuca

SEQ ID NO: 7869 - RNA, 29 nt, Artificial Sequence
  Synthetic Oligonucleotide; IFNG exon 2; Set A
auauucagcuuaccucuuuccaauucuuc

SEQ ID NO: 7870 - RNA, 28 nt, Artificial Sequence
  Synthetic Oligonucleotide; IFNG exon 2; Set A
auauucagcuuaccucuuuccaauucuu

SEQ ID NO: 7871 - RNA, 27 nt, Artificial Sequence
  Synthetic Oligonucleotide; IFNG exon 2; Set A
auauucagcuuaccucuuuccaauucu

SEQ ID NO: 7872 - RNA, 26 nt, Artificial Sequence
  Synthetic Oligonucleotide; IFNG exon 2; Set C
auauucagcuuaccucuuuccaauuc

SEQ ID NO: 7873 - RNA, 25 nt, Artificial Sequence
  Synthetic Oligonucleotide; IFNG exon 2; Set C
auauucagcuuaccucuuuccaauu

SEQ ID NO: 7874 - RNA, 32 nt, Artificial Sequence
  Synthetic Oligonucleotide; IFNG exon 2; Set A
aaugggaauauucagcuuaccucuuuccaauu

SEQ ID NO: 7875 - RNA, 28 nt, Artificial Sequence
  Synthetic Oligonucleotide; IFNG exon 2; Set A
ugggaauauucagcuuaccucuuuccaa

SEQ ID NO: 7876 - RNA, 31 nt, Artificial Sequence
  Synthetic Oligonucleotide; IFNG exon 2; Set A
aaugggaauauucagcuuaccucuuuccaau

SEQ ID NO: 7877 - RNA, 29 nt, Artificial Sequence
  Synthetic Oligonucleotide; IFNG exon 2; Set A
augggaauauucagcuuaccucuuuccaa

SEQ ID NO: 7878 - RNA, 30 nt, Artificial Sequence
  Synthetic Oligonucleotide; IFNG exon 2; Set A
aaugggaauauucagcuuaccucuuuccaa

SEQ ID NO: 7879 - RNA, 31 nt, Artificial Sequence
  Synthetic Oligonucleotide; IFNG exon 2; Set A
aaaugggaauauucagcuuaccucuuuccaa

SEQ ID NO: 7880 - RNA, 32 nt, Artificial Sequence
  Synthetic Oligonucleotide; IFNG exon 2; Set A
caaaugggaauauucagcuuaccucuuuccaa

SEQ ID NO: 7881 - RNA, 30 nt, Artificial Sequence
  Synthetic Oligonucleotide; IFNG exon 2; Set B
agcaacaggaaaauuagccaaaugggaaua

SEQ ID NO: 7882 - RNA, 35 nt, Artificial Sequence
  Synthetic Oligonucleotide; IFNG exon 2; Set B
aaagcaagcaacaggaaaauuagccaaaugggaau

SEQ ID NO: 7883 - RNA, 34 nt, Artificial Sequence
  Synthetic Oligonucleotide; IFNG exon 2; Set B
aaagcaagcaacaggaaaauuagccaaaugggaa

SEQ ID NO: 7884 - RNA, 38 nt, Artificial Sequence
  Synthetic Oligonucleotide; IFNG exon 2; Set B
agaaagcaagcaacaggaaaauuagccaaaugggaaua

SEQ ID NO: 7885 - RNA, 33 nt, Artificial Sequence
  Synthetic Oligonucleotide; IFNG exon 2; Set B
aaagcaagcaacaggaaaauuagccaaauggga

SEQ ID NO: 7886 - RNA, 32 nt, Artificial Sequence
  Synthetic Oligonucleotide; IFNG exon 2; Set B
aaagcaagcaacaggaaaauuagccaaauggg

SEQ ID NO: 7887 - RNA, 38 nt, Artificial Sequence
  Synthetic Oligonucleotide; IFNG exon 2; Set B
cagaaagcaagcaacaggaaaauuagccaaaugggaau

SEQ ID NO: 7888 - RNA, 37 nt, Artificial Sequence
  Synthetic Oligonucleotide; IFNG exon 2; Set B
cagaaagcaagcaacaggaaaauuagccaaaugggaa

SEQ ID NO: 7889 - RNA, 36 nt, Artificial Sequence
  Synthetic Oligonucleotide; IFNG exon 2; Set B
cagaaagcaagcaacaggaaaauuagccaaauggga

SEQ ID NO: 7890 - RNA, 35 nt, Artificial Sequence
  Synthetic Oligonucleotide; IFNG exon 2; Set B
cagaaagcaagcaacaggaaaauuagccaaauggg

SEQ ID NO: 7891 - RNA, 31 nt, Artificial Sequence
  Synthetic Oligonucleotide; IFNG exon 2; Set C
agaaagcaagcaacaggaaaauuagccaaau

SEQ ID NO: 7892 - RNA, 30 nt, Artificial Sequence
  Synthetic Oligonucleotide; IFNG exon 2; Set C
agaaagcaagcaacaggaaaauuagccaaa

SEQ ID NO: 7893 - RNA, 29 nt, Artificial Sequence
  Synthetic Oligonucleotide; IFNG exon 2; Set C
agaaagcaagcaacaggaaaauuagccaa

SEQ ID NO: 7894 - RNA, 21 nt, Artificial Sequence
  Synthetic Oligonucleotide; IFNG exon 2; Set C
aaagcaagcaacaggaaaauu

SEQ ID NO: 7895 - RNA, 20 nt, Artificial Sequence
  Synthetic Oligonucleotide; IFNG exon 2; Set C
aaagcaagcaacaggaaaau

SEQ ID NO: 7896 - RNA, 24 nt, Artificial Sequence
  Synthetic Oligonucleotide; IFNG exon 2; Set C
cagaaagcaagcaacaggaaaauu

SEQ ID NO: 7897 - RNA, 23 nt, Artificial Sequence
  Synthetic Oligonucleotide; IFNG exon 2; Set C
cagaaagcaagcaacaggaaaau

SEQ ID NO: 7898 - RNA, 15 nt, Artificial Sequence
  Synthetic Oligonucleotide; IFNG exon 3; Set C
gaugaugugaauuua

SEQ ID NO: 7899 - RNA, 16 nt, Artificial Sequence
  Synthetic Oligonucleotide; IFNG exon 3; Set C
ggaugaugugaauuua

SEQ ID NO: 7900 - RNA, 15 nt, Artificial Sequence
  Synthetic Oligonucleotide; IFNG exon 3; Set C
ggaugaugugaauuu

SEQ ID NO: 7901 - RNA, 25 nt, Artificial Sequence
  Synthetic Oligonucleotide; IFNG exon 3; Set C
acaaacagaggaugaugugaauuua

SEQ ID NO: 7902 - RNA, 23 nt, Artificial Sequence
  Synthetic Oligonucleotide; IFNG exon 3; Set C
uuuuuaaaaaguuugaaguaaaa

SEQ ID NO: 7903 - RNA, 15 nt, Artificial Sequence
  Synthetic Oligonucleotide; IFNG exon 3; Set C
uuuuuaaaaaguuug

SEQ ID NO: 7904 - RNA, 20 nt, Artificial Sequence
  Synthetic Oligonucleotide; IFNG exon 3; Set C
cguuucuuuuuguugcuauu

SEQ ID NO: 7905 - RNA, 19 nt, Artificial Sequence
  Synthetic Oligonucleotide; IFNG exon 3; Set C
cguuucuuuuuguugcuau

SEQ ID NO: 7906 - RNA, 26 nt, Artificial Sequence
  Synthetic Oligonucleotide; IFNG exon 3; Set C
ucaucucguuucuuuuuguugcuauu

SEQ ID NO: 7907 - RNA, 27 nt, Artificial Sequence
  Synthetic Oligonucleotide; IFNG exon 3; Set A
gucaucucguuucuuuuuguugcuauu

SEQ ID NO: 7908 - RNA, 33 nt, Artificial Sequence
  Synthetic Oligonucleotide; IFNG exon 3; Set A
uucgaagucaucucguuucuuuuuguugcuauu

SEQ ID NO: 7909 - RNA, 34 nt, Artificial Sequence
  Synthetic Oligonucleotide; IFNG exon 3; Set A
uuucgaagucaucucguuucuuuuuguugcuauu

SEQ ID NO: 7910 - RNA, 32 nt, Artificial Sequence
  Synthetic Oligonucleotide; IFNG exon 3; Set A
uucgaagucaucucguuucuuuuuguugcuau

SEQ ID NO: 7911 - RNA, 35 nt, Artificial Sequence
  Synthetic Oligonucleotide; IFNG exon 3; Set A
uuuucgaagucaucucguuucuuuuuguugcuauu

SEQ ID NO: 7912 - RNA, 33 nt, Artificial Sequence
  Synthetic Oligonucleotide; IFNG exon 3; Set A
uuucgaagucaucucguuucuuuuuguugcuau

SEQ ID NO: 7913 - RNA, 39 nt, Artificial Sequence
  Synthetic Oligonucleotide; IFNG exon 3; Set B
aauuagucagcuuuucgaagucaucucguuucuuuuugu

SEQ ID NO: 7914 - RNA, 38 nt, Artificial Sequence
  Synthetic Oligonucleotide; IFNG exon 3; Set B
aauuagucagcuuuucgaagucaucucguuucuuuuug

SEQ ID NO: 7915 - RNA, 40 nt, Artificial Sequence
  Synthetic Oligonucleotide; IFNG exon 3; Set B
uaauuagucagcuuuucgaagucaucucguuucuuuuugu

SEQ ID NO: 7916 - RNA, 39 nt, Artificial Sequence
  Synthetic Oligonucleotide; IFNG exon 3; Set B
uaauuagucagcuuuucgaagucaucucguuucuuuuug

SEQ ID NO: 7917 - RNA, 40 nt, Artificial Sequence
  Synthetic Oligonucleotide; IFNG exon 3; Set B
auaauuagucagcuuuucgaagucaucucguuucuuuuug

SEQ ID NO: 7918 - RNA, 17 nt, Artificial Sequence
  Synthetic Oligonucleotide; IFNG exon 3; Set C
aggaugaugugaauuua

SEQ ID NO: 7919 - RNA, 16 nt, Artificial Sequence
  Synthetic Oligonucleotide; IFNG exon 3; Set C
aggaugaugugaauuu

SEQ ID NO: 7920 - RNA, 18 nt, Artificial Sequence
  Synthetic Oligonucleotide; IFNG exon 3; Set C
gaggaugaugugaauuua

SEQ ID NO: 7921 - RNA, 15 nt, Artificial Sequence
  Synthetic Oligonucleotide; IFNG exon 3; Set C
aggaugaugugaauu

SEQ ID NO: 7922 - RNA, 17 nt, Artificial Sequence
  Synthetic Oligonucleotide; IFNG exon 3; Set C
gaggaugaugugaauuu

SEQ ID NO: 7923 - RNA, 16 nt, Artificial Sequence
  Synthetic Oligonucleotide; IFNG exon 3; Set C
gaggaugaugugaauu

SEQ ID NO: 7924 - RNA, 24 nt, Artificial Sequence
  Synthetic Oligonucleotide; IFNG exon 3; Set C
acaaacagaggaugaugugaauuu

SEQ ID NO: 7925 - RNA, 26 nt, Artificial Sequence
  Synthetic Oligonucleotide; IFNG exon 3; Set C
cacaaacagaggaugaugugaauuua

SEQ ID NO: 7926 - RNA, 23 nt, Artificial Sequence
  Synthetic Oligonucleotide; IFNG exon 3; Set C
acaaacagaggaugaugugaauu

SEQ ID NO: 7927 - RNA, 27 nt, Artificial Sequence
  Synthetic Oligonucleotide; IFNG exon 3; Set C
gcacaaacagaggaugaugugaauuua

SEQ ID NO: 7928 - RNA, 25 nt, Artificial Sequence
  Synthetic Oligonucleotide; IFNG exon 3; Set C
cacaaacagaggaugaugugaauuu

SEQ ID NO: 7929 - RNA, 28 nt, Artificial Sequence
  Synthetic Oligonucleotide; IFNG exon 3; Set A
agcacaaacagaggaugaugugaauuua

SEQ ID NO: 7930 - RNA, 26 nt, Artificial Sequence
  Synthetic Oligonucleotide; IFNG exon 3; Set C
gcacaaacagaggaugaugugaauuu

SEQ ID NO: 7931 - RNA, 24 nt, Artificial Sequence
  Synthetic Oligonucleotide; IFNG exon 3; Set C
cacaaacagaggaugaugugaauu

SEQ ID NO: 7932 - RNA, 22 nt, Artificial Sequence
  Synthetic Oligonucleotide; IFNG exon 3; Set C
acaaacagaggaugaugugaau

SEQ ID NO: 7933 - RNA, 27 nt, Artificial Sequence
  Synthetic Oligonucleotide; IFNG exon 3; Set C
agcacaaacagaggaugaugugaauuu

SEQ ID NO: 7934 - RNA, 25 nt, Artificial Sequence
  Synthetic Oligonucleotide; IFNG exon 3; Set C
gcacaaacagaggaugaugugaauu

SEQ ID NO: 7935 - RNA, 29 nt, Artificial Sequence
  Synthetic Oligonucleotide; IFNG exon 3; Set A
gagcacaaacagaggaugaugugaauuua

SEQ ID NO: 7936 - RNA, 26 nt, Artificial Sequence
  Synthetic Oligonucleotide; IFNG exon 3; Set C
agcacaaacagaggaugaugugaauu

SEQ ID NO: 7937 - RNA, 30 nt, Artificial Sequence
  Synthetic Oligonucleotide; IFNG exon 3; Set A
agagcacaaacagaggaugaugugaauuua

SEQ ID NO: 7938 - RNA, 31 nt, Artificial Sequence
  Synthetic Oligonucleotide; IFNG exon 3; Set A
aagagcacaaacagaggaugaugugaauuua

SEQ ID NO: 7939 - RNA, 29 nt, Artificial Sequence
  Synthetic Oligonucleotide; IFNG exon 3; Set A
agagcacaaacagaggaugaugugaauuu

SEQ ID NO: 7940 - RNA, 30 nt, Artificial Sequence
  Synthetic Oligonucleotide; IFNG exon 3; Set A
aagagcacaaacagaggaugaugugaauuu

SEQ ID NO: 7941 - RNA, 28 nt, Artificial Sequence
  Synthetic Oligonucleotide; IFNG exon 3; Set A
agagcacaaacagaggaugaugugaauu

SEQ ID NO: 7942 - RNA, 29 nt, Artificial Sequence
  Synthetic Oligonucleotide; IFNG exon 3; Set A
aagagcacaaacagaggaugaugugaauu

SEQ ID NO: 7943 - RNA, 38 nt, Artificial Sequence
  Synthetic Oligonucleotide; IFNG exon 3; Set A
ggaaggaaagagcacaaacagaggaugaugugaauuua

SEQ ID NO: 7944 - RNA, 39 nt, Artificial Sequence
  Synthetic Oligonucleotide; IFNG exon 3; Set A
uggaaggaaagagcacaaacagaggaugaugugaauuua

SEQ ID NO: 7945 - RNA, 37 nt, Artificial Sequence
  Synthetic Oligonucleotide; IFNG exon 3; Set A
ggaaggaaagagcacaaacagaggaugaugugaauuu

SEQ ID NO: 7946 - RNA, 38 nt, Artificial Sequence
  Synthetic Oligonucleotide; IFNG exon 3; Set A
uggaaggaaagagcacaaacagaggaugaugugaauuu

SEQ ID NO: 7947 - RNA, 36 nt, Artificial Sequence
  Synthetic Oligonucleotide; IFNG exon 3; Set A
ggaaggaaagagcacaaacagaggaugaugugaauu

SEQ ID NO: 7948 - RNA, 37 nt, Artificial Sequence
  Synthetic Oligonucleotide; IFNG exon 3; Set A
uggaaggaaagagcacaaacagaggaugaugugaauu

SEQ ID NO: 7949 - RNA, 15 nt, Artificial Sequence
  Synthetic Oligonucleotide; IFNG exon 3; Set C
agcacaaacagagga

SEQ ID NO: 7950 - RNA, 25 nt, Artificial Sequence
  Synthetic Oligonucleotide; IFNG exon 3; Set A
ggaaggaaagagcacaaacagagga

SEQ ID NO: 7951 - RNA, 26 nt, Artificial Sequence
  Synthetic Oligonucleotide; IFNG exon 3; Set A
uggaaggaaagagcacaaacagagga

SEQ ID NO: 7952 - RNA, 17 nt, Artificial Sequence
  Synthetic Oligonucleotide; IFNG exon 3; Set C
uggaaggaaagagcaca

SEQ ID NO: 7953 - RNA, 20 nt, Artificial Sequence
  Synthetic Oligonucleotide; IFNG exon 3; Set C
auuuggcucugcauuauuuu

SEQ ID NO: 7954 - RNA, 38 nt, Artificial Sequence
  Synthetic Oligonucleotide; IFNG exon 3; Set A
uugaaguaaaaggagacaauuuggcucugcauuauuuu

SEQ ID NO: 7955 - RNA, 39 nt, Artificial Sequence
  Synthetic Oligonucleotide; IFNG exon 3; Set A
uuugaaguaaaaggagacaauuuggcucugcauuauuuu

SEQ ID NO: 7956 - RNA, 37 nt, Artificial Sequence
  Synthetic Oligonucleotide; IFNG exon 3; Set A
uugaaguaaaaggagacaauuuggcucugcauuauuu

SEQ ID NO: 7957 - RNA, 40 nt, Artificial Sequence
  Synthetic Oligonucleotide; IFNG exon 3; Set A
guuugaaguaaaaggagacaauuuggcucugcauuauuuu

SEQ ID NO: 7958 - RNA, 38 nt, Artificial Sequence
  Synthetic Oligonucleotide; IFNG exon 3; Set A
uuugaaguaaaaggagacaauuuggcucugcauuauuu

SEQ ID NO: 7959 - RNA, 36 nt, Artificial Sequence
  Synthetic Oligonucleotide; IFNG exon 3; Set A
uugaaguaaaaggagacaauuuggcucugcauuauu

SEQ ID NO: 7960 - RNA, 39 nt, Artificial Sequence
  Synthetic Oligonucleotide; IFNG exon 3; Set A
guuugaaguaaaaggagacaauuuggcucugcauuauuu

SEQ ID NO: 7961 - RNA, 37 nt, Artificial Sequence
  Synthetic Oligonucleotide; IFNG exon 3; Set A
uuugaaguaaaaggagacaauuuggcucugcauuauu

SEQ ID NO: 7962 - RNA, 38 nt, Artificial Sequence
  Synthetic Oligonucleotide; IFNG exon 3; Set A
guuugaaguaaaaggagacaauuuggcucugcauuauu

SEQ ID NO: 7963 - RNA, 36 nt, Artificial Sequence
  Synthetic Oligonucleotide; IFNG exon 3; Set A
uuugaaguaaaaggagacaauuuggcucugcauuau

SEQ ID NO: 7964 - RNA, 40 nt, Artificial Sequence
  Synthetic Oligonucleotide; IFNG exon 3; Set A
aguuugaaguaaaaggagacaauuuggcucugcauuauuu

SEQ ID NO: 7965 - RNA, 37 nt, Artificial Sequence
  Synthetic Oligonucleotide; IFNG exon 3; Set A
guuugaaguaaaaggagacaauuuggcucugcauuau

SEQ ID NO: 7966 - RNA, 35 nt, Artificial Sequence
  Synthetic Oligonucleotide; IFNG exon 3; Set A
uuugaaguaaaaggagacaauuuggcucugcauua

SEQ ID NO: 7967 - RNA, 39 nt, Artificial Sequence
  Synthetic Oligonucleotide; IFNG exon 3; Set A
aguuugaaguaaaaggagacaauuuggcucugcauuauu

SEQ ID NO: 7968 - RNA, 36 nt, Artificial Sequence
  Synthetic Oligonucleotide; IFNG exon 3; Set A
guuugaaguaaaaggagacaauuuggcucugcauua

SEQ ID NO: 7969 - RNA, 38 nt, Artificial Sequence
  Synthetic Oligonucleotide; IFNG exon 3; Set A
aguuugaaguaaaaggagacaauuuggcucugcauuau

SEQ ID NO: 7970 - RNA, 34 nt, Artificial Sequence
  Synthetic Oligonucleotide; IFNG exon 3; Set A
uuugaaguaaaaggagacaauuuggcucugcauu

SEQ ID NO: 7971 - RNA, 37 nt, Artificial Sequence
  Synthetic Oligonucleotide; IFNG exon 3; Set A
aguuugaaguaaaaggagacaauuuggcucugcauua

SEQ ID NO: 7972 - RNA, 35 nt, Artificial Sequence
  Synthetic Oligonucleotide; IFNG exon 3; Set A
guuugaaguaaaaggagacaauuuggcucugcauu

SEQ ID NO: 7973 - RNA, 23 nt, Artificial Sequence
  Synthetic Oligonucleotide; IFNG exon 3; Set C
uugaaguaaaaggagacaauuug

SEQ ID NO: 7974 - RNA, 22 nt, Artificial Sequence
  Synthetic Oligonucleotide; IFNG exon 3; Set C
uugaaguaaaaggagacaauuu

SEQ ID NO: 7975 - RNA, 24 nt, Artificial Sequence
  Synthetic Oligonucleotide; IFNG exon 3; Set C
uuugaaguaaaaggagacaauuug

SEQ ID NO: 7976 - RNA, 23 nt, Artificial Sequence
  Synthetic Oligonucleotide; IFNG exon 3; Set C
uuugaaguaaaaggagacaauuu

SEQ ID NO: 7977 - RNA, 21 nt, Artificial Sequence
  Synthetic Oligonucleotide; IFNG exon 3; Set C
uugaaguaaaaggagacaauu

SEQ ID NO: 7978 - RNA, 25 nt, Artificial Sequence
  Synthetic Oligonucleotide; IFNG exon 3; Set C
guuugaaguaaaaggagacaauuug

SEQ ID NO: 7979 - RNA, 24 nt, Artificial Sequence
  Synthetic Oligonucleotide; IFNG exon 3; Set C
guuugaaguaaaaggagacaauuu

SEQ ID NO: 7980 - RNA, 22 nt, Artificial Sequence
  Synthetic Oligonucleotide; IFNG exon 3; Set C
uuugaaguaaaaggagacaauu

SEQ ID NO: 7981 - RNA, 26 nt, Artificial Sequence
  Synthetic Oligonucleotide; IFNG exon 3; Set C
aguuugaaguaaaaggagacaauuug

SEQ ID NO: 7982 - RNA, 25 nt, Artificial Sequence
  Synthetic Oligonucleotide; IFNG exon 3; Set C
aguuugaaguaaaaggagacaauuu

SEQ ID NO: 7983 - RNA, 23 nt, Artificial Sequence
  Synthetic Oligonucleotide; IFNG exon 3; Set C
guuugaaguaaaaggagacaauu

SEQ ID NO: 7984 - RNA, 27 nt, Artificial Sequence
  Synthetic Oligonucleotide; IFNG exon 3; Set C
aaguuugaaguaaaaggagacaauuug

SEQ ID NO: 7985 - RNA, 26 nt, Artificial Sequence
  Synthetic Oligonucleotide; IFNG exon 3; Set C
aaguuugaaguaaaaggagacaauuu

SEQ ID NO: 7986 - RNA, 24 nt, Artificial Sequence
  Synthetic Oligonucleotide; IFNG exon 3; Set C
aguuugaaguaaaaggagacaauu

SEQ ID NO: 7987 - RNA, 25 nt, Artificial Sequence
  Synthetic Oligonucleotide; IFNG exon 3; Set C
aaguuugaaguaaaaggagacaauu

SEQ ID NO: 7988 - RNA, 31 nt, Artificial Sequence
  Synthetic Oligonucleotide; IFNG exon 3; Set C
uaaaaaguuugaaguaaaaggagacaauuug

SEQ ID NO: 7989 - RNA, 30 nt, Artificial Sequence
  Synthetic Oligonucleotide; IFNG exon 3; Set C
uaaaaaguuugaaguaaaaggagacaauuu

SEQ ID NO: 7990 - RNA, 32 nt, Artificial Sequence
  Synthetic Oligonucleotide; IFNG exon 3; Set C
uuaaaaaguuugaaguaaaaggagacaauuug

SEQ ID NO: 7991 - RNA, 31 nt, Artificial Sequence
  Synthetic Oligonucleotide; IFNG exon 3; Set C
uuaaaaaguuugaaguaaaaggagacaauuu

SEQ ID NO: 7992 - RNA, 29 nt, Artificial Sequence
  Synthetic Oligonucleotide; IFNG exon 3; Set C
uaaaaaguuugaaguaaaaggagacaauu

SEQ ID NO: 7993 - RNA, 33 nt, Artificial Sequence
  Synthetic Oligonucleotide; IFNG exon 3; Set C
uuuaaaaaguuugaaguaaaaggagacaauuug

SEQ ID NO: 7994 - RNA, 32 nt, Artificial Sequence
  Synthetic Oligonucleotide; IFNG exon 3; Set C
uuuaaaaaguuugaaguaaaaggagacaauuu

SEQ ID NO: 7995 - RNA, 30 nt, Artificial Sequence
  Synthetic Oligonucleotide; IFNG exon 3; Set C
uuaaaaaguuugaaguaaaaggagacaauu

SEQ ID NO: 7996 - RNA, 34 nt, Artificial Sequence
  Synthetic Oligonucleotide; IFNG exon 3; Set C
uuuuaaaaaguuugaaguaaaaggagacaauuug

SEQ ID NO: 7997 - RNA, 33 nt, Artificial Sequence
  Synthetic Oligonucleotide; IFNG exon 3; Set C
uuuuaaaaaguuugaaguaaaaggagacaauuu

SEQ ID NO: 7998 - RNA, 31 nt, Artificial Sequence
  Synthetic Oligonucleotide; IFNG exon 3; Set C
uuuaaaaaguuugaaguaaaaggagacaauu

SEQ ID NO: 7999 - RNA, 35 nt, Artificial Sequence
  Synthetic Oligonucleotide; IFNG exon 3; Set C
uuuuuaaaaaguuugaaguaaaaggagacaauuug

SEQ ID NO: 8000 - RNA, 15 nt, Artificial Sequence
  Synthetic Oligonucleotide; IFNG exon 3; Set C
guuugaaguaaaagg

SEQ ID NO: 8001 - RNA, 34 nt, Artificial Sequence
  Synthetic Oligonucleotide; IFNG exon 3; Set C
uuuuuaaaaaguuugaaguaaaaggagacaauuu

SEQ ID NO: 8002 - RNA, 32 nt, Artificial Sequence
  Synthetic Oligonucleotide; IFNG exon 3; Set C
uuuuaaaaaguuugaaguaaaaggagacaauu

SEQ ID NO: 8003 - RNA, 16 nt, Artificial Sequence
  Synthetic Oligonucleotide; IFNG exon 3; Set C
aguuugaaguaaaagg

SEQ ID NO: 8004 - RNA, 33 nt, Artificial Sequence
  Synthetic Oligonucleotide; IFNG exon 3; Set C
uuuuuaaaaaguuugaaguaaaaggagacaauu

SEQ ID NO: 8005 - RNA, 15 nt, Artificial Sequence
  Synthetic Oligonucleotide; IFNG exon 3; Set C
aguuugaaguaaaag

SEQ ID NO: 8006 - RNA, 15 nt, Artificial Sequence
  Synthetic Oligonucleotide; IFNG exon 3; Set C
aaguuugaaguaaaa

SEQ ID NO: 8007 - RNA, 16 nt, Artificial Sequence
  Synthetic Oligonucleotide; IFNG exon 3; Set C
aaaguuugaaguaaaa

SEQ ID NO: 8008 - RNA, 17 nt, Artificial Sequence
  Synthetic Oligonucleotide; IFNG exon 3; Set C
aaaaguuugaaguaaaa

SEQ ID NO: 8009 - RNA, 18 nt, Artificial Sequence
  Synthetic Oligonucleotide; IFNG exon 3; Set C
aaaaaguuugaaguaaaa

SEQ ID NO: 8010 - RNA, 20 nt, Artificial Sequence
  Synthetic Oligonucleotide; IFNG exon 3; Set C
uaaaaaguuugaaguaaaag

SEQ ID NO: 8011 - RNA, 19 nt, Artificial Sequence
  Synthetic Oligonucleotide; IFNG exon 3; Set C
uaaaaaguuugaaguaaaa

SEQ ID NO: 8012 - RNA, 21 nt, Artificial Sequence
  Synthetic Oligonucleotide; IFNG exon 3; Set C
uuaaaaaguuugaaguaaaag

SEQ ID NO: 8013 - RNA, 20 nt, Artificial Sequence
  Synthetic Oligonucleotide; IFNG exon 3; Set C
uuaaaaaguuugaaguaaaa

SEQ ID NO: 8014 - RNA, 18 nt, Artificial Sequence
  Synthetic Oligonucleotide; IFNG exon 3; Set C
uaaaaaguuugaaguaaa

SEQ ID NO: 8015 - RNA, 22 nt, Artificial Sequence
  Synthetic Oligonucleotide; IFNG exon 3; Set C
uuuaaaaaguuugaaguaaaag

SEQ ID NO: 8016 - RNA, 24 nt, Artificial Sequence
  Synthetic Oligonucleotide; IFNG exon 3; Set C
uuuuaaaaaguuugaaguaaaagg

SEQ ID NO: 8017 - RNA, 21 nt, Artificial Sequence
  Synthetic Oligonucleotide; IFNG exon 3; Set C
uuuaaaaaguuugaaguaaaa

SEQ ID NO: 8018 - RNA, 17 nt, Artificial Sequence
  Synthetic Oligonucleotide; IFNG exon 3; Set C
uaaaaaguuugaaguaa

SEQ ID NO: 8019 - RNA, 19 nt, Artificial Sequence
  Synthetic Oligonucleotide; IFNG exon 3; Set C
uuaaaaaguuugaaguaaa

SEQ ID NO: 8020 - RNA, 23 nt, Artificial Sequence
  Synthetic Oligonucleotide; IFNG exon 3; Set C
uuuuaaaaaguuugaaguaaaag

SEQ ID NO: 8021 - RNA, 25 nt, Artificial Sequence
  Synthetic Oligonucleotide; IFNG exon 3; Set C
uuuuuaaaaaguuugaaguaaaagg

SEQ ID NO: 8022 - RNA, 22 nt, Artificial Sequence
  Synthetic Oligonucleotide; IFNG exon 3; Set C
uuuuaaaaaguuugaaguaaaa

SEQ ID NO: 8023 - RNA, 18 nt, Artificial Sequence
  Synthetic Oligonucleotide; IFNG exon 3; Set C
uuaaaaaguuugaaguaa

SEQ ID NO: 8024 - RNA, 20 nt, Artificial Sequence
  Synthetic Oligonucleotide; IFNG exon 3; Set C
uuuaaaaaguuugaaguaaa

SEQ ID NO: 8025 - RNA, 16 nt, Artificial Sequence
  Synthetic Oligonucleotide; IFNG exon 3; Set C
uaaaaaguuugaagua

SEQ ID NO: 8026 - RNA, 24 nt, Artificial Sequence
  Synthetic Oligonucleotide; IFNG exon 3; Set C
uuuuuaaaaaguuugaaguaaaag

SEQ ID NO: 8027 - RNA, 19 nt, Artificial Sequence
  Synthetic Oligonucleotide; IFNG exon 3; Set C
uuuaaaaaguuugaaguaa

SEQ ID NO: 8028 - RNA, 21 nt, Artificial Sequence
  Synthetic Oligonucleotide; IFNG exon 3; Set C
uuuuaaaaaguuugaaguaaa

SEQ ID NO: 8029 - RNA, 17 nt, Artificial Sequence
  Synthetic Oligonucleotide; IFNG exon 3; Set C
uuaaaaaguuugaagua

SEQ ID NO: 8030 - RNA, 20 nt, Artificial Sequence
  Synthetic Oligonucleotide; IFNG exon 3; Set C
uuuuaaaaaguuugaaguaa

SEQ ID NO: 8031 - RNA, 22 nt, Artificial Sequence
  Synthetic Oligonucleotide; IFNG exon 3; Set C
uuuuuaaaaaguuugaaguaaa

SEQ ID NO: 8032 - RNA, 18 nt, Artificial Sequence
  Synthetic Oligonucleotide; IFNG exon 3; Set C
uuuaaaaaguuugaagua

SEQ ID NO: 8033 - RNA, 21 nt, Artificial Sequence
  Synthetic Oligonucleotide; IFNG exon 3; Set C
uuuuuaaaaaguuugaaguaa

SEQ ID NO: 8034 - RNA, 19 nt, Artificial Sequence
  Synthetic Oligonucleotide; IFNG exon 3; Set C
uuuuaaaaaguuugaagua

SEQ ID NO: 8035 - RNA, 20 nt, Artificial Sequence
  Synthetic Oligonucleotide; IFNG exon 3; Set C
uuuuuaaaaaguuugaagua

SEQ ID NO: 8036 - RNA, 18 nt, Artificial Sequence
  Synthetic Oligonucleotide; IFNG exon 3; Set C
uuuuaaaaaguuugaagu

SEQ ID NO: 8037 - RNA, 19 nt, Artificial Sequence
  Synthetic Oligonucleotide; IFNG exon 3; Set C
uuuuuaaaaaguuugaagu

SEQ ID NO: 8038 - RNA, 15 nt, Artificial Sequence
  Synthetic Oligonucleotide; IFNG exon 3; Set C
uuuuaaaaaguuuga

SEQ ID NO: 8039 - RNA, 16 nt, Artificial Sequence
  Synthetic Oligonucleotide; IFNG exon 3; Set C
uuuuuaaaaaguuuga

SEQ ID NO: 8040 - RNA, 25 nt, Artificial Sequence
  Synthetic Oligonucleotide; IFNG exon 3; Set C
uguugcuauugaaaaacuugacauu

SEQ ID NO: 8041 - RNA, 26 nt, Artificial Sequence
  Synthetic Oligonucleotide; IFNG exon 3; Set C
uuguugcuauugaaaaacuugacauu

SEQ ID NO: 8042 - RNA, 27 nt, Artificial Sequence
  Synthetic Oligonucleotide; IFNG exon 3; Set C
uuuguugcuauugaaaaacuugacauu

SEQ ID NO: 8043 - RNA, 25 nt, Artificial Sequence
  Synthetic Oligonucleotide; IFNG exon 3; Set C
uuguugcuauugaaaaacuugacau

SEQ ID NO: 8044 - RNA, 28 nt, Artificial Sequence
  Synthetic Oligonucleotide; IFNG exon 3; Set C
uuuuguugcuauugaaaaacuugacauu

SEQ ID NO: 8045 - RNA, 27 nt, Artificial Sequence
  Synthetic Oligonucleotide; IFNG exon 3; Set C
uuuuguugcuauugaaaaacuugacau

SEQ ID NO: 8046 - RNA, 15 nt, Artificial Sequence
  Synthetic Oligonucleotide; IFNG exon 3; Set C
uuuuuguugcuauug

SEQ ID NO: 8047 - RNA, 15 nt, Artificial Sequence
  Synthetic Oligonucleotide; IFNG exon 3; Set C
cuuuuuguugcuauu

SEQ ID NO: 8048 - RNA, 16 nt, Artificial Sequence
  Synthetic Oligonucleotide; IFNG exon 3; Set C
ucuuuuuguugcuauu

SEQ ID NO: 8049 - RNA, 15 nt, Artificial Sequence
  Synthetic Oligonucleotide; IFNG exon 3; Set C
ucuuuuuguugcuau

SEQ ID NO: 8050 - RNA, 19 nt, Artificial Sequence
  Synthetic Oligonucleotide; IFNG exon 3; Set C
uuucuuuuuguugcuauug

SEQ ID NO: 8051 - RNA, 18 nt, Artificial Sequence
  Synthetic Oligonucleotide; IFNG exon 3; Set C
uuucuuuuuguugcuauu

SEQ ID NO: 8052 - RNA, 20 nt, Artificial Sequence
  Synthetic Oligonucleotide; IFNG exon 3; Set C
guuucuuuuuguugcuauug

SEQ ID NO: 8053 - RNA, 19 nt, Artificial Sequence
  Synthetic Oligonucleotide; IFNG exon 3; Set C
guuucuuuuuguugcuauu

SEQ ID NO: 8054 - RNA, 17 nt, Artificial Sequence
  Synthetic Oligonucleotide; IFNG exon 3; Set C
uuucuuuuuguugcuau

SEQ ID NO: 8055 - RNA, 21 nt, Artificial Sequence
  Synthetic Oligonucleotide; IFNG exon 3; Set C
cguuucuuuuuguugcuauug

SEQ ID NO: 8056 - RNA, 18 nt, Artificial Sequence
  Synthetic Oligonucleotide; IFNG exon 3; Set C
guuucuuuuuguugcuau

SEQ ID NO: 8057 - RNA, 18 nt, Artificial Sequence
  Synthetic Oligonucleotide; IFNG exon 3; Set C
cguuucuuuuuguugcua

SEQ ID NO: 8058 - RNA, 17 nt, Artificial Sequence
  Synthetic Oligonucleotide; IFNG exon 3; Set C
cguuucuuuuuguugcu

SEQ ID NO: 8059 - RNA, 16 nt, Artificial Sequence
  Synthetic Oligonucleotide; IFNG exon 3; Set C
cguuucuuuuuguugc

SEQ ID NO: 8060 - RNA, 27 nt, Artificial Sequence
  Synthetic Oligonucleotide; IFNG exon 3; Set C
ucaucucguuucuuuuuguugcuauug

SEQ ID NO: 8061 - RNA, 15 nt, Artificial Sequence
  Synthetic Oligonucleotide; IFNG exon 3; Set C
cguuucuuuuuguug

SEQ ID NO: 8062 - RNA, 28 nt, Artificial Sequence
  Synthetic Oligonucleotide; IFNG exon 3; Set A
gucaucucguuucuuuuuguugcuauug

SEQ ID NO: 8063 - RNA, 25 nt, Artificial Sequence
  Synthetic Oligonucleotide; IFNG exon 3; Set C
ucaucucguuucuuuuuguugcuau

SEQ ID NO: 8064 - RNA, 26 nt, Artificial Sequence
  Synthetic Oligonucleotide; IFNG exon 3; Set A
gucaucucguuucuuuuuguugcuau

SEQ ID NO: 8065 - RNA, 24 nt, Artificial Sequence
  Synthetic Oligonucleotide; IFNG exon 3; Set C
ucaucucguuucuuuuuguugcua

SEQ ID NO: 8066 - RNA, 25 nt, Artificial Sequence
  Synthetic Oligonucleotide; IFNG exon 3; Set A
gucaucucguuucuuuuuguugcua

SEQ ID NO: 8067 - RNA, 32 nt, Artificial Sequence
  Synthetic Oligonucleotide; IFNG exon 3; Set A
ucgaagucaucucguuucuuuuuguugcuauu

SEQ ID NO: 8068 - RNA, 20 nt, Artificial Sequence
  Synthetic Oligonucleotide; IFNG exon 3; Set C
ucaucucguuucuuuuuguu

SEQ ID NO: 8069 - RNA, 34 nt, Artificial Sequence
  Synthetic Oligonucleotide; IFNG exon 3; Set A
uucgaagucaucucguuucuuuuuguugcuauug

SEQ ID NO: 8070 - RNA, 19 nt, Artificial Sequence
  Synthetic Oligonucleotide; IFNG exon 3; Set C
ucaucucguuucuuuuugu

SEQ ID NO: 8071 - RNA, 31 nt, Artificial Sequence
  Synthetic Oligonucleotide; IFNG exon 3; Set A
ucgaagucaucucguuucuuuuuguugcuau

SEQ ID NO: 8072 - RNA, 21 nt, Artificial Sequence
  Synthetic Oligonucleotide; IFNG exon 3; Set C
gucaucucguuucuuuuuguu

SEQ ID NO: 8073 - RNA, 35 nt, Artificial Sequence
  Synthetic Oligonucleotide; IFNG exon 3; Set A
uuucgaagucaucucguuucuuuuuguugcuauug

SEQ ID NO: 8074 - RNA, 18 nt, Artificial Sequence
  Synthetic Oligonucleotide; IFNG exon 3; Set C
ucaucucguuucuuuuug

SEQ ID NO: 8075 - RNA, 20 nt, Artificial Sequence
  Synthetic Oligonucleotide; IFNG exon 3; Set C
gucaucucguuucuuuuugu

SEQ ID NO: 8076 - RNA, 36 nt, Artificial Sequence
  Synthetic Oligonucleotide; IFNG exon 3; Set A
uuuucgaagucaucucguuucuuuuuguugcuauug

SEQ ID NO: 8077 - RNA, 19 nt, Artificial Sequence
  Synthetic Oligonucleotide; IFNG exon 3; Set C
gucaucucguuucuuuuug

SEQ ID NO: 8078 - RNA, 17 nt, Artificial Sequence
  Synthetic Oligonucleotide; IFNG exon 3; Set C
ucaucucguuucuuuuu

SEQ ID NO: 8079 - RNA, 31 nt, Artificial Sequence
  Synthetic Oligonucleotide; IFNG exon 3; Set A
uucgaagucaucucguuucuuuuuguugcua

SEQ ID NO: 8080 - RNA, 34 nt, Artificial Sequence
  Synthetic Oligonucleotide; IFNG exon 3; Set A
uuuucgaagucaucucguuucuuuuuguugcuau

SEQ ID NO: 8081 - RNA, 18 nt, Artificial Sequence
  Synthetic Oligonucleotide; IFNG exon 3; Set C
gucaucucguuucuuuuu

SEQ ID NO: 8082 - RNA, 16 nt, Artificial Sequence
  Synthetic Oligonucleotide; IFNG exon 3; Set C
ucaucucguuucuuuu

SEQ ID NO: 8083 - RNA, 32 nt, Artificial Sequence
  Synthetic Oligonucleotide; IFNG exon 3; Set A
uuucgaagucaucucguuucuuuuuguugcua

SEQ ID NO: 8084 - RNA, 17 nt, Artificial Sequence
  Synthetic Oligonucleotide; IFNG exon 3; Set C
gucaucucguuucuuuu

SEQ ID NO: 8085 - RNA, 15 nt, Artificial Sequence
  Synthetic Oligonucleotide; IFNG exon 3; Set C
ucaucucguuucuuu

SEQ ID NO: 8086 - RNA, 33 nt, Artificial Sequence
  Synthetic Oligonucleotide; IFNG exon 3; Set A
uuuucgaagucaucucguuucuuuuuguugcua

SEQ ID NO: 8087 - RNA, 16 nt, Artificial Sequence
  Synthetic Oligonucleotide; IFNG exon 3; Set C
gucaucucguuucuuu

SEQ ID NO: 8088 - RNA, 28 nt, Artificial Sequence
  Synthetic Oligonucleotide; IFNG exon 3; Set C
uucgaagucaucucguuucuuuuuguug

SEQ ID NO: 8089 - RNA, 25 nt, Artificial Sequence
  Synthetic Oligonucleotide; IFNG exon 3; Set C
ucgaagucaucucguuucuuuuugu

SEQ ID NO: 8090 - RNA, 27 nt, Artificial Sequence
  Synthetic Oligonucleotide; IFNG exon 3; Set C
uucgaagucaucucguuucuuuuuguu

SEQ ID NO: 8091 - RNA, 29 nt, Artificial Sequence
  Synthetic Oligonucleotide; IFNG exon 3; Set C
uuucgaagucaucucguuucuuuuuguug

SEQ ID NO: 8092 - RNA, 24 nt, Artificial Sequence
  Synthetic Oligonucleotide; IFNG exon 3; Set C
ucgaagucaucucguuucuuuuug

SEQ ID NO: 8093 - RNA, 26 nt, Artificial Sequence
  Synthetic Oligonucleotide; IFNG exon 3; Set C
uucgaagucaucucguuucuuuuugu

SEQ ID NO: 8094 - RNA, 28 nt, Artificial Sequence
  Synthetic Oligonucleotide; IFNG exon 3; Set C
uuucgaagucaucucguuucuuuuuguu

SEQ ID NO: 8095 - RNA, 30 nt, Artificial Sequence
  Synthetic Oligonucleotide; IFNG exon 3; Set A
uuuucgaagucaucucguuucuuuuuguug

SEQ ID NO: 8096 - RNA, 25 nt, Artificial Sequence
  Synthetic Oligonucleotide; IFNG exon 3; Set C
uucgaagucaucucguuucuuuuug

SEQ ID NO: 8097 - RNA, 27 nt, Artificial Sequence
  Synthetic Oligonucleotide; IFNG exon 3; Set C
uuucgaagucaucucguuucuuuuugu

SEQ ID NO: 8098 - RNA, 29 nt, Artificial Sequence
  Synthetic Oligonucleotide; IFNG exon 3; Set C
uuuucgaagucaucucguuucuuuuuguu

SEQ ID NO: 8099 - RNA, 26 nt, Artificial Sequence
  Synthetic Oligonucleotide; IFNG exon 3; Set C
uuucgaagucaucucguuucuuuuug

SEQ ID NO: 8100 - RNA, 28 nt, Artificial Sequence
  Synthetic Oligonucleotide; IFNG exon 3; Set C
uuuucgaagucaucucguuucuuuuugu

SEQ ID NO: 8101 - RNA, 24 nt, Artificial Sequence
  Synthetic Oligonucleotide; IFNG exon 3; Set C
uucgaagucaucucguuucuuuuu

SEQ ID NO: 8102 - RNA, 27 nt, Artificial Sequence
  Synthetic Oligonucleotide; IFNG exon 3; Set C
uuuucgaagucaucucguuucuuuuug

SEQ ID NO: 8103 - RNA, 25 nt, Artificial Sequence
  Synthetic Oligonucleotide; IFNG exon 3; Set C
uuucgaagucaucucguuucuuuuu

SEQ ID NO: 8104 - RNA, 23 nt, Artificial Sequence
  Synthetic Oligonucleotide; IFNG exon 3; Set C
uucgaagucaucucguuucuuuu

SEQ ID NO: 8105 - RNA, 26 nt, Artificial Sequence
  Synthetic Oligonucleotide; IFNG exon 3; Set C
uuuucgaagucaucucguuucuuuuu

SEQ ID NO: 8106 - RNA, 24 nt, Artificial Sequence
  Synthetic Oligonucleotide; IFNG exon 3; Set C
uuucgaagucaucucguuucuuuu

SEQ ID NO: 8107 - RNA, 22 nt, Artificial Sequence
  Synthetic Oligonucleotide; IFNG exon 3; Set C
uucgaagucaucucguuucuuu

SEQ ID NO: 8108 - RNA, 25 nt, Artificial Sequence
  Synthetic Oligonucleotide; IFNG exon 3; Set C
uuuucgaagucaucucguuucuuuu

SEQ ID NO: 8109 - RNA, 23 nt, Artificial Sequence
  Synthetic Oligonucleotide; IFNG exon 3; Set C
uuucgaagucaucucguuucuuu

SEQ ID NO: 8110 - RNA, 24 nt, Artificial Sequence
  Synthetic Oligonucleotide; IFNG exon 3; Set C
uuuucgaagucaucucguuucuuu

SEQ ID NO: 8111 - RNA, 37 nt, Artificial Sequence
  Synthetic Oligonucleotide; IFNG exon 3; Set B
uagucagcuuuucgaagucaucucguuucuuuuuguu

SEQ ID NO: 8112 - RNA, 17 nt, Artificial Sequence
  Synthetic Oligonucleotide; IFNG exon 3; Set C
uucgaagucaucucguu

SEQ ID NO: 8113 - RNA, 36 nt, Artificial Sequence
  Synthetic Oligonucleotide; IFNG exon 3; Set B
uagucagcuuuucgaagucaucucguuucuuuuugu

SEQ ID NO: 8114 - RNA, 38 nt, Artificial Sequence
  Synthetic Oligonucleotide; IFNG exon 3; Set B
uuagucagcuuuucgaagucaucucguuucuuuuuguu

SEQ ID NO: 8115 - RNA, 16 nt, Artificial Sequence
  Synthetic Oligonucleotide; IFNG exon 3; Set C
uucgaagucaucucgu

SEQ ID NO: 8116 - RNA, 18 nt, Artificial Sequence
  Synthetic Oligonucleotide; IFNG exon 3; Set C
uuucgaagucaucucguu

SEQ ID NO: 8117 - RNA, 40 nt, Artificial Sequence
  Synthetic Oligonucleotide; IFNG exon 3; Set A
auuagucagcuuuucgaagucaucucguuucuuuuuguug

SEQ ID NO: 8118 - RNA, 35 nt, Artificial Sequence
  Synthetic Oligonucleotide; IFNG exon 3; Set B
uagucagcuuuucgaagucaucucguuucuuuuug

SEQ ID NO: 8119 - RNA, 37 nt, Artificial Sequence
  Synthetic Oligonucleotide; IFNG exon 3; Set B
uuagucagcuuuucgaagucaucucguuucuuuuugu

SEQ ID NO: 8120 - RNA, 39 nt, Artificial Sequence
  Synthetic Oligonucleotide; IFNG exon 3; Set B
auuagucagcuuuucgaagucaucucguuucuuuuuguu

SEQ ID NO: 8121 - RNA, 17 nt, Artificial Sequence
  Synthetic Oligonucleotide; IFNG exon 3; Set C
uuucgaagucaucucgu

SEQ ID NO: 8122 - RNA, 19 nt, Artificial Sequence
  Synthetic Oligonucleotide; IFNG exon 3; Set C
uuuucgaagucaucucguu

SEQ ID NO: 8123 - RNA, 36 nt, Artificial Sequence
  Synthetic Oligonucleotide; IFNG exon 3; Set B
uuagucagcuuuucgaagucaucucguuucuuuuug

SEQ ID NO: 8124 - RNA, 38 nt, Artificial Sequence
  Synthetic Oligonucleotide; IFNG exon 3; Set B
auuagucagcuuuucgaagucaucucguuucuuuuugu

SEQ ID NO: 8125 - RNA, 34 nt, Artificial Sequence
  Synthetic Oligonucleotide; IFNG exon 3; Set B
uagucagcuuuucgaagucaucucguuucuuuuu

SEQ ID NO: 8126 - RNA, 40 nt, Artificial Sequence
  Synthetic Oligonucleotide; IFNG exon 3; Set B
aauuagucagcuuuucgaagucaucucguuucuuuuuguu

SEQ ID NO: 8127 - RNA, 18 nt, Artificial Sequence
  Synthetic Oligonucleotide; IFNG exon 3; Set C
uuuucgaagucaucucgu

SEQ ID NO: 8128 - RNA, 37 nt, Artificial Sequence
  Synthetic Oligonucleotide; IFNG exon 3; Set B
auuagucagcuuuucgaagucaucucguuucuuuuug

SEQ ID NO: 8129 - RNA, 35 nt, Artificial Sequence
  Synthetic Oligonucleotide; IFNG exon 3; Set B
uuagucagcuuuucgaagucaucucguuucuuuuu

SEQ ID NO: 8130 - RNA, 33 nt, Artificial Sequence
  Synthetic Oligonucleotide; IFNG exon 3; Set B
uagucagcuuuucgaagucaucucguuucuuuu

SEQ ID NO: 8131 - RNA, 36 nt, Artificial Sequence
  Synthetic Oligonucleotide; IFNG exon 3; Set B
auuagucagcuuuucgaagucaucucguuucuuuuu

SEQ ID NO: 8132 - RNA, 34 nt, Artificial Sequence
  Synthetic Oligonucleotide; IFNG exon 3; Set B
uuagucagcuuuucgaagucaucucguuucuuuu

SEQ ID NO: 8133 - RNA, 32 nt, Artificial Sequence
  Synthetic Oligonucleotide; IFNG exon 3; Set B
uagucagcuuuucgaagucaucucguuucuuu

SEQ ID NO: 8134 - RNA, 37 nt, Artificial Sequence
  Synthetic Oligonucleotide; IFNG exon 3; Set B
aauuagucagcuuuucgaagucaucucguuucuuuuu

SEQ ID NO: 8135 - RNA, 35 nt, Artificial Sequence
  Synthetic Oligonucleotide; IFNG exon 3; Set B
auuagucagcuuuucgaagucaucucguuucuuuu

SEQ ID NO: 8136 - RNA, 33 nt, Artificial Sequence
  Synthetic Oligonucleotide; IFNG exon 3; Set B
uuagucagcuuuucgaagucaucucguuucuuu

SEQ ID NO: 8137 - RNA, 38 nt, Artificial Sequence
  Synthetic Oligonucleotide; IFNG exon 3; Set B
uaauuagucagcuuuucgaagucaucucguuucuuuuu

SEQ ID NO: 8138 - RNA, 36 nt, Artificial Sequence
  Synthetic Oligonucleotide; IFNG exon 3; Set B
aauuagucagcuuuucgaagucaucucguuucuuuu

SEQ ID NO: 8139 - RNA, 34 nt, Artificial Sequence
  Synthetic Oligonucleotide; IFNG exon 3; Set B
auuagucagcuuuucgaagucaucucguuucuuu

SEQ ID NO: 8140 - RNA, 39 nt, Artificial Sequence
  Synthetic Oligonucleotide; IFNG exon 3; Set B
auaauuagucagcuuuucgaagucaucucguuucuuuuu

SEQ ID NO: 8141 - RNA, 37 nt, Artificial Sequence
  Synthetic Oligonucleotide; IFNG exon 3; Set B
uaauuagucagcuuuucgaagucaucucguuucuuuu

SEQ ID NO: 8142 - RNA, 35 nt, Artificial Sequence
  Synthetic Oligonucleotide; IFNG exon 3; Set B
aauuagucagcuuuucgaagucaucucguuucuuu

SEQ ID NO: 8143 - RNA, 40 nt, Artificial Sequence
  Synthetic Oligonucleotide; IFNG exon 3; Set B
aauaauuagucagcuuuucgaagucaucucguuucuuuuu

SEQ ID NO: 8144 - RNA, 38 nt, Artificial Sequence
  Synthetic Oligonucleotide; IFNG exon 3; Set B
auaauuagucagcuuuucgaagucaucucguuucuuuu

SEQ ID NO: 8145 - RNA, 36 nt, Artificial Sequence
  Synthetic Oligonucleotide; IFNG exon 3; Set B
uaauuagucagcuuuucgaagucaucucguuucuuu

SEQ ID NO: 8146 - RNA, 39 nt, Artificial Sequence
  Synthetic Oligonucleotide; IFNG exon 3; Set B
aauaauuagucagcuuuucgaagucaucucguuucuuuu

SEQ ID NO: 8147 - RNA, 37 nt, Artificial Sequence
  Synthetic Oligonucleotide; IFNG exon 3; Set B
auaauuagucagcuuuucgaagucaucucguuucuuu

SEQ ID NO: 8148 - RNA, 38 nt, Artificial Sequence
  Synthetic Oligonucleotide; IFNG exon 3; Set B
aauaauuagucagcuuuucgaagucaucucguuucuuu

SEQ ID NO: 8149 - RNA, 26 nt, Artificial Sequence
  Synthetic Oligonucleotide; IFNG exon 3; Set B
uagucagcuuuucgaagucaucucgu

SEQ ID NO: 8150 - RNA, 27 nt, Artificial Sequence
  Synthetic Oligonucleotide; IFNG exon 3; Set B
uuagucagcuuuucgaagucaucucgu

SEQ ID NO: 8151 - RNA, 29 nt, Artificial Sequence
  Synthetic Oligonucleotide; IFNG exon 3; Set B
auuagucagcuuuucgaagucaucucguu

SEQ ID NO: 8152 - RNA, 28 nt, Artificial Sequence
  Synthetic Oligonucleotide; IFNG exon 3; Set B
auuagucagcuuuucgaagucaucucgu

SEQ ID NO: 8153 - RNA, 30 nt, Artificial Sequence
  Synthetic Oligonucleotide; IFNG exon 3; Set B
aauuagucagcuuuucgaagucaucucguu

SEQ ID NO: 8154 - RNA, 29 nt, Artificial Sequence
  Synthetic Oligonucleotide; IFNG exon 3; Set B
aauuagucagcuuuucgaagucaucucgu

SEQ ID NO: 8155 - RNA, 31 nt, Artificial Sequence
  Synthetic Oligonucleotide; IFNG exon 3; Set B
uaauuagucagcuuuucgaagucaucucguu

SEQ ID NO: 8156 - RNA, 33 nt, Artificial Sequence
  Synthetic Oligonucleotide; IFNG exon 3; Set B
auaauuagucagcuuuucgaagucaucucguuu

SEQ ID NO: 8157 - RNA, 30 nt, Artificial Sequence
  Synthetic Oligonucleotide; IFNG exon 3; Set B
uaauuagucagcuuuucgaagucaucucgu

SEQ ID NO: 8158 - RNA, 32 nt, Artificial Sequence
  Synthetic Oligonucleotide; IFNG exon 3; Set B
auaauuagucagcuuuucgaagucaucucguu

SEQ ID NO: 8159 - RNA, 31 nt, Artificial Sequence
  Synthetic Oligonucleotide; IFNG exon 3; Set B
auaauuagucagcuuuucgaagucaucucgu

SEQ ID NO: 8160 - RNA, 20 nt, Artificial Sequence
  Synthetic Oligonucleotide; IFNG exon 3; Set C
uagucagcuuuucgaaguca

SEQ ID NO: 8161 - RNA, 21 nt, Artificial Sequence
  Synthetic Oligonucleotide; IFNG exon 3; Set C
uuagucagcuuuucgaaguca

SEQ ID NO: 8162 - RNA, 19 nt, Artificial Sequence
  Synthetic Oligonucleotide; IFNG exon 3; Set C
uagucagcuuuucgaaguc

SEQ ID NO: 8163 - RNA, 22 nt, Artificial Sequence
  Synthetic Oligonucleotide; IFNG exon 3; Set C
auuagucagcuuuucgaaguca

SEQ ID NO: 8164 - RNA, 20 nt, Artificial Sequence
  Synthetic Oligonucleotide; IFNG exon 3; Set C
uuagucagcuuuucgaaguc

SEQ ID NO: 8165 - RNA, 23 nt, Artificial Sequence
  Synthetic Oligonucleotide; IFNG exon 3; Set C
aauuagucagcuuuucgaaguca

SEQ ID NO: 8166 - RNA, 21 nt, Artificial Sequence
  Synthetic Oligonucleotide; IFNG exon 3; Set C
auuagucagcuuuucgaaguc

SEQ ID NO: 8167 - RNA, 24 nt, Artificial Sequence
  Synthetic Oligonucleotide; IFNG exon 3; Set C
uaauuagucagcuuuucgaaguca

SEQ ID NO: 8168 - RNA, 22 nt, Artificial Sequence
  Synthetic Oligonucleotide; IFNG exon 3; Set C
aauuagucagcuuuucgaaguc

SEQ ID NO: 8169 - RNA, 25 nt, Artificial Sequence
  Synthetic Oligonucleotide; IFNG exon 3; Set C
auaauuagucagcuuuucgaaguca

SEQ ID NO: 8170 - RNA, 23 nt, Artificial Sequence
  Synthetic Oligonucleotide; IFNG exon 3; Set C
uaauuagucagcuuuucgaaguc

SEQ ID NO: 8171 - RNA, 24 nt, Artificial Sequence
  Synthetic Oligonucleotide; IFNG exon 3; Set C
auaauuagucagcuuuucgaaguc

SEQ ID NO: 8172 - RNA, 15 nt, Artificial Sequence
  Synthetic Oligonucleotide; IFNG exon 3; Set C
auuagucagcuuuuc

SEQ ID NO: 8173 - RNA, 16 nt, Artificial Sequence
  Synthetic Oligonucleotide; IFNG exon 3; Set C
aauuagucagcuuuuc

SEQ ID NO: 8174 - RNA, 18 nt, Artificial Sequence
  Synthetic Oligonucleotide; IFNG exon 3; Set C
uaauuagucagcuuuucg

SEQ ID NO: 8175 - RNA, 17 nt, Artificial Sequence
  Synthetic Oligonucleotide; IFNG exon 3; Set C
uaauuagucagcuuuuc

SEQ ID NO: 8176 - RNA, 15 nt, Artificial Sequence
  Synthetic Oligonucleotide; IFNG exon 3; Set C
aauuagucagcuuuu

SEQ ID NO: 8177 - RNA, 19 nt, Artificial Sequence
  Synthetic Oligonucleotide; IFNG exon 3; Set C
auaauuagucagcuuuucg

SEQ ID NO: 8178 - RNA, 18 nt, Artificial Sequence
  Synthetic Oligonucleotide; IFNG exon 3; Set C
auaauuagucagcuuuuc

SEQ ID NO: 8179 - RNA, 16 nt, Artificial Sequence
  Synthetic Oligonucleotide; IFNG exon 3; Set C
uaauuagucagcuuuu

SEQ ID NO: 8180 - RNA, 19 nt, Artificial Sequence
  Synthetic Oligonucleotide; IFNG exon 3; Set C
aauaauuagucagcuuuuc

SEQ ID NO: 8181 - RNA, 17 nt, Artificial Sequence
  Synthetic Oligonucleotide; IFNG exon 3; Set C
auaauuagucagcuuuu

SEQ ID NO: 8182 - RNA, 15 nt, Artificial Sequence
  Synthetic Oligonucleotide; IFNG exon 3; Set C
uaauuagucagcuuu

SEQ ID NO: 8183 - RNA, 20 nt, Artificial Sequence
  Synthetic Oligonucleotide; IFNG exon 3; Set C
gaauaauuagucagcuuuuc

SEQ ID NO: 8184 - RNA, 18 nt, Artificial Sequence
  Synthetic Oligonucleotide; IFNG exon 3; Set C
aauaauuagucagcuuuu

SEQ ID NO: 8185 - RNA, 16 nt, Artificial Sequence
  Synthetic Oligonucleotide; IFNG exon 3; Set C
auaauuagucagcuuu

SEQ ID NO: 8186 - RNA, 17 nt, Artificial Sequence
  Synthetic Oligonucleotide; IFNG exon 3; Set C
aauaauuagucagcuuu

SEQ ID NO: 8187 - RNA, 35 nt, Artificial Sequence
  Synthetic Oligonucleotide; IFNG exon 3; Set B
uuaaauagccucaccgaauaauuagucagcuuuuc

SEQ ID NO: 8188 - RNA, 36 nt, Artificial Sequence
  Synthetic Oligonucleotide; IFNG exon 3; Set B
uuuaaauagccucaccgaauaauuagucagcuuuuc

SEQ ID NO: 8189 - RNA, 34 nt, Artificial Sequence
  Synthetic Oligonucleotide; IFNG exon 3; Set B
uuaaauagccucaccgaauaauuagucagcuuuu

SEQ ID NO: 8190 - RNA, 37 nt, Artificial Sequence
  Synthetic Oligonucleotide; IFNG exon 3; Set B
auuuaaauagccucaccgaauaauuagucagcuuuuc

SEQ ID NO: 8191 - RNA, 35 nt, Artificial Sequence
  Synthetic Oligonucleotide; IFNG exon 3; Set B
uuuaaauagccucaccgaauaauuagucagcuuuu

SEQ ID NO: 8192 - RNA, 33 nt, Artificial Sequence
  Synthetic Oligonucleotide; IFNG exon 3; Set B
uuaaauagccucaccgaauaauuagucagcuuu

SEQ ID NO: 8193 - RNA, 38 nt, Artificial Sequence
  Synthetic Oligonucleotide; IFNG exon 3; Set B
aauuuaaauagccucaccgaauaauuagucagcuuuuc

SEQ ID NO: 8194 - RNA, 36 nt, Artificial Sequence
  Synthetic Oligonucleotide; IFNG exon 3; Set B
auuuaaauagccucaccgaauaauuagucagcuuuu

SEQ ID NO: 8195 - RNA, 34 nt, Artificial Sequence
  Synthetic Oligonucleotide; IFNG exon 3; Set B
uuuaaauagccucaccgaauaauuagucagcuuu

SEQ ID NO: 8196 - RNA, 37 nt, Artificial Sequence
  Synthetic Oligonucleotide; IFNG exon 3; Set B
aauuuaaauagccucaccgaauaauuagucagcuuuu

SEQ ID NO: 8197 - RNA, 35 nt, Artificial Sequence
  Synthetic Oligonucleotide; IFNG exon 3; Set B
auuuaaauagccucaccgaauaauuagucagcuuu

SEQ ID NO: 8198 - RNA, 20 nt, Artificial Sequence
  Synthetic Oligonucleotide; IFNG exon 3; Set C
uagccucaccgaauaauuag

SEQ ID NO: 8199 - RNA, 36 nt, Artificial Sequence
  Synthetic Oligonucleotide; IFNG exon 3; Set B
aauuuaaauagccucaccgaauaauuagucagcuuu

SEQ ID NO: 8200 - RNA, 19 nt, Artificial Sequence
  Synthetic Oligonucleotide; IFNG exon 3; Set C
uagccucaccgaauaauua

SEQ ID NO: 8201 - RNA, 18 nt, Artificial Sequence
  Synthetic Oligonucleotide; IFNG exon 3; Set C
uagccucaccgaauaauu

SEQ ID NO: 8202 - RNA, 17 nt, Artificial Sequence
  Synthetic Oligonucleotide; IFNG exon 3; Set C
uagccucaccgaauaau

SEQ ID NO: 8203 - RNA, 25 nt, Artificial Sequence
  Synthetic Oligonucleotide; IFNG exon 3; Set C
uuaaauagccucaccgaauaauuag

SEQ ID NO: 8204 - RNA, 24 nt, Artificial Sequence
  Synthetic Oligonucleotide; IFNG exon 3; Set C
uuaaauagccucaccgaauaauua

SEQ ID NO: 8205 - RNA, 26 nt, Artificial Sequence
  Synthetic Oligonucleotide; IFNG exon 3; Set C
uuuaaauagccucaccgaauaauuag

SEQ ID NO: 8206 - RNA, 23 nt, Artificial Sequence
  Synthetic Oligonucleotide; IFNG exon 3; Set C
uuaaauagccucaccgaauaauu

SEQ ID NO: 8207 - RNA, 25 nt, Artificial Sequence
  Synthetic Oligonucleotide; IFNG exon 3; Set C
uuuaaauagccucaccgaauaauua

SEQ ID NO: 8208 - RNA, 27 nt, Artificial Sequence
  Synthetic Oligonucleotide; IFNG exon 3; Set C
auuuaaauagccucaccgaauaauuag

SEQ ID NO: 8209 - RNA, 24 nt, Artificial Sequence
  Synthetic Oligonucleotide; IFNG exon 3; Set C
uuuaaauagccucaccgaauaauu

SEQ ID NO: 8210 - RNA, 22 nt, Artificial Sequence
  Synthetic Oligonucleotide; IFNG exon 3; Set C
uuaaauagccucaccgaauaau

SEQ ID NO: 8211 - RNA, 26 nt, Artificial Sequence
  Synthetic Oligonucleotide; IFNG exon 3; Set C
auuuaaauagccucaccgaauaauua

SEQ ID NO: 8212 - RNA, 28 nt, Artificial Sequence
  Synthetic Oligonucleotide; IFNG exon 3; Set C
aauuuaaauagccucaccgaauaauuag

SEQ ID NO: 8213 - RNA, 23 nt, Artificial Sequence
  Synthetic Oligonucleotide; IFNG exon 3; Set C
uuuaaauagccucaccgaauaau

SEQ ID NO: 8214 - RNA, 21 nt, Artificial Sequence
  Synthetic Oligonucleotide; IFNG exon 3; Set C
uuaaauagccucaccgaauaa

SEQ ID NO: 8215 - RNA, 25 nt, Artificial Sequence
  Synthetic Oligonucleotide; IFNG exon 3; Set C
auuuaaauagccucaccgaauaauu

SEQ ID NO: 8216 - RNA, 27 nt, Artificial Sequence
  Synthetic Oligonucleotide; IFNG exon 3; Set C
aauuuaaauagccucaccgaauaauua

SEQ ID NO: 8217 - RNA, 22 nt, Artificial Sequence
  Synthetic Oligonucleotide; IFNG exon 3; Set C
uuuaaauagccucaccgaauaa

SEQ ID NO: 8218 - RNA, 20 nt, Artificial Sequence
  Synthetic Oligonucleotide; IFNG exon 3; Set C
uuaaauagccucaccgaaua

SEQ ID NO: 8219 - RNA, 24 nt, Artificial Sequence
  Synthetic Oligonucleotide; IFNG exon 3; Set C
auuuaaauagccucaccgaauaau

SEQ ID NO: 8220 - RNA, 26 nt, Artificial Sequence
  Synthetic Oligonucleotide; IFNG exon 3; Set C
aauuuaaauagccucaccgaauaauu

SEQ ID NO: 8221 - RNA, 21 nt, Artificial Sequence
  Synthetic Oligonucleotide; IFNG exon 3; Set C
uuuaaauagccucaccgaaua

SEQ ID NO: 8222 - RNA, 23 nt, Artificial Sequence
  Synthetic Oligonucleotide; IFNG exon 3; Set C
auuuaaauagccucaccgaauaa

SEQ ID NO: 8223 - RNA, 25 nt, Artificial Sequence
  Synthetic Oligonucleotide; IFNG exon 3; Set C
aauuuaaauagccucaccgaauaau

SEQ ID NO: 8224 - RNA, 22 nt, Artificial Sequence
  Synthetic Oligonucleotide; IFNG exon 3; Set C
auuuaaauagccucaccgaaua

SEQ ID NO: 8225 - RNA, 24 nt, Artificial Sequence
  Synthetic Oligonucleotide; IFNG exon 3; Set C
aauuuaaauagccucaccgaauaa

SEQ ID NO: 8226 - RNA, 20 nt, Artificial Sequence
  Synthetic Oligonucleotide; IFNG exon 3; Set C
uuuaaauagccucaccgaau

SEQ ID NO: 8227 - RNA, 23 nt, Artificial Sequence
  Synthetic Oligonucleotide; IFNG exon 3; Set C
aauuuaaauagccucaccgaaua

SEQ ID NO: 8228 - RNA, 21 nt, Artificial Sequence
  Synthetic Oligonucleotide; IFNG exon 3; Set C
auuuaaauagccucaccgaau

SEQ ID NO: 8229 - RNA, 22 nt, Artificial Sequence
  Synthetic Oligonucleotide; IFNG exon 3; Set C
aauuuaaauagccucaccgaau

SEQ ID NO: 8230 - RNA, 40 nt, Artificial Sequence
  Synthetic Oligonucleotide; IFNG exon 3; Set C
gaaaccaaagaaagaauuuaaauagccucaccgaauaauu

SEQ ID NO: 8231 - RNA, 39 nt, Artificial Sequence
  Synthetic Oligonucleotide; IFNG exon 3; Set C
gaaaccaaagaaagaauuuaaauagccucaccgaauaau

SEQ ID NO: 8232 - RNA, 40 nt, Artificial Sequence
  Synthetic Oligonucleotide; IFNG exon 3; Set B
ugaaaccaaagaaagaauuuaaauagccucaccgaauaau

SEQ ID NO: 8233 - RNA, 38 nt, Artificial Sequence
  Synthetic Oligonucleotide; IFNG exon 3; Set C
gaaaccaaagaaagaauuuaaauagccucaccgaauaa

SEQ ID NO: 8234 - RNA, 39 nt, Artificial Sequence
  Synthetic Oligonucleotide; IFNG exon 3; Set B
ugaaaccaaagaaagaauuuaaauagccucaccgaauaa

SEQ ID NO: 8235 - RNA, 37 nt, Artificial Sequence
  Synthetic Oligonucleotide; IFNG exon 3; Set B
gaaaccaaagaaagaauuuaaauagccucaccgaaua

SEQ ID NO: 8236 - RNA, 40 nt, Artificial Sequence
  Synthetic Oligonucleotide; IFNG exon 3; Set B
augaaaccaaagaaagaauuuaaauagccucaccgaauaa

SEQ ID NO: 8237 - RNA, 38 nt, Artificial Sequence
  Synthetic Oligonucleotide; IFNG exon 3; Set B
ugaaaccaaagaaagaauuuaaauagccucaccgaaua

SEQ ID NO: 8238 - RNA, 39 nt, Artificial Sequence
  Synthetic Oligonucleotide; IFNG exon 3; Set B
augaaaccaaagaaagaauuuaaauagccucaccgaaua

SEQ ID NO: 8239 - RNA, 40 nt, Artificial Sequence
  Synthetic Oligonucleotide; IFNG exon 3; Set B
aaugaaaccaaagaaagaauuuaaauagccucaccgaaua

SEQ ID NO: 8240 - RNA, 25 nt, Artificial Sequence
  Synthetic Oligonucleotide; IFNG exon 3; Set C
gaaaccaaagaaagaauuuaaauag

SEQ ID NO: 8241 - RNA, 26 nt, Artificial Sequence
  Synthetic Oligonucleotide; IFNG exon 3; Set C
ugaaaccaaagaaagaauuuaaauag

SEQ ID NO: 8242 - RNA, 27 nt, Artificial Sequence
  Synthetic Oligonucleotide; IFNG exon 3; Set C
augaaaccaaagaaagaauuuaaauag

SEQ ID NO: 8243 - RNA, 28 nt, Artificial Sequence
  Synthetic Oligonucleotide; IFNG exon 3; Set C
aaugaaaccaaagaaagaauuuaaauag

SEQ ID NO: 8244 - RNA, 20 nt, Artificial Sequence
  Synthetic Oligonucleotide; IFNG exon 3; Set C
gaaaccaaagaaagaauuua

SEQ ID NO: 8245 - RNA, 19 nt, Artificial Sequence
  Synthetic Oligonucleotide; IFNG exon 3; Set C
gaaaccaaagaaagaauuu

SEQ ID NO: 8246 - RNA, 21 nt, Artificial Sequence
  Synthetic Oligonucleotide; IFNG exon 3; Set C
ugaaaccaaagaaagaauuua

SEQ ID NO: 8247 - RNA, 20 nt, Artificial Sequence
  Synthetic Oligonucleotide; IFNG exon 3; Set C
ugaaaccaaagaaagaauuu

SEQ ID NO: 8248 - RNA, 22 nt, Artificial Sequence
  Synthetic Oligonucleotide; IFNG exon 3; Set C
augaaaccaaagaaagaauuua

SEQ ID NO: 8249 - RNA, 18 nt, Artificial Sequence
  Synthetic Oligonucleotide; IFNG exon 3; Set C
gaaaccaaagaaagaauu

SEQ ID NO: 8250 - RNA, 21 nt, Artificial Sequence
  Synthetic Oligonucleotide; IFNG exon 3; Set C
augaaaccaaagaaagaauuu

SEQ ID NO: 8251 - RNA, 23 nt, Artificial Sequence
  Synthetic Oligonucleotide; IFNG exon 3; Set C
aaugaaaccaaagaaagaauuua

SEQ ID NO: 8252 - RNA, 19 nt, Artificial Sequence
  Synthetic Oligonucleotide; IFNG exon 3; Set C
ugaaaccaaagaaagaauu

SEQ ID NO: 8253 - RNA, 17 nt, Artificial Sequence
  Synthetic Oligonucleotide; IFNG exon 3; Set C
gaaaccaaagaaagaau

SEQ ID NO: 8254 - RNA, 22 nt, Artificial Sequence
  Synthetic Oligonucleotide; IFNG exon 3; Set C
aaugaaaccaaagaaagaauuu

SEQ ID NO: 8255 - RNA, 24 nt, Artificial Sequence
  Synthetic Oligonucleotide; IFNG exon 3; Set C
caaugaaaccaaagaaagaauuua

SEQ ID NO: 8256 - RNA, 20 nt, Artificial Sequence
  Synthetic Oligonucleotide; IFNG exon 3; Set C
augaaaccaaagaaagaauu

SEQ ID NO: 8257 - RNA, 18 nt, Artificial Sequence
  Synthetic Oligonucleotide; IFNG exon 3; Set C
ugaaaccaaagaaagaau

SEQ ID NO: 8258 - RNA, 23 nt, Artificial Sequence
  Synthetic Oligonucleotide; IFNG exon 3; Set C
caaugaaaccaaagaaagaauuu

SEQ ID NO: 8259 - RNA, 21 nt, Artificial Sequence
  Synthetic Oligonucleotide; IFNG exon 3; Set C
aaugaaaccaaagaaagaauu

SEQ ID NO: 8260 - RNA, 19 nt, Artificial Sequence
  Synthetic Oligonucleotide; IFNG exon 3; Set C
augaaaccaaagaaagaau

SEQ ID NO: 8261 - RNA, 20 nt, Artificial Sequence
  Synthetic Oligonucleotide; IFNG exon 3; Set C
aaugaaaccaaagaaagaau

SEQ ID NO: 8262 - RNA, 38 nt, Artificial Sequence
  Synthetic Oligonucleotide; IFNG exon 3; Set B
gacccucggcaaugaaaccaaagaaagaauuuaaauag

SEQ ID NO: 8263 - RNA, 39 nt, Artificial Sequence
  Synthetic Oligonucleotide; IFNG exon 3; Set B
agacccucggcaaugaaaccaaagaaagaauuuaaauag

SEQ ID NO: 8264 - RNA, 33 nt, Artificial Sequence
  Synthetic Oligonucleotide; IFNG exon 3; Set B
gacccucggcaaugaaaccaaagaaagaauuua

SEQ ID NO: 8265 - RNA, 32 nt, Artificial Sequence
  Synthetic Oligonucleotide; IFNG exon 3; Set B
gacccucggcaaugaaaccaaagaaagaauuu

SEQ ID NO: 8266 - RNA, 34 nt, Artificial Sequence
  Synthetic Oligonucleotide; IFNG exon 3; Set B
agacccucggcaaugaaaccaaagaaagaauuua

SEQ ID NO: 8267 - RNA, 33 nt, Artificial Sequence
  Synthetic Oligonucleotide; IFNG exon 3; Set B
agacccucggcaaugaaaccaaagaaagaauuu

SEQ ID NO: 8268 - RNA, 31 nt, Artificial Sequence
  Synthetic Oligonucleotide; IFNG exon 3; Set B
gacccucggcaaugaaaccaaagaaagaauu

SEQ ID NO: 8269 - RNA, 32 nt, Artificial Sequence
  Synthetic Oligonucleotide; IFNG exon 3; Set B
agacccucggcaaugaaaccaaagaaagaauu

SEQ ID NO: 8270 - RNA, 30 nt, Artificial Sequence
  Synthetic Oligonucleotide; IFNG exon 3; Set B
gacccucggcaaugaaaccaaagaaagaau

SEQ ID NO: 8271 - RNA, 31 nt, Artificial Sequence
  Synthetic Oligonucleotide; IFNG exon 3; Set B
agacccucggcaaugaaaccaaagaaagaau

SEQ ID NO: 8272 - RNA, 16 nt, Artificial Sequence
  Synthetic Oligonucleotide; IFNG exon 3; Set C
gacccucggcaaugaa

SEQ ID NO: 8273 - RNA, 15 nt, Artificial Sequence
  Synthetic Oligonucleotide; IFNG exon 3; Set C
gacccucggcaauga

SEQ ID NO: 8274 - RNA, 17 nt, Artificial Sequence
  Synthetic Oligonucleotide; IFNG exon 3; Set C
agacccucggcaaugaa

SEQ ID NO: 8275 - RNA, 16 nt, Artificial Sequence
  Synthetic Oligonucleotide; IFNG exon 3; Set C
agacccucggcaauga

SEQ ID NO: 8276 - RNA, 15 nt, Artificial Sequence
  Synthetic Oligonucleotide; IFNG exon 3; Set C
agacccucggcaaug

SEQ ID NO: 8277 - RNA, 24 nt, Artificial Sequence
  Synthetic Oligonucleotide; IFNG exon 3; Set C
gaugaugugaauuuauccaucaga

SEQ ID NO: 8278 - RNA, 25 nt, Artificial Sequence
  Synthetic Oligonucleotide; IFNG exon 3; Set C
ggaugaugugaauuuauccaucaga

SEQ ID NO: 8279 - RNA, 34 nt, Artificial Sequence
  Synthetic Oligonucleotide; IFNG exon 3; Set A
acaaacagaggaugaugugaauuuauccaucaga

SEQ ID NO: 8280 - RNA, 15 nt, Artificial Sequence
  Synthetic Oligonucleotide; IFNG exon 3; Set C
gaggaugaugugaau

SEQ ID NO: 8281 - RNA, 23 nt, Artificial Sequence
  Synthetic Oligonucleotide; IFNG exon 3; Set C
aaacagaggaugaugugaauuua

SEQ ID NO: 8282 - RNA, 22 nt, Artificial Sequence
  Synthetic Oligonucleotide; IFNG exon 3; Set C
aaacagaggaugaugugaauuu

SEQ ID NO: 8283 - RNA, 24 nt, Artificial Sequence
  Synthetic Oligonucleotide; IFNG exon 3; Set C
caaacagaggaugaugugaauuua

SEQ ID NO: 8284 - RNA, 21 nt, Artificial Sequence
  Synthetic Oligonucleotide; IFNG exon 3; Set C
aaacagaggaugaugugaauu

SEQ ID NO: 8285 - RNA, 23 nt, Artificial Sequence
  Synthetic Oligonucleotide; IFNG exon 3; Set C
caaacagaggaugaugugaauuu

SEQ ID NO: 8286 - RNA, 22 nt, Artificial Sequence
  Synthetic Oligonucleotide; IFNG exon 3; Set C
caaacagaggaugaugugaauu

SEQ ID NO: 8287 - RNA, 23 nt, Artificial Sequence
  Synthetic Oligonucleotide; IFNG exon 3; Set C
cacaaacagaggaugaugugaau

SEQ ID NO: 8288 - RNA, 21 nt, Artificial Sequence
  Synthetic Oligonucleotide; IFNG exon 3; Set C
acaaacagaggaugaugugaa

SEQ ID NO: 8289 - RNA, 28 nt, Artificial Sequence
  Synthetic Oligonucleotide; IFNG exon 3; Set A
gagcacaaacagaggaugaugugaauuu

SEQ ID NO: 8290 - RNA, 24 nt, Artificial Sequence
  Synthetic Oligonucleotide; IFNG exon 3; Set C
gcacaaacagaggaugaugugaau

SEQ ID NO: 8291 - RNA, 20 nt, Artificial Sequence
  Synthetic Oligonucleotide; IFNG exon 3; Set C
acaaacagaggaugauguga

SEQ ID NO: 8292 - RNA, 27 nt, Artificial Sequence
  Synthetic Oligonucleotide; IFNG exon 3; Set A
gagcacaaacagaggaugaugugaauu

SEQ ID NO: 8293 - RNA, 25 nt, Artificial Sequence
  Synthetic Oligonucleotide; IFNG exon 3; Set C
agcacaaacagaggaugaugugaau

SEQ ID NO: 8294 - RNA, 26 nt, Artificial Sequence
  Synthetic Oligonucleotide; IFNG exon 3; Set A
gagcacaaacagaggaugaugugaau

SEQ ID NO: 8295 - RNA, 18 nt, Artificial Sequence
  Synthetic Oligonucleotide; IFNG exon 3; Set C
acaaacagaggaugaugu

SEQ ID NO: 8296 - RNA, 27 nt, Artificial Sequence
  Synthetic Oligonucleotide; IFNG exon 3; Set A
agagcacaaacagaggaugaugugaau

SEQ ID NO: 8297 - RNA, 17 nt, Artificial Sequence
  Synthetic Oligonucleotide; IFNG exon 3; Set C
acaaacagaggaugaug

SEQ ID NO: 8298 - RNA, 28 nt, Artificial Sequence
  Synthetic Oligonucleotide; IFNG exon 3; Set A
aagagcacaaacagaggaugaugugaau

SEQ ID NO: 8299 - RNA, 16 nt, Artificial Sequence
  Synthetic Oligonucleotide; IFNG exon 3; Set C
acaaacagaggaugau

SEQ ID NO: 8300 - RNA, 15 nt, Artificial Sequence
  Synthetic Oligonucleotide; IFNG exon 3; Set C
acaaacagaggauga

SEQ ID NO: 8301 - RNA, 17 nt, Artificial Sequence
  Synthetic Oligonucleotide; IFNG exon 3; Set C
cacaaacagaggaugau

SEQ ID NO: 8302 - RNA, 16 nt, Artificial Sequence
  Synthetic Oligonucleotide; IFNG exon 3; Set C
cacaaacagaggauga

SEQ ID NO: 8303 - RNA, 18 nt, Artificial Sequence
  Synthetic Oligonucleotide; IFNG exon 3; Set C
gcacaaacagaggaugau

SEQ ID NO: 8304 - RNA, 37 nt, Artificial Sequence
  Synthetic Oligonucleotide; IFNG exon 3; Set A
gaaggaaagagcacaaacagaggaugaugugaauuua

SEQ ID NO: 8305 - RNA, 17 nt, Artificial Sequence
  Synthetic Oligonucleotide; IFNG exon 3; Set C
gcacaaacagaggauga

SEQ ID NO: 8306 - RNA, 15 nt, Artificial Sequence
  Synthetic Oligonucleotide; IFNG exon 3; Set C
cacaaacagaggaug

SEQ ID NO: 8307 - RNA, 19 nt, Artificial Sequence
  Synthetic Oligonucleotide; IFNG exon 3; Set C
agcacaaacagaggaugau

SEQ ID NO: 8308 - RNA, 36 nt, Artificial Sequence
  Synthetic Oligonucleotide; IFNG exon 3; Set A
gaaggaaagagcacaaacagaggaugaugugaauuu

SEQ ID NO: 8309 - RNA, 18 nt, Artificial Sequence
  Synthetic Oligonucleotide; IFNG exon 3; Set C
agcacaaacagaggauga

SEQ ID NO: 8310 - RNA, 16 nt, Artificial Sequence
  Synthetic Oligonucleotide; IFNG exon 3; Set C
gcacaaacagaggaug

SEQ ID NO: 8311 - RNA, 35 nt, Artificial Sequence
  Synthetic Oligonucleotide; IFNG exon 3; Set A
gaaggaaagagcacaaacagaggaugaugugaauu

SEQ ID NO: 8312 - RNA, 15 nt, Artificial Sequence
  Synthetic Oligonucleotide; IFNG exon 3; Set C
gcacaaacagaggau

SEQ ID NO: 8313 - RNA, 19 nt, Artificial Sequence
  Synthetic Oligonucleotide; IFNG exon 3; Set C
gagcacaaacagaggauga

SEQ ID NO: 8314 - RNA, 17 nt, Artificial Sequence
  Synthetic Oligonucleotide; IFNG exon 3; Set C
agcacaaacagaggaug

SEQ ID NO: 8315 - RNA, 16 nt, Artificial Sequence
  Synthetic Oligonucleotide; IFNG exon 3; Set C
agcacaaacagaggau

SEQ ID NO: 8316 - RNA, 20 nt, Artificial Sequence
  Synthetic Oligonucleotide; IFNG exon 3; Set C
agagcacaaacagaggauga

SEQ ID NO: 8317 - RNA, 17 nt, Artificial Sequence
  Synthetic Oligonucleotide; IFNG exon 3; Set C
gagcacaaacagaggau

SEQ ID NO: 8318 - RNA, 35 nt, Artificial Sequence
  Synthetic Oligonucleotide; IFNG exon 3; Set A
ggaaggaaagagcacaaacagaggaugaugugaau

SEQ ID NO: 8319 - RNA, 21 nt, Artificial Sequence
  Synthetic Oligonucleotide; IFNG exon 3; Set C
aagagcacaaacagaggauga

SEQ ID NO: 8320 - RNA, 19 nt, Artificial Sequence
  Synthetic Oligonucleotide; IFNG exon 3; Set C
agagcacaaacagaggaug

SEQ ID NO: 8321 - RNA, 16 nt, Artificial Sequence
  Synthetic Oligonucleotide; IFNG exon 3; Set C
gagcacaaacagagga

SEQ ID NO: 8322 - RNA, 18 nt, Artificial Sequence
  Synthetic Oligonucleotide; IFNG exon 3; Set C
agagcacaaacagaggau

SEQ ID NO: 8323 - RNA, 36 nt, Artificial Sequence
  Synthetic Oligonucleotide; IFNG exon 3; Set A
uggaaggaaagagcacaaacagaggaugaugugaau

SEQ ID NO: 8324 - RNA, 20 nt, Artificial Sequence
  Synthetic Oligonucleotide; IFNG exon 3; Set C
aagagcacaaacagaggaug

SEQ ID NO: 8325 - RNA, 17 nt, Artificial Sequence
  Synthetic Oligonucleotide; IFNG exon 3; Set C
agagcacaaacagagga

SEQ ID NO: 8326 - RNA, 19 nt, Artificial Sequence
  Synthetic Oligonucleotide; IFNG exon 3; Set C
aagagcacaaacagaggau

SEQ ID NO: 8327 - RNA, 18 nt, Artificial Sequence
  Synthetic Oligonucleotide; IFNG exon 3; Set C
aagagcacaaacagagga

SEQ ID NO: 8328 - RNA, 32 nt, Artificial Sequence
  Synthetic Oligonucleotide; IFNG exon 3; Set A
uggaaggaaagagcacaaacagaggaugaugu

SEQ ID NO: 8329 - RNA, 29 nt, Artificial Sequence
  Synthetic Oligonucleotide; IFNG exon 3; Set A
ggaaggaaagagcacaaacagaggaugau

SEQ ID NO: 8330 - RNA, 28 nt, Artificial Sequence
  Synthetic Oligonucleotide; IFNG exon 3; Set A
ggaaggaaagagcacaaacagaggauga

SEQ ID NO: 8331 - RNA, 30 nt, Artificial Sequence
  Synthetic Oligonucleotide; IFNG exon 3; Set A
uggaaggaaagagcacaaacagaggaugau

SEQ ID NO: 8332 - RNA, 29 nt, Artificial Sequence
  Synthetic Oligonucleotide; IFNG exon 3; Set A
uggaaggaaagagcacaaacagaggauga

SEQ ID NO: 8333 - RNA, 27 nt, Artificial Sequence
  Synthetic Oligonucleotide; IFNG exon 3; Set A
ggaaggaaagagcacaaacagaggaug

SEQ ID NO: 8334 - RNA, 26 nt, Artificial Sequence
  Synthetic Oligonucleotide; IFNG exon 3; Set A
ggaaggaaagagcacaaacagaggau

SEQ ID NO: 8335 - RNA, 28 nt, Artificial Sequence
  Synthetic Oligonucleotide; IFNG exon 3; Set A
uggaaggaaagagcacaaacagaggaug

SEQ ID NO: 8336 - RNA, 27 nt, Artificial Sequence
  Synthetic Oligonucleotide; IFNG exon 3; Set A
uggaaggaaagagcacaaacagaggau

SEQ ID NO: 8337 - RNA, 25 nt, Artificial Sequence
  Synthetic Oligonucleotide; IFNG exon 3; Set C
uggaaggaaagagcacaaacagagg

SEQ ID NO: 8338 - RNA, 16 nt, Artificial Sequence
  Synthetic Oligonucleotide; IFNG exon 3; Set C
ggaaggaaagagcaca

SEQ ID NO: 8339 - RNA, 15 nt, Artificial Sequence
  Synthetic Oligonucleotide; IFNG exon 3; Set C
ggaaggaaagagcac

SEQ ID NO: 8340 - RNA, 16 nt, Artificial Sequence
  Synthetic Oligonucleotide; IFNG exon 3; Set C
uggaaggaaagagcac

SEQ ID NO: 8341 - RNA, 15 nt, Artificial Sequence
  Synthetic Oligonucleotide; IFNG exon 3; Set C
uggaaggaaagagca

SEQ ID NO: 8342 - RNA, 19 nt, Artificial Sequence
  Synthetic Oligonucleotide; IFNG exon 3; Set C
uuggcucugcauuauuuuu

SEQ ID NO: 8343 - RNA, 18 nt, Artificial Sequence
  Synthetic Oligonucleotide; IFNG exon 3; Set C
uuggcucugcauuauuuu

SEQ ID NO: 8344 - RNA, 20 nt, Artificial Sequence
  Synthetic Oligonucleotide; IFNG exon 3; Set C
uuuggcucugcauuauuuuu

SEQ ID NO: 8345 - RNA, 19 nt, Artificial Sequence
  Synthetic Oligonucleotide; IFNG exon 3; Set C
uuuggcucugcauuauuuu

SEQ ID NO: 8346 - RNA, 17 nt, Artificial Sequence
  Synthetic Oligonucleotide; IFNG exon 3; Set C
uuggcucugcauuauuu

SEQ ID NO: 8347 - RNA, 21 nt, Artificial Sequence
  Synthetic Oligonucleotide; IFNG exon 3; Set C
auuuggcucugcauuauuuuu

SEQ ID NO: 8348 - RNA, 18 nt, Artificial Sequence
  Synthetic Oligonucleotide; IFNG exon 3; Set C
uuuggcucugcauuauuu

SEQ ID NO: 8349 - RNA, 16 nt, Artificial Sequence
  Synthetic Oligonucleotide; IFNG exon 3; Set C
uuggcucugcauuauu

SEQ ID NO: 8350 - RNA, 17 nt, Artificial Sequence
  Synthetic Oligonucleotide; IFNG exon 3; Set C
uuuggcucugcauuauu

SEQ ID NO: 8351 - RNA, 19 nt, Artificial Sequence
  Synthetic Oligonucleotide; IFNG exon 3; Set C
auuuggcucugcauuauuu

SEQ ID NO: 8352 - RNA, 15 nt, Artificial Sequence
  Synthetic Oligonucleotide; IFNG exon 3; Set C
uuggcucugcauuau

SEQ ID NO: 8353 - RNA, 16 nt, Artificial Sequence
  Synthetic Oligonucleotide; IFNG exon 3; Set C
uuuggcucugcauuau

SEQ ID NO: 8354 - RNA, 18 nt, Artificial Sequence
  Synthetic Oligonucleotide; IFNG exon 3; Set C
auuuggcucugcauuauu

SEQ ID NO: 8355 - RNA, 15 nt, Artificial Sequence
  Synthetic Oligonucleotide; IFNG exon 3; Set C
uuuggcucugcauua

SEQ ID NO: 8356 - RNA, 17 nt, Artificial Sequence
  Synthetic Oligonucleotide; IFNG exon 3; Set C
auuuggcucugcauuau

SEQ ID NO: 8357 - RNA, 16 nt, Artificial Sequence
  Synthetic Oligonucleotide; IFNG exon 3; Set C
auuuggcucugcauua

SEQ ID NO: 8358 - RNA, 15 nt, Artificial Sequence
  Synthetic Oligonucleotide; IFNG exon 3; Set C
auuuggcucugcauu

SEQ ID NO: 8359 - RNA, 31 nt, Artificial Sequence
  Synthetic Oligonucleotide; IFNG exon 3; Set A
aaaggagacaauuuggcucugcauuauuuuu

SEQ ID NO: 8360 - RNA, 30 nt, Artificial Sequence
  Synthetic Oligonucleotide; IFNG exon 3; Set A
aaaggagacaauuuggcucugcauuauuuu

SEQ ID NO: 8361 - RNA, 32 nt, Artificial Sequence
  Synthetic Oligonucleotide; IFNG exon 3; Set A
aaaaggagacaauuuggcucugcauuauuuuu

SEQ ID NO: 8362 - RNA, 29 nt, Artificial Sequence
  Synthetic Oligonucleotide; IFNG exon 3; Set A
aaaggagacaauuuggcucugcauuauuu

SEQ ID NO: 8363 - RNA, 31 nt, Artificial Sequence
  Synthetic Oligonucleotide; IFNG exon 3; Set A
aaaaggagacaauuuggcucugcauuauuuu

SEQ ID NO: 8364 - RNA, 33 nt, Artificial Sequence
  Synthetic Oligonucleotide; IFNG exon 3; Set A
uaaaaggagacaauuuggcucugcauuauuuuu

SEQ ID NO: 8365 - RNA, 28 nt, Artificial Sequence
  Synthetic Oligonucleotide; IFNG exon 3; Set A
aaaggagacaauuuggcucugcauuauu

SEQ ID NO: 8366 - RNA, 32 nt, Artificial Sequence
  Synthetic Oligonucleotide; IFNG exon 3; Set A
uaaaaggagacaauuuggcucugcauuauuuu

SEQ ID NO: 8367 - RNA, 30 nt, Artificial Sequence
  Synthetic Oligonucleotide; IFNG exon 3; Set A
aaaaggagacaauuuggcucugcauuauuu

SEQ ID NO: 8368 - RNA, 27 nt, Artificial Sequence
  Synthetic Oligonucleotide; IFNG exon 3; Set A
aaaggagacaauuuggcucugcauuau

SEQ ID NO: 8369 - RNA, 31 nt, Artificial Sequence
  Synthetic Oligonucleotide; IFNG exon 3; Set A
uaaaaggagacaauuuggcucugcauuauuu

SEQ ID NO: 8370 - RNA, 29 nt, Artificial Sequence
  Synthetic Oligonucleotide; IFNG exon 3; Set A
aaaaggagacaauuuggcucugcauuauu

SEQ ID NO: 8371 - RNA, 33 nt, Artificial Sequence
  Synthetic Oligonucleotide; IFNG exon 3; Set A
guaaaaggagacaauuuggcucugcauuauuuu

SEQ ID NO: 8372 - RNA, 26 nt, Artificial Sequence
  Synthetic Oligonucleotide; IFNG exon 3; Set A
aaaggagacaauuuggcucugcauua

SEQ ID NO: 8373 - RNA, 30 nt, Artificial Sequence
  Synthetic Oligonucleotide; IFNG exon 3; Set A
uaaaaggagacaauuuggcucugcauuauu

SEQ ID NO: 8374 - RNA, 28 nt, Artificial Sequence
  Synthetic Oligonucleotide; IFNG exon 3; Set C
aaaaggagacaauuuggcucugcauuau

SEQ ID NO: 8375 - RNA, 32 nt, Artificial Sequence
  Synthetic Oligonucleotide; IFNG exon 3; Set A
guaaaaggagacaauuuggcucugcauuauuu

SEQ ID NO: 8376 - RNA, 34 nt, Artificial Sequence
  Synthetic Oligonucleotide; IFNG exon 3; Set A
aguaaaaggagacaauuuggcucugcauuauuuu

SEQ ID NO: 8377 - RNA, 29 nt, Artificial Sequence
  Synthetic Oligonucleotide; IFNG exon 3; Set A
uaaaaggagacaauuuggcucugcauuau

SEQ ID NO: 8378 - RNA, 27 nt, Artificial Sequence
  Synthetic Oligonucleotide; IFNG exon 3; Set C
aaaaggagacaauuuggcucugcauua

SEQ ID NO: 8379 - RNA, 31 nt, Artificial Sequence
  Synthetic Oligonucleotide; IFNG exon 3; Set A
guaaaaggagacaauuuggcucugcauuauu

SEQ ID NO: 8380 - RNA, 25 nt, Artificial Sequence
  Synthetic Oligonucleotide; IFNG exon 3; Set C
aaaggagacaauuuggcucugcauu

SEQ ID NO: 8381 - RNA, 28 nt, Artificial Sequence
  Synthetic Oligonucleotide; IFNG exon 3; Set A
uaaaaggagacaauuuggcucugcauua

SEQ ID NO: 8382 - RNA, 30 nt, Artificial Sequence
  Synthetic Oligonucleotide; IFNG exon 3; Set A
guaaaaggagacaauuuggcucugcauuau

SEQ ID NO: 8383 - RNA, 36 nt, Artificial Sequence
  Synthetic Oligonucleotide; IFNG exon 3; Set A
gaaguaaaaggagacaauuuggcucugcauuauuuu

SEQ ID NO: 8384 - RNA, 26 nt, Artificial Sequence
  Synthetic Oligonucleotide; IFNG exon 3; Set C
aaaaggagacaauuuggcucugcauu

SEQ ID NO: 8385 - RNA, 38 nt, Artificial Sequence
  Synthetic Oligonucleotide; IFNG exon 3; Set A
ugaaguaaaaggagacaauuuggcucugcauuauuuuu

SEQ ID NO: 8386 - RNA, 37 nt, Artificial Sequence
  Synthetic Oligonucleotide; IFNG exon 3; Set A
ugaaguaaaaggagacaauuuggcucugcauuauuuu

SEQ ID NO: 8387 - RNA, 29 nt, Artificial Sequence
  Synthetic Oligonucleotide; IFNG exon 3; Set A
guaaaaggagacaauuuggcucugcauua

SEQ ID NO: 8388 - RNA, 27 nt, Artificial Sequence
  Synthetic Oligonucleotide; IFNG exon 3; Set C
uaaaaggagacaauuuggcucugcauu

SEQ ID NO: 8389 - RNA, 39 nt, Artificial Sequence
  Synthetic Oligonucleotide; IFNG exon 3; Set A
uugaaguaaaaggagacaauuuggcucugcauuauuuuu

SEQ ID NO: 8390 - RNA, 36 nt, Artificial Sequence
  Synthetic Oligonucleotide; IFNG exon 3; Set A
ugaaguaaaaggagacaauuuggcucugcauuauuu

SEQ ID NO: 8391 - RNA, 40 nt, Artificial Sequence
  Synthetic Oligonucleotide; IFNG exon 3; Set A
uuugaaguaaaaggagacaauuuggcucugcauuauuuuu

SEQ ID NO: 8392 - RNA, 35 nt, Artificial Sequence
  Synthetic Oligonucleotide; IFNG exon 3; Set A
ugaaguaaaaggagacaauuuggcucugcauuauu

SEQ ID NO: 8393 - RNA, 34 nt, Artificial Sequence
  Synthetic Oligonucleotide; IFNG exon 3; Set A
ugaaguaaaaggagacaauuuggcucugcauuau

SEQ ID NO: 8394 - RNA, 35 nt, Artificial Sequence
  Synthetic Oligonucleotide; IFNG exon 3; Set A
uugaaguaaaaggagacaauuuggcucugcauuau

SEQ ID NO: 8395 - RNA, 33 nt, Artificial Sequence
  Synthetic Oligonucleotide; IFNG exon 3; Set A
ugaaguaaaaggagacaauuuggcucugcauua

SEQ ID NO: 8396 - RNA, 34 nt, Artificial Sequence
  Synthetic Oligonucleotide; IFNG exon 3; Set A
uugaaguaaaaggagacaauuuggcucugcauua

SEQ ID NO: 8397 - RNA, 32 nt, Artificial Sequence
  Synthetic Oligonucleotide; IFNG exon 3; Set A
ugaaguaaaaggagacaauuuggcucugcauu

SEQ ID NO: 8398 - RNA, 33 nt, Artificial Sequence
  Synthetic Oligonucleotide; IFNG exon 3; Set A
uugaaguaaaaggagacaauuuggcucugcauu

SEQ ID NO: 8399 - RNA, 40 nt, Artificial Sequence
  Synthetic Oligonucleotide; IFNG exon 3; Set A
aaguuugaaguaaaaggagacaauuuggcucugcauuauu

SEQ ID NO: 8400 - RNA, 39 nt, Artificial Sequence
  Synthetic Oligonucleotide; IFNG exon 3; Set A
aaguuugaaguaaaaggagacaauuuggcucugcauuau

SEQ ID NO: 8401 - RNA, 15 nt, Artificial Sequence
  Synthetic Oligonucleotide; IFNG exon 3; Set C
aaaggagacaauuug

SEQ ID NO: 8402 - RNA, 38 nt, Artificial Sequence
  Synthetic Oligonucleotide; IFNG exon 3; Set A
aaguuugaaguaaaaggagacaauuuggcucugcauua

SEQ ID NO: 8403 - RNA, 40 nt, Artificial Sequence
  Synthetic Oligonucleotide; IFNG exon 3; Set A
aaaguuugaaguaaaaggagacaauuuggcucugcauuau

SEQ ID NO: 8404 - RNA, 36 nt, Artificial Sequence
  Synthetic Oligonucleotide; IFNG exon 3; Set A
aguuugaaguaaaaggagacaauuuggcucugcauu

SEQ ID NO: 8405 - RNA, 16 nt, Artificial Sequence
  Synthetic Oligonucleotide; IFNG exon 3; Set C
aaaaggagacaauuug

SEQ ID NO: 8406 - RNA, 39 nt, Artificial Sequence
  Synthetic Oligonucleotide; IFNG exon 3; Set A
aaaguuugaaguaaaaggagacaauuuggcucugcauua

SEQ ID NO: 8407 - RNA, 37 nt, Artificial Sequence
  Synthetic Oligonucleotide; IFNG exon 3; Set A
aaguuugaaguaaaaggagacaauuuggcucugcauu

SEQ ID NO: 8408 - RNA, 15 nt, Artificial Sequence
  Synthetic Oligonucleotide; IFNG exon 3; Set C
aaaaggagacaauuu

SEQ ID NO: 8409 - RNA, 17 nt, Artificial Sequence
  Synthetic Oligonucleotide; IFNG exon 3; Set C
uaaaaggagacaauuug

SEQ ID NO: 8410 - RNA, 40 nt, Artificial Sequence
  Synthetic Oligonucleotide; IFNG exon 3; Set A
aaaaguuugaaguaaaaggagacaauuuggcucugcauua

SEQ ID NO: 8411 - RNA, 38 nt, Artificial Sequence
  Synthetic Oligonucleotide; IFNG exon 3; Set A
aaaguuugaaguaaaaggagacaauuuggcucugcauu

SEQ ID NO: 8412 - RNA, 16 nt, Artificial Sequence
  Synthetic Oligonucleotide; IFNG exon 3; Set C
uaaaaggagacaauuu

SEQ ID NO: 8413 - RNA, 18 nt, Artificial Sequence
  Synthetic Oligonucleotide; IFNG exon 3; Set C
guaaaaggagacaauuug

SEQ ID NO: 8414 - RNA, 39 nt, Artificial Sequence
  Synthetic Oligonucleotide; IFNG exon 3; Set A
aaaaguuugaaguaaaaggagacaauuuggcucugcauu

SEQ ID NO: 8415 - RNA, 17 nt, Artificial Sequence
  Synthetic Oligonucleotide; IFNG exon 3; Set C
guaaaaggagacaauuu

SEQ ID NO: 8416 - RNA, 15 nt, Artificial Sequence
  Synthetic Oligonucleotide; IFNG exon 3; Set C
uaaaaggagacaauu

SEQ ID NO: 8417 - RNA, 19 nt, Artificial Sequence
  Synthetic Oligonucleotide; IFNG exon 3; Set C
aguaaaaggagacaauuug

SEQ ID NO: 8418 - RNA, 40 nt, Artificial Sequence
  Synthetic Oligonucleotide; IFNG exon 3; Set A
aaaaaguuugaaguaaaaggagacaauuuggcucugcauu

SEQ ID NO: 8419 - RNA, 18 nt, Artificial Sequence
  Synthetic Oligonucleotide; IFNG exon 3; Set C
aguaaaaggagacaauuu

SEQ ID NO: 8420 - RNA, 16 nt, Artificial Sequence
  Synthetic Oligonucleotide; IFNG exon 3; Set C
guaaaaggagacaauu

SEQ ID NO: 8421 - RNA, 19 nt, Artificial Sequence
  Synthetic Oligonucleotide; IFNG exon 3; Set C
aaguaaaaggagacaauuu

SEQ ID NO: 8422 - RNA, 17 nt, Artificial Sequence
  Synthetic Oligonucleotide; IFNG exon 3; Set C
aguaaaaggagacaauu

SEQ ID NO: 8423 - RNA, 21 nt, Artificial Sequence
  Synthetic Oligonucleotide; IFNG exon 3; Set C
gaaguaaaaggagacaauuug

SEQ ID NO: 8424 - RNA, 20 nt, Artificial Sequence
  Synthetic Oligonucleotide; IFNG exon 3; Set C
gaaguaaaaggagacaauuu

SEQ ID NO: 8425 - RNA, 18 nt, Artificial Sequence
  Synthetic Oligonucleotide; IFNG exon 3; Set C
aaguaaaaggagacaauu

SEQ ID NO: 8426 - RNA, 22 nt, Artificial Sequence
  Synthetic Oligonucleotide; IFNG exon 3; Set C
ugaaguaaaaggagacaauuug

SEQ ID NO: 8427 - RNA, 24 nt, Artificial Sequence
  Synthetic Oligonucleotide; IFNG exon 3; Set C
uugaaguaaaaggagacaauuugg

SEQ ID NO: 8428 - RNA, 21 nt, Artificial Sequence
  Synthetic Oligonucleotide; IFNG exon 3; Set C
ugaaguaaaaggagacaauuu

SEQ ID NO: 8429 - RNA, 19 nt, Artificial Sequence
  Synthetic Oligonucleotide; IFNG exon 3; Set C
gaaguaaaaggagacaauu

SEQ ID NO: 8430 - RNA, 25 nt, Artificial Sequence
  Synthetic Oligonucleotide; IFNG exon 3; Set C
uuugaaguaaaaggagacaauuugg

SEQ ID NO: 8431 - RNA, 20 nt, Artificial Sequence
  Synthetic Oligonucleotide; IFNG exon 3; Set C
ugaaguaaaaggagacaauu

SEQ ID NO: 8432 - RNA, 26 nt, Artificial Sequence
  Synthetic Oligonucleotide; IFNG exon 3; Set C
guuugaaguaaaaggagacaauuugg

SEQ ID NO: 8433 - RNA, 27 nt, Artificial Sequence
  Synthetic Oligonucleotide; IFNG exon 3; Set C
aguuugaaguaaaaggagacaauuugg

SEQ ID NO: 8434 - RNA, 28 nt, Artificial Sequence
  Synthetic Oligonucleotide; IFNG exon 3; Set C
aaguuugaaguaaaaggagacaauuugg

SEQ ID NO: 8435 - RNA, 28 nt, Artificial Sequence
  Synthetic Oligonucleotide; IFNG exon 3; Set C
aaaguuugaaguaaaaggagacaauuug

SEQ ID NO: 8436 - RNA, 27 nt, Artificial Sequence
  Synthetic Oligonucleotide; IFNG exon 3; Set C
aaaguuugaaguaaaaggagacaauuu

SEQ ID NO: 8437 - RNA, 29 nt, Artificial Sequence
  Synthetic Oligonucleotide; IFNG exon 3; Set C
aaaaguuugaaguaaaaggagacaauuug

SEQ ID NO: 8438 - RNA, 28 nt, Artificial Sequence
  Synthetic Oligonucleotide; IFNG exon 3; Set C
aaaaguuugaaguaaaaggagacaauuu

SEQ ID NO: 8439 - RNA, 26 nt, Artificial Sequence
  Synthetic Oligonucleotide; IFNG exon 3; Set C
aaaguuugaaguaaaaggagacaauu

SEQ ID NO: 8440 - RNA, 30 nt, Artificial Sequence
  Synthetic Oligonucleotide; IFNG exon 3; Set C
aaaaaguuugaaguaaaaggagacaauuug

SEQ ID NO: 8441 - RNA, 32 nt, Artificial Sequence
  Synthetic Oligonucleotide; IFNG exon 3; Set C
uaaaaaguuugaaguaaaaggagacaauuugg

SEQ ID NO: 8442 - RNA, 29 nt, Artificial Sequence
  Synthetic Oligonucleotide; IFNG exon 3; Set C
aaaaaguuugaaguaaaaggagacaauuu

SEQ ID NO: 8443 - RNA, 27 nt, Artificial Sequence
  Synthetic Oligonucleotide; IFNG exon 3; Set C
aaaaguuugaaguaaaaggagacaauu

SEQ ID NO: 8444 - RNA, 33 nt, Artificial Sequence
  Synthetic Oligonucleotide; IFNG exon 3; Set C
uuaaaaaguuugaaguaaaaggagacaauuugg

SEQ ID NO: 8445 - RNA, 28 nt, Artificial Sequence
  Synthetic Oligonucleotide; IFNG exon 3; Set C
aaaaaguuugaaguaaaaggagacaauu

SEQ ID NO: 8446 - RNA, 34 nt, Artificial Sequence
  Synthetic Oligonucleotide; IFNG exon 3; Set C
uuuaaaaaguuugaaguaaaaggagacaauuugg

SEQ ID NO: 8447 - RNA, 35 nt, Artificial Sequence
  Synthetic Oligonucleotide; IFNG exon 3; Set C
uuuuaaaaaguuugaaguaaaaggagacaauuugg

SEQ ID NO: 8448 - RNA, 36 nt, Artificial Sequence
  Synthetic Oligonucleotide; IFNG exon 3; Set C
uuuuuaaaaaguuugaaguaaaaggagacaauuugg

SEQ ID NO: 8449 - RNA, 17 nt, Artificial Sequence
  Synthetic Oligonucleotide; IFNG exon 3; Set C
aaguuugaaguaaaagg

SEQ ID NO: 8450 - RNA, 16 nt, Artificial Sequence
  Synthetic Oligonucleotide; IFNG exon 3; Set C
aaguuugaaguaaaag

SEQ ID NO: 8451 - RNA, 18 nt, Artificial Sequence
  Synthetic Oligonucleotide; IFNG exon 3; Set C
aaaguuugaaguaaaagg

SEQ ID NO: 8452 - RNA, 17 nt, Artificial Sequence
  Synthetic Oligonucleotide; IFNG exon 3; Set C
aaaguuugaaguaaaag

SEQ ID NO: 8453 - RNA, 19 nt, Artificial Sequence
  Synthetic Oligonucleotide; IFNG exon 3; Set C
aaaaguuugaaguaaaagg

SEQ ID NO: 8454 - RNA, 18 nt, Artificial Sequence
  Synthetic Oligonucleotide; IFNG exon 3; Set C
aaaaguuugaaguaaaag

SEQ ID NO: 8455 - RNA, 20 nt, Artificial Sequence
  Synthetic Oligonucleotide; IFNG exon 3; Set C
aaaaaguuugaaguaaaagg

SEQ ID NO: 8456 - RNA, 15 nt, Artificial Sequence
  Synthetic Oligonucleotide; IFNG exon 3; Set C
aaaguuugaaguaaa

SEQ ID NO: 8457 - RNA, 19 nt, Artificial Sequence
  Synthetic Oligonucleotide; IFNG exon 3; Set C
aaaaaguuugaaguaaaag

SEQ ID NO: 8458 - RNA, 21 nt, Artificial Sequence
  Synthetic Oligonucleotide; IFNG exon 3; Set C
uaaaaaguuugaaguaaaagg

SEQ ID NO: 8459 - RNA, 16 nt, Artificial Sequence
  Synthetic Oligonucleotide; IFNG exon 3; Set C
aaaaguuugaaguaaa

SEQ ID NO: 8460 - RNA, 22 nt, Artificial Sequence
  Synthetic Oligonucleotide; IFNG exon 3; Set C
uuaaaaaguuugaaguaaaagg

SEQ ID NO: 8461 - RNA, 15 nt, Artificial Sequence
  Synthetic Oligonucleotide; IFNG exon 3; Set C
aaaaguuugaaguaa

SEQ ID NO: 8462 - RNA, 17 nt, Artificial Sequence
  Synthetic Oligonucleotide; IFNG exon 3; Set C
aaaaaguuugaaguaaa

SEQ ID NO: 8463 - RNA, 23 nt, Artificial Sequence
  Synthetic Oligonucleotide; IFNG exon 3; Set C
uuuaaaaaguuugaaguaaaagg

SEQ ID NO: 8464 - RNA, 16 nt, Artificial Sequence
  Synthetic Oligonucleotide; IFNG exon 3; Set C
aaaaaguuugaaguaa

SEQ ID NO: 8465 - RNA, 15 nt, Artificial Sequence
  Synthetic Oligonucleotide; IFNG exon 3; Set C
aaaaaguuugaagua

SEQ ID NO: 8466 - RNA, 15 nt, Artificial Sequence
  Synthetic Oligonucleotide; IFNG exon 3; Set C
uaaaaaguuugaagu

SEQ ID NO: 8467 - RNA, 24 nt, Artificial Sequence
  Synthetic Oligonucleotide; IFNG exon 3; Set C
guuuuuaaaaaguuugaaguaaaa

SEQ ID NO: 8468 - RNA, 16 nt, Artificial Sequence
  Synthetic Oligonucleotide; IFNG exon 3; Set C
uuaaaaaguuugaagu

SEQ ID NO: 8469 - RNA, 17 nt, Artificial Sequence
  Synthetic Oligonucleotide; IFNG exon 3; Set C
uuuaaaaaguuugaagu

SEQ ID NO: 8470 - RNA, 15 nt, Artificial Sequence
  Synthetic Oligonucleotide; IFNG exon 3; Set C
uuaaaaaguuugaag

SEQ ID NO: 8471 - RNA, 16 nt, Artificial Sequence
  Synthetic Oligonucleotide; IFNG exon 3; Set C
uuuaaaaaguuugaag

SEQ ID NO: 8472 - RNA, 15 nt, Artificial Sequence
  Synthetic Oligonucleotide; IFNG exon 3; Set C
uuuaaaaaguuugaa

SEQ ID NO: 8473 - RNA, 17 nt, Artificial Sequence
  Synthetic Oligonucleotide; IFNG exon 3; Set C
uuuuaaaaaguuugaag

SEQ ID NO: 8474 - RNA, 16 nt, Artificial Sequence
  Synthetic Oligonucleotide; IFNG exon 3; Set C
uuuuaaaaaguuugaa

SEQ ID NO: 8475 - RNA, 18 nt, Artificial Sequence
  Synthetic Oligonucleotide; IFNG exon 3; Set C
uuuuuaaaaaguuugaag

SEQ ID NO: 8476 - RNA, 17 nt, Artificial Sequence
  Synthetic Oligonucleotide; IFNG exon 3; Set C
uuuuuaaaaaguuugaa

SEQ ID NO: 8477 - RNA, 16 nt, Artificial Sequence
  Synthetic Oligonucleotide; IFNG exon 3; Set C
guuuuuaaaaaguuug

SEQ ID NO: 8478 - RNA, 15 nt, Artificial Sequence
  Synthetic Oligonucleotide; IFNG exon 3; Set C
guuuuuaaaaaguuu

SEQ ID NO: 8479 - RNA, 35 nt, Artificial Sequence
  Synthetic Oligonucleotide; IFNG exon 3; Set C
ucaucuuuaaaguuuuuaaaaaguuugaaguaaaa

SEQ ID NO: 8480 - RNA, 36 nt, Artificial Sequence
  Synthetic Oligonucleotide; IFNG exon 3; Set C
gucaucuuuaaaguuuuuaaaaaguuugaaguaaaa

SEQ ID NO: 8481 - RNA, 34 nt, Artificial Sequence
  Synthetic Oligonucleotide; IFNG exon 3; Set C
ucaucuuuaaaguuuuuaaaaaguuugaaguaaa

SEQ ID NO: 8482 - RNA, 37 nt, Artificial Sequence
  Synthetic Oligonucleotide; IFNG exon 3; Set C
ggucaucuuuaaaguuuuuaaaaaguuugaaguaaaa

SEQ ID NO: 8483 - RNA, 33 nt, Artificial Sequence
  Synthetic Oligonucleotide; IFNG exon 3; Set C
ucaucuuuaaaguuuuuaaaaaguuugaaguaa

SEQ ID NO: 8484 - RNA, 35 nt, Artificial Sequence
  Synthetic Oligonucleotide; IFNG exon 3; Set C
gucaucuuuaaaguuuuuaaaaaguuugaaguaaa

SEQ ID NO: 8485 - RNA, 34 nt, Artificial Sequence
  Synthetic Oligonucleotide; IFNG exon 3; Set C
gucaucuuuaaaguuuuuaaaaaguuugaaguaa

SEQ ID NO: 8486 - RNA, 36 nt, Artificial Sequence
  Synthetic Oligonucleotide; IFNG exon 3; Set C
ggucaucuuuaaaguuuuuaaaaaguuugaaguaaa

SEQ ID NO: 8487 - RNA, 35 nt, Artificial Sequence
  Synthetic Oligonucleotide; IFNG exon 3; Set C
ggucaucuuuaaaguuuuuaaaaaguuugaaguaa

SEQ ID NO: 8488 - RNA, 27 nt, Artificial Sequence
  Synthetic Oligonucleotide; IFNG exon 3; Set C
ucaucuuuaaaguuuuuaaaaaguuug

SEQ ID NO: 8489 - RNA, 26 nt, Artificial Sequence
  Synthetic Oligonucleotide; IFNG exon 3; Set C
ucaucuuuaaaguuuuuaaaaaguuu

SEQ ID NO: 8490 - RNA, 28 nt, Artificial Sequence
  Synthetic Oligonucleotide; IFNG exon 3; Set C
gucaucuuuaaaguuuuuaaaaaguuug

SEQ ID NO: 8491 - RNA, 30 nt, Artificial Sequence
  Synthetic Oligonucleotide; IFNG exon 3; Set C
ggucaucuuuaaaguuuuuaaaaaguuuga

SEQ ID NO: 8492 - RNA, 27 nt, Artificial Sequence
  Synthetic Oligonucleotide; IFNG exon 3; Set C
gucaucuuuaaaguuuuuaaaaaguuu

SEQ ID NO: 8493 - RNA, 25 nt, Artificial Sequence
  Synthetic Oligonucleotide; IFNG exon 3; Set C
ucaucuuuaaaguuuuuaaaaaguu

SEQ ID NO: 8494 - RNA, 29 nt, Artificial Sequence
  Synthetic Oligonucleotide; IFNG exon 3; Set C
ggucaucuuuaaaguuuuuaaaaaguuug

SEQ ID NO: 8495 - RNA, 28 nt, Artificial Sequence
  Synthetic Oligonucleotide; IFNG exon 3; Set C
ggucaucuuuaaaguuuuuaaaaaguuu

SEQ ID NO: 8496 - RNA, 26 nt, Artificial Sequence
  Synthetic Oligonucleotide; IFNG exon 3; Set C
gucaucuuuaaaguuuuuaaaaaguu

SEQ ID NO: 8497 - RNA, 24 nt, Artificial Sequence
  Synthetic Oligonucleotide; IFNG exon 3; Set C
ucaucuuuaaaguuuuuaaaaagu

SEQ ID NO: 8498 - RNA, 27 nt, Artificial Sequence
  Synthetic Oligonucleotide; IFNG exon 3; Set C
ggucaucuuuaaaguuuuuaaaaaguu

SEQ ID NO: 8499 - RNA, 25 nt, Artificial Sequence
  Synthetic Oligonucleotide; IFNG exon 3; Set C
gucaucuuuaaaguuuuuaaaaagu

SEQ ID NO: 8500 - RNA, 26 nt, Artificial Sequence
  Synthetic Oligonucleotide; IFNG exon 3; Set C
ggucaucuuuaaaguuuuuaaaaagu

SEQ ID NO: 8501 - RNA, 40 nt, Artificial Sequence
  Synthetic Oligonucleotide; IFNG exon 3; Set A
uuggaugcucuggucaucuuuaaaguuuuuaaaaaguuug

SEQ ID NO: 8502 - RNA, 39 nt, Artificial Sequence
  Synthetic Oligonucleotide; IFNG exon 3; Set A
uuggaugcucuggucaucuuuaaaguuuuuaaaaaguuu

SEQ ID NO: 8503 - RNA, 38 nt, Artificial Sequence
  Synthetic Oligonucleotide; IFNG exon 3; Set A
uuggaugcucuggucaucuuuaaaguuuuuaaaaaguu

SEQ ID NO: 8504 - RNA, 40 nt, Artificial Sequence
  Synthetic Oligonucleotide; IFNG exon 3; Set A
uuuggaugcucuggucaucuuuaaaguuuuuaaaaaguuu

SEQ ID NO: 8505 - RNA, 39 nt, Artificial Sequence
  Synthetic Oligonucleotide; IFNG exon 3; Set A
uuuggaugcucuggucaucuuuaaaguuuuuaaaaaguu

SEQ ID NO: 8506 - RNA, 37 nt, Artificial Sequence
  Synthetic Oligonucleotide; IFNG exon 3; Set A
uuggaugcucuggucaucuuuaaaguuuuuaaaaagu

SEQ ID NO: 8507 - RNA, 40 nt, Artificial Sequence
  Synthetic Oligonucleotide; IFNG exon 3; Set A
uuuuggaugcucuggucaucuuuaaaguuuuuaaaaaguu

SEQ ID NO: 8508 - RNA, 38 nt, Artificial Sequence
  Synthetic Oligonucleotide; IFNG exon 3; Set A
uuuggaugcucuggucaucuuuaaaguuuuuaaaaagu

SEQ ID NO: 8509 - RNA, 36 nt, Artificial Sequence
  Synthetic Oligonucleotide; IFNG exon 3; Set C
uuggaugcucuggucaucuuuaaaguuuuuaaaaag

SEQ ID NO: 8510 - RNA, 39 nt, Artificial Sequence
  Synthetic Oligonucleotide; IFNG exon 3; Set A
uuuuggaugcucuggucaucuuuaaaguuuuuaaaaagu

SEQ ID NO: 8511 - RNA, 37 nt, Artificial Sequence
  Synthetic Oligonucleotide; IFNG exon 3; Set A
uuuggaugcucuggucaucuuuaaaguuuuuaaaaag

SEQ ID NO: 8512 - RNA, 38 nt, Artificial Sequence
  Synthetic Oligonucleotide; IFNG exon 3; Set A
uuuuggaugcucuggucaucuuuaaaguuuuuaaaaag

SEQ ID NO: 8513 - RNA, 32 nt, Artificial Sequence
  Synthetic Oligonucleotide; IFNG exon 3; Set A
uuggaugcucuggucaucuuuaaaguuuuuaa

SEQ ID NO: 8514 - RNA, 31 nt, Artificial Sequence
  Synthetic Oligonucleotide; IFNG exon 3; Set A
uuggaugcucuggucaucuuuaaaguuuuua

SEQ ID NO: 8515 - RNA, 33 nt, Artificial Sequence
  Synthetic Oligonucleotide; IFNG exon 3; Set A
uuuggaugcucuggucaucuuuaaaguuuuuaa

SEQ ID NO: 8516 - RNA, 30 nt, Artificial Sequence
  Synthetic Oligonucleotide; IFNG exon 3; Set A
uuggaugcucuggucaucuuuaaaguuuuu

SEQ ID NO: 8517 - RNA, 34 nt, Artificial Sequence
  Synthetic Oligonucleotide; IFNG exon 3; Set A
uuuuggaugcucuggucaucuuuaaaguuuuuaa

SEQ ID NO: 8518 - RNA, 32 nt, Artificial Sequence
  Synthetic Oligonucleotide; IFNG exon 3; Set A
uuuggaugcucuggucaucuuuaaaguuuuua

SEQ ID NO: 8519 - RNA, 29 nt, Artificial Sequence
  Synthetic Oligonucleotide; IFNG exon 3; Set A
uuggaugcucuggucaucuuuaaaguuuu

SEQ ID NO: 8520 - RNA, 31 nt, Artificial Sequence
  Synthetic Oligonucleotide; IFNG exon 3; Set A
uuuggaugcucuggucaucuuuaaaguuuuu

SEQ ID NO: 8521 - RNA, 33 nt, Artificial Sequence
  Synthetic Oligonucleotide; IFNG exon 3; Set A
uuuuggaugcucuggucaucuuuaaaguuuuua

SEQ ID NO: 8522 - RNA, 28 nt, Artificial Sequence
  Synthetic Oligonucleotide; IFNG exon 3; Set A
uuggaugcucuggucaucuuuaaaguuu

SEQ ID NO: 8523 - RNA, 30 nt, Artificial Sequence
  Synthetic Oligonucleotide; IFNG exon 3; Set A
uuuggaugcucuggucaucuuuaaaguuuu

SEQ ID NO: 8524 - RNA, 32 nt, Artificial Sequence
  Synthetic Oligonucleotide; IFNG exon 3; Set A
uuuuggaugcucuggucaucuuuaaaguuuuu

SEQ ID NO: 8525 - RNA, 29 nt, Artificial Sequence
  Synthetic Oligonucleotide; IFNG exon 3; Set A
uuuggaugcucuggucaucuuuaaaguuu

SEQ ID NO: 8526 - RNA, 31 nt, Artificial Sequence
  Synthetic Oligonucleotide; IFNG exon 3; Set A
uuuuggaugcucuggucaucuuuaaaguuuu

SEQ ID NO: 8527 - RNA, 30 nt, Artificial Sequence
  Synthetic Oligonucleotide; IFNG exon 3; Set A
uuuuggaugcucuggucaucuuuaaaguuu

SEQ ID NO: 8528 - RNA, 21 nt, Artificial Sequence
  Synthetic Oligonucleotide; IFNG exon 3; Set C
cauucaugucuuccuugaugg

SEQ ID NO: 8529 - RNA, 23 nt, Artificial Sequence
  Synthetic Oligonucleotide; IFNG exon 3; Set C
acauucaugucuuccuugauggu

SEQ ID NO: 8530 - RNA, 18 nt, Artificial Sequence
  Synthetic Oligonucleotide; IFNG exon 3; Set C
auucaugucuuccuugau

SEQ ID NO: 8531 - RNA, 22 nt, Artificial Sequence
  Synthetic Oligonucleotide; IFNG exon 3; Set C
acauucaugucuuccuugaugg

SEQ ID NO: 8532 - RNA, 19 nt, Artificial Sequence
  Synthetic Oligonucleotide; IFNG exon 3; Set C
cauucaugucuuccuugau

SEQ ID NO: 8533 - RNA, 17 nt, Artificial Sequence
  Synthetic Oligonucleotide; IFNG exon 3; Set C
auucaugucuuccuuga

SEQ ID NO: 8534 - RNA, 21 nt, Artificial Sequence
  Synthetic Oligonucleotide; IFNG exon 3; Set C
acauucaugucuuccuugaug

SEQ ID NO: 8535 - RNA, 20 nt, Artificial Sequence
  Synthetic Oligonucleotide; IFNG exon 3; Set C
acauucaugucuuccuugau

SEQ ID NO: 8536 - RNA, 18 nt, Artificial Sequence
  Synthetic Oligonucleotide; IFNG exon 3; Set C
cauucaugucuuccuuga

SEQ ID NO: 8537 - RNA, 19 nt, Artificial Sequence
  Synthetic Oligonucleotide; IFNG exon 3; Set C
acauucaugucuuccuuga

SEQ ID NO: 8538 - RNA, 18 nt, Artificial Sequence
  Synthetic Oligonucleotide; IFNG exon 3; Set C
acauucaugucuuccuug

SEQ ID NO: 8539 - RNA, 36 nt, Artificial Sequence
  Synthetic Oligonucleotide; IFNG exon 3; Set A
auugaaaaacuugacauucaugucuuccuugauggu

SEQ ID NO: 8540 - RNA, 35 nt, Artificial Sequence
  Synthetic Oligonucleotide; IFNG exon 3; Set A
auugaaaaacuugacauucaugucuuccuugaugg

SEQ ID NO: 8541 - RNA, 37 nt, Artificial Sequence
  Synthetic Oligonucleotide; IFNG exon 3; Set A
uauugaaaaacuugacauucaugucuuccuugauggu

SEQ ID NO: 8542 - RNA, 34 nt, Artificial Sequence
  Synthetic Oligonucleotide; IFNG exon 3; Set A
auugaaaaacuugacauucaugucuuccuugaug

SEQ ID NO: 8543 - RNA, 36 nt, Artificial Sequence
  Synthetic Oligonucleotide; IFNG exon 3; Set A
uauugaaaaacuugacauucaugucuuccuugaugg

SEQ ID NO: 8544 - RNA, 33 nt, Artificial Sequence
  Synthetic Oligonucleotide; IFNG exon 3; Set A
auugaaaaacuugacauucaugucuuccuugau

SEQ ID NO: 8545 - RNA, 35 nt, Artificial Sequence
  Synthetic Oligonucleotide; IFNG exon 3; Set A
uauugaaaaacuugacauucaugucuuccuugaug

SEQ ID NO: 8546 - RNA, 34 nt, Artificial Sequence
  Synthetic Oligonucleotide; IFNG exon 3; Set A
uauugaaaaacuugacauucaugucuuccuugau

SEQ ID NO: 8547 - RNA, 32 nt, Artificial Sequence
  Synthetic Oligonucleotide; IFNG exon 3; Set A
auugaaaaacuugacauucaugucuuccuuga

SEQ ID NO: 8548 - RNA, 31 nt, Artificial Sequence
  Synthetic Oligonucleotide; IFNG exon 3; Set C
auugaaaaacuugacauucaugucuuccuug

SEQ ID NO: 8549 - RNA, 33 nt, Artificial Sequence
  Synthetic Oligonucleotide; IFNG exon 3; Set A
uauugaaaaacuugacauucaugucuuccuuga

SEQ ID NO: 8550 - RNA, 32 nt, Artificial Sequence
  Synthetic Oligonucleotide; IFNG exon 3; Set C
uauugaaaaacuugacauucaugucuuccuug

SEQ ID NO: 8551 - RNA, 40 nt, Artificial Sequence
  Synthetic Oligonucleotide; IFNG exon 3; Set A
guugcuauugaaaaacuugacauucaugucuuccuugaug

SEQ ID NO: 8552 - RNA, 39 nt, Artificial Sequence
  Synthetic Oligonucleotide; IFNG exon 3; Set A
guugcuauugaaaaacuugacauucaugucuuccuugau

SEQ ID NO: 8553 - RNA, 40 nt, Artificial Sequence
  Synthetic Oligonucleotide; IFNG exon 3; Set A
uguugcuauugaaaaacuugacauucaugucuuccuugau

SEQ ID NO: 8554 - RNA, 38 nt, Artificial Sequence
  Synthetic Oligonucleotide; IFNG exon 3; Set A
guugcuauugaaaaacuugacauucaugucuuccuuga

SEQ ID NO: 8555 - RNA, 39 nt, Artificial Sequence
  Synthetic Oligonucleotide; IFNG exon 3; Set A
uguugcuauugaaaaacuugacauucaugucuuccuuga

SEQ ID NO: 8556 - RNA, 37 nt, Artificial Sequence
  Synthetic Oligonucleotide; IFNG exon 3; Set A
guugcuauugaaaaacuugacauucaugucuuccuug

SEQ ID NO: 8557 - RNA, 40 nt, Artificial Sequence
  Synthetic Oligonucleotide; IFNG exon 3; Set A
uuguugcuauugaaaaacuugacauucaugucuuccuuga

SEQ ID NO: 8558 - RNA, 38 nt, Artificial Sequence
  Synthetic Oligonucleotide; IFNG exon 3; Set A
uguugcuauugaaaaacuugacauucaugucuuccuug

SEQ ID NO: 8559 - RNA, 39 nt, Artificial Sequence
  Synthetic Oligonucleotide; IFNG exon 3; Set A
uuguugcuauugaaaaacuugacauucaugucuuccuug

SEQ ID NO: 8560 - RNA, 40 nt, Artificial Sequence
  Synthetic Oligonucleotide; IFNG exon 3; Set A
uuuguugcuauugaaaaacuugacauucaugucuuccuug

SEQ ID NO: 8561 - RNA, 18 nt, Artificial Sequence
  Synthetic Oligonucleotide; IFNG exon 3; Set C
auugaaaaacuugacauu

SEQ ID NO: 8562 - RNA, 19 nt, Artificial Sequence
  Synthetic Oligonucleotide; IFNG exon 3; Set C
uauugaaaaacuugacauu

SEQ ID NO: 8563 - RNA, 17 nt, Artificial Sequence
  Synthetic Oligonucleotide; IFNG exon 3; Set C
auugaaaaacuugacau

SEQ ID NO: 8564 - RNA, 16 nt, Artificial Sequence
  Synthetic Oligonucleotide; IFNG exon 3; Set C
auugaaaaacuugaca

SEQ ID NO: 8565 - RNA, 18 nt, Artificial Sequence
  Synthetic Oligonucleotide; IFNG exon 3; Set C
uauugaaaaacuugacau

SEQ ID NO: 8566 - RNA, 17 nt, Artificial Sequence
  Synthetic Oligonucleotide; IFNG exon 3; Set C
uauugaaaaacuugaca

SEQ ID NO: 8567 - RNA, 24 nt, Artificial Sequence
  Synthetic Oligonucleotide; IFNG exon 3; Set C
guugcuauugaaaaacuugacauu

SEQ ID NO: 8568 - RNA, 23 nt, Artificial Sequence
  Synthetic Oligonucleotide; IFNG exon 3; Set C
guugcuauugaaaaacuugacau

SEQ ID NO: 8569 - RNA, 24 nt, Artificial Sequence
  Synthetic Oligonucleotide; IFNG exon 3; Set C
uguugcuauugaaaaacuugacau

SEQ ID NO: 8570 - RNA, 22 nt, Artificial Sequence
  Synthetic Oligonucleotide; IFNG exon 3; Set C
guugcuauugaaaaacuugaca

SEQ ID NO: 8571 - RNA, 23 nt, Artificial Sequence
  Synthetic Oligonucleotide; IFNG exon 3; Set C
uguugcuauugaaaaacuugaca

SEQ ID NO: 8572 - RNA, 24 nt, Artificial Sequence
  Synthetic Oligonucleotide; IFNG exon 3; Set C
uuguugcuauugaaaaacuugaca

SEQ ID NO: 8573 - RNA, 26 nt, Artificial Sequence
  Synthetic Oligonucleotide; IFNG exon 3; Set C
uuuguugcuauugaaaaacuugacau

SEQ ID NO: 8574 - RNA, 29 nt, Artificial Sequence
  Synthetic Oligonucleotide; IFNG exon 3; Set C
uuuuuguugcuauugaaaaacuugacauu

SEQ ID NO: 8575 - RNA, 25 nt, Artificial Sequence
  Synthetic Oligonucleotide; IFNG exon 3; Set C
uuuguugcuauugaaaaacuugaca

SEQ ID NO: 8576 - RNA, 26 nt, Artificial Sequence
  Synthetic Oligonucleotide; IFNG exon 3; Set C
uuuuguugcuauugaaaaacuugaca

SEQ ID NO: 8577 - RNA, 28 nt, Artificial Sequence
  Synthetic Oligonucleotide; IFNG exon 3; Set C
uuuuuguugcuauugaaaaacuugacau

SEQ ID NO: 8578 - RNA, 27 nt, Artificial Sequence
  Synthetic Oligonucleotide; IFNG exon 3; Set C
uuuuuguugcuauugaaaaacuugaca

SEQ ID NO: 8579 - RNA, 33 nt, Artificial Sequence
  Synthetic Oligonucleotide; IFNG exon 3; Set C
uuucuuuuuguugcuauugaaaaacuugacauu

SEQ ID NO: 8580 - RNA, 34 nt, Artificial Sequence
  Synthetic Oligonucleotide; IFNG exon 3; Set C
guuucuuuuuguugcuauugaaaaacuugacauu

SEQ ID NO: 8581 - RNA, 32 nt, Artificial Sequence
  Synthetic Oligonucleotide; IFNG exon 3; Set C
uuucuuuuuguugcuauugaaaaacuugacau

SEQ ID NO: 8582 - RNA, 35 nt, Artificial Sequence
  Synthetic Oligonucleotide; IFNG exon 3; Set A
cguuucuuuuuguugcuauugaaaaacuugacauu

SEQ ID NO: 8583 - RNA, 33 nt, Artificial Sequence
  Synthetic Oligonucleotide; IFNG exon 3; Set C
guuucuuuuuguugcuauugaaaaacuugacau

SEQ ID NO: 8584 - RNA, 31 nt, Artificial Sequence
  Synthetic Oligonucleotide; IFNG exon 3; Set C
uuucuuuuuguugcuauugaaaaacuugaca

SEQ ID NO: 8585 - RNA, 34 nt, Artificial Sequence
  Synthetic Oligonucleotide; IFNG exon 3; Set A
cguuucuuuuuguugcuauugaaaaacuugacau

SEQ ID NO: 8586 - RNA, 32 nt, Artificial Sequence
  Synthetic Oligonucleotide; IFNG exon 3; Set C
guuucuuuuuguugcuauugaaaaacuugaca

SEQ ID NO: 8587 - RNA, 33 nt, Artificial Sequence
  Synthetic Oligonucleotide; IFNG exon 3; Set A
cguuucuuuuuguugcuauugaaaaacuugaca

SEQ ID NO: 8588 - RNA, 40 nt, Artificial Sequence
  Synthetic Oligonucleotide; IFNG exon 3; Set A
ucaucucguuucuuuuuguugcuauugaaaaacuugacau

SEQ ID NO: 8589 - RNA, 39 nt, Artificial Sequence
  Synthetic Oligonucleotide; IFNG exon 3; Set A
ucaucucguuucuuuuuguugcuauugaaaaacuugaca

SEQ ID NO: 8590 - RNA, 40 nt, Artificial Sequence
  Synthetic Oligonucleotide; IFNG exon 3; Set A
gucaucucguuucuuuuuguugcuauugaaaaacuugaca

SEQ ID NO: 8591 - RNA, 16 nt, Artificial Sequence
  Synthetic Oligonucleotide; IFNG exon 3; Set C
cuuuuuguugcuauug

SEQ ID NO: 8592 - RNA, 17 nt, Artificial Sequence
  Synthetic Oligonucleotide; IFNG exon 3; Set C
ucuuuuuguugcuauug

SEQ ID NO: 8593 - RNA, 18 nt, Artificial Sequence
  Synthetic Oligonucleotide; IFNG exon 3; Set C
uucuuuuuguugcuauug

SEQ ID NO: 8594 - RNA, 17 nt, Artificial Sequence
  Synthetic Oligonucleotide; IFNG exon 3; Set C
uucuuuuuguugcuauu

SEQ ID NO: 8595 - RNA, 16 nt, Artificial Sequence
  Synthetic Oligonucleotide; IFNG exon 3; Set C
uucuuuuuguugcuau

SEQ ID NO: 8596 - RNA, 22 nt, Artificial Sequence
  Synthetic Oligonucleotide; IFNG exon 3; Set C
ucguuucuuuuuguugcuauug

SEQ ID NO: 8597 - RNA, 16 nt, Artificial Sequence
  Synthetic Oligonucleotide; IFNG exon 3; Set C
uuucuuuuuguugcua

SEQ ID NO: 8598 - RNA, 21 nt, Artificial Sequence
  Synthetic Oligonucleotide; IFNG exon 3; Set C
ucguuucuuuuuguugcuauu

SEQ ID NO: 8599 - RNA, 17 nt, Artificial Sequence
  Synthetic Oligonucleotide; IFNG exon 3; Set C
guuucuuuuuguugcua

SEQ ID NO: 8600 - RNA, 15 nt, Artificial Sequence
  Synthetic Oligonucleotide; IFNG exon 3; Set C
uuucuuuuuguugcu

SEQ ID NO: 8601 - RNA, 22 nt, Artificial Sequence
  Synthetic Oligonucleotide; IFNG exon 3; Set C
cucguuucuuuuuguugcuauu

SEQ ID NO: 8602 - RNA, 20 nt, Artificial Sequence
  Synthetic Oligonucleotide; IFNG exon 3; Set C
ucguuucuuuuuguugcuau

SEQ ID NO: 8603 - RNA, 16 nt, Artificial Sequence
  Synthetic Oligonucleotide; IFNG exon 3; Set C
guuucuuuuuguugcu

SEQ ID NO: 8604 - RNA, 21 nt, Artificial Sequence
  Synthetic Oligonucleotide; IFNG exon 3; Set C
cucguuucuuuuuguugcuau

SEQ ID NO: 8605 - RNA, 15 nt, Artificial Sequence
  Synthetic Oligonucleotide; IFNG exon 3; Set C
guuucuuuuuguugc

SEQ ID NO: 8606 - RNA, 26 nt, Artificial Sequence
  Synthetic Oligonucleotide; IFNG exon 3; Set C
caucucguuucuuuuuguugcuauug

SEQ ID NO: 8607 - RNA, 25 nt, Artificial Sequence
  Synthetic Oligonucleotide; IFNG exon 3; Set C
caucucguuucuuuuuguugcuauu

SEQ ID NO: 8608 - RNA, 24 nt, Artificial Sequence
  Synthetic Oligonucleotide; IFNG exon 3; Set C
caucucguuucuuuuuguugcuau

SEQ ID NO: 8609 - RNA, 15 nt, Artificial Sequence
  Synthetic Oligonucleotide; IFNG exon 3; Set C
ucguuucuuuuuguu

SEQ ID NO: 8610 - RNA, 16 nt, Artificial Sequence
  Synthetic Oligonucleotide; IFNG exon 3; Set C
cucguuucuuuuuguu

SEQ ID NO: 8611 - RNA, 15 nt, Artificial Sequence
  Synthetic Oligonucleotide; IFNG exon 3; Set C
cucguuucuuuuugu

SEQ ID NO: 8612 - RNA, 23 nt, Artificial Sequence
  Synthetic Oligonucleotide; IFNG exon 3; Set C
ucaucucguuucuuuuuguugcu

SEQ ID NO: 8613 - RNA, 22 nt, Artificial Sequence
  Synthetic Oligonucleotide; IFNG exon 3; Set C
ucaucucguuucuuuuuguugc

SEQ ID NO: 8614 - RNA, 24 nt, Artificial Sequence
  Synthetic Oligonucleotide; IFNG exon 3; Set C
gucaucucguuucuuuuuguugcu

SEQ ID NO: 8615 - RNA, 19 nt, Artificial Sequence
  Synthetic Oligonucleotide; IFNG exon 3; Set C
caucucguuucuuuuuguu

SEQ ID NO: 8616 - RNA, 33 nt, Artificial Sequence
  Synthetic Oligonucleotide; IFNG exon 3; Set A
ucgaagucaucucguuucuuuuuguugcuauug

SEQ ID NO: 8617 - RNA, 21 nt, Artificial Sequence
  Synthetic Oligonucleotide; IFNG exon 3; Set C
ucaucucguuucuuuuuguug

SEQ ID NO: 8618 - RNA, 23 nt, Artificial Sequence
  Synthetic Oligonucleotide; IFNG exon 3; Set C
gucaucucguuucuuuuuguugc

SEQ ID NO: 8619 - RNA, 18 nt, Artificial Sequence
  Synthetic Oligonucleotide; IFNG exon 3; Set C
caucucguuucuuuuugu

SEQ ID NO: 8620 - RNA, 22 nt, Artificial Sequence
  Synthetic Oligonucleotide; IFNG exon 3; Set C
gucaucucguuucuuuuuguug

SEQ ID NO: 8621 - RNA, 17 nt, Artificial Sequence
  Synthetic Oligonucleotide; IFNG exon 3; Set C
caucucguuucuuuuug

SEQ ID NO: 8622 - RNA, 16 nt, Artificial Sequence
  Synthetic Oligonucleotide; IFNG exon 3; Set C
caucucguuucuuuuu

SEQ ID NO: 8623 - RNA, 30 nt, Artificial Sequence
  Synthetic Oligonucleotide; IFNG exon 3; Set A
ucgaagucaucucguuucuuuuuguugcua

SEQ ID NO: 8624 - RNA, 15 nt, Artificial Sequence
  Synthetic Oligonucleotide; IFNG exon 3; Set C
caucucguuucuuuu

SEQ ID NO: 8625 - RNA, 29 nt, Artificial Sequence
  Synthetic Oligonucleotide; IFNG exon 3; Set A
ucgaagucaucucguuucuuuuuguugcu

SEQ ID NO: 8626 - RNA, 30 nt, Artificial Sequence
  Synthetic Oligonucleotide; IFNG exon 3; Set A
uucgaagucaucucguuucuuuuuguugcu

SEQ ID NO: 8627 - RNA, 28 nt, Artificial Sequence
  Synthetic Oligonucleotide; IFNG exon 3; Set A
ucgaagucaucucguuucuuuuuguugc

SEQ ID NO: 8628 - RNA, 27 nt, Artificial Sequence
  Synthetic Oligonucleotide; IFNG exon 3; Set C
ucgaagucaucucguuucuuuuuguug

SEQ ID NO: 8629 - RNA, 29 nt, Artificial Sequence
  Synthetic Oligonucleotide; IFNG exon 3; Set A
uucgaagucaucucguuucuuuuuguugc

SEQ ID NO: 8630 - RNA, 31 nt, Artificial Sequence
  Synthetic Oligonucleotide; IFNG exon 3; Set A
uuucgaagucaucucguuucuuuuuguugcu

SEQ ID NO: 8631 - RNA, 26 nt, Artificial Sequence
  Synthetic Oligonucleotide; IFNG exon 3; Set C
ucgaagucaucucguuucuuuuuguu

SEQ ID NO: 8632 - RNA, 30 nt, Artificial Sequence
  Synthetic Oligonucleotide; IFNG exon 3; Set A
uuucgaagucaucucguuucuuuuuguugc

SEQ ID NO: 8633 - RNA, 32 nt, Artificial Sequence
  Synthetic Oligonucleotide; IFNG exon 3; Set A
uuuucgaagucaucucguuucuuuuuguugcu

SEQ ID NO: 8634 - RNA, 31 nt, Artificial Sequence
  Synthetic Oligonucleotide; IFNG exon 3; Set A
uuuucgaagucaucucguuucuuuuuguugc

SEQ ID NO: 8635 - RNA, 15 nt, Artificial Sequence
  Synthetic Oligonucleotide; IFNG exon 3; Set C
gucaucucguuucuu

SEQ ID NO: 8636 - RNA, 23 nt, Artificial Sequence
  Synthetic Oligonucleotide; IFNG exon 3; Set C
ucgaagucaucucguuucuuuuu

SEQ ID NO: 8637 - RNA, 40 nt, Artificial Sequence
  Synthetic Oligonucleotide; IFNG exon 3; Set C
gucagcuuuucgaagucaucucguuucuuuuuguugcuau

SEQ ID NO: 8638 - RNA, 22 nt, Artificial Sequence
  Synthetic Oligonucleotide; IFNG exon 3; Set C
ucgaagucaucucguuucuuuu

SEQ ID NO: 8639 - RNA, 21 nt, Artificial Sequence
  Synthetic Oligonucleotide; IFNG exon 3; Set C
ucgaagucaucucguuucuuu

SEQ ID NO: 8640 - RNA, 21 nt, Artificial Sequence
  Synthetic Oligonucleotide; IFNG exon 3; Set C
uucgaagucaucucguuucuu

SEQ ID NO: 8641 - RNA, 40 nt, Artificial Sequence
  Synthetic Oligonucleotide; IFNG exon 3; Set C
uagucagcuuuucgaagucaucucguuucuuuuuguugcu

SEQ ID NO: 8642 - RNA, 22 nt, Artificial Sequence
  Synthetic Oligonucleotide; IFNG exon 3; Set C
uuucgaagucaucucguuucuu

SEQ ID NO: 8643 - RNA, 20 nt, Artificial Sequence
  Synthetic Oligonucleotide; IFNG exon 3; Set C
uucgaagucaucucguuucu

SEQ ID NO: 8644 - RNA, 35 nt, Artificial Sequence
  Synthetic Oligonucleotide; IFNG exon 3; Set B
gucagcuuuucgaagucaucucguuucuuuuuguu

SEQ ID NO: 8645 - RNA, 39 nt, Artificial Sequence
  Synthetic Oligonucleotide; IFNG exon 3; Set C
uagucagcuuuucgaagucaucucguuucuuuuuguugc

SEQ ID NO: 8646 - RNA, 23 nt, Artificial Sequence
  Synthetic Oligonucleotide; IFNG exon 3; Set C
uuuucgaagucaucucguuucuu

SEQ ID NO: 8647 - RNA, 21 nt, Artificial Sequence
  Synthetic Oligonucleotide; IFNG exon 3; Set C
uuucgaagucaucucguuucu

SEQ ID NO: 8648 - RNA, 19 nt, Artificial Sequence
  Synthetic Oligonucleotide; IFNG exon 3; Set C
uucgaagucaucucguuuc

SEQ ID NO: 8649 - RNA, 34 nt, Artificial Sequence
  Synthetic Oligonucleotide; IFNG exon 3; Set B
gucagcuuuucgaagucaucucguuucuuuuugu

SEQ ID NO: 8650 - RNA, 36 nt, Artificial Sequence
  Synthetic Oligonucleotide; IFNG exon 3; Set B
agucagcuuuucgaagucaucucguuucuuuuuguu

SEQ ID NO: 8651 - RNA, 16 nt, Artificial Sequence
  Synthetic Oligonucleotide; IFNG exon 3; Set C
ucgaagucaucucguu

SEQ ID NO: 8652 - RNA, 18 nt, Artificial Sequence
  Synthetic Oligonucleotide; IFNG exon 3; Set C
uucgaagucaucucguuu

SEQ ID NO: 8653 - RNA, 38 nt, Artificial Sequence
  Synthetic Oligonucleotide; IFNG exon 3; Set A
uagucagcuuuucgaagucaucucguuucuuuuuguug

SEQ ID NO: 8654 - RNA, 40 nt, Artificial Sequence
  Synthetic Oligonucleotide; IFNG exon 3; Set C
uuagucagcuuuucgaagucaucucguuucuuuuuguugc

SEQ ID NO: 8655 - RNA, 22 nt, Artificial Sequence
  Synthetic Oligonucleotide; IFNG exon 3; Set C
uuuucgaagucaucucguuucu

SEQ ID NO: 8656 - RNA, 20 nt, Artificial Sequence
  Synthetic Oligonucleotide; IFNG exon 3; Set C
uuucgaagucaucucguuuc

SEQ ID NO: 8657 - RNA, 33 nt, Artificial Sequence
  Synthetic Oligonucleotide; IFNG exon 3; Set B
gucagcuuuucgaagucaucucguuucuuuuug

SEQ ID NO: 8658 - RNA, 35 nt, Artificial Sequence
  Synthetic Oligonucleotide; IFNG exon 3; Set B
agucagcuuuucgaagucaucucguuucuuuuugu

SEQ ID NO: 8659 - RNA, 15 nt, Artificial Sequence
  Synthetic Oligonucleotide; IFNG exon 3; Set C
ucgaagucaucucgu

SEQ ID NO: 8660 - RNA, 19 nt, Artificial Sequence
  Synthetic Oligonucleotide; IFNG exon 3; Set C
uuucgaagucaucucguuu

SEQ ID NO: 8661 - RNA, 39 nt, Artificial Sequence
  Synthetic Oligonucleotide; IFNG exon 3; Set A
uuagucagcuuuucgaagucaucucguuucuuuuuguug

SEQ ID NO: 8662 - RNA, 21 nt, Artificial Sequence
  Synthetic Oligonucleotide; IFNG exon 3; Set C
uuuucgaagucaucucguuuc

SEQ ID NO: 8663 - RNA, 34 nt, Artificial Sequence
  Synthetic Oligonucleotide; IFNG exon 3; Set B
agucagcuuuucgaagucaucucguuucuuuuug

SEQ ID NO: 8664 - RNA, 32 nt, Artificial Sequence
  Synthetic Oligonucleotide; IFNG exon 3; Set B
gucagcuuuucgaagucaucucguuucuuuuu

SEQ ID NO: 8665 - RNA, 20 nt, Artificial Sequence
  Synthetic Oligonucleotide; IFNG exon 3; Set C
uuuucgaagucaucucguuu

SEQ ID NO: 8666 - RNA, 33 nt, Artificial Sequence
  Synthetic Oligonucleotide; IFNG exon 3; Set B
agucagcuuuucgaagucaucucguuucuuuuu

SEQ ID NO: 8667 - RNA, 15 nt, Artificial Sequence
  Synthetic Oligonucleotide; IFNG exon 3; Set C
uucgaagucaucucg

SEQ ID NO: 8668 - RNA, 32 nt, Artificial Sequence
  Synthetic Oligonucleotide; IFNG exon 3; Set B
agucagcuuuucgaagucaucucguuucuuuu

SEQ ID NO: 8669 - RNA, 16 nt, Artificial Sequence
  Synthetic Oligonucleotide; IFNG exon 3; Set C
uuucgaagucaucucg

SEQ ID NO: 8670 - RNA, 31 nt, Artificial Sequence
  Synthetic Oligonucleotide; IFNG exon 3; Set B
agucagcuuuucgaagucaucucguuucuuu

SEQ ID NO: 8671 - RNA, 17 nt, Artificial Sequence
  Synthetic Oligonucleotide; IFNG exon 3; Set C
uuuucgaagucaucucg

SEQ ID NO: 8672 - RNA, 31 nt, Artificial Sequence
  Synthetic Oligonucleotide; IFNG exon 3; Set B
uagucagcuuuucgaagucaucucguuucuu

SEQ ID NO: 8673 - RNA, 32 nt, Artificial Sequence
  Synthetic Oligonucleotide; IFNG exon 3; Set B
uuagucagcuuuucgaagucaucucguuucuu

SEQ ID NO: 8674 - RNA, 30 nt, Artificial Sequence
  Synthetic Oligonucleotide; IFNG exon 3; Set B
uagucagcuuuucgaagucaucucguuucu

SEQ ID NO: 8675 - RNA, 33 nt, Artificial Sequence
  Synthetic Oligonucleotide; IFNG exon 3; Set B
auuagucagcuuuucgaagucaucucguuucuu

SEQ ID NO: 8676 - RNA, 31 nt, Artificial Sequence
  Synthetic Oligonucleotide; IFNG exon 3; Set B
uuagucagcuuuucgaagucaucucguuucu

SEQ ID NO: 8677 - RNA, 29 nt, Artificial Sequence
  Synthetic Oligonucleotide; IFNG exon 3; Set B
uagucagcuuuucgaagucaucucguuuc

SEQ ID NO: 8678 - RNA, 28 nt, Artificial Sequence
  Synthetic Oligonucleotide; IFNG exon 3; Set B
uagucagcuuuucgaagucaucucguuu

SEQ ID NO: 8679 - RNA, 34 nt, Artificial Sequence
  Synthetic Oligonucleotide; IFNG exon 3; Set B
aauuagucagcuuuucgaagucaucucguuucuu

SEQ ID NO: 8680 - RNA, 32 nt, Artificial Sequence
  Synthetic Oligonucleotide; IFNG exon 3; Set B
auuagucagcuuuucgaagucaucucguuucu

SEQ ID NO: 8681 - RNA, 30 nt, Artificial Sequence
  Synthetic Oligonucleotide; IFNG exon 3; Set B
uuagucagcuuuucgaagucaucucguuuc

SEQ ID NO: 8682 - RNA, 27 nt, Artificial Sequence
  Synthetic Oligonucleotide; IFNG exon 3; Set B
uagucagcuuuucgaagucaucucguu

SEQ ID NO: 8683 - RNA, 29 nt, Artificial Sequence
  Synthetic Oligonucleotide; IFNG exon 3; Set B
uuagucagcuuuucgaagucaucucguuu

SEQ ID NO: 8684 - RNA, 35 nt, Artificial Sequence
  Synthetic Oligonucleotide; IFNG exon 3; Set B
uaauuagucagcuuuucgaagucaucucguuucuu

SEQ ID NO: 8685 - RNA, 33 nt, Artificial Sequence
  Synthetic Oligonucleotide; IFNG exon 3; Set B
aauuagucagcuuuucgaagucaucucguuucu

SEQ ID NO: 8686 - RNA, 31 nt, Artificial Sequence
  Synthetic Oligonucleotide; IFNG exon 3; Set B
auuagucagcuuuucgaagucaucucguuuc

SEQ ID NO: 8687 - RNA, 40 nt, Artificial Sequence
  Synthetic Oligonucleotide; IFNG exon 3; Set B
gaauaauuagucagcuuuucgaagucaucucguuucuuuu

SEQ ID NO: 8688 - RNA, 28 nt, Artificial Sequence
  Synthetic Oligonucleotide; IFNG exon 3; Set B
uuagucagcuuuucgaagucaucucguu

SEQ ID NO: 8689 - RNA, 30 nt, Artificial Sequence
  Synthetic Oligonucleotide; IFNG exon 3; Set B
auuagucagcuuuucgaagucaucucguuu

SEQ ID NO: 8690 - RNA, 36 nt, Artificial Sequence
  Synthetic Oligonucleotide; IFNG exon 3; Set B
auaauuagucagcuuuucgaagucaucucguuucuu

SEQ ID NO: 8691 - RNA, 34 nt, Artificial Sequence
  Synthetic Oligonucleotide; IFNG exon 3; Set B
uaauuagucagcuuuucgaagucaucucguuucu

SEQ ID NO: 8692 - RNA, 32 nt, Artificial Sequence
  Synthetic Oligonucleotide; IFNG exon 3; Set B
aauuagucagcuuuucgaagucaucucguuuc

SEQ ID NO: 8693 - RNA, 39 nt, Artificial Sequence
  Synthetic Oligonucleotide; IFNG exon 3; Set B
gaauaauuagucagcuuuucgaagucaucucguuucuuu

SEQ ID NO: 8694 - RNA, 31 nt, Artificial Sequence
  Synthetic Oligonucleotide; IFNG exon 3; Set B
aauuagucagcuuuucgaagucaucucguuu

SEQ ID NO: 8695 - RNA, 35 nt, Artificial Sequence
  Synthetic Oligonucleotide; IFNG exon 3; Set B
auaauuagucagcuuuucgaagucaucucguuucu

SEQ ID NO: 8696 - RNA, 33 nt, Artificial Sequence
  Synthetic Oligonucleotide; IFNG exon 3; Set B
uaauuagucagcuuuucgaagucaucucguuuc

SEQ ID NO: 8697 - RNA, 32 nt, Artificial Sequence
  Synthetic Oligonucleotide; IFNG exon 3; Set B
uaauuagucagcuuuucgaagucaucucguuu

SEQ ID NO: 8698 - RNA, 34 nt, Artificial Sequence
  Synthetic Oligonucleotide; IFNG exon 3; Set B
auaauuagucagcuuuucgaagucaucucguuuc

SEQ ID NO: 8699 - RNA, 26 nt, Artificial Sequence
  Synthetic Oligonucleotide; IFNG exon 3; Set B
uuagucagcuuuucgaagucaucucg

SEQ ID NO: 8700 - RNA, 27 nt, Artificial Sequence
  Synthetic Oligonucleotide; IFNG exon 3; Set B
auuagucagcuuuucgaagucaucucg

SEQ ID NO: 8701 - RNA, 34 nt, Artificial Sequence
  Synthetic Oligonucleotide; IFNG exon 3; Set B
aauaauuagucagcuuuucgaagucaucucguuu

SEQ ID NO: 8702 - RNA, 28 nt, Artificial Sequence
  Synthetic Oligonucleotide; IFNG exon 3; Set B
aauuagucagcuuuucgaagucaucucg

SEQ ID NO: 8703 - RNA, 33 nt, Artificial Sequence
  Synthetic Oligonucleotide; IFNG exon 3; Set B
aauaauuagucagcuuuucgaagucaucucguu

SEQ ID NO: 8704 - RNA, 35 nt, Artificial Sequence
  Synthetic Oligonucleotide; IFNG exon 3; Set B
gaauaauuagucagcuuuucgaagucaucucguuu

SEQ ID NO: 8705 - RNA, 29 nt, Artificial Sequence
  Synthetic Oligonucleotide; IFNG exon 3; Set B
uaauuagucagcuuuucgaagucaucucg

SEQ ID NO: 8706 - RNA, 32 nt, Artificial Sequence
  Synthetic Oligonucleotide; IFNG exon 3; Set B
aauaauuagucagcuuuucgaagucaucucgu

SEQ ID NO: 8707 - RNA, 34 nt, Artificial Sequence
  Synthetic Oligonucleotide; IFNG exon 3; Set B
gaauaauuagucagcuuuucgaagucaucucguu

SEQ ID NO: 8708 - RNA, 30 nt, Artificial Sequence
  Synthetic Oligonucleotide; IFNG exon 3; Set B
auaauuagucagcuuuucgaagucaucucg

SEQ ID NO: 8709 - RNA, 33 nt, Artificial Sequence
  Synthetic Oligonucleotide; IFNG exon 3; Set B
gaauaauuagucagcuuuucgaagucaucucgu

SEQ ID NO: 8710 - RNA, 23 nt, Artificial Sequence
  Synthetic Oligonucleotide; IFNG exon 3; Set C
auuagucagcuuuucgaagucau

SEQ ID NO: 8711 - RNA, 24 nt, Artificial Sequence
  Synthetic Oligonucleotide; IFNG exon 3; Set C
aauuagucagcuuuucgaagucau

SEQ ID NO: 8712 - RNA, 25 nt, Artificial Sequence
  Synthetic Oligonucleotide; IFNG exon 3; Set C
uaauuagucagcuuuucgaagucau

SEQ ID NO: 8713 - RNA, 26 nt, Artificial Sequence
  Synthetic Oligonucleotide; IFNG exon 3; Set C
auaauuagucagcuuuucgaagucau

SEQ ID NO: 8714 - RNA, 26 nt, Artificial Sequence
  Synthetic Oligonucleotide; IFNG exon 3; Set C
aauaauuagucagcuuuucgaaguca

SEQ ID NO: 8715 - RNA, 27 nt, Artificial Sequence
  Synthetic Oligonucleotide; IFNG exon 3; Set C
gaauaauuagucagcuuuucgaaguca

SEQ ID NO: 8716 - RNA, 25 nt, Artificial Sequence
  Synthetic Oligonucleotide; IFNG exon 3; Set C
aauaauuagucagcuuuucgaaguc

SEQ ID NO: 8717 - RNA, 15 nt, Artificial Sequence
  Synthetic Oligonucleotide; IFNG exon 3; Set C
uuagucagcuuuucg

SEQ ID NO: 8718 - RNA, 26 nt, Artificial Sequence
  Synthetic Oligonucleotide; IFNG exon 3; Set C
gaauaauuagucagcuuuucgaaguc

SEQ ID NO: 8719 - RNA, 16 nt, Artificial Sequence
  Synthetic Oligonucleotide; IFNG exon 3; Set C
auuagucagcuuuucg

SEQ ID NO: 8720 - RNA, 17 nt, Artificial Sequence
  Synthetic Oligonucleotide; IFNG exon 3; Set C
aauuagucagcuuuucg

SEQ ID NO: 8721 - RNA, 20 nt, Artificial Sequence
  Synthetic Oligonucleotide; IFNG exon 3; Set C
aauaauuagucagcuuuucg

SEQ ID NO: 8722 - RNA, 21 nt, Artificial Sequence
  Synthetic Oligonucleotide; IFNG exon 3; Set C
gaauaauuagucagcuuuucg

SEQ ID NO: 8723 - RNA, 19 nt, Artificial Sequence
  Synthetic Oligonucleotide; IFNG exon 3; Set C
gaauaauuagucagcuuuu

SEQ ID NO: 8724 - RNA, 18 nt, Artificial Sequence
  Synthetic Oligonucleotide; IFNG exon 3; Set C
gaauaauuagucagcuuu

SEQ ID NO: 8725 - RNA, 37 nt, Artificial Sequence
  Synthetic Oligonucleotide; IFNG exon 3; Set C
uagccucaccgaauaauuagucagcuuuucgaaguca

SEQ ID NO: 8726 - RNA, 36 nt, Artificial Sequence
  Synthetic Oligonucleotide; IFNG exon 3; Set C
uagccucaccgaauaauuagucagcuuuucgaaguc

SEQ ID NO: 8727 - RNA, 40 nt, Artificial Sequence
  Synthetic Oligonucleotide; IFNG exon 3; Set B
uaaauagccucaccgaauaauuagucagcuuuucgaaguc

SEQ ID NO: 8728 - RNA, 31 nt, Artificial Sequence
  Synthetic Oligonucleotide; IFNG exon 3; Set B
uagccucaccgaauaauuagucagcuuuucg

SEQ ID NO: 8729 - RNA, 30 nt, Artificial Sequence
  Synthetic Oligonucleotide; IFNG exon 3; Set B
uagccucaccgaauaauuagucagcuuuuc

SEQ ID NO: 8730 - RNA, 29 nt, Artificial Sequence
  Synthetic Oligonucleotide; IFNG exon 3; Set B
uagccucaccgaauaauuagucagcuuuu

SEQ ID NO: 8731 - RNA, 28 nt, Artificial Sequence
  Synthetic Oligonucleotide; IFNG exon 3; Set B
uagccucaccgaauaauuagucagcuuu

SEQ ID NO: 8732 - RNA, 33 nt, Artificial Sequence
  Synthetic Oligonucleotide; IFNG exon 3; Set B
aaauagccucaccgaauaauuagucagcuuuuc

SEQ ID NO: 8733 - RNA, 34 nt, Artificial Sequence
  Synthetic Oligonucleotide; IFNG exon 3; Set B
uaaauagccucaccgaauaauuagucagcuuuuc

SEQ ID NO: 8734 - RNA, 32 nt, Artificial Sequence
  Synthetic Oligonucleotide; IFNG exon 3; Set B
aaauagccucaccgaauaauuagucagcuuuu

SEQ ID NO: 8735 - RNA, 36 nt, Artificial Sequence
  Synthetic Oligonucleotide; IFNG exon 3; Set B
uuaaauagccucaccgaauaauuagucagcuuuucg

SEQ ID NO: 8736 - RNA, 33 nt, Artificial Sequence
  Synthetic Oligonucleotide; IFNG exon 3; Set B
uaaauagccucaccgaauaauuagucagcuuuu

SEQ ID NO: 8737 - RNA, 31 nt, Artificial Sequence
  Synthetic Oligonucleotide; IFNG exon 3; Set B
aaauagccucaccgaauaauuagucagcuuu

SEQ ID NO: 8738 - RNA, 37 nt, Artificial Sequence
  Synthetic Oligonucleotide; IFNG exon 3; Set B
uuuaaauagccucaccgaauaauuagucagcuuuucg

SEQ ID NO: 8739 - RNA, 32 nt, Artificial Sequence
  Synthetic Oligonucleotide; IFNG exon 3; Set B
uaaauagccucaccgaauaauuagucagcuuu

SEQ ID NO: 8740 - RNA, 38 nt, Artificial Sequence
  Synthetic Oligonucleotide; IFNG exon 3; Set B
auuuaaauagccucaccgaauaauuagucagcuuuucg

SEQ ID NO: 8741 - RNA, 39 nt, Artificial Sequence
  Synthetic Oligonucleotide; IFNG exon 3; Set B
aauuuaaauagccucaccgaauaauuagucagcuuuucg

SEQ ID NO: 8742 - RNA, 39 nt, Artificial Sequence
  Synthetic Oligonucleotide; IFNG exon 3; Set B
gaauuuaaauagccucaccgaauaauuagucagcuuuuc

SEQ ID NO: 8743 - RNA, 40 nt, Artificial Sequence
  Synthetic Oligonucleotide; IFNG exon 3; Set B
agaauuuaaauagccucaccgaauaauuagucagcuuuuc

SEQ ID NO: 8744 - RNA, 38 nt, Artificial Sequence
  Synthetic Oligonucleotide; IFNG exon 3; Set B
gaauuuaaauagccucaccgaauaauuagucagcuuuu

SEQ ID NO: 8745 - RNA, 39 nt, Artificial Sequence
  Synthetic Oligonucleotide; IFNG exon 3; Set B
agaauuuaaauagccucaccgaauaauuagucagcuuuu

SEQ ID NO: 8746 - RNA, 37 nt, Artificial Sequence
  Synthetic Oligonucleotide; IFNG exon 3; Set B
gaauuuaaauagccucaccgaauaauuagucagcuuu

SEQ ID NO: 8747 - RNA, 22 nt, Artificial Sequence
  Synthetic Oligonucleotide; IFNG exon 3; Set C
aauagccucaccgaauaauuag

SEQ ID NO: 8748 - RNA, 40 nt, Artificial Sequence
  Synthetic Oligonucleotide; IFNG exon 3; Set B
aagaauuuaaauagccucaccgaauaauuagucagcuuuu

SEQ ID NO: 8749 - RNA, 38 nt, Artificial Sequence
  Synthetic Oligonucleotide; IFNG exon 3; Set B
agaauuuaaauagccucaccgaauaauuagucagcuuu

SEQ ID NO: 8750 - RNA, 21 nt, Artificial Sequence
  Synthetic Oligonucleotide; IFNG exon 3; Set C
aauagccucaccgaauaauua

SEQ ID NO: 8751 - RNA, 23 nt, Artificial Sequence
  Synthetic Oligonucleotide; IFNG exon 3; Set C
aaauagccucaccgaauaauuag

SEQ ID NO: 8752 - RNA, 39 nt, Artificial Sequence
  Synthetic Oligonucleotide; IFNG exon 3; Set B
aagaauuuaaauagccucaccgaauaauuagucagcuuu

SEQ ID NO: 8753 - RNA, 27 nt, Artificial Sequence
  Synthetic Oligonucleotide; IFNG exon 3; Set C
uuaaauagccucaccgaauaauuaguc

SEQ ID NO: 8754 - RNA, 16 nt, Artificial Sequence
  Synthetic Oligonucleotide; IFNG exon 3; Set C
uagccucaccgaauaa

SEQ ID NO: 8755 - RNA, 20 nt, Artificial Sequence
  Synthetic Oligonucleotide; IFNG exon 3; Set C
aauagccucaccgaauaauu

SEQ ID NO: 8756 - RNA, 22 nt, Artificial Sequence
  Synthetic Oligonucleotide; IFNG exon 3; Set C
aaauagccucaccgaauaauua

SEQ ID NO: 8757 - RNA, 24 nt, Artificial Sequence
  Synthetic Oligonucleotide; IFNG exon 3; Set C
uaaauagccucaccgaauaauuag

SEQ ID NO: 8758 - RNA, 40 nt, Artificial Sequence
  Synthetic Oligonucleotide; IFNG exon 3; Set B
aaagaauuuaaauagccucaccgaauaauuagucagcuuu

SEQ ID NO: 8759 - RNA, 26 nt, Artificial Sequence
  Synthetic Oligonucleotide; IFNG exon 3; Set C
uuaaauagccucaccgaauaauuagu

SEQ ID NO: 8760 - RNA, 28 nt, Artificial Sequence
  Synthetic Oligonucleotide; IFNG exon 3; Set C
uuuaaauagccucaccgaauaauuaguc

SEQ ID NO: 8761 - RNA, 15 nt, Artificial Sequence
  Synthetic Oligonucleotide; IFNG exon 3; Set C
uagccucaccgaaua

SEQ ID NO: 8762 - RNA, 21 nt, Artificial Sequence
  Synthetic Oligonucleotide; IFNG exon 3; Set C
aaauagccucaccgaauaauu

SEQ ID NO: 8763 - RNA, 19 nt, Artificial Sequence
  Synthetic Oligonucleotide; IFNG exon 3; Set C
aauagccucaccgaauaau

SEQ ID NO: 8764 - RNA, 23 nt, Artificial Sequence
  Synthetic Oligonucleotide; IFNG exon 3; Set C
uaaauagccucaccgaauaauua

SEQ ID NO: 8765 - RNA, 27 nt, Artificial Sequence
  Synthetic Oligonucleotide; IFNG exon 3; Set C
uuuaaauagccucaccgaauaauuagu

SEQ ID NO: 8766 - RNA, 29 nt, Artificial Sequence
  Synthetic Oligonucleotide; IFNG exon 3; Set C
auuuaaauagccucaccgaauaauuaguc

SEQ ID NO: 8767 - RNA, 22 nt, Artificial Sequence
  Synthetic Oligonucleotide; IFNG exon 3; Set C
uaaauagccucaccgaauaauu

SEQ ID NO: 8768 - RNA, 20 nt, Artificial Sequence
  Synthetic Oligonucleotide; IFNG exon 3; Set C
aaauagccucaccgaauaau

SEQ ID NO: 8769 - RNA, 28 nt, Artificial Sequence
  Synthetic Oligonucleotide; IFNG exon 3; Set C
auuuaaauagccucaccgaauaauuagu

SEQ ID NO: 8770 - RNA, 30 nt, Artificial Sequence
  Synthetic Oligonucleotide; IFNG exon 3; Set C
aauuuaaauagccucaccgaauaauuaguc

SEQ ID NO: 8771 - RNA, 21 nt, Artificial Sequence
  Synthetic Oligonucleotide; IFNG exon 3; Set C
uaaauagccucaccgaauaau

SEQ ID NO: 8772 - RNA, 19 nt, Artificial Sequence
  Synthetic Oligonucleotide; IFNG exon 3; Set C
aaauagccucaccgaauaa

SEQ ID NO: 8773 - RNA, 29 nt, Artificial Sequence
  Synthetic Oligonucleotide; IFNG exon 3; Set C
aauuuaaauagccucaccgaauaauuagu

SEQ ID NO: 8774 - RNA, 20 nt, Artificial Sequence
  Synthetic Oligonucleotide; IFNG exon 3; Set C
uaaauagccucaccgaauaa

SEQ ID NO: 8775 - RNA, 18 nt, Artificial Sequence
  Synthetic Oligonucleotide; IFNG exon 3; Set C
aaauagccucaccgaaua

SEQ ID NO: 8776 - RNA, 19 nt, Artificial Sequence
  Synthetic Oligonucleotide; IFNG exon 3; Set C
uaaauagccucaccgaaua

SEQ ID NO: 8777 - RNA, 29 nt, Artificial Sequence
  Synthetic Oligonucleotide; IFNG exon 3; Set C
gaauuuaaauagccucaccgaauaauuag

SEQ ID NO: 8778 - RNA, 28 nt, Artificial Sequence
  Synthetic Oligonucleotide; IFNG exon 3; Set C
gaauuuaaauagccucaccgaauaauua

SEQ ID NO: 8779 - RNA, 30 nt, Artificial Sequence
  Synthetic Oligonucleotide; IFNG exon 3; Set C
agaauuuaaauagccucaccgaauaauuag

SEQ ID NO: 8780 - RNA, 27 nt, Artificial Sequence
  Synthetic Oligonucleotide; IFNG exon 3; Set C
gaauuuaaauagccucaccgaauaauu

SEQ ID NO: 8781 - RNA, 29 nt, Artificial Sequence
  Synthetic Oligonucleotide; IFNG exon 3; Set C
agaauuuaaauagccucaccgaauaauua

SEQ ID NO: 8782 - RNA, 31 nt, Artificial Sequence
  Synthetic Oligonucleotide; IFNG exon 3; Set C
aagaauuuaaauagccucaccgaauaauuag

SEQ ID NO: 8783 - RNA, 19 nt, Artificial Sequence
  Synthetic Oligonucleotide; IFNG exon 3; Set C
uuaaauagccucaccgaau

SEQ ID NO: 8784 - RNA, 28 nt, Artificial Sequence
  Synthetic Oligonucleotide; IFNG exon 3; Set C
agaauuuaaauagccucaccgaauaauu

SEQ ID NO: 8785 - RNA, 26 nt, Artificial Sequence
  Synthetic Oligonucleotide; IFNG exon 3; Set C
gaauuuaaauagccucaccgaauaau

SEQ ID NO: 8786 - RNA, 30 nt, Artificial Sequence
  Synthetic Oligonucleotide; IFNG exon 3; Set C
aagaauuuaaauagccucaccgaauaauua

SEQ ID NO: 8787 - RNA, 32 nt, Artificial Sequence
  Synthetic Oligonucleotide; IFNG exon 3; Set C
aaagaauuuaaauagccucaccgaauaauuag

SEQ ID NO: 8788 - RNA, 18 nt, Artificial Sequence
  Synthetic Oligonucleotide; IFNG exon 3; Set C
uuaaauagccucaccgaa

SEQ ID NO: 8789 - RNA, 27 nt, Artificial Sequence
  Synthetic Oligonucleotide; IFNG exon 3; Set C
agaauuuaaauagccucaccgaauaau

SEQ ID NO: 8790 - RNA, 29 nt, Artificial Sequence
  Synthetic Oligonucleotide; IFNG exon 3; Set C
aagaauuuaaauagccucaccgaauaauu

SEQ ID NO: 8791 - RNA, 25 nt, Artificial Sequence
  Synthetic Oligonucleotide; IFNG exon 3; Set C
gaauuuaaauagccucaccgaauaa

SEQ ID NO: 8792 - RNA, 31 nt, Artificial Sequence
  Synthetic Oligonucleotide; IFNG exon 3; Set C
aaagaauuuaaauagccucaccgaauaauua

SEQ ID NO: 8793 - RNA, 33 nt, Artificial Sequence
  Synthetic Oligonucleotide; IFNG exon 3; Set C
gaaagaauuuaaauagccucaccgaauaauuag

SEQ ID NO: 8794 - RNA, 19 nt, Artificial Sequence
  Synthetic Oligonucleotide; IFNG exon 3; Set C
uuuaaauagccucaccgaa

SEQ ID NO: 8795 - RNA, 30 nt, Artificial Sequence
  Synthetic Oligonucleotide; IFNG exon 3; Set C
aaagaauuuaaauagccucaccgaauaauu

SEQ ID NO: 8796 - RNA, 26 nt, Artificial Sequence
  Synthetic Oligonucleotide; IFNG exon 3; Set C
agaauuuaaauagccucaccgaauaa

SEQ ID NO: 8797 - RNA, 28 nt, Artificial Sequence
  Synthetic Oligonucleotide; IFNG exon 3; Set C
aagaauuuaaauagccucaccgaauaau

SEQ ID NO: 8798 - RNA, 24 nt, Artificial Sequence
  Synthetic Oligonucleotide; IFNG exon 3; Set C
gaauuuaaauagccucaccgaaua

SEQ ID NO: 8799 - RNA, 32 nt, Artificial Sequence
  Synthetic Oligonucleotide; IFNG exon 3; Set C
gaaagaauuuaaauagccucaccgaauaauua

SEQ ID NO: 8800 - RNA, 34 nt, Artificial Sequence
  Synthetic Oligonucleotide; IFNG exon 3; Set C
agaaagaauuuaaauagccucaccgaauaauuag

SEQ ID NO: 8801 - RNA, 20 nt, Artificial Sequence
  Synthetic Oligonucleotide; IFNG exon 3; Set C
auuuaaauagccucaccgaa

SEQ ID NO: 8802 - RNA, 29 nt, Artificial Sequence
  Synthetic Oligonucleotide; IFNG exon 3; Set C
aaagaauuuaaauagccucaccgaauaau

SEQ ID NO: 8803 - RNA, 31 nt, Artificial Sequence
  Synthetic Oligonucleotide; IFNG exon 3; Set C
gaaagaauuuaaauagccucaccgaauaauu

SEQ ID NO: 8804 - RNA, 25 nt, Artificial Sequence
  Synthetic Oligonucleotide; IFNG exon 3; Set C
agaauuuaaauagccucaccgaaua

SEQ ID NO: 8805 - RNA, 27 nt, Artificial Sequence
  Synthetic Oligonucleotide; IFNG exon 3; Set C
aagaauuuaaauagccucaccgaauaa

SEQ ID NO: 8806 - RNA, 33 nt, Artificial Sequence
  Synthetic Oligonucleotide; IFNG exon 3; Set C
agaaagaauuuaaauagccucaccgaauaauua

SEQ ID NO: 8807 - RNA, 21 nt, Artificial Sequence
  Synthetic Oligonucleotide; IFNG exon 3; Set C
aauuuaaauagccucaccgaa

SEQ ID NO: 8808 - RNA, 28 nt, Artificial Sequence
  Synthetic Oligonucleotide; IFNG exon 3; Set C
aaagaauuuaaauagccucaccgaauaa

SEQ ID NO: 8809 - RNA, 30 nt, Artificial Sequence
  Synthetic Oligonucleotide; IFNG exon 3; Set C
gaaagaauuuaaauagccucaccgaauaau

SEQ ID NO: 8810 - RNA, 26 nt, Artificial Sequence
  Synthetic Oligonucleotide; IFNG exon 3; Set C
aagaauuuaaauagccucaccgaaua

SEQ ID NO: 8811 - RNA, 32 nt, Artificial Sequence
  Synthetic Oligonucleotide; IFNG exon 3; Set C
agaaagaauuuaaauagccucaccgaauaauu

SEQ ID NO: 8812 - RNA, 27 nt, Artificial Sequence
  Synthetic Oligonucleotide; IFNG exon 3; Set C
aaagaauuuaaauagccucaccgaaua

SEQ ID NO: 8813 - RNA, 29 nt, Artificial Sequence
  Synthetic Oligonucleotide; IFNG exon 3; Set C
gaaagaauuuaaauagccucaccgaauaa

SEQ ID NO: 8814 - RNA, 31 nt, Artificial Sequence
  Synthetic Oligonucleotide; IFNG exon 3; Set C
agaaagaauuuaaauagccucaccgaauaau

SEQ ID NO: 8815 - RNA, 28 nt, Artificial Sequence
  Synthetic Oligonucleotide; IFNG exon 3; Set C
gaaagaauuuaaauagccucaccgaaua

SEQ ID NO: 8816 - RNA, 30 nt, Artificial Sequence
  Synthetic Oligonucleotide; IFNG exon 3; Set C
agaaagaauuuaaauagccucaccgaauaa

SEQ ID NO: 8817 - RNA, 29 nt, Artificial Sequence
  Synthetic Oligonucleotide; IFNG exon 3; Set C
agaaagaauuuaaauagccucaccgaaua

SEQ ID NO: 8818 - RNA, 15 nt, Artificial Sequence
  Synthetic Oligonucleotide; IFNG exon 3; Set C
aauuuaaauagccuc

SEQ ID NO: 8819 - RNA, 36 nt, Artificial Sequence
  Synthetic Oligonucleotide; IFNG exon 3; Set C
gaaaccaaagaaagaauuuaaauagccucaccgaau

SEQ ID NO: 8820 - RNA, 15 nt, Artificial Sequence
  Synthetic Oligonucleotide; IFNG exon 3; Set C
aaagaauuuaaauag

SEQ ID NO: 8821 - RNA, 37 nt, Artificial Sequence
  Synthetic Oligonucleotide; IFNG exon 3; Set B
ugaaaccaaagaaagaauuuaaauagccucaccgaau

SEQ ID NO: 8822 - RNA, 35 nt, Artificial Sequence
  Synthetic Oligonucleotide; IFNG exon 3; Set C
gaaaccaaagaaagaauuuaaauagccucaccgaa

SEQ ID NO: 8823 - RNA, 16 nt, Artificial Sequence
  Synthetic Oligonucleotide; IFNG exon 3; Set C
gaaagaauuuaaauag

SEQ ID NO: 8824 - RNA, 38 nt, Artificial Sequence
  Synthetic Oligonucleotide; IFNG exon 3; Set B
augaaaccaaagaaagaauuuaaauagccucaccgaau

SEQ ID NO: 8825 - RNA, 36 nt, Artificial Sequence
  Synthetic Oligonucleotide; IFNG exon 3; Set B
ugaaaccaaagaaagaauuuaaauagccucaccgaa

SEQ ID NO: 8826 - RNA, 39 nt, Artificial Sequence
  Synthetic Oligonucleotide; IFNG exon 3; Set C
aaugaaaccaaagaaagaauuuaaauagccucaccgaau

SEQ ID NO: 8827 - RNA, 37 nt, Artificial Sequence
  Synthetic Oligonucleotide; IFNG exon 3; Set B
augaaaccaaagaaagaauuuaaauagccucaccgaa

SEQ ID NO: 8828 - RNA, 40 nt, Artificial Sequence
  Synthetic Oligonucleotide; IFNG exon 3; Set B
caaugaaaccaaagaaagaauuuaaauagccucaccgaau

SEQ ID NO: 8829 - RNA, 38 nt, Artificial Sequence
  Synthetic Oligonucleotide; IFNG exon 3; Set C
aaugaaaccaaagaaagaauuuaaauagccucaccgaa

SEQ ID NO: 8830 - RNA, 30 nt, Artificial Sequence
  Synthetic Oligonucleotide; IFNG exon 3; Set C
ugaaaccaaagaaagaauuuaaauagccuc

SEQ ID NO: 8831 - RNA, 31 nt, Artificial Sequence
  Synthetic Oligonucleotide; IFNG exon 3; Set C
augaaaccaaagaaagaauuuaaauagccuc

SEQ ID NO: 8832 - RNA, 32 nt, Artificial Sequence
  Synthetic Oligonucleotide; IFNG exon 3; Set C
aaugaaaccaaagaaagaauuuaaauagccuc

SEQ ID NO: 8833 - RNA, 23 nt, Artificial Sequence
  Synthetic Oligonucleotide; IFNG exon 3; Set C
gaaaccaaagaaagaauuuaaau

SEQ ID NO: 8834 - RNA, 25 nt, Artificial Sequence
  Synthetic Oligonucleotide; IFNG exon 3; Set C
ugaaaccaaagaaagaauuuaaaua

SEQ ID NO: 8835 - RNA, 22 nt, Artificial Sequence
  Synthetic Oligonucleotide; IFNG exon 3; Set C
gaaaccaaagaaagaauuuaaa

SEQ ID NO: 8836 - RNA, 24 nt, Artificial Sequence
  Synthetic Oligonucleotide; IFNG exon 3; Set C
ugaaaccaaagaaagaauuuaaau

SEQ ID NO: 8837 - RNA, 26 nt, Artificial Sequence
  Synthetic Oligonucleotide; IFNG exon 3; Set C
augaaaccaaagaaagaauuuaaaua

SEQ ID NO: 8838 - RNA, 29 nt, Artificial Sequence
  Synthetic Oligonucleotide; IFNG exon 3; Set C
caaugaaaccaaagaaagaauuuaaauag

SEQ ID NO: 8839 - RNA, 21 nt, Artificial Sequence
  Synthetic Oligonucleotide; IFNG exon 3; Set C
gaaaccaaagaaagaauuuaa

SEQ ID NO: 8840 - RNA, 23 nt, Artificial Sequence
  Synthetic Oligonucleotide; IFNG exon 3; Set C
ugaaaccaaagaaagaauuuaaa

SEQ ID NO: 8841 - RNA, 25 nt, Artificial Sequence
  Synthetic Oligonucleotide; IFNG exon 3; Set C
augaaaccaaagaaagaauuuaaau

SEQ ID NO: 8842 - RNA, 27 nt, Artificial Sequence
  Synthetic Oligonucleotide; IFNG exon 3; Set C
aaugaaaccaaagaaagaauuuaaaua

SEQ ID NO: 8843 - RNA, 30 nt, Artificial Sequence
  Synthetic Oligonucleotide; IFNG exon 3; Set C
gcaaugaaaccaaagaaagaauuuaaauag

SEQ ID NO: 8844 - RNA, 22 nt, Artificial Sequence
  Synthetic Oligonucleotide; IFNG exon 3; Set C
ugaaaccaaagaaagaauuuaa

SEQ ID NO: 8845 - RNA, 24 nt, Artificial Sequence
  Synthetic Oligonucleotide; IFNG exon 3; Set C
augaaaccaaagaaagaauuuaaa

SEQ ID NO: 8846 - RNA, 26 nt, Artificial Sequence
  Synthetic Oligonucleotide; IFNG exon 3; Set C
aaugaaaccaaagaaagaauuuaaau

SEQ ID NO: 8847 - RNA, 31 nt, Artificial Sequence
  Synthetic Oligonucleotide; IFNG exon 3; Set C
ggcaaugaaaccaaagaaagaauuuaaauag

SEQ ID NO: 8848 - RNA, 23 nt, Artificial Sequence
  Synthetic Oligonucleotide; IFNG exon 3; Set C
augaaaccaaagaaagaauuuaa

SEQ ID NO: 8849 - RNA, 25 nt, Artificial Sequence
  Synthetic Oligonucleotide; IFNG exon 3; Set C
aaugaaaccaaagaaagaauuuaaa

SEQ ID NO: 8850 - RNA, 24 nt, Artificial Sequence
  Synthetic Oligonucleotide; IFNG exon 3; Set C
aaugaaaccaaagaaagaauuuaa

SEQ ID NO: 8851 - RNA, 25 nt, Artificial Sequence
  Synthetic Oligonucleotide; IFNG exon 3; Set C
gcaaugaaaccaaagaaagaauuua

SEQ ID NO: 8852 - RNA, 24 nt, Artificial Sequence
  Synthetic Oligonucleotide; IFNG exon 3; Set C
gcaaugaaaccaaagaaagaauuu

SEQ ID NO: 8853 - RNA, 26 nt, Artificial Sequence
  Synthetic Oligonucleotide; IFNG exon 3; Set C
ggcaaugaaaccaaagaaagaauuua

SEQ ID NO: 8854 - RNA, 22 nt, Artificial Sequence
  Synthetic Oligonucleotide; IFNG exon 3; Set C
caaugaaaccaaagaaagaauu

SEQ ID NO: 8855 - RNA, 18 nt, Artificial Sequence
  Synthetic Oligonucleotide; IFNG exon 3; Set C
augaaaccaaagaaagaa

SEQ ID NO: 8856 - RNA, 25 nt, Artificial Sequence
  Synthetic Oligonucleotide; IFNG exon 3; Set C
ggcaaugaaaccaaagaaagaauuu

SEQ ID NO: 8857 - RNA, 23 nt, Artificial Sequence
  Synthetic Oligonucleotide; IFNG exon 3; Set C
gcaaugaaaccaaagaaagaauu

SEQ ID NO: 8858 - RNA, 21 nt, Artificial Sequence
  Synthetic Oligonucleotide; IFNG exon 3; Set C
caaugaaaccaaagaaagaau

SEQ ID NO: 8859 - RNA, 19 nt, Artificial Sequence
  Synthetic Oligonucleotide; IFNG exon 3; Set C
aaugaaaccaaagaaagaa

SEQ ID NO: 8860 - RNA, 24 nt, Artificial Sequence
  Synthetic Oligonucleotide; IFNG exon 3; Set C
ggcaaugaaaccaaagaaagaauu

SEQ ID NO: 8861 - RNA, 22 nt, Artificial Sequence
  Synthetic Oligonucleotide; IFNG exon 3; Set C
gcaaugaaaccaaagaaagaau

SEQ ID NO: 8862 - RNA, 18 nt, Artificial Sequence
  Synthetic Oligonucleotide; IFNG exon 3; Set C
aaugaaaccaaagaaaga

SEQ ID NO: 8863 - RNA, 23 nt, Artificial Sequence
  Synthetic Oligonucleotide; IFNG exon 3; Set C
ggcaaugaaaccaaagaaagaau

SEQ ID NO: 8864 - RNA, 15 nt, Artificial Sequence
  Synthetic Oligonucleotide; IFNG exon 3; Set C
augaaaccaaagaaa

SEQ ID NO: 8865 - RNA, 40 nt, Artificial Sequence
  Synthetic Oligonucleotide; IFNG exon 3; Set B
aagacccucggcaaugaaaccaaagaaagaauuuaaauag

SEQ ID NO: 8866 - RNA, 16 nt, Artificial Sequence
  Synthetic Oligonucleotide; IFNG exon 3; Set C
aaugaaaccaaagaaa

SEQ ID NO: 8867 - RNA, 36 nt, Artificial Sequence
  Synthetic Oligonucleotide; IFNG exon 3; Set B
gacccucggcaaugaaaccaaagaaagaauuuaaau

SEQ ID NO: 8868 - RNA, 38 nt, Artificial Sequence
  Synthetic Oligonucleotide; IFNG exon 3; Set B
agacccucggcaaugaaaccaaagaaagaauuuaaaua

SEQ ID NO: 8869 - RNA, 35 nt, Artificial Sequence
  Synthetic Oligonucleotide; IFNG exon 3; Set B
gacccucggcaaugaaaccaaagaaagaauuuaaa

SEQ ID NO: 8870 - RNA, 15 nt, Artificial Sequence
  Synthetic Oligonucleotide; IFNG exon 3; Set C
aaugaaaccaaagaa

SEQ ID NO: 8871 - RNA, 37 nt, Artificial Sequence
  Synthetic Oligonucleotide; IFNG exon 3; Set B
agacccucggcaaugaaaccaaagaaagaauuuaaau

SEQ ID NO: 8872 - RNA, 32 nt, Artificial Sequence
  Synthetic Oligonucleotide; IFNG exon 3; Set B
acccucggcaaugaaaccaaagaaagaauuua

SEQ ID NO: 8873 - RNA, 34 nt, Artificial Sequence
  Synthetic Oligonucleotide; IFNG exon 3; Set B
gacccucggcaaugaaaccaaagaaagaauuuaa

SEQ ID NO: 8874 - RNA, 36 nt, Artificial Sequence
  Synthetic Oligonucleotide; IFNG exon 3; Set B
agacccucggcaaugaaaccaaagaaagaauuuaaa

SEQ ID NO: 8875 - RNA, 31 nt, Artificial Sequence
  Synthetic Oligonucleotide; IFNG exon 3; Set B
acccucggcaaugaaaccaaagaaagaauuu

SEQ ID NO: 8876 - RNA, 35 nt, Artificial Sequence
  Synthetic Oligonucleotide; IFNG exon 3; Set B
agacccucggcaaugaaaccaaagaaagaauuuaa

SEQ ID NO: 8877 - RNA, 30 nt, Artificial Sequence
  Synthetic Oligonucleotide; IFNG exon 3; Set B
acccucggcaaugaaaccaaagaaagaauu

SEQ ID NO: 8878 - RNA, 35 nt, Artificial Sequence
  Synthetic Oligonucleotide; IFNG exon 3; Set B
aagacccucggcaaugaaaccaaagaaagaauuua

SEQ ID NO: 8879 - RNA, 29 nt, Artificial Sequence
  Synthetic Oligonucleotide; IFNG exon 3; Set B
acccucggcaaugaaaccaaagaaagaau

SEQ ID NO: 8880 - RNA, 34 nt, Artificial Sequence
  Synthetic Oligonucleotide; IFNG exon 3; Set B
aagacccucggcaaugaaaccaaagaaagaauuu

SEQ ID NO: 8881 - RNA, 33 nt, Artificial Sequence
  Synthetic Oligonucleotide; IFNG exon 3; Set B
aagacccucggcaaugaaaccaaagaaagaauu

SEQ ID NO: 8882 - RNA, 29 nt, Artificial Sequence
  Synthetic Oligonucleotide; IFNG exon 3; Set B
gacccucggcaaugaaaccaaagaaagaa

SEQ ID NO: 8883 - RNA, 32 nt, Artificial Sequence
  Synthetic Oligonucleotide; IFNG exon 3; Set B
aagacccucggcaaugaaaccaaagaaagaau

SEQ ID NO: 8884 - RNA, 30 nt, Artificial Sequence
  Synthetic Oligonucleotide; IFNG exon 3; Set B
agacccucggcaaugaaaccaaagaaagaa

SEQ ID NO: 8885 - RNA, 39 nt, Artificial Sequence
  Synthetic Oligonucleotide; IFNG exon 3; Set B
uugcaagacccucggcaaugaaaccaaagaaagaauuua

SEQ ID NO: 8886 - RNA, 29 nt, Artificial Sequence
  Synthetic Oligonucleotide; IFNG exon 3; Set B
agacccucggcaaugaaaccaaagaaaga

SEQ ID NO: 8887 - RNA, 38 nt, Artificial Sequence
  Synthetic Oligonucleotide; IFNG exon 3; Set B
uugcaagacccucggcaaugaaaccaaagaaagaauuu

SEQ ID NO: 8888 - RNA, 26 nt, Artificial Sequence
  Synthetic Oligonucleotide; IFNG exon 3; Set B
gacccucggcaaugaaaccaaagaaa

SEQ ID NO: 8889 - RNA, 37 nt, Artificial Sequence
  Synthetic Oligonucleotide; IFNG exon 3; Set B
uugcaagacccucggcaaugaaaccaaagaaagaauu

SEQ ID NO: 8890 - RNA, 27 nt, Artificial Sequence
  Synthetic Oligonucleotide; IFNG exon 3; Set B
agacccucggcaaugaaaccaaagaaa

SEQ ID NO: 8891 - RNA, 36 nt, Artificial Sequence
  Synthetic Oligonucleotide; IFNG exon 3; Set B
uugcaagacccucggcaaugaaaccaaagaaagaau

SEQ ID NO: 8892 - RNA, 15 nt, Artificial Sequence
  Synthetic Oligonucleotide; IFNG exon 3; Set C
acccucggcaaugaa

SEQ ID NO: 8893 - RNA, 18 nt, Artificial Sequence
  Synthetic Oligonucleotide; IFNG exon 3; Set C
aagacccucggcaaugaa

SEQ ID NO: 8894 - RNA, 17 nt, Artificial Sequence
  Synthetic Oligonucleotide; IFNG exon 3; Set C
aagacccucggcaauga

SEQ ID NO: 8895 - RNA, 16 nt, Artificial Sequence
  Synthetic Oligonucleotide; IFNG exon 3; Set C
aagacccucggcaaug

SEQ ID NO: 8896 - RNA, 15 nt, Artificial Sequence
  Synthetic Oligonucleotide; IFNG exon 3; Set C
aagacccucggcaau

SEQ ID NO: 8897 - RNA, 22 nt, Artificial Sequence
  Synthetic Oligonucleotide; IFNG exon 3; Set B
uugcaagacccucggcaaugaa

SEQ ID NO: 8898 - RNA, 21 nt, Artificial Sequence
  Synthetic Oligonucleotide; IFNG exon 3; Set B
uugcaagacccucggcaauga

SEQ ID NO: 8899 - RNA, 20 nt, Artificial Sequence
  Synthetic Oligonucleotide; IFNG exon 3; Set B
uugcaagacccucggcaaug

SEQ ID NO: 8900 - RNA, 19 nt, Artificial Sequence
  Synthetic Oligonucleotide; IFNG exon 3; Set B
uugcaagacccucggcaau

SEQ ID NO: 8901 - RNA, 15 nt, Artificial Sequence
  Synthetic Oligonucleotide; IFNG exon 3; Set C
aauuuauccaucaga

SEQ ID NO: 8902 - RNA, 21 nt, Artificial Sequence
  Synthetic Oligonucleotide; IFNG exon 3; Set C
gaugugaauuuauccaucaga

SEQ ID NO: 8903 - RNA, 22 nt, Artificial Sequence
  Synthetic Oligonucleotide; IFNG exon 3; Set C
ugaugugaauuuauccaucaga

SEQ ID NO: 8904 - RNA, 23 nt, Artificial Sequence
  Synthetic Oligonucleotide; IFNG exon 3; Set C
augaugugaauuuauccaucaga

SEQ ID NO: 8905 - RNA, 26 nt, Artificial Sequence
  Synthetic Oligonucleotide; IFNG exon 3; Set C
aggaugaugugaauuuauccaucaga

SEQ ID NO: 8906 - RNA, 27 nt, Artificial Sequence
  Synthetic Oligonucleotide; IFNG exon 3; Set A
gaggaugaugugaauuuauccaucaga

SEQ ID NO: 8907 - RNA, 35 nt, Artificial Sequence
  Synthetic Oligonucleotide; IFNG exon 3; Set A
cacaaacagaggaugaugugaauuuauccaucaga

SEQ ID NO: 8908 - RNA, 36 nt, Artificial Sequence
  Synthetic Oligonucleotide; IFNG exon 3; Set A
gcacaaacagaggaugaugugaauuuauccaucaga

SEQ ID NO: 8909 - RNA, 37 nt, Artificial Sequence
  Synthetic Oligonucleotide; IFNG exon 3; Set A
agcacaaacagaggaugaugugaauuuauccaucaga

SEQ ID NO: 8910 - RNA, 38 nt, Artificial Sequence
  Synthetic Oligonucleotide; IFNG exon 3; Set C
gagcacaaacagaggaugaugugaauuuauccaucaga

SEQ ID NO: 8911 - RNA, 39 nt, Artificial Sequence
  Synthetic Oligonucleotide; IFNG exon 3; Set C
agagcacaaacagaggaugaugugaauuuauccaucaga

SEQ ID NO: 8912 - RNA, 40 nt, Artificial Sequence
  Synthetic Oligonucleotide; IFNG exon 3; Set A
aagagcacaaacagaggaugaugugaauuuauccaucaga

SEQ ID NO: 8913 - RNA, 20 nt, Artificial Sequence
  Synthetic Oligonucleotide; IFNG exon 3; Set C
aaacagaggaugaugugaau

SEQ ID NO: 8914 - RNA, 21 nt, Artificial Sequence
  Synthetic Oligonucleotide; IFNG exon 3; Set C
caaacagaggaugaugugaau

SEQ ID NO: 8915 - RNA, 22 nt, Artificial Sequence
  Synthetic Oligonucleotide; IFNG exon 3; Set C
cacaaacagaggaugaugugaa

SEQ ID NO: 8916 - RNA, 17 nt, Artificial Sequence
  Synthetic Oligonucleotide; IFNG exon 3; Set C
caaacagaggaugaugu

SEQ ID NO: 8917 - RNA, 23 nt, Artificial Sequence
  Synthetic Oligonucleotide; IFNG exon 3; Set C
gcacaaacagaggaugaugugaa

SEQ ID NO: 8918 - RNA, 21 nt, Artificial Sequence
  Synthetic Oligonucleotide; IFNG exon 3; Set C
cacaaacagaggaugauguga

SEQ ID NO: 8919 - RNA, 19 nt, Artificial Sequence
  Synthetic Oligonucleotide; IFNG exon 3; Set C
acaaacagaggaugaugug

SEQ ID NO: 8920 - RNA, 24 nt, Artificial Sequence
  Synthetic Oligonucleotide; IFNG exon 3; Set C
agcacaaacagaggaugaugugaa

SEQ ID NO: 8921 - RNA, 22 nt, Artificial Sequence
  Synthetic Oligonucleotide; IFNG exon 3; Set C
gcacaaacagaggaugauguga

SEQ ID NO: 8922 - RNA, 15 nt, Artificial Sequence
  Synthetic Oligonucleotide; IFNG exon 3; Set C
caaacagaggaugau

SEQ ID NO: 8923 - RNA, 19 nt, Artificial Sequence
  Synthetic Oligonucleotide; IFNG exon 3; Set C
cacaaacagaggaugaugu

SEQ ID NO: 8924 - RNA, 23 nt, Artificial Sequence
  Synthetic Oligonucleotide; IFNG exon 3; Set C
agcacaaacagaggaugauguga

SEQ ID NO: 8925 - RNA, 25 nt, Artificial Sequence
  Synthetic Oligonucleotide; IFNG exon 3; Set A
gagcacaaacagaggaugaugugaa

SEQ ID NO: 8926 - RNA, 20 nt, Artificial Sequence
  Synthetic Oligonucleotide; IFNG exon 3; Set C
gcacaaacagaggaugaugu

SEQ ID NO: 8927 - RNA, 18 nt, Artificial Sequence
  Synthetic Oligonucleotide; IFNG exon 3; Set C
cacaaacagaggaugaug

SEQ ID NO: 8928 - RNA, 26 nt, Artificial Sequence
  Synthetic Oligonucleotide; IFNG exon 3; Set A
agagcacaaacagaggaugaugugaa

SEQ ID NO: 8929 - RNA, 24 nt, Artificial Sequence
  Synthetic Oligonucleotide; IFNG exon 3; Set A
gagcacaaacagaggaugauguga

SEQ ID NO: 8930 - RNA, 21 nt, Artificial Sequence
  Synthetic Oligonucleotide; IFNG exon 3; Set C
agcacaaacagaggaugaugu

SEQ ID NO: 8931 - RNA, 19 nt, Artificial Sequence
  Synthetic Oligonucleotide; IFNG exon 3; Set C
gcacaaacagaggaugaug

SEQ ID NO: 8932 - RNA, 27 nt, Artificial Sequence
  Synthetic Oligonucleotide; IFNG exon 3; Set A
aagagcacaaacagaggaugaugugaa

SEQ ID NO: 8933 - RNA, 25 nt, Artificial Sequence
  Synthetic Oligonucleotide; IFNG exon 3; Set A
agagcacaaacagaggaugauguga

SEQ ID NO: 8934 - RNA, 22 nt, Artificial Sequence
  Synthetic Oligonucleotide; IFNG exon 3; Set C
gagcacaaacagaggaugaugu

SEQ ID NO: 8935 - RNA, 20 nt, Artificial Sequence
  Synthetic Oligonucleotide; IFNG exon 3; Set C
agcacaaacagaggaugaug

SEQ ID NO: 8936 - RNA, 26 nt, Artificial Sequence
  Synthetic Oligonucleotide; IFNG exon 3; Set A
aagagcacaaacagaggaugauguga

SEQ ID NO: 8937 - RNA, 23 nt, Artificial Sequence
  Synthetic Oligonucleotide; IFNG exon 3; Set C
agagcacaaacagaggaugaugu

SEQ ID NO: 8938 - RNA, 21 nt, Artificial Sequence
  Synthetic Oligonucleotide; IFNG exon 3; Set C
gagcacaaacagaggaugaug

SEQ ID NO: 8939 - RNA, 20 nt, Artificial Sequence
  Synthetic Oligonucleotide; IFNG exon 3; Set C
gagcacaaacagaggaugau

SEQ ID NO: 8940 - RNA, 24 nt, Artificial Sequence
  Synthetic Oligonucleotide; IFNG exon 3; Set C
aagagcacaaacagaggaugaugu

SEQ ID NO: 8941 - RNA, 22 nt, Artificial Sequence
  Synthetic Oligonucleotide; IFNG exon 3; Set C
agagcacaaacagaggaugaug

SEQ ID NO: 8942 - RNA, 21 nt, Artificial Sequence
  Synthetic Oligonucleotide; IFNG exon 3; Set C
agagcacaaacagaggaugau

SEQ ID NO: 8943 - RNA, 23 nt, Artificial Sequence
  Synthetic Oligonucleotide; IFNG exon 3; Set C
aagagcacaaacagaggaugaug

SEQ ID NO: 8944 - RNA, 34 nt, Artificial Sequence
  Synthetic Oligonucleotide; IFNG exon 3; Set A
gaaggaaagagcacaaacagaggaugaugugaau

SEQ ID NO: 8945 - RNA, 18 nt, Artificial Sequence
  Synthetic Oligonucleotide; IFNG exon 3; Set C
gagcacaaacagaggaug

SEQ ID NO: 8946 - RNA, 22 nt, Artificial Sequence
  Synthetic Oligonucleotide; IFNG exon 3; Set C
aagagcacaaacagaggaugau

SEQ ID NO: 8947 - RNA, 34 nt, Artificial Sequence
  Synthetic Oligonucleotide; IFNG exon 3; Set A
ggaaggaaagagcacaaacagaggaugaugugaa

SEQ ID NO: 8948 - RNA, 15 nt, Artificial Sequence
  Synthetic Oligonucleotide; IFNG exon 3; Set C
gagcacaaacagagg

SEQ ID NO: 8949 - RNA, 35 nt, Artificial Sequence
  Synthetic Oligonucleotide; IFNG exon 3; Set A
uggaaggaaagagcacaaacagaggaugaugugaa

SEQ ID NO: 8950 - RNA, 33 nt, Artificial Sequence
  Synthetic Oligonucleotide; IFNG exon 3; Set A
ggaaggaaagagcacaaacagaggaugauguga

SEQ ID NO: 8951 - RNA, 16 nt, Artificial Sequence
  Synthetic Oligonucleotide; IFNG exon 3; Set C
agagcacaaacagagg

SEQ ID NO: 8952 - RNA, 34 nt, Artificial Sequence
  Synthetic Oligonucleotide; IFNG exon 3; Set A
uggaaggaaagagcacaaacagaggaugauguga

SEQ ID NO: 8953 - RNA, 17 nt, Artificial Sequence
  Synthetic Oligonucleotide; IFNG exon 3; Set C
aagagcacaaacagagg

SEQ ID NO: 8954 - RNA, 15 nt, Artificial Sequence
  Synthetic Oligonucleotide; IFNG exon 3; Set C
agagcacaaacagag

SEQ ID NO: 8955 - RNA, 31 nt, Artificial Sequence
  Synthetic Oligonucleotide; IFNG exon 3; Set A
ggaaggaaagagcacaaacagaggaugaugu

SEQ ID NO: 8956 - RNA, 16 nt, Artificial Sequence
  Synthetic Oligonucleotide; IFNG exon 3; Set C
aagagcacaaacagag

SEQ ID NO: 8957 - RNA, 30 nt, Artificial Sequence
  Synthetic Oligonucleotide; IFNG exon 3; Set A
ggaaggaaagagcacaaacagaggaugaug

SEQ ID NO: 8958 - RNA, 27 nt, Artificial Sequence
  Synthetic Oligonucleotide; IFNG exon 3; Set A
gaaggaaagagcacaaacagaggauga

SEQ ID NO: 8959 - RNA, 31 nt, Artificial Sequence
  Synthetic Oligonucleotide; IFNG exon 3; Set A
uggaaggaaagagcacaaacagaggaugaug

SEQ ID NO: 8960 - RNA, 25 nt, Artificial Sequence
  Synthetic Oligonucleotide; IFNG exon 3; Set C
gaaggaaagagcacaaacagaggau

SEQ ID NO: 8961 - RNA, 24 nt, Artificial Sequence
  Synthetic Oligonucleotide; IFNG exon 3; Set C
gaaggaaagagcacaaacagagga

SEQ ID NO: 8962 - RNA, 24 nt, Artificial Sequence
  Synthetic Oligonucleotide; IFNG exon 3; Set C
ggaaggaaagagcacaaacagagg

SEQ ID NO: 8963 - RNA, 23 nt, Artificial Sequence
  Synthetic Oligonucleotide; IFNG exon 3; Set C
ggaaggaaagagcacaaacagag

SEQ ID NO: 8964 - RNA, 24 nt, Artificial Sequence
  Synthetic Oligonucleotide; IFNG exon 3; Set C
uggaaggaaagagcacaaacagag

SEQ ID NO: 8965 - RNA, 18 nt, Artificial Sequence
  Synthetic Oligonucleotide; IFNG exon 3; Set C
ggaaggaaagagcacaaa

SEQ ID NO: 8966 - RNA, 15 nt, Artificial Sequence
  Synthetic Oligonucleotide; IFNG exon 3; Set C
gaaggaaagagcaca

SEQ ID NO: 8967 - RNA, 19 nt, Artificial Sequence
  Synthetic Oligonucleotide; IFNG exon 3; Set C
uggaaggaaagagcacaaa

SEQ ID NO: 8968 - RNA, 17 nt, Artificial Sequence
  Synthetic Oligonucleotide; IFNG exon 3; Set C
ggaaggaaagagcacaa

SEQ ID NO: 8969 - RNA, 18 nt, Artificial Sequence
  Synthetic Oligonucleotide; IFNG exon 3; Set C
uggaaggaaagagcacaa

SEQ ID NO: 8970 - RNA, 34 nt, Artificial Sequence
  Synthetic Oligonucleotide; IFNG exon 3; Set C
uuuucugucacucuccuuggaaggaaagagcaca

SEQ ID NO: 8971 - RNA, 35 nt, Artificial Sequence
  Synthetic Oligonucleotide; IFNG exon 3; Set C
uuuuucugucacucuccuuggaaggaaagagcaca

SEQ ID NO: 8972 - RNA, 36 nt, Artificial Sequence
  Synthetic Oligonucleotide; IFNG exon 3; Set C
auuuuucugucacucuccuuggaaggaaagagcaca

SEQ ID NO: 8973 - RNA, 37 nt, Artificial Sequence
  Synthetic Oligonucleotide; IFNG exon 3; Set C
uauuuuucugucacucuccuuggaaggaaagagcaca

SEQ ID NO: 8974 - RNA, 38 nt, Artificial Sequence
  Synthetic Oligonucleotide; IFNG exon 3; Set C
uuauuuuucugucacucuccuuggaaggaaagagcaca

SEQ ID NO: 8975 - RNA, 39 nt, Artificial Sequence
  Synthetic Oligonucleotide; IFNG exon 3; Set C
auuauuuuucugucacucuccuuggaaggaaagagcaca

SEQ ID NO: 8976 - RNA, 37 nt, Artificial Sequence
  Synthetic Oligonucleotide; IFNG exon 3; Set C
uuauuuuucugucacucuccuuggaaggaaagagcac

SEQ ID NO: 8977 - RNA, 36 nt, Artificial Sequence
  Synthetic Oligonucleotide; IFNG exon 3; Set A
uuauuuuucugucacucuccuuggaaggaaagagca

SEQ ID NO: 8978 - RNA, 38 nt, Artificial Sequence
  Synthetic Oligonucleotide; IFNG exon 3; Set A
auuauuuuucugucacucuccuuggaaggaaagagcac

SEQ ID NO: 8979 - RNA, 37 nt, Artificial Sequence
  Synthetic Oligonucleotide; IFNG exon 3; Set A
auuauuuuucugucacucuccuuggaaggaaagagca

SEQ ID NO: 8980 - RNA, 21 nt, Artificial Sequence
  Synthetic Oligonucleotide; IFNG exon 3; Set C
uuuucugucacucuccuugga

SEQ ID NO: 8981 - RNA, 22 nt, Artificial Sequence
  Synthetic Oligonucleotide; IFNG exon 3; Set C
uuuuucugucacucuccuugga

SEQ ID NO: 8982 - RNA, 23 nt, Artificial Sequence
  Synthetic Oligonucleotide; IFNG exon 3; Set C
auuuuucugucacucuccuugga

SEQ ID NO: 8983 - RNA, 21 nt, Artificial Sequence
  Synthetic Oligonucleotide; IFNG exon 3; Set C
uuuuucugucacucuccuugg

SEQ ID NO: 8984 - RNA, 24 nt, Artificial Sequence
  Synthetic Oligonucleotide; IFNG exon 3; Set A
uauuuuucugucacucuccuugga

SEQ ID NO: 8985 - RNA, 22 nt, Artificial Sequence
  Synthetic Oligonucleotide; IFNG exon 3; Set C
auuuuucugucacucuccuugg

SEQ ID NO: 8986 - RNA, 25 nt, Artificial Sequence
  Synthetic Oligonucleotide; IFNG exon 3; Set A
uuauuuuucugucacucuccuugga

SEQ ID NO: 8987 - RNA, 23 nt, Artificial Sequence
  Synthetic Oligonucleotide; IFNG exon 3; Set C
uauuuuucugucacucuccuugg

SEQ ID NO: 8988 - RNA, 24 nt, Artificial Sequence
  Synthetic Oligonucleotide; IFNG exon 3; Set C
uuauuuuucugucacucuccuugg

SEQ ID NO: 8989 - RNA, 26 nt, Artificial Sequence
  Synthetic Oligonucleotide; IFNG exon 3; Set A
auuauuuuucugucacucuccuugga

SEQ ID NO: 8990 - RNA, 25 nt, Artificial Sequence
  Synthetic Oligonucleotide; IFNG exon 3; Set C
auuauuuuucugucacucuccuugg

SEQ ID NO: 8991 - RNA, 36 nt, Artificial Sequence
  Synthetic Oligonucleotide; IFNG exon 3; Set C
uuggcucugcauuauuuuucugucacucuccuugga

SEQ ID NO: 8992 - RNA, 37 nt, Artificial Sequence
  Synthetic Oligonucleotide; IFNG exon 3; Set C
uuuggcucugcauuauuuuucugucacucuccuugga

SEQ ID NO: 8993 - RNA, 35 nt, Artificial Sequence
  Synthetic Oligonucleotide; IFNG exon 3; Set C
uuggcucugcauuauuuuucugucacucuccuugg

SEQ ID NO: 8994 - RNA, 36 nt, Artificial Sequence
  Synthetic Oligonucleotide; IFNG exon 3; Set C
uuuggcucugcauuauuuuucugucacucuccuugg

SEQ ID NO: 8995 - RNA, 38 nt, Artificial Sequence
  Synthetic Oligonucleotide; IFNG exon 3; Set C
auuuggcucugcauuauuuuucugucacucuccuugga

SEQ ID NO: 8996 - RNA, 37 nt, Artificial Sequence
  Synthetic Oligonucleotide; IFNG exon 3; Set C
auuuggcucugcauuauuuuucugucacucuccuugg

SEQ ID NO: 8997 - RNA, 18 nt, Artificial Sequence
  Synthetic Oligonucleotide; IFNG exon 3; Set C
uggcucugcauuauuuuu

SEQ ID NO: 8998 - RNA, 17 nt, Artificial Sequence
  Synthetic Oligonucleotide; IFNG exon 3; Set C
uggcucugcauuauuuu

SEQ ID NO: 8999 - RNA, 16 nt, Artificial Sequence
  Synthetic Oligonucleotide; IFNG exon 3; Set C
uggcucugcauuauuu

SEQ ID NO: 9000 - RNA, 15 nt, Artificial Sequence
  Synthetic Oligonucleotide; IFNG exon 3; Set C
uggcucugcauuauu

SEQ ID NO: 9001 - RNA, 29 nt, Artificial Sequence
  Synthetic Oligonucleotide; IFNG exon 3; Set A
aggagacaauuuggcucugcauuauuuuu

SEQ ID NO: 9002 - RNA, 28 nt, Artificial Sequence
  Synthetic Oligonucleotide; IFNG exon 3; Set A
aggagacaauuuggcucugcauuauuuu

SEQ ID NO: 9003 - RNA, 30 nt, Artificial Sequence
  Synthetic Oligonucleotide; IFNG exon 3; Set A
aaggagacaauuuggcucugcauuauuuuu

SEQ ID NO: 9004 - RNA, 29 nt, Artificial Sequence
  Synthetic Oligonucleotide; IFNG exon 3; Set A
aaggagacaauuuggcucugcauuauuuu

SEQ ID NO: 9005 - RNA, 27 nt, Artificial Sequence
  Synthetic Oligonucleotide; IFNG exon 3; Set A
aggagacaauuuggcucugcauuauuu

SEQ ID NO: 9006 - RNA, 28 nt, Artificial Sequence
  Synthetic Oligonucleotide; IFNG exon 3; Set A
aaggagacaauuuggcucugcauuauuu

SEQ ID NO: 9007 - RNA, 26 nt, Artificial Sequence
  Synthetic Oligonucleotide; IFNG exon 3; Set A
aggagacaauuuggcucugcauuauu

SEQ ID NO: 9008 - RNA, 27 nt, Artificial Sequence
  Synthetic Oligonucleotide; IFNG exon 3; Set A
aaggagacaauuuggcucugcauuauu

SEQ ID NO: 9009 - RNA, 25 nt, Artificial Sequence
  Synthetic Oligonucleotide; IFNG exon 3; Set A
aggagacaauuuggcucugcauuau

SEQ ID NO: 9010 - RNA, 26 nt, Artificial Sequence
  Synthetic Oligonucleotide; IFNG exon 3; Set A
aaggagacaauuuggcucugcauuau

SEQ ID NO: 9011 - RNA, 24 nt, Artificial Sequence
  Synthetic Oligonucleotide; IFNG exon 3; Set A
aggagacaauuuggcucugcauua

SEQ ID NO: 9012 - RNA, 34 nt, Artificial Sequence
  Synthetic Oligonucleotide; IFNG exon 3; Set A
guaaaaggagacaauuuggcucugcauuauuuuu

SEQ ID NO: 9013 - RNA, 25 nt, Artificial Sequence
  Synthetic Oligonucleotide; IFNG exon 3; Set A
aaggagacaauuuggcucugcauua

SEQ ID NO: 9014 - RNA, 23 nt, Artificial Sequence
  Synthetic Oligonucleotide; IFNG exon 3; Set A
aggagacaauuuggcucugcauu

SEQ ID NO: 9015 - RNA, 35 nt, Artificial Sequence
  Synthetic Oligonucleotide; IFNG exon 3; Set A
aguaaaaggagacaauuuggcucugcauuauuuuu

SEQ ID NO: 9016 - RNA, 24 nt, Artificial Sequence
  Synthetic Oligonucleotide; IFNG exon 3; Set A
aaggagacaauuuggcucugcauu

SEQ ID NO: 9017 - RNA, 36 nt, Artificial Sequence
  Synthetic Oligonucleotide; IFNG exon 3; Set A
aaguaaaaggagacaauuuggcucugcauuauuuuu

SEQ ID NO: 9018 - RNA, 33 nt, Artificial Sequence
  Synthetic Oligonucleotide; IFNG exon 3; Set A
aguaaaaggagacaauuuggcucugcauuauuu

SEQ ID NO: 9019 - RNA, 35 nt, Artificial Sequence
  Synthetic Oligonucleotide; IFNG exon 3; Set A
aaguaaaaggagacaauuuggcucugcauuauuuu

SEQ ID NO: 9020 - RNA, 37 nt, Artificial Sequence
  Synthetic Oligonucleotide; IFNG exon 3; Set A
gaaguaaaaggagacaauuuggcucugcauuauuuuu

SEQ ID NO: 9021 - RNA, 32 nt, Artificial Sequence
  Synthetic Oligonucleotide; IFNG exon 3; Set A
aguaaaaggagacaauuuggcucugcauuauu

SEQ ID NO: 9022 - RNA, 34 nt, Artificial Sequence
  Synthetic Oligonucleotide; IFNG exon 3; Set A
aaguaaaaggagacaauuuggcucugcauuauuu

SEQ ID NO: 9023 - RNA, 31 nt, Artificial Sequence
  Synthetic Oligonucleotide; IFNG exon 3; Set A
aguaaaaggagacaauuuggcucugcauuau

SEQ ID NO: 9024 - RNA, 35 nt, Artificial Sequence
  Synthetic Oligonucleotide; IFNG exon 3; Set A
gaaguaaaaggagacaauuuggcucugcauuauuu

SEQ ID NO: 9025 - RNA, 33 nt, Artificial Sequence
  Synthetic Oligonucleotide; IFNG exon 3; Set A
aaguaaaaggagacaauuuggcucugcauuauu

SEQ ID NO: 9026 - RNA, 30 nt, Artificial Sequence
  Synthetic Oligonucleotide; IFNG exon 3; Set A
aguaaaaggagacaauuuggcucugcauua

SEQ ID NO: 9027 - RNA, 34 nt, Artificial Sequence
  Synthetic Oligonucleotide; IFNG exon 3; Set A
gaaguaaaaggagacaauuuggcucugcauuauu

SEQ ID NO: 9028 - RNA, 32 nt, Artificial Sequence
  Synthetic Oligonucleotide; IFNG exon 3; Set A
aaguaaaaggagacaauuuggcucugcauuau

SEQ ID NO: 9029 - RNA, 28 nt, Artificial Sequence
  Synthetic Oligonucleotide; IFNG exon 3; Set A
guaaaaggagacaauuuggcucugcauu

SEQ ID NO: 9030 - RNA, 33 nt, Artificial Sequence
  Synthetic Oligonucleotide; IFNG exon 3; Set A
gaaguaaaaggagacaauuuggcucugcauuau

SEQ ID NO: 9031 - RNA, 31 nt, Artificial Sequence
  Synthetic Oligonucleotide; IFNG exon 3; Set A
aaguaaaaggagacaauuuggcucugcauua

SEQ ID NO: 9032 - RNA, 29 nt, Artificial Sequence
  Synthetic Oligonucleotide; IFNG exon 3; Set A
aguaaaaggagacaauuuggcucugcauu

SEQ ID NO: 9033 - RNA, 32 nt, Artificial Sequence
  Synthetic Oligonucleotide; IFNG exon 3; Set A
gaaguaaaaggagacaauuuggcucugcauua

SEQ ID NO: 9034 - RNA, 30 nt, Artificial Sequence
  Synthetic Oligonucleotide; IFNG exon 3; Set A
aaguaaaaggagacaauuuggcucugcauu

SEQ ID NO: 9035 - RNA, 31 nt, Artificial Sequence
  Synthetic Oligonucleotide; IFNG exon 3; Set A
gaaguaaaaggagacaauuuggcucugcauu

SEQ ID NO: 9036 - RNA, 15 nt, Artificial Sequence
  Synthetic Oligonucleotide; IFNG exon 3; Set C
aaggagacaauuugg

SEQ ID NO: 9037 - RNA, 16 nt, Artificial Sequence
  Synthetic Oligonucleotide; IFNG exon 3; Set C
aaaggagacaauuugg

SEQ ID NO: 9038 - RNA, 17 nt, Artificial Sequence
  Synthetic Oligonucleotide; IFNG exon 3; Set C
aaaaggagacaauuugg

SEQ ID NO: 9039 - RNA, 18 nt, Artificial Sequence
  Synthetic Oligonucleotide; IFNG exon 3; Set C
uaaaaggagacaauuugg

SEQ ID NO: 9040 - RNA, 19 nt, Artificial Sequence
  Synthetic Oligonucleotide; IFNG exon 3; Set C
guaaaaggagacaauuugg

SEQ ID NO: 9041 - RNA, 20 nt, Artificial Sequence
  Synthetic Oligonucleotide; IFNG exon 3; Set C
aguaaaaggagacaauuugg

SEQ ID NO: 9042 - RNA, 20 nt, Artificial Sequence
  Synthetic Oligonucleotide; IFNG exon 3; Set C
aaguaaaaggagacaauuug

SEQ ID NO: 9043 - RNA, 22 nt, Artificial Sequence
  Synthetic Oligonucleotide; IFNG exon 3; Set C
gaaguaaaaggagacaauuugg

SEQ ID NO: 9044 - RNA, 23 nt, Artificial Sequence
  Synthetic Oligonucleotide; IFNG exon 3; Set C
ugaaguaaaaggagacaauuugg

SEQ ID NO: 9045 - RNA, 29 nt, Artificial Sequence
  Synthetic Oligonucleotide; IFNG exon 3; Set C
aaaguuugaaguaaaaggagacaauuugg

SEQ ID NO: 9046 - RNA, 21 nt, Artificial Sequence
  Synthetic Oligonucleotide; IFNG exon 3; Set C
uuugaaguaaaaggagacaau

SEQ ID NO: 9047 - RNA, 30 nt, Artificial Sequence
  Synthetic Oligonucleotide; IFNG exon 3; Set C
aaaaguuugaaguaaaaggagacaauuugg

SEQ ID NO: 9048 - RNA, 22 nt, Artificial Sequence
  Synthetic Oligonucleotide; IFNG exon 3; Set C
guuugaaguaaaaggagacaau

SEQ ID NO: 9049 - RNA, 31 nt, Artificial Sequence
  Synthetic Oligonucleotide; IFNG exon 3; Set C
aaaaaguuugaaguaaaaggagacaauuugg

SEQ ID NO: 9050 - RNA, 36 nt, Artificial Sequence
  Synthetic Oligonucleotide; IFNG exon 3; Set C
guuuuuaaaaaguuugaaguaaaaggagacaauuug

SEQ ID NO: 9051 - RNA, 30 nt, Artificial Sequence
  Synthetic Oligonucleotide; IFNG exon 3; Set C
uuuaaaaaguuugaaguaaaaggagacaau

SEQ ID NO: 9052 - RNA, 35 nt, Artificial Sequence
  Synthetic Oligonucleotide; IFNG exon 3; Set C
guuuuuaaaaaguuugaaguaaaaggagacaauuu

SEQ ID NO: 9053 - RNA, 31 nt, Artificial Sequence
  Synthetic Oligonucleotide; IFNG exon 3; Set C
uuuuaaaaaguuugaaguaaaaggagacaau

SEQ ID NO: 9054 - RNA, 34 nt, Artificial Sequence
  Synthetic Oligonucleotide; IFNG exon 3; Set C
guuuuuaaaaaguuugaaguaaaaggagacaauu

SEQ ID NO: 9055 - RNA, 32 nt, Artificial Sequence
  Synthetic Oligonucleotide; IFNG exon 3; Set C
uuuuuaaaaaguuugaaguaaaaggagacaau

SEQ ID NO: 9056 - RNA, 39 nt, Artificial Sequence
  Synthetic Oligonucleotide; IFNG exon 3; Set C
uaaaguuuuuaaaaaguuugaaguaaaaggagacaauuu

SEQ ID NO: 9057 - RNA, 40 nt, Artificial Sequence
  Synthetic Oligonucleotide; IFNG exon 3; Set C
uuaaaguuuuuaaaaaguuugaaguaaaaggagacaauuu

SEQ ID NO: 9058 - RNA, 38 nt, Artificial Sequence
  Synthetic Oligonucleotide; IFNG exon 3; Set C
uaaaguuuuuaaaaaguuugaaguaaaaggagacaauu

SEQ ID NO: 9059 - RNA, 26 nt, Artificial Sequence
  Synthetic Oligonucleotide; IFNG exon 3; Set C
guuuuuaaaaaguuugaaguaaaagg

SEQ ID NO: 9060 - RNA, 25 nt, Artificial Sequence
  Synthetic Oligonucleotide; IFNG exon 3; Set C
guuuuuaaaaaguuugaaguaaaag

SEQ ID NO: 9061 - RNA, 23 nt, Artificial Sequence
  Synthetic Oligonucleotide; IFNG exon 3; Set C
guuuuuaaaaaguuugaaguaaa

SEQ ID NO: 9062 - RNA, 22 nt, Artificial Sequence
  Synthetic Oligonucleotide; IFNG exon 3; Set C
guuuuuaaaaaguuugaaguaa

SEQ ID NO: 9063 - RNA, 21 nt, Artificial Sequence
  Synthetic Oligonucleotide; IFNG exon 3; Set C
guuuuuaaaaaguuugaagua

SEQ ID NO: 9064 - RNA, 28 nt, Artificial Sequence
  Synthetic Oligonucleotide; IFNG exon 3; Set C
uaaaguuuuuaaaaaguuugaaguaaaa

SEQ ID NO: 9065 - RNA, 20 nt, Artificial Sequence
  Synthetic Oligonucleotide; IFNG exon 3; Set C
guuuuuaaaaaguuugaagu

SEQ ID NO: 9066 - RNA, 29 nt, Artificial Sequence
  Synthetic Oligonucleotide; IFNG exon 3; Set C
uuaaaguuuuuaaaaaguuugaaguaaaa

SEQ ID NO: 9067 - RNA, 27 nt, Artificial Sequence
  Synthetic Oligonucleotide; IFNG exon 3; Set C
uaaaguuuuuaaaaaguuugaaguaaa

SEQ ID NO: 9068 - RNA, 19 nt, Artificial Sequence
  Synthetic Oligonucleotide; IFNG exon 3; Set C
guuuuuaaaaaguuugaag

SEQ ID NO: 9069 - RNA, 30 nt, Artificial Sequence
  Synthetic Oligonucleotide; IFNG exon 3; Set C
uuuaaaguuuuuaaaaaguuugaaguaaaa

SEQ ID NO: 9070 - RNA, 26 nt, Artificial Sequence
  Synthetic Oligonucleotide; IFNG exon 3; Set C
uaaaguuuuuaaaaaguuugaaguaa

SEQ ID NO: 9071 - RNA, 18 nt, Artificial Sequence
  Synthetic Oligonucleotide; IFNG exon 3; Set C
guuuuuaaaaaguuugaa

SEQ ID NO: 9072 - RNA, 17 nt, Artificial Sequence
  Synthetic Oligonucleotide; IFNG exon 3; Set C
guuuuuaaaaaguuuga

SEQ ID NO: 9073 - RNA, 37 nt, Artificial Sequence
  Synthetic Oligonucleotide; IFNG exon 3; Set C
ucaucuuuaaaguuuuuaaaaaguuugaaguaaaagg

SEQ ID NO: 9074 - RNA, 36 nt, Artificial Sequence
  Synthetic Oligonucleotide; IFNG exon 3; Set C
ucaucuuuaaaguuuuuaaaaaguuugaaguaaaag

SEQ ID NO: 9075 - RNA, 38 nt, Artificial Sequence
  Synthetic Oligonucleotide; IFNG exon 3; Set C
gucaucuuuaaaguuuuuaaaaaguuugaaguaaaagg

SEQ ID NO: 9076 - RNA, 37 nt, Artificial Sequence
  Synthetic Oligonucleotide; IFNG exon 3; Set C
gucaucuuuaaaguuuuuaaaaaguuugaaguaaaag

SEQ ID NO: 9077 - RNA, 39 nt, Artificial Sequence
  Synthetic Oligonucleotide; IFNG exon 3; Set C
ggucaucuuuaaaguuuuuaaaaaguuugaaguaaaagg

SEQ ID NO: 9078 - RNA, 20 nt, Artificial Sequence
  Synthetic Oligonucleotide; IFNG exon 3; Set C
uaaaguuuuuaaaaaguuug

SEQ ID NO: 9079 - RNA, 38 nt, Artificial Sequence
  Synthetic Oligonucleotide; IFNG exon 3; Set C
ggucaucuuuaaaguuuuuaaaaaguuugaaguaaaag

SEQ ID NO: 9080 - RNA, 19 nt, Artificial Sequence
  Synthetic Oligonucleotide; IFNG exon 3; Set C
uaaaguuuuuaaaaaguuu

SEQ ID NO: 9081 - RNA, 21 nt, Artificial Sequence
  Synthetic Oligonucleotide; IFNG exon 3; Set C
uuaaaguuuuuaaaaaguuug

SEQ ID NO: 9082 - RNA, 39 nt, Artificial Sequence
  Synthetic Oligonucleotide; IFNG exon 3; Set C
uggucaucuuuaaaguuuuuaaaaaguuugaaguaaaag

SEQ ID NO: 9083 - RNA, 18 nt, Artificial Sequence
  Synthetic Oligonucleotide; IFNG exon 3; Set C
uaaaguuuuuaaaaaguu

SEQ ID NO: 9084 - RNA, 20 nt, Artificial Sequence
  Synthetic Oligonucleotide; IFNG exon 3; Set C
uuaaaguuuuuaaaaaguuu

SEQ ID NO: 9085 - RNA, 22 nt, Artificial Sequence
  Synthetic Oligonucleotide; IFNG exon 3; Set C
uuuaaaguuuuuaaaaaguuug

SEQ ID NO: 9086 - RNA, 38 nt, Artificial Sequence
  Synthetic Oligonucleotide; IFNG exon 3; Set C
uggucaucuuuaaaguuuuuaaaaaguuugaaguaaaa

SEQ ID NO: 9087 - RNA, 32 nt, Artificial Sequence
  Synthetic Oligonucleotide; IFNG exon 3; Set C
ucaucuuuaaaguuuuuaaaaaguuugaagua

SEQ ID NO: 9088 - RNA, 40 nt, Artificial Sequence
  Synthetic Oligonucleotide; IFNG exon 3; Set C
cuggucaucuuuaaaguuuuuaaaaaguuugaaguaaaag

SEQ ID NO: 9089 - RNA, 19 nt, Artificial Sequence
  Synthetic Oligonucleotide; IFNG exon 3; Set C
uuaaaguuuuuaaaaaguu

SEQ ID NO: 9090 - RNA, 21 nt, Artificial Sequence
  Synthetic Oligonucleotide; IFNG exon 3; Set C
uuuaaaguuuuuaaaaaguuu

SEQ ID NO: 9091 - RNA, 17 nt, Artificial Sequence
  Synthetic Oligonucleotide; IFNG exon 3; Set C
uaaaguuuuuaaaaagu

SEQ ID NO: 9092 - RNA, 39 nt, Artificial Sequence
  Synthetic Oligonucleotide; IFNG exon 3; Set C
cuggucaucuuuaaaguuuuuaaaaaguuugaaguaaaa

SEQ ID NO: 9093 - RNA, 37 nt, Artificial Sequence
  Synthetic Oligonucleotide; IFNG exon 3; Set C
uggucaucuuuaaaguuuuuaaaaaguuugaaguaaa

SEQ ID NO: 9094 - RNA, 33 nt, Artificial Sequence
  Synthetic Oligonucleotide; IFNG exon 3; Set C
gucaucuuuaaaguuuuuaaaaaguuugaagua

SEQ ID NO: 9095 - RNA, 31 nt, Artificial Sequence
  Synthetic Oligonucleotide; IFNG exon 3; Set C
ucaucuuuaaaguuuuuaaaaaguuugaagu

SEQ ID NO: 9096 - RNA, 20 nt, Artificial Sequence
  Synthetic Oligonucleotide; IFNG exon 3; Set C
uuuaaaguuuuuaaaaaguu

SEQ ID NO: 9097 - RNA, 18 nt, Artificial Sequence
  Synthetic Oligonucleotide; IFNG exon 3; Set C
uuaaaguuuuuaaaaagu

SEQ ID NO: 9098 - RNA, 40 nt, Artificial Sequence
  Synthetic Oligonucleotide; IFNG exon 3; Set C
ucuggucaucuuuaaaguuuuuaaaaaguuugaaguaaaa

SEQ ID NO: 9099 - RNA, 36 nt, Artificial Sequence
  Synthetic Oligonucleotide; IFNG exon 3; Set C
uggucaucuuuaaaguuuuuaaaaaguuugaaguaa

SEQ ID NO: 9100 - RNA, 38 nt, Artificial Sequence
  Synthetic Oligonucleotide; IFNG exon 3; Set C
cuggucaucuuuaaaguuuuuaaaaaguuugaaguaaa

SEQ ID NO: 9101 - RNA, 34 nt, Artificial Sequence
  Synthetic Oligonucleotide; IFNG exon 3; Set C
ggucaucuuuaaaguuuuuaaaaaguuugaagua

SEQ ID NO: 9102 - RNA, 32 nt, Artificial Sequence
  Synthetic Oligonucleotide; IFNG exon 3; Set C
gucaucuuuaaaguuuuuaaaaaguuugaagu

SEQ ID NO: 9103 - RNA, 30 nt, Artificial Sequence
  Synthetic Oligonucleotide; IFNG exon 3; Set C
ucaucuuuaaaguuuuuaaaaaguuugaag

SEQ ID NO: 9104 - RNA, 19 nt, Artificial Sequence
  Synthetic Oligonucleotide; IFNG exon 3; Set C
uuuaaaguuuuuaaaaagu

SEQ ID NO: 9105 - RNA, 37 nt, Artificial Sequence
  Synthetic Oligonucleotide; IFNG exon 3; Set C
cuggucaucuuuaaaguuuuuaaaaaguuugaaguaa

SEQ ID NO: 9106 - RNA, 39 nt, Artificial Sequence
  Synthetic Oligonucleotide; IFNG exon 3; Set C
ucuggucaucuuuaaaguuuuuaaaaaguuugaaguaaa

SEQ ID NO: 9107 - RNA, 35 nt, Artificial Sequence
  Synthetic Oligonucleotide; IFNG exon 3; Set C
uggucaucuuuaaaguuuuuaaaaaguuugaagua

SEQ ID NO: 9108 - RNA, 33 nt, Artificial Sequence
  Synthetic Oligonucleotide; IFNG exon 3; Set C
ggucaucuuuaaaguuuuuaaaaaguuugaagu

SEQ ID NO: 9109 - RNA, 29 nt, Artificial Sequence
  Synthetic Oligonucleotide; IFNG exon 3; Set C
ucaucuuuaaaguuuuuaaaaaguuugaa

SEQ ID NO: 9110 - RNA, 31 nt, Artificial Sequence
  Synthetic Oligonucleotide; IFNG exon 3; Set C
gucaucuuuaaaguuuuuaaaaaguuugaag

SEQ ID NO: 9111 - RNA, 38 nt, Artificial Sequence
  Synthetic Oligonucleotide; IFNG exon 3; Set C
ucuggucaucuuuaaaguuuuuaaaaaguuugaaguaa

SEQ ID NO: 9112 - RNA, 40 nt, Artificial Sequence
  Synthetic Oligonucleotide; IFNG exon 3; Set C
cucuggucaucuuuaaaguuuuuaaaaaguuugaaguaaa

SEQ ID NO: 9113 - RNA, 28 nt, Artificial Sequence
  Synthetic Oligonucleotide; IFNG exon 3; Set C
ucaucuuuaaaguuuuuaaaaaguuuga

SEQ ID NO: 9114 - RNA, 36 nt, Artificial Sequence
  Synthetic Oligonucleotide; IFNG exon 3; Set C
cuggucaucuuuaaaguuuuuaaaaaguuugaagua

SEQ ID NO: 9115 - RNA, 30 nt, Artificial Sequence
  Synthetic Oligonucleotide; IFNG exon 3; Set C
gucaucuuuaaaguuuuuaaaaaguuugaa

SEQ ID NO: 9116 - RNA, 32 nt, Artificial Sequence
  Synthetic Oligonucleotide; IFNG exon 3; Set C
ggucaucuuuaaaguuuuuaaaaaguuugaag

SEQ ID NO: 9117 - RNA, 39 nt, Artificial Sequence
  Synthetic Oligonucleotide; IFNG exon 3; Set C
cucuggucaucuuuaaaguuuuuaaaaaguuugaaguaa

SEQ ID NO: 9118 - RNA, 29 nt, Artificial Sequence
  Synthetic Oligonucleotide; IFNG exon 3; Set C
gucaucuuuaaaguuuuuaaaaaguuuga

SEQ ID NO: 9119 - RNA, 37 nt, Artificial Sequence
  Synthetic Oligonucleotide; IFNG exon 3; Set C
ucuggucaucuuuaaaguuuuuaaaaaguuugaagua

SEQ ID NO: 9120 - RNA, 31 nt, Artificial Sequence
  Synthetic Oligonucleotide; IFNG exon 3; Set C
ggucaucuuuaaaguuuuuaaaaaguuugaa

SEQ ID NO: 9121 - RNA, 38 nt, Artificial Sequence
  Synthetic Oligonucleotide; IFNG exon 3; Set C
cucuggucaucuuuaaaguuuuuaaaaaguuugaagua

SEQ ID NO: 9122 - RNA, 31 nt, Artificial Sequence
  Synthetic Oligonucleotide; IFNG exon 3; Set C
uggucaucuuuaaaguuuuuaaaaaguuuga

SEQ ID NO: 9123 - RNA, 30 nt, Artificial Sequence
  Synthetic Oligonucleotide; IFNG exon 3; Set C
uggucaucuuuaaaguuuuuaaaaaguuug

SEQ ID NO: 9124 - RNA, 32 nt, Artificial Sequence
  Synthetic Oligonucleotide; IFNG exon 3; Set C
cuggucaucuuuaaaguuuuuaaaaaguuuga

SEQ ID NO: 9125 - RNA, 29 nt, Artificial Sequence
  Synthetic Oligonucleotide; IFNG exon 3; Set C
uggucaucuuuaaaguuuuuaaaaaguuu

SEQ ID NO: 9126 - RNA, 31 nt, Artificial Sequence
  Synthetic Oligonucleotide; IFNG exon 3; Set C
cuggucaucuuuaaaguuuuuaaaaaguuug

SEQ ID NO: 9127 - RNA, 23 nt, Artificial Sequence
  Synthetic Oligonucleotide; IFNG exon 3; Set C
ucaucuuuaaaguuuuuaaaaag

SEQ ID NO: 9128 - RNA, 33 nt, Artificial Sequence
  Synthetic Oligonucleotide; IFNG exon 3; Set C
ucuggucaucuuuaaaguuuuuaaaaaguuuga

SEQ ID NO: 9129 - RNA, 28 nt, Artificial Sequence
  Synthetic Oligonucleotide; IFNG exon 3; Set C
uggucaucuuuaaaguuuuuaaaaaguu

SEQ ID NO: 9130 - RNA, 30 nt, Artificial Sequence
  Synthetic Oligonucleotide; IFNG exon 3; Set C
cuggucaucuuuaaaguuuuuaaaaaguuu

SEQ ID NO: 9131 - RNA, 32 nt, Artificial Sequence
  Synthetic Oligonucleotide; IFNG exon 3; Set C
ucuggucaucuuuaaaguuuuuaaaaaguuug

SEQ ID NO: 9132 - RNA, 24 nt, Artificial Sequence
  Synthetic Oligonucleotide; IFNG exon 3; Set C
gucaucuuuaaaguuuuuaaaaag

SEQ ID NO: 9133 - RNA, 34 nt, Artificial Sequence
  Synthetic Oligonucleotide; IFNG exon 3; Set C
cucuggucaucuuuaaaguuuuuaaaaaguuuga

SEQ ID NO: 9134 - RNA, 22 nt, Artificial Sequence
  Synthetic Oligonucleotide; IFNG exon 3; Set C
ucaucuuuaaaguuuuuaaaaa

SEQ ID NO: 9135 - RNA, 29 nt, Artificial Sequence
  Synthetic Oligonucleotide; IFNG exon 3; Set C
cuggucaucuuuaaaguuuuuaaaaaguu

SEQ ID NO: 9136 - RNA, 31 nt, Artificial Sequence
  Synthetic Oligonucleotide; IFNG exon 3; Set C
ucuggucaucuuuaaaguuuuuaaaaaguuu

SEQ ID NO: 9137 - RNA, 27 nt, Artificial Sequence
  Synthetic Oligonucleotide; IFNG exon 3; Set C
uggucaucuuuaaaguuuuuaaaaagu

SEQ ID NO: 9138 - RNA, 33 nt, Artificial Sequence
  Synthetic Oligonucleotide; IFNG exon 3; Set C
cucuggucaucuuuaaaguuuuuaaaaaguuug

SEQ ID NO: 9139 - RNA, 25 nt, Artificial Sequence
  Synthetic Oligonucleotide; IFNG exon 3; Set C
ggucaucuuuaaaguuuuuaaaaag

SEQ ID NO: 9140 - RNA, 23 nt, Artificial Sequence
  Synthetic Oligonucleotide; IFNG exon 3; Set C
gucaucuuuaaaguuuuuaaaaa

SEQ ID NO: 9141 - RNA, 21 nt, Artificial Sequence
  Synthetic Oligonucleotide; IFNG exon 3; Set C
ucaucuuuaaaguuuuuaaaa

SEQ ID NO: 9142 - RNA, 30 nt, Artificial Sequence
  Synthetic Oligonucleotide; IFNG exon 3; Set C
ucuggucaucuuuaaaguuuuuaaaaaguu

SEQ ID NO: 9143 - RNA, 32 nt, Artificial Sequence
  Synthetic Oligonucleotide; IFNG exon 3; Set C
cucuggucaucuuuaaaguuuuuaaaaaguuu

SEQ ID NO: 9144 - RNA, 28 nt, Artificial Sequence
  Synthetic Oligonucleotide; IFNG exon 3; Set C
cuggucaucuuuaaaguuuuuaaaaagu

SEQ ID NO: 9145 - RNA, 26 nt, Artificial Sequence
  Synthetic Oligonucleotide; IFNG exon 3; Set C
uggucaucuuuaaaguuuuuaaaaag

SEQ ID NO: 9146 - RNA, 24 nt, Artificial Sequence
  Synthetic Oligonucleotide; IFNG exon 3; Set C
ggucaucuuuaaaguuuuuaaaaa

SEQ ID NO: 9147 - RNA, 22 nt, Artificial Sequence
  Synthetic Oligonucleotide; IFNG exon 3; Set C
gucaucuuuaaaguuuuuaaaa

SEQ ID NO: 9148 - RNA, 20 nt, Artificial Sequence
  Synthetic Oligonucleotide; IFNG exon 3; Set C
ucaucuuuaaaguuuuuaaa

SEQ ID NO: 9149 - RNA, 31 nt, Artificial Sequence
  Synthetic Oligonucleotide; IFNG exon 3; Set C
cucuggucaucuuuaaaguuuuuaaaaaguu

SEQ ID NO: 9150 - RNA, 29 nt, Artificial Sequence
  Synthetic Oligonucleotide; IFNG exon 3; Set C
ucuggucaucuuuaaaguuuuuaaaaagu

SEQ ID NO: 9151 - RNA, 19 nt, Artificial Sequence
  Synthetic Oligonucleotide; IFNG exon 3; Set C
ucaucuuuaaaguuuuuaa

SEQ ID NO: 9152 - RNA, 27 nt, Artificial Sequence
  Synthetic Oligonucleotide; IFNG exon 3; Set C
cuggucaucuuuaaaguuuuuaaaaag

SEQ ID NO: 9153 - RNA, 23 nt, Artificial Sequence
  Synthetic Oligonucleotide; IFNG exon 3; Set C
ggucaucuuuaaaguuuuuaaaa

SEQ ID NO: 9154 - RNA, 21 nt, Artificial Sequence
  Synthetic Oligonucleotide; IFNG exon 3; Set C
gucaucuuuaaaguuuuuaaa

SEQ ID NO: 9155 - RNA, 30 nt, Artificial Sequence
  Synthetic Oligonucleotide; IFNG exon 3; Set C
cucuggucaucuuuaaaguuuuuaaaaagu

SEQ ID NO: 9156 - RNA, 20 nt, Artificial Sequence
  Synthetic Oligonucleotide; IFNG exon 3; Set C
gucaucuuuaaaguuuuuaa

SEQ ID NO: 9157 - RNA, 18 nt, Artificial Sequence
  Synthetic Oligonucleotide; IFNG exon 3; Set C
ucaucuuuaaaguuuuua

SEQ ID NO: 9158 - RNA, 28 nt, Artificial Sequence
  Synthetic Oligonucleotide; IFNG exon 3; Set C
ucuggucaucuuuaaaguuuuuaaaaag

SEQ ID NO: 9159 - RNA, 22 nt, Artificial Sequence
  Synthetic Oligonucleotide; IFNG exon 3; Set C
ggucaucuuuaaaguuuuuaaa

SEQ ID NO: 9160 - RNA, 17 nt, Artificial Sequence
  Synthetic Oligonucleotide; IFNG exon 3; Set C
ucaucuuuaaaguuuuu

SEQ ID NO: 9161 - RNA, 21 nt, Artificial Sequence
  Synthetic Oligonucleotide; IFNG exon 3; Set C
ggucaucuuuaaaguuuuuaa

SEQ ID NO: 9162 - RNA, 19 nt, Artificial Sequence
  Synthetic Oligonucleotide; IFNG exon 3; Set C
gucaucuuuaaaguuuuua

SEQ ID NO: 9163 - RNA, 29 nt, Artificial Sequence
  Synthetic Oligonucleotide; IFNG exon 3; Set C
cucuggucaucuuuaaaguuuuuaaaaag

SEQ ID NO: 9164 - RNA, 16 nt, Artificial Sequence
  Synthetic Oligonucleotide; IFNG exon 3; Set C
ucaucuuuaaaguuuu

SEQ ID NO: 9165 - RNA, 18 nt, Artificial Sequence
  Synthetic Oligonucleotide; IFNG exon 3; Set C
gucaucuuuaaaguuuuu

SEQ ID NO: 9166 - RNA, 20 nt, Artificial Sequence
  Synthetic Oligonucleotide; IFNG exon 3; Set C
ggucaucuuuaaaguuuuua

SEQ ID NO: 9167 - RNA, 22 nt, Artificial Sequence
  Synthetic Oligonucleotide; IFNG exon 3; Set C
uggucaucuuuaaaguuuuuaa

SEQ ID NO: 9168 - RNA, 15 nt, Artificial Sequence
  Synthetic Oligonucleotide; IFNG exon 3; Set C
ucaucuuuaaaguuu

SEQ ID NO: 9169 - RNA, 17 nt, Artificial Sequence
  Synthetic Oligonucleotide; IFNG exon 3; Set C
gucaucuuuaaaguuuu

SEQ ID NO: 9170 - RNA, 19 nt, Artificial Sequence
  Synthetic Oligonucleotide; IFNG exon 3; Set C
ggucaucuuuaaaguuuuu

SEQ ID NO: 9171 - RNA, 21 nt, Artificial Sequence
  Synthetic Oligonucleotide; IFNG exon 3; Set C
uggucaucuuuaaaguuuuua

SEQ ID NO: 9172 - RNA, 23 nt, Artificial Sequence
  Synthetic Oligonucleotide; IFNG exon 3; Set C
cuggucaucuuuaaaguuuuuaa

SEQ ID NO: 9173 - RNA, 16 nt, Artificial Sequence
  Synthetic Oligonucleotide; IFNG exon 3; Set C
gucaucuuuaaaguuu

SEQ ID NO: 9174 - RNA, 18 nt, Artificial Sequence
  Synthetic Oligonucleotide; IFNG exon 3; Set C
ggucaucuuuaaaguuuu

SEQ ID NO: 9175 - RNA, 20 nt, Artificial Sequence
  Synthetic Oligonucleotide; IFNG exon 3; Set C
uggucaucuuuaaaguuuuu

SEQ ID NO: 9176 - RNA, 22 nt, Artificial Sequence
  Synthetic Oligonucleotide; IFNG exon 3; Set C
cuggucaucuuuaaaguuuuua

SEQ ID NO: 9177 - RNA, 24 nt, Artificial Sequence
  Synthetic Oligonucleotide; IFNG exon 3; Set C
ucuggucaucuuuaaaguuuuuaa

SEQ ID NO: 9178 - RNA, 17 nt, Artificial Sequence
  Synthetic Oligonucleotide; IFNG exon 3; Set C
ggucaucuuuaaaguuu

SEQ ID NO: 9179 - RNA, 19 nt, Artificial Sequence
  Synthetic Oligonucleotide; IFNG exon 3; Set C
uggucaucuuuaaaguuuu

SEQ ID NO: 9180 - RNA, 21 nt, Artificial Sequence
  Synthetic Oligonucleotide; IFNG exon 3; Set C
cuggucaucuuuaaaguuuuu

SEQ ID NO: 9181 - RNA, 23 nt, Artificial Sequence
  Synthetic Oligonucleotide; IFNG exon 3; Set C
ucuggucaucuuuaaaguuuuua

SEQ ID NO: 9182 - RNA, 25 nt, Artificial Sequence
  Synthetic Oligonucleotide; IFNG exon 3; Set C
cucuggucaucuuuaaaguuuuuaa

SEQ ID NO: 9183 - RNA, 18 nt, Artificial Sequence
  Synthetic Oligonucleotide; IFNG exon 3; Set C
uggucaucuuuaaaguuu

SEQ ID NO: 9184 - RNA, 20 nt, Artificial Sequence
  Synthetic Oligonucleotide; IFNG exon 3; Set C
cuggucaucuuuaaaguuuu

SEQ ID NO: 9185 - RNA, 22 nt, Artificial Sequence
  Synthetic Oligonucleotide; IFNG exon 3; Set C
ucuggucaucuuuaaaguuuuu

SEQ ID NO: 9186 - RNA, 24 nt, Artificial Sequence
  Synthetic Oligonucleotide; IFNG exon 3; Set C
cucuggucaucuuuaaaguuuuua

SEQ ID NO: 9187 - RNA, 19 nt, Artificial Sequence
  Synthetic Oligonucleotide; IFNG exon 3; Set C
cuggucaucuuuaaaguuu

SEQ ID NO: 9188 - RNA, 21 nt, Artificial Sequence
  Synthetic Oligonucleotide; IFNG exon 3; Set C
ucuggucaucuuuaaaguuuu

SEQ ID NO: 9189 - RNA, 23 nt, Artificial Sequence
  Synthetic Oligonucleotide; IFNG exon 3; Set C
cucuggucaucuuuaaaguuuuu

SEQ ID NO: 9190 - RNA, 20 nt, Artificial Sequence
  Synthetic Oligonucleotide; IFNG exon 3; Set C
ucuggucaucuuuaaaguuu

SEQ ID NO: 9191 - RNA, 22 nt, Artificial Sequence
  Synthetic Oligonucleotide; IFNG exon 3; Set C
cucuggucaucuuuaaaguuuu

SEQ ID NO: 9192 - RNA, 21 nt, Artificial Sequence
  Synthetic Oligonucleotide; IFNG exon 3; Set C
cucuggucaucuuuaaaguuu

SEQ ID NO: 9193 - RNA, 35 nt, Artificial Sequence
  Synthetic Oligonucleotide; IFNG exon 3; Set C
uuggaugcucuggucaucuuuaaaguuuuuaaaaa

SEQ ID NO: 9194 - RNA, 34 nt, Artificial Sequence
  Synthetic Oligonucleotide; IFNG exon 3; Set A
uuggaugcucuggucaucuuuaaaguuuuuaaaa

SEQ ID NO: 9195 - RNA, 36 nt, Artificial Sequence
  Synthetic Oligonucleotide; IFNG exon 3; Set A
uuuggaugcucuggucaucuuuaaaguuuuuaaaaa

SEQ ID NO: 9196 - RNA, 33 nt, Artificial Sequence
  Synthetic Oligonucleotide; IFNG exon 3; Set A
uuggaugcucuggucaucuuuaaaguuuuuaaa

SEQ ID NO: 9197 - RNA, 37 nt, Artificial Sequence
  Synthetic Oligonucleotide; IFNG exon 3; Set A
uuuuggaugcucuggucaucuuuaaaguuuuuaaaaa

SEQ ID NO: 9198 - RNA, 35 nt, Artificial Sequence
  Synthetic Oligonucleotide; IFNG exon 3; Set A
uuuggaugcucuggucaucuuuaaaguuuuuaaaa

SEQ ID NO: 9199 - RNA, 36 nt, Artificial Sequence
  Synthetic Oligonucleotide; IFNG exon 3; Set A
uuuuggaugcucuggucaucuuuaaaguuuuuaaaa

SEQ ID NO: 9200 - RNA, 34 nt, Artificial Sequence
  Synthetic Oligonucleotide; IFNG exon 3; Set A
uuuggaugcucuggucaucuuuaaaguuuuuaaa

SEQ ID NO: 9201 - RNA, 35 nt, Artificial Sequence
  Synthetic Oligonucleotide; IFNG exon 3; Set A
uuuuggaugcucuggucaucuuuaaaguuuuuaaa

SEQ ID NO: 9202 - RNA, 16 nt, Artificial Sequence
  Synthetic Oligonucleotide; IFNG exon 3; Set C
uuggaugcucugguca

SEQ ID NO: 9203 - RNA, 15 nt, Artificial Sequence
  Synthetic Oligonucleotide; IFNG exon 3; Set C
uuggaugcucugguc

SEQ ID NO: 9204 - RNA, 17 nt, Artificial Sequence
  Synthetic Oligonucleotide; IFNG exon 3; Set C
uuuggaugcucugguca

SEQ ID NO: 9205 - RNA, 16 nt, Artificial Sequence
  Synthetic Oligonucleotide; IFNG exon 3; Set C
uuuggaugcucugguc

SEQ ID NO: 9206 - RNA, 18 nt, Artificial Sequence
  Synthetic Oligonucleotide; IFNG exon 3; Set C
uuuuggaugcucugguca

SEQ ID NO: 9207 - RNA, 15 nt, Artificial Sequence
  Synthetic Oligonucleotide; IFNG exon 3; Set C
uuuggaugcucuggu

SEQ ID NO: 9208 - RNA, 17 nt, Artificial Sequence
  Synthetic Oligonucleotide; IFNG exon 3; Set C
uuuuggaugcucugguc

SEQ ID NO: 9209 - RNA, 16 nt, Artificial Sequence
  Synthetic Oligonucleotide; IFNG exon 3; Set C
uuuuggaugcucuggu

SEQ ID NO: 9210 - RNA, 34 nt, Artificial Sequence
  Synthetic Oligonucleotide; IFNG exon 3; Set C
gauggucuccacacucuuuuggaugcucugguca

SEQ ID NO: 9211 - RNA, 33 nt, Artificial Sequence
  Synthetic Oligonucleotide; IFNG exon 3; Set C
gauggucuccacacucuuuuggaugcucugguc

SEQ ID NO: 9212 - RNA, 35 nt, Artificial Sequence
  Synthetic Oligonucleotide; IFNG exon 3; Set C
ugauggucuccacacucuuuuggaugcucugguca

SEQ ID NO: 9213 - RNA, 32 nt, Artificial Sequence
  Synthetic Oligonucleotide; IFNG exon 3; Set C
gauggucuccacacucuuuuggaugcucuggu

SEQ ID NO: 9214 - RNA, 34 nt, Artificial Sequence
  Synthetic Oligonucleotide; IFNG exon 3; Set C
ugauggucuccacacucuuuuggaugcucugguc

SEQ ID NO: 9215 - RNA, 36 nt, Artificial Sequence
  Synthetic Oligonucleotide; IFNG exon 3; Set C
uugauggucuccacacucuuuuggaugcucugguca

SEQ ID NO: 9216 - RNA, 33 nt, Artificial Sequence
  Synthetic Oligonucleotide; IFNG exon 3; Set C
ugauggucuccacacucuuuuggaugcucuggu

SEQ ID NO: 9217 - RNA, 35 nt, Artificial Sequence
  Synthetic Oligonucleotide; IFNG exon 3; Set C
uugauggucuccacacucuuuuggaugcucugguc

SEQ ID NO: 9218 - RNA, 34 nt, Artificial Sequence
  Synthetic Oligonucleotide; IFNG exon 3; Set C
uugauggucuccacacucuuuuggaugcucuggu

SEQ ID NO: 9219 - RNA, 19 nt, Artificial Sequence
  Synthetic Oligonucleotide; IFNG exon 3; Set C
uggucuccacacucuuuug

SEQ ID NO: 9220 - RNA, 20 nt, Artificial Sequence
  Synthetic Oligonucleotide; IFNG exon 3; Set C
auggucuccacacucuuuug

SEQ ID NO: 9221 - RNA, 21 nt, Artificial Sequence
  Synthetic Oligonucleotide; IFNG exon 3; Set C
gauggucuccacacucuuuug

SEQ ID NO: 9222 - RNA, 22 nt, Artificial Sequence
  Synthetic Oligonucleotide; IFNG exon 3; Set A
ugauggucuccacacucuuuug

SEQ ID NO: 9223 - RNA, 20 nt, Artificial Sequence
  Synthetic Oligonucleotide; IFNG exon 3; Set C
gauggucuccacacucuuuu

SEQ ID NO: 9224 - RNA, 23 nt, Artificial Sequence
  Synthetic Oligonucleotide; IFNG exon 3; Set A
uugauggucuccacacucuuuug

SEQ ID NO: 9225 - RNA, 19 nt, Artificial Sequence
  Synthetic Oligonucleotide; IFNG exon 3; Set C
gauggucuccacacucuuu

SEQ ID NO: 9226 - RNA, 21 nt, Artificial Sequence
  Synthetic Oligonucleotide; IFNG exon 3; Set C
ugauggucuccacacucuuuu

SEQ ID NO: 9227 - RNA, 22 nt, Artificial Sequence
  Synthetic Oligonucleotide; IFNG exon 3; Set C
uugauggucuccacacucuuuu

SEQ ID NO: 9228 - RNA, 20 nt, Artificial Sequence
  Synthetic Oligonucleotide; IFNG exon 3; Set C
ugauggucuccacacucuuu

SEQ ID NO: 9229 - RNA, 21 nt, Artificial Sequence
  Synthetic Oligonucleotide; IFNG exon 3; Set C
uugauggucuccacacucuuu

SEQ ID NO: 9230 - RNA, 36 nt, Artificial Sequence
  Synthetic Oligonucleotide; IFNG exon 3; Set C
auucaugucuuccuugauggucuccacacucuuuug

SEQ ID NO: 9231 - RNA, 37 nt, Artificial Sequence
  Synthetic Oligonucleotide; IFNG exon 3; Set C
cauucaugucuuccuugauggucuccacacucuuuug

SEQ ID NO: 9232 - RNA, 35 nt, Artificial Sequence
  Synthetic Oligonucleotide; IFNG exon 3; Set C
auucaugucuuccuugauggucuccacacucuuuu

SEQ ID NO: 9233 - RNA, 38 nt, Artificial Sequence
  Synthetic Oligonucleotide; IFNG exon 3; Set C
acauucaugucuuccuugauggucuccacacucuuuug

SEQ ID NO: 9234 - RNA, 34 nt, Artificial Sequence
  Synthetic Oligonucleotide; IFNG exon 3; Set C
auucaugucuuccuugauggucuccacacucuuu

SEQ ID NO: 9235 - RNA, 36 nt, Artificial Sequence
  Synthetic Oligonucleotide; IFNG exon 3; Set C
cauucaugucuuccuugauggucuccacacucuuuu

SEQ ID NO: 9236 - RNA, 37 nt, Artificial Sequence
  Synthetic Oligonucleotide; IFNG exon 3; Set C
acauucaugucuuccuugauggucuccacacucuuuu

SEQ ID NO: 9237 - RNA, 35 nt, Artificial Sequence
  Synthetic Oligonucleotide; IFNG exon 3; Set C
cauucaugucuuccuugauggucuccacacucuuu

SEQ ID NO: 9238 - RNA, 36 nt, Artificial Sequence
  Synthetic Oligonucleotide; IFNG exon 3; Set C
acauucaugucuuccuugauggucuccacacucuuu

SEQ ID NO: 9239 - RNA, 21 nt, Artificial Sequence
  Synthetic Oligonucleotide; IFNG exon 3; Set C
auucaugucuuccuugauggu

SEQ ID NO: 9240 - RNA, 20 nt, Artificial Sequence
  Synthetic Oligonucleotide; IFNG exon 3; Set C
auucaugucuuccuugaugg

SEQ ID NO: 9241 - RNA, 22 nt, Artificial Sequence
  Synthetic Oligonucleotide; IFNG exon 3; Set C
cauucaugucuuccuugauggu

SEQ ID NO: 9242 - RNA, 19 nt, Artificial Sequence
  Synthetic Oligonucleotide; IFNG exon 3; Set C
auucaugucuuccuugaug

SEQ ID NO: 9243 - RNA, 20 nt, Artificial Sequence
  Synthetic Oligonucleotide; IFNG exon 3; Set C
cauucaugucuuccuugaug

SEQ ID NO: 9244 - RNA, 16 nt, Artificial Sequence
  Synthetic Oligonucleotide; IFNG exon 3; Set C
auucaugucuuccuug

SEQ ID NO: 9245 - RNA, 17 nt, Artificial Sequence
  Synthetic Oligonucleotide; IFNG exon 3; Set C
cauucaugucuuccuug

SEQ ID NO: 9246 - RNA, 35 nt, Artificial Sequence
  Synthetic Oligonucleotide; IFNG exon 3; Set A
uugaaaaacuugacauucaugucuuccuugauggu

SEQ ID NO: 9247 - RNA, 34 nt, Artificial Sequence
  Synthetic Oligonucleotide; IFNG exon 3; Set A
uugaaaaacuugacauucaugucuuccuugaugg

SEQ ID NO: 9248 - RNA, 33 nt, Artificial Sequence
  Synthetic Oligonucleotide; IFNG exon 3; Set A
uugaaaaacuugacauucaugucuuccuugaug

SEQ ID NO: 9249 - RNA, 32 nt, Artificial Sequence
  Synthetic Oligonucleotide; IFNG exon 3; Set A
uugaaaaacuugacauucaugucuuccuugau

SEQ ID NO: 9250 - RNA, 38 nt, Artificial Sequence
  Synthetic Oligonucleotide; IFNG exon 3; Set A
cuauugaaaaacuugacauucaugucuuccuugauggu

SEQ ID NO: 9251 - RNA, 31 nt, Artificial Sequence
  Synthetic Oligonucleotide; IFNG exon 3; Set A
uugaaaaacuugacauucaugucuuccuuga

SEQ ID NO: 9252 - RNA, 37 nt, Artificial Sequence
  Synthetic Oligonucleotide; IFNG exon 3; Set A
cuauugaaaaacuugacauucaugucuuccuugaugg

SEQ ID NO: 9253 - RNA, 39 nt, Artificial Sequence
  Synthetic Oligonucleotide; IFNG exon 3; Set A
gcuauugaaaaacuugacauucaugucuuccuugauggu

SEQ ID NO: 9254 - RNA, 30 nt, Artificial Sequence
  Synthetic Oligonucleotide; IFNG exon 3; Set C
uugaaaaacuugacauucaugucuuccuug

SEQ ID NO: 9255 - RNA, 36 nt, Artificial Sequence
  Synthetic Oligonucleotide; IFNG exon 3; Set A
cuauugaaaaacuugacauucaugucuuccuugaug

SEQ ID NO: 9256 - RNA, 38 nt, Artificial Sequence
  Synthetic Oligonucleotide; IFNG exon 3; Set A
gcuauugaaaaacuugacauucaugucuuccuugaugg

SEQ ID NO: 9257 - RNA, 40 nt, Artificial Sequence
  Synthetic Oligonucleotide; IFNG exon 3; Set A
ugcuauugaaaaacuugacauucaugucuuccuugauggu

SEQ ID NO: 9258 - RNA, 35 nt, Artificial Sequence
  Synthetic Oligonucleotide; IFNG exon 3; Set A
cuauugaaaaacuugacauucaugucuuccuugau

SEQ ID NO: 9259 - RNA, 37 nt, Artificial Sequence
  Synthetic Oligonucleotide; IFNG exon 3; Set A
gcuauugaaaaacuugacauucaugucuuccuugaug

SEQ ID NO: 9260 - RNA, 39 nt, Artificial Sequence
  Synthetic Oligonucleotide; IFNG exon 3; Set A
ugcuauugaaaaacuugacauucaugucuuccuugaugg

SEQ ID NO: 9261 - RNA, 36 nt, Artificial Sequence
  Synthetic Oligonucleotide; IFNG exon 3; Set A
gcuauugaaaaacuugacauucaugucuuccuugau

SEQ ID NO: 9262 - RNA, 34 nt, Artificial Sequence
  Synthetic Oligonucleotide; IFNG exon 3; Set A
cuauugaaaaacuugacauucaugucuuccuuga

SEQ ID NO: 9263 - RNA, 38 nt, Artificial Sequence
  Synthetic Oligonucleotide; IFNG exon 3; Set A
ugcuauugaaaaacuugacauucaugucuuccuugaug

SEQ ID NO: 9264 - RNA, 40 nt, Artificial Sequence
  Synthetic Oligonucleotide; IFNG exon 3; Set A
uugcuauugaaaaacuugacauucaugucuuccuugaugg

SEQ ID NO: 9265 - RNA, 37 nt, Artificial Sequence
  Synthetic Oligonucleotide; IFNG exon 3; Set A
ugcuauugaaaaacuugacauucaugucuuccuugau

SEQ ID NO: 9266 - RNA, 33 nt, Artificial Sequence
  Synthetic Oligonucleotide; IFNG exon 3; Set A
cuauugaaaaacuugacauucaugucuuccuug

SEQ ID NO: 9267 - RNA, 35 nt, Artificial Sequence
  Synthetic Oligonucleotide; IFNG exon 3; Set A
gcuauugaaaaacuugacauucaugucuuccuuga

SEQ ID NO: 9268 - RNA, 39 nt, Artificial Sequence
  Synthetic Oligonucleotide; IFNG exon 3; Set A
uugcuauugaaaaacuugacauucaugucuuccuugaug

SEQ ID NO: 9269 - RNA, 38 nt, Artificial Sequence
  Synthetic Oligonucleotide; IFNG exon 3; Set A
uugcuauugaaaaacuugacauucaugucuuccuugau

SEQ ID NO: 9270 - RNA, 36 nt, Artificial Sequence
  Synthetic Oligonucleotide; IFNG exon 3; Set A
ugcuauugaaaaacuugacauucaugucuuccuuga

SEQ ID NO: 9271 - RNA, 34 nt, Artificial Sequence
  Synthetic Oligonucleotide; IFNG exon 3; Set A
gcuauugaaaaacuugacauucaugucuuccuug

SEQ ID NO: 9272 - RNA, 37 nt, Artificial Sequence
  Synthetic Oligonucleotide; IFNG exon 3; Set A
uugcuauugaaaaacuugacauucaugucuuccuuga

SEQ ID NO: 9273 - RNA, 35 nt, Artificial Sequence
  Synthetic Oligonucleotide; IFNG exon 3; Set A
ugcuauugaaaaacuugacauucaugucuuccuug

SEQ ID NO: 9274 - RNA, 36 nt, Artificial Sequence
  Synthetic Oligonucleotide; IFNG exon 3; Set A
uugcuauugaaaaacuugacauucaugucuuccuug

SEQ ID NO: 9275 - RNA, 17 nt, Artificial Sequence
  Synthetic Oligonucleotide; IFNG exon 3; Set C
uugaaaaacuugacauu

SEQ ID NO: 9276 - RNA, 16 nt, Artificial Sequence
  Synthetic Oligonucleotide; IFNG exon 3; Set C
uugaaaaacuugacau

SEQ ID NO: 9277 - RNA, 15 nt, Artificial Sequence
  Synthetic Oligonucleotide; IFNG exon 3; Set C
uugaaaaacuugaca

SEQ ID NO: 9278 - RNA, 20 nt, Artificial Sequence
  Synthetic Oligonucleotide; IFNG exon 3; Set C
cuauugaaaaacuugacauu

SEQ ID NO: 9279 - RNA, 21 nt, Artificial Sequence
  Synthetic Oligonucleotide; IFNG exon 3; Set C
gcuauugaaaaacuugacauu

SEQ ID NO: 9280 - RNA, 19 nt, Artificial Sequence
  Synthetic Oligonucleotide; IFNG exon 3; Set C
cuauugaaaaacuugacau

SEQ ID NO: 9281 - RNA, 22 nt, Artificial Sequence
  Synthetic Oligonucleotide; IFNG exon 3; Set C
ugcuauugaaaaacuugacauu

SEQ ID NO: 9282 - RNA, 18 nt, Artificial Sequence
  Synthetic Oligonucleotide; IFNG exon 3; Set C
cuauugaaaaacuugaca

SEQ ID NO: 9283 - RNA, 20 nt, Artificial Sequence
  Synthetic Oligonucleotide; IFNG exon 3; Set C
gcuauugaaaaacuugacau

SEQ ID NO: 9284 - RNA, 23 nt, Artificial Sequence
  Synthetic Oligonucleotide; IFNG exon 3; Set C
uugcuauugaaaaacuugacauu

SEQ ID NO: 9285 - RNA, 21 nt, Artificial Sequence
  Synthetic Oligonucleotide; IFNG exon 3; Set C
ugcuauugaaaaacuugacau

SEQ ID NO: 9286 - RNA, 19 nt, Artificial Sequence
  Synthetic Oligonucleotide; IFNG exon 3; Set C
gcuauugaaaaacuugaca

SEQ ID NO: 9287 - RNA, 22 nt, Artificial Sequence
  Synthetic Oligonucleotide; IFNG exon 3; Set C
uugcuauugaaaaacuugacau

SEQ ID NO: 9288 - RNA, 20 nt, Artificial Sequence
  Synthetic Oligonucleotide; IFNG exon 3; Set C
ugcuauugaaaaacuugaca

SEQ ID NO: 9289 - RNA, 21 nt, Artificial Sequence
  Synthetic Oligonucleotide; IFNG exon 3; Set C
uugcuauugaaaaacuugaca

SEQ ID NO: 9290 - RNA, 30 nt, Artificial Sequence
  Synthetic Oligonucleotide; IFNG exon 3; Set C
cuuuuuguugcuauugaaaaacuugacauu

SEQ ID NO: 9291 - RNA, 31 nt, Artificial Sequence
  Synthetic Oligonucleotide; IFNG exon 3; Set C
ucuuuuuguugcuauugaaaaacuugacauu

SEQ ID NO: 9292 - RNA, 29 nt, Artificial Sequence
  Synthetic Oligonucleotide; IFNG exon 3; Set C
cuuuuuguugcuauugaaaaacuugacau

SEQ ID NO: 9293 - RNA, 32 nt, Artificial Sequence
  Synthetic Oligonucleotide; IFNG exon 3; Set C
uucuuuuuguugcuauugaaaaacuugacauu

SEQ ID NO: 9294 - RNA, 28 nt, Artificial Sequence
  Synthetic Oligonucleotide; IFNG exon 3; Set C
cuuuuuguugcuauugaaaaacuugaca

SEQ ID NO: 9295 - RNA, 30 nt, Artificial Sequence
  Synthetic Oligonucleotide; IFNG exon 3; Set C
ucuuuuuguugcuauugaaaaacuugacau

SEQ ID NO: 9296 - RNA, 29 nt, Artificial Sequence
  Synthetic Oligonucleotide; IFNG exon 3; Set C
ucuuuuuguugcuauugaaaaacuugaca

SEQ ID NO: 9297 - RNA, 31 nt, Artificial Sequence
  Synthetic Oligonucleotide; IFNG exon 3; Set C
uucuuuuuguugcuauugaaaaacuugacau

SEQ ID NO: 9298 - RNA, 30 nt, Artificial Sequence
  Synthetic Oligonucleotide; IFNG exon 3; Set C
uucuuuuuguugcuauugaaaaacuugaca

SEQ ID NO: 9299 - RNA, 36 nt, Artificial Sequence
  Synthetic Oligonucleotide; IFNG exon 3; Set A
ucguuucuuuuuguugcuauugaaaaacuugacauu

SEQ ID NO: 9300 - RNA, 37 nt, Artificial Sequence
  Synthetic Oligonucleotide; IFNG exon 3; Set A
cucguuucuuuuuguugcuauugaaaaacuugacauu

SEQ ID NO: 9301 - RNA, 35 nt, Artificial Sequence
  Synthetic Oligonucleotide; IFNG exon 3; Set A
ucguuucuuuuuguugcuauugaaaaacuugacau

SEQ ID NO: 9302 - RNA, 34 nt, Artificial Sequence
  Synthetic Oligonucleotide; IFNG exon 3; Set A
ucguuucuuuuuguugcuauugaaaaacuugaca

SEQ ID NO: 9303 - RNA, 40 nt, Artificial Sequence
  Synthetic Oligonucleotide; IFNG exon 3; Set A
caucucguuucuuuuuguugcuauugaaaaacuugacauu

SEQ ID NO: 9304 - RNA, 39 nt, Artificial Sequence
  Synthetic Oligonucleotide; IFNG exon 3; Set A
caucucguuucuuuuuguugcuauugaaaaacuugacau

SEQ ID NO: 9305 - RNA, 38 nt, Artificial Sequence
  Synthetic Oligonucleotide; IFNG exon 3; Set A
caucucguuucuuuuuguugcuauugaaaaacuugaca

SEQ ID NO: 9306 - RNA, 15 nt, Artificial Sequence
  Synthetic Oligonucleotide; IFNG exon 3; Set C
uucuuuuuguugcua

SEQ ID NO: 9307 - RNA, 23 nt, Artificial Sequence
  Synthetic Oligonucleotide; IFNG exon 3; Set C
cucguuucuuuuuguugcuauug

SEQ ID NO: 9308 - RNA, 23 nt, Artificial Sequence
  Synthetic Oligonucleotide; IFNG exon 3; Set C
ucucguuucuuuuuguugcuauu

SEQ ID NO: 9309 - RNA, 19 nt, Artificial Sequence
  Synthetic Oligonucleotide; IFNG exon 3; Set C
ucguuucuuuuuguugcua

SEQ ID NO: 9310 - RNA, 24 nt, Artificial Sequence
  Synthetic Oligonucleotide; IFNG exon 3; Set C
aucucguuucuuuuuguugcuauu

SEQ ID NO: 9311 - RNA, 20 nt, Artificial Sequence
  Synthetic Oligonucleotide; IFNG exon 3; Set C
cucguuucuuuuuguugcua

SEQ ID NO: 9312 - RNA, 18 nt, Artificial Sequence
  Synthetic Oligonucleotide; IFNG exon 3; Set C
ucguuucuuuuuguugcu

SEQ ID NO: 9313 - RNA, 17 nt, Artificial Sequence
  Synthetic Oligonucleotide; IFNG exon 3; Set C
ucguuucuuuuuguugc

SEQ ID NO: 9314 - RNA, 19 nt, Artificial Sequence
  Synthetic Oligonucleotide; IFNG exon 3; Set C
cucguuucuuuuuguugcu

SEQ ID NO: 9315 - RNA, 16 nt, Artificial Sequence
  Synthetic Oligonucleotide; IFNG exon 3; Set C
ucguuucuuuuuguug

SEQ ID NO: 9316 - RNA, 18 nt, Artificial Sequence
  Synthetic Oligonucleotide; IFNG exon 3; Set C
cucguuucuuuuuguugc

SEQ ID NO: 9317 - RNA, 23 nt, Artificial Sequence
  Synthetic Oligonucleotide; IFNG exon 3; Set C
caucucguuucuuuuuguugcua

SEQ ID NO: 9318 - RNA, 17 nt, Artificial Sequence
  Synthetic Oligonucleotide; IFNG exon 3; Set C
cucguuucuuuuuguug

SEQ ID NO: 9319 - RNA, 22 nt, Artificial Sequence
  Synthetic Oligonucleotide; IFNG exon 3; Set C
caucucguuucuuuuuguugcu

SEQ ID NO: 9320 - RNA, 21 nt, Artificial Sequence
  Synthetic Oligonucleotide; IFNG exon 3; Set C
caucucguuucuuuuuguugc

SEQ ID NO: 9321 - RNA, 20 nt, Artificial Sequence
  Synthetic Oligonucleotide; IFNG exon 3; Set C
caucucguuucuuuuuguug

SEQ ID NO: 9322 - RNA, 31 nt, Artificial Sequence
  Synthetic Oligonucleotide; IFNG exon 3; Set A
cgaagucaucucguuucuuuuuguugcuauu

SEQ ID NO: 9323 - RNA, 30 nt, Artificial Sequence
  Synthetic Oligonucleotide; IFNG exon 3; Set A
cgaagucaucucguuucuuuuuguugcuau

SEQ ID NO: 9324 - RNA, 24 nt, Artificial Sequence
  Synthetic Oligonucleotide; IFNG exon 3; Set C
cgaagucaucucguuucuuuuugu

SEQ ID NO: 9325 - RNA, 23 nt, Artificial Sequence
  Synthetic Oligonucleotide; IFNG exon 3; Set C
cgaagucaucucguuucuuuuug

SEQ ID NO: 9326 - RNA, 39 nt, Artificial Sequence
  Synthetic Oligonucleotide; IFNG exon 3; Set C
gucagcuuuucgaagucaucucguuucuuuuuguugcua

SEQ ID NO: 9327 - RNA, 40 nt, Artificial Sequence
  Synthetic Oligonucleotide; IFNG exon 3; Set C
agucagcuuuucgaagucaucucguuucuuuuuguugcua

SEQ ID NO: 9328 - RNA, 38 nt, Artificial Sequence
  Synthetic Oligonucleotide; IFNG exon 3; Set C
gucagcuuuucgaagucaucucguuucuuuuuguugcu

SEQ ID NO: 9329 - RNA, 20 nt, Artificial Sequence
  Synthetic Oligonucleotide; IFNG exon 3; Set C
ucgaagucaucucguuucuu

SEQ ID NO: 9330 - RNA, 39 nt, Artificial Sequence
  Synthetic Oligonucleotide; IFNG exon 3; Set C
agucagcuuuucgaagucaucucguuucuuuuuguugcu

SEQ ID NO: 9331 - RNA, 37 nt, Artificial Sequence
  Synthetic Oligonucleotide; IFNG exon 3; Set C
gucagcuuuucgaagucaucucguuucuuuuuguugc

SEQ ID NO: 9332 - RNA, 19 nt, Artificial Sequence
  Synthetic Oligonucleotide; IFNG exon 3; Set C
ucgaagucaucucguuucu

SEQ ID NO: 9333 - RNA, 36 nt, Artificial Sequence
  Synthetic Oligonucleotide; IFNG exon 3; Set A
gucagcuuuucgaagucaucucguuucuuuuuguug

SEQ ID NO: 9334 - RNA, 38 nt, Artificial Sequence
  Synthetic Oligonucleotide; IFNG exon 3; Set C
agucagcuuuucgaagucaucucguuucuuuuuguugc

SEQ ID NO: 9335 - RNA, 18 nt, Artificial Sequence
  Synthetic Oligonucleotide; IFNG exon 3; Set C
ucgaagucaucucguuuc

SEQ ID NO: 9336 - RNA, 17 nt, Artificial Sequence
  Synthetic Oligonucleotide; IFNG exon 3; Set C
ucgaagucaucucguuu

SEQ ID NO: 9337 - RNA, 37 nt, Artificial Sequence
  Synthetic Oligonucleotide; IFNG exon 3; Set A
agucagcuuuucgaagucaucucguuucuuuuuguug

SEQ ID NO: 9338 - RNA, 31 nt, Artificial Sequence
  Synthetic Oligonucleotide; IFNG exon 3; Set B
gucagcuuuucgaagucaucucguuucuuuu

SEQ ID NO: 9339 - RNA, 30 nt, Artificial Sequence
  Synthetic Oligonucleotide; IFNG exon 3; Set B
gucagcuuuucgaagucaucucguuucuuu

SEQ ID NO: 9340 - RNA, 15 nt, Artificial Sequence
  Synthetic Oligonucleotide; IFNG exon 3; Set C
uuucgaagucaucuc

SEQ ID NO: 9341 - RNA, 30 nt, Artificial Sequence
  Synthetic Oligonucleotide; IFNG exon 3; Set B
agucagcuuuucgaagucaucucguuucuu

SEQ ID NO: 9342 - RNA, 16 nt, Artificial Sequence
  Synthetic Oligonucleotide; IFNG exon 3; Set C
uuuucgaagucaucuc

SEQ ID NO: 9343 - RNA, 25 nt, Artificial Sequence
  Synthetic Oligonucleotide; IFNG exon 3; Set B
gucagcuuuucgaagucaucucguu

SEQ ID NO: 9344 - RNA, 27 nt, Artificial Sequence
  Synthetic Oligonucleotide; IFNG exon 3; Set B
agucagcuuuucgaagucaucucguuu

SEQ ID NO: 9345 - RNA, 24 nt, Artificial Sequence
  Synthetic Oligonucleotide; IFNG exon 3; Set B
gucagcuuuucgaagucaucucgu

SEQ ID NO: 9346 - RNA, 26 nt, Artificial Sequence
  Synthetic Oligonucleotide; IFNG exon 3; Set B
agucagcuuuucgaagucaucucguu

SEQ ID NO: 9347 - RNA, 25 nt, Artificial Sequence
  Synthetic Oligonucleotide; IFNG exon 3; Set B
agucagcuuuucgaagucaucucgu

SEQ ID NO: 9348 - RNA, 37 nt, Artificial Sequence
  Synthetic Oligonucleotide; IFNG exon 3; Set B
aauaauuagucagcuuuucgaagucaucucguuucuu

SEQ ID NO: 9349 - RNA, 25 nt, Artificial Sequence
  Synthetic Oligonucleotide; IFNG exon 3; Set B
uagucagcuuuucgaagucaucucg

SEQ ID NO: 9350 - RNA, 38 nt, Artificial Sequence
  Synthetic Oligonucleotide; IFNG exon 3; Set B
gaauaauuagucagcuuuucgaagucaucucguuucuu

SEQ ID NO: 9351 - RNA, 36 nt, Artificial Sequence
  Synthetic Oligonucleotide; IFNG exon 3; Set B
aauaauuagucagcuuuucgaagucaucucguuucu

SEQ ID NO: 9352 - RNA, 24 nt, Artificial Sequence
  Synthetic Oligonucleotide; IFNG exon 3; Set C
uagucagcuuuucgaagucaucuc

SEQ ID NO: 9353 - RNA, 37 nt, Artificial Sequence
  Synthetic Oligonucleotide; IFNG exon 3; Set B
gaauaauuagucagcuuuucgaagucaucucguuucu

SEQ ID NO: 9354 - RNA, 35 nt, Artificial Sequence
  Synthetic Oligonucleotide; IFNG exon 3; Set B
aauaauuagucagcuuuucgaagucaucucguuuc

SEQ ID NO: 9355 - RNA, 25 nt, Artificial Sequence
  Synthetic Oligonucleotide; IFNG exon 3; Set C
uuagucagcuuuucgaagucaucuc

SEQ ID NO: 9356 - RNA, 18 nt, Artificial Sequence
  Synthetic Oligonucleotide; IFNG exon 3; Set C
gucagcuuuucgaaguca

SEQ ID NO: 9357 - RNA, 36 nt, Artificial Sequence
  Synthetic Oligonucleotide; IFNG exon 3; Set B
gaauaauuagucagcuuuucgaagucaucucguuuc

SEQ ID NO: 9358 - RNA, 26 nt, Artificial Sequence
  Synthetic Oligonucleotide; IFNG exon 3; Set C
auuagucagcuuuucgaagucaucuc

SEQ ID NO: 9359 - RNA, 19 nt, Artificial Sequence
  Synthetic Oligonucleotide; IFNG exon 3; Set C
agucagcuuuucgaaguca

SEQ ID NO: 9360 - RNA, 17 nt, Artificial Sequence
  Synthetic Oligonucleotide; IFNG exon 3; Set C
gucagcuuuucgaaguc

SEQ ID NO: 9361 - RNA, 21 nt, Artificial Sequence
  Synthetic Oligonucleotide; IFNG exon 3; Set C
uagucagcuuuucgaagucau

SEQ ID NO: 9362 - RNA, 27 nt, Artificial Sequence
  Synthetic Oligonucleotide; IFNG exon 3; Set C
aauuagucagcuuuucgaagucaucuc

SEQ ID NO: 9363 - RNA, 18 nt, Artificial Sequence
  Synthetic Oligonucleotide; IFNG exon 3; Set C
agucagcuuuucgaaguc

SEQ ID NO: 9364 - RNA, 22 nt, Artificial Sequence
  Synthetic Oligonucleotide; IFNG exon 3; Set C
uuagucagcuuuucgaagucau

SEQ ID NO: 9365 - RNA, 28 nt, Artificial Sequence
  Synthetic Oligonucleotide; IFNG exon 3; Set C
uaauuagucagcuuuucgaagucaucuc

SEQ ID NO: 9366 - RNA, 31 nt, Artificial Sequence
  Synthetic Oligonucleotide; IFNG exon 3; Set B
aauaauuagucagcuuuucgaagucaucucg

SEQ ID NO: 9367 - RNA, 29 nt, Artificial Sequence
  Synthetic Oligonucleotide; IFNG exon 3; Set C
auaauuagucagcuuuucgaagucaucuc

SEQ ID NO: 9368 - RNA, 32 nt, Artificial Sequence
  Synthetic Oligonucleotide; IFNG exon 3; Set B
gaauaauuagucagcuuuucgaagucaucucg

SEQ ID NO: 9369 - RNA, 27 nt, Artificial Sequence
  Synthetic Oligonucleotide; IFNG exon 3; Set C
aauaauuagucagcuuuucgaagucau

SEQ ID NO: 9370 - RNA, 40 nt, Artificial Sequence
  Synthetic Oligonucleotide; IFNG exon 3; Set C
cucaccgaauaauuagucagcuuuucgaagucaucucguu

SEQ ID NO: 9371 - RNA, 28 nt, Artificial Sequence
  Synthetic Oligonucleotide; IFNG exon 3; Set C
gaauaauuagucagcuuuucgaagucau

SEQ ID NO: 9372 - RNA, 39 nt, Artificial Sequence
  Synthetic Oligonucleotide; IFNG exon 3; Set C
cucaccgaauaauuagucagcuuuucgaagucaucucgu

SEQ ID NO: 9373 - RNA, 33 nt, Artificial Sequence
  Synthetic Oligonucleotide; IFNG exon 3; Set B
cucaccgaauaauuagucagcuuuucgaaguca

SEQ ID NO: 9374 - RNA, 32 nt, Artificial Sequence
  Synthetic Oligonucleotide; IFNG exon 3; Set B
cucaccgaauaauuagucagcuuuucgaaguc

SEQ ID NO: 9375 - RNA, 38 nt, Artificial Sequence
  Synthetic Oligonucleotide; IFNG exon 3; Set C
uagccucaccgaauaauuagucagcuuuucgaagucau

SEQ ID NO: 9376 - RNA, 38 nt, Artificial Sequence
  Synthetic Oligonucleotide; IFNG exon 3; Set C
auagccucaccgaauaauuagucagcuuuucgaaguca

SEQ ID NO: 9377 - RNA, 39 nt, Artificial Sequence
  Synthetic Oligonucleotide; IFNG exon 3; Set C
aauagccucaccgaauaauuagucagcuuuucgaaguca

SEQ ID NO: 9378 - RNA, 37 nt, Artificial Sequence
  Synthetic Oligonucleotide; IFNG exon 3; Set B
auagccucaccgaauaauuagucagcuuuucgaaguc

SEQ ID NO: 9379 - RNA, 26 nt, Artificial Sequence
  Synthetic Oligonucleotide; IFNG exon 3; Set C
cucaccgaauaauuagucagcuuuuc

SEQ ID NO: 9380 - RNA, 40 nt, Artificial Sequence
  Synthetic Oligonucleotide; IFNG exon 3; Set B
aaauagccucaccgaauaauuagucagcuuuucgaaguca

SEQ ID NO: 9381 - RNA, 38 nt, Artificial Sequence
  Synthetic Oligonucleotide; IFNG exon 3; Set B
aauagccucaccgaauaauuagucagcuuuucgaaguc

SEQ ID NO: 9382 - RNA, 25 nt, Artificial Sequence
  Synthetic Oligonucleotide; IFNG exon 3; Set C
cucaccgaauaauuagucagcuuuu

SEQ ID NO: 9383 - RNA, 39 nt, Artificial Sequence
  Synthetic Oligonucleotide; IFNG exon 3; Set B
aaauagccucaccgaauaauuagucagcuuuucgaaguc

SEQ ID NO: 9384 - RNA, 24 nt, Artificial Sequence
  Synthetic Oligonucleotide; IFNG exon 3; Set C
cucaccgaauaauuagucagcuuu

SEQ ID NO: 9385 - RNA, 31 nt, Artificial Sequence
  Synthetic Oligonucleotide; IFNG exon 3; Set B
auagccucaccgaauaauuagucagcuuuuc

SEQ ID NO: 9386 - RNA, 33 nt, Artificial Sequence
  Synthetic Oligonucleotide; IFNG exon 3; Set B
aauagccucaccgaauaauuagucagcuuuucg

SEQ ID NO: 9387 - RNA, 32 nt, Artificial Sequence
  Synthetic Oligonucleotide; IFNG exon 3; Set B
aauagccucaccgaauaauuagucagcuuuuc

SEQ ID NO: 9388 - RNA, 30 nt, Artificial Sequence
  Synthetic Oligonucleotide; IFNG exon 3; Set B
auagccucaccgaauaauuagucagcuuuu

SEQ ID NO: 9389 - RNA, 34 nt, Artificial Sequence
  Synthetic Oligonucleotide; IFNG exon 3; Set B
aaauagccucaccgaauaauuagucagcuuuucg

SEQ ID NO: 9390 - RNA, 31 nt, Artificial Sequence
  Synthetic Oligonucleotide; IFNG exon 3; Set B
aauagccucaccgaauaauuagucagcuuuu

SEQ ID NO: 9391 - RNA, 29 nt, Artificial Sequence
  Synthetic Oligonucleotide; IFNG exon 3; Set B
auagccucaccgaauaauuagucagcuuu

SEQ ID NO: 9392 - RNA, 35 nt, Artificial Sequence
  Synthetic Oligonucleotide; IFNG exon 3; Set B
uaaauagccucaccgaauaauuagucagcuuuucg

SEQ ID NO: 9393 - RNA, 30 nt, Artificial Sequence
  Synthetic Oligonucleotide; IFNG exon 3; Set B
aauagccucaccgaauaauuagucagcuuu

SEQ ID NO: 9394 - RNA, 16 nt, Artificial Sequence
  Synthetic Oligonucleotide; IFNG exon 3; Set C
cucaccgaauaauuag

SEQ ID NO: 9395 - RNA, 15 nt, Artificial Sequence
  Synthetic Oligonucleotide; IFNG exon 3; Set C
cucaccgaauaauua

SEQ ID NO: 9396 - RNA, 40 nt, Artificial Sequence
  Synthetic Oligonucleotide; IFNG exon 3; Set B
gaauuuaaauagccucaccgaauaauuagucagcuuuucg

SEQ ID NO: 9397 - RNA, 22 nt, Artificial Sequence
  Synthetic Oligonucleotide; IFNG exon 3; Set C
uagccucaccgaauaauuaguc

SEQ ID NO: 9398 - RNA, 21 nt, Artificial Sequence
  Synthetic Oligonucleotide; IFNG exon 3; Set C
uagccucaccgaauaauuagu

SEQ ID NO: 9399 - RNA, 21 nt, Artificial Sequence
  Synthetic Oligonucleotide; IFNG exon 3; Set C
auagccucaccgaauaauuag

SEQ ID NO: 9400 - RNA, 20 nt, Artificial Sequence
  Synthetic Oligonucleotide; IFNG exon 3; Set C
auagccucaccgaauaauua

SEQ ID NO: 9401 - RNA, 24 nt, Artificial Sequence
  Synthetic Oligonucleotide; IFNG exon 3; Set C
aaauagccucaccgaauaauuagu

SEQ ID NO: 9402 - RNA, 19 nt, Artificial Sequence
  Synthetic Oligonucleotide; IFNG exon 3; Set C
auagccucaccgaauaauu

SEQ ID NO: 9403 - RNA, 25 nt, Artificial Sequence
  Synthetic Oligonucleotide; IFNG exon 3; Set C
uaaauagccucaccgaauaauuagu

SEQ ID NO: 9404 - RNA, 18 nt, Artificial Sequence
  Synthetic Oligonucleotide; IFNG exon 3; Set C
auagccucaccgaauaau

SEQ ID NO: 9405 - RNA, 17 nt, Artificial Sequence
  Synthetic Oligonucleotide; IFNG exon 3; Set C
auagccucaccgaauaa

SEQ ID NO: 9406 - RNA, 18 nt, Artificial Sequence
  Synthetic Oligonucleotide; IFNG exon 3; Set C
aauagccucaccgaauaa

SEQ ID NO: 9407 - RNA, 16 nt, Artificial Sequence
  Synthetic Oligonucleotide; IFNG exon 3; Set C
auagccucaccgaaua

SEQ ID NO: 9408 - RNA, 17 nt, Artificial Sequence
  Synthetic Oligonucleotide; IFNG exon 3; Set C
aauagccucaccgaaua

SEQ ID NO: 9409 - RNA, 16 nt, Artificial Sequence
  Synthetic Oligonucleotide; IFNG exon 3; Set C
aauagccucaccgaau

SEQ ID NO: 9410 - RNA, 30 nt, Artificial Sequence
  Synthetic Oligonucleotide; IFNG exon 3; Set C
gaauuuaaauagccucaccgaauaauuagu

SEQ ID NO: 9411 - RNA, 17 nt, Artificial Sequence
  Synthetic Oligonucleotide; IFNG exon 3; Set C
aaauagccucaccgaau

SEQ ID NO: 9412 - RNA, 31 nt, Artificial Sequence
  Synthetic Oligonucleotide; IFNG exon 3; Set C
agaauuuaaauagccucaccgaauaauuagu

SEQ ID NO: 9413 - RNA, 18 nt, Artificial Sequence
  Synthetic Oligonucleotide; IFNG exon 3; Set C
uaaauagccucaccgaau

SEQ ID NO: 9414 - RNA, 16 nt, Artificial Sequence
  Synthetic Oligonucleotide; IFNG exon 3; Set C
aaauagccucaccgaa

SEQ ID NO: 9415 - RNA, 32 nt, Artificial Sequence
  Synthetic Oligonucleotide; IFNG exon 3; Set C
aagaauuuaaauagccucaccgaauaauuagu

SEQ ID NO: 9416 - RNA, 34 nt, Artificial Sequence
  Synthetic Oligonucleotide; IFNG exon 3; Set C
aaagaauuuaaauagccucaccgaauaauuaguc

SEQ ID NO: 9417 - RNA, 17 nt, Artificial Sequence
  Synthetic Oligonucleotide; IFNG exon 3; Set C
uaaauagccucaccgaa

SEQ ID NO: 9418 - RNA, 33 nt, Artificial Sequence
  Synthetic Oligonucleotide; IFNG exon 3; Set C
aaagaauuuaaauagccucaccgaauaauuagu

SEQ ID NO: 9419 - RNA, 34 nt, Artificial Sequence
  Synthetic Oligonucleotide; IFNG exon 3; Set C
gaaagaauuuaaauagccucaccgaauaauuagu

SEQ ID NO: 9420 - RNA, 23 nt, Artificial Sequence
  Synthetic Oligonucleotide; IFNG exon 3; Set C
gaauuuaaauagccucaccgaau

SEQ ID NO: 9421 - RNA, 24 nt, Artificial Sequence
  Synthetic Oligonucleotide; IFNG exon 3; Set C
agaauuuaaauagccucaccgaau

SEQ ID NO: 9422 - RNA, 22 nt, Artificial Sequence
  Synthetic Oligonucleotide; IFNG exon 3; Set C
gaauuuaaauagccucaccgaa

SEQ ID NO: 9423 - RNA, 25 nt, Artificial Sequence
  Synthetic Oligonucleotide; IFNG exon 3; Set C
aagaauuuaaauagccucaccgaau

SEQ ID NO: 9424 - RNA, 23 nt, Artificial Sequence
  Synthetic Oligonucleotide; IFNG exon 3; Set C
agaauuuaaauagccucaccgaa

SEQ ID NO: 9425 - RNA, 26 nt, Artificial Sequence
  Synthetic Oligonucleotide; IFNG exon 3; Set C
aaagaauuuaaauagccucaccgaau

SEQ ID NO: 9426 - RNA, 24 nt, Artificial Sequence
  Synthetic Oligonucleotide; IFNG exon 3; Set C
aagaauuuaaauagccucaccgaa

SEQ ID NO: 9427 - RNA, 27 nt, Artificial Sequence
  Synthetic Oligonucleotide; IFNG exon 3; Set C
gaaagaauuuaaauagccucaccgaau

SEQ ID NO: 9428 - RNA, 25 nt, Artificial Sequence
  Synthetic Oligonucleotide; IFNG exon 3; Set C
aaagaauuuaaauagccucaccgaa

SEQ ID NO: 9429 - RNA, 28 nt, Artificial Sequence
  Synthetic Oligonucleotide; IFNG exon 3; Set C
agaaagaauuuaaauagccucaccgaau

SEQ ID NO: 9430 - RNA, 26 nt, Artificial Sequence
  Synthetic Oligonucleotide; IFNG exon 3; Set C
gaaagaauuuaaauagccucaccgaa

SEQ ID NO: 9431 - RNA, 27 nt, Artificial Sequence
  Synthetic Oligonucleotide; IFNG exon 3; Set C
agaaagaauuuaaauagccucaccgaa

SEQ ID NO: 9432 - RNA, 17 nt, Artificial Sequence
  Synthetic Oligonucleotide; IFNG exon 3; Set C
agaauuuaaauagccuc

SEQ ID NO: 9433 - RNA, 19 nt, Artificial Sequence
  Synthetic Oligonucleotide; IFNG exon 3; Set C
aaagaauuuaaauagccuc

SEQ ID NO: 9434 - RNA, 20 nt, Artificial Sequence
  Synthetic Oligonucleotide; IFNG exon 3; Set C
gaaagaauuuaaauagccuc

SEQ ID NO: 9435 - RNA, 17 nt, Artificial Sequence
  Synthetic Oligonucleotide; IFNG exon 3; Set C
agaaagaauuuaaauag

SEQ ID NO: 9436 - RNA, 15 nt, Artificial Sequence
  Synthetic Oligonucleotide; IFNG exon 3; Set C
gaaagaauuuaaaua

SEQ ID NO: 9437 - RNA, 39 nt, Artificial Sequence
  Synthetic Oligonucleotide; IFNG exon 3; Set B
caaugaaaccaaagaaagaauuuaaauagccucaccgaa

SEQ ID NO: 9438 - RNA, 40 nt, Artificial Sequence
  Synthetic Oligonucleotide; IFNG exon 3; Set B
gcaaugaaaccaaagaaagaauuuaaauagccucaccgaa

SEQ ID NO: 9439 - RNA, 29 nt, Artificial Sequence
  Synthetic Oligonucleotide; IFNG exon 3; Set C
gaaaccaaagaaagaauuuaaauagccuc

SEQ ID NO: 9440 - RNA, 33 nt, Artificial Sequence
  Synthetic Oligonucleotide; IFNG exon 3; Set C
caaugaaaccaaagaaagaauuuaaauagccuc

SEQ ID NO: 9441 - RNA, 24 nt, Artificial Sequence
  Synthetic Oligonucleotide; IFNG exon 3; Set C
gaaaccaaagaaagaauuuaaaua

SEQ ID NO: 9442 - RNA, 34 nt, Artificial Sequence
  Synthetic Oligonucleotide; IFNG exon 3; Set C
gcaaugaaaccaaagaaagaauuuaaauagccuc

SEQ ID NO: 9443 - RNA, 35 nt, Artificial Sequence
  Synthetic Oligonucleotide; IFNG exon 3; Set C
ggcaaugaaaccaaagaaagaauuuaaauagccuc

SEQ ID NO: 9444 - RNA, 28 nt, Artificial Sequence
  Synthetic Oligonucleotide; IFNG exon 3; Set C
caaugaaaccaaagaaagaauuuaaaua

SEQ ID NO: 9445 - RNA, 27 nt, Artificial Sequence
  Synthetic Oligonucleotide; IFNG exon 3; Set C
caaugaaaccaaagaaagaauuuaaau

SEQ ID NO: 9446 - RNA, 29 nt, Artificial Sequence
  Synthetic Oligonucleotide; IFNG exon 3; Set C
gcaaugaaaccaaagaaagaauuuaaaua

SEQ ID NO: 9447 - RNA, 26 nt, Artificial Sequence
  Synthetic Oligonucleotide; IFNG exon 3; Set C
caaugaaaccaaagaaagaauuuaaa

SEQ ID NO: 9448 - RNA, 28 nt, Artificial Sequence
  Synthetic Oligonucleotide; IFNG exon 3; Set C
gcaaugaaaccaaagaaagaauuuaaau

SEQ ID NO: 9449 - RNA, 30 nt, Artificial Sequence
  Synthetic Oligonucleotide; IFNG exon 3; Set C
ggcaaugaaaccaaagaaagaauuuaaaua

SEQ ID NO: 9450 - RNA, 25 nt, Artificial Sequence
  Synthetic Oligonucleotide; IFNG exon 3; Set C
caaugaaaccaaagaaagaauuuaa

SEQ ID NO: 9451 - RNA, 27 nt, Artificial Sequence
  Synthetic Oligonucleotide; IFNG exon 3; Set C
gcaaugaaaccaaagaaagaauuuaaa

SEQ ID NO: 9452 - RNA, 29 nt, Artificial Sequence
  Synthetic Oligonucleotide; IFNG exon 3; Set C
ggcaaugaaaccaaagaaagaauuuaaau

SEQ ID NO: 9453 - RNA, 26 nt, Artificial Sequence
  Synthetic Oligonucleotide; IFNG exon 3; Set C
gcaaugaaaccaaagaaagaauuuaa

SEQ ID NO: 9454 - RNA, 28 nt, Artificial Sequence
  Synthetic Oligonucleotide; IFNG exon 3; Set C
ggcaaugaaaccaaagaaagaauuuaaa

SEQ ID NO: 9455 - RNA, 16 nt, Artificial Sequence
  Synthetic Oligonucleotide; IFNG exon 3; Set C
gaaaccaaagaaagaa

SEQ ID NO: 9456 - RNA, 27 nt, Artificial Sequence
  Synthetic Oligonucleotide; IFNG exon 3; Set C
ggcaaugaaaccaaagaaagaauuuaa

SEQ ID NO: 9457 - RNA, 15 nt, Artificial Sequence
  Synthetic Oligonucleotide; IFNG exon 3; Set C
gaaaccaaagaaaga

SEQ ID NO: 9458 - RNA, 17 nt, Artificial Sequence
  Synthetic Oligonucleotide; IFNG exon 3; Set C
ugaaaccaaagaaagaa

SEQ ID NO: 9459 - RNA, 16 nt, Artificial Sequence
  Synthetic Oligonucleotide; IFNG exon 3; Set C
ugaaaccaaagaaaga

SEQ ID NO: 9460 - RNA, 37 nt, Artificial Sequence
  Synthetic Oligonucleotide; IFNG exon 3; Set B
acccucggcaaugaaaccaaagaaagaauuuaaauag

SEQ ID NO: 9461 - RNA, 17 nt, Artificial Sequence
  Synthetic Oligonucleotide; IFNG exon 3; Set C
augaaaccaaagaaaga

SEQ ID NO: 9462 - RNA, 15 nt, Artificial Sequence
  Synthetic Oligonucleotide; IFNG exon 3; Set C
ugaaaccaaagaaag

SEQ ID NO: 9463 - RNA, 16 nt, Artificial Sequence
  Synthetic Oligonucleotide; IFNG exon 3; Set C
augaaaccaaagaaag

SEQ ID NO: 9464 - RNA, 20 nt, Artificial Sequence
  Synthetic Oligonucleotide; IFNG exon 3; Set C
caaugaaaccaaagaaagaa

SEQ ID NO: 9465 - RNA, 19 nt, Artificial Sequence
  Synthetic Oligonucleotide; IFNG exon 3; Set C
caaugaaaccaaagaaaga

SEQ ID NO: 9466 - RNA, 17 nt, Artificial Sequence
  Synthetic Oligonucleotide; IFNG exon 3; Set C
aaugaaaccaaagaaag

SEQ ID NO: 9467 - RNA, 21 nt, Artificial Sequence
  Synthetic Oligonucleotide; IFNG exon 3; Set C
gcaaugaaaccaaagaaagaa

SEQ ID NO: 9468 - RNA, 37 nt, Artificial Sequence
  Synthetic Oligonucleotide; IFNG exon 3; Set B
gacccucggcaaugaaaccaaagaaagaauuuaaaua

SEQ ID NO: 9469 - RNA, 20 nt, Artificial Sequence
  Synthetic Oligonucleotide; IFNG exon 3; Set C
gcaaugaaaccaaagaaaga

SEQ ID NO: 9470 - RNA, 18 nt, Artificial Sequence
  Synthetic Oligonucleotide; IFNG exon 3; Set C
caaugaaaccaaagaaag

SEQ ID NO: 9471 - RNA, 22 nt, Artificial Sequence
  Synthetic Oligonucleotide; IFNG exon 3; Set C
ggcaaugaaaccaaagaaagaa

SEQ ID NO: 9472 - RNA, 33 nt, Artificial Sequence
  Synthetic Oligonucleotide; IFNG exon 3; Set B
acccucggcaaugaaaccaaagaaagaauuuaa

SEQ ID NO: 9473 - RNA, 17 nt, Artificial Sequence
  Synthetic Oligonucleotide; IFNG exon 3; Set C
caaugaaaccaaagaaa

SEQ ID NO: 9474 - RNA, 21 nt, Artificial Sequence
  Synthetic Oligonucleotide; IFNG exon 3; Set C
ggcaaugaaaccaaagaaaga

SEQ ID NO: 9475 - RNA, 19 nt, Artificial Sequence
  Synthetic Oligonucleotide; IFNG exon 3; Set C
gcaaugaaaccaaagaaag

SEQ ID NO: 9476 - RNA, 39 nt, Artificial Sequence
  Synthetic Oligonucleotide; IFNG exon 3; Set B
aagacccucggcaaugaaaccaaagaaagaauuuaaaua

SEQ ID NO: 9477 - RNA, 18 nt, Artificial Sequence
  Synthetic Oligonucleotide; IFNG exon 3; Set C
gcaaugaaaccaaagaaa

SEQ ID NO: 9478 - RNA, 16 nt, Artificial Sequence
  Synthetic Oligonucleotide; IFNG exon 3; Set C
caaugaaaccaaagaa

SEQ ID NO: 9479 - RNA, 20 nt, Artificial Sequence
  Synthetic Oligonucleotide; IFNG exon 3; Set C
ggcaaugaaaccaaagaaag

SEQ ID NO: 9480 - RNA, 38 nt, Artificial Sequence
  Synthetic Oligonucleotide; IFNG exon 3; Set B
aagacccucggcaaugaaaccaaagaaagaauuuaaau

SEQ ID NO: 9481 - RNA, 19 nt, Artificial Sequence
  Synthetic Oligonucleotide; IFNG exon 3; Set C
ggcaaugaaaccaaagaaa

SEQ ID NO: 9482 - RNA, 37 nt, Artificial Sequence
  Synthetic Oligonucleotide; IFNG exon 3; Set B
aagacccucggcaaugaaaccaaagaaagaauuuaaa

SEQ ID NO: 9483 - RNA, 17 nt, Artificial Sequence
  Synthetic Oligonucleotide; IFNG exon 3; Set C
gcaaugaaaccaaagaa

SEQ ID NO: 9484 - RNA, 36 nt, Artificial Sequence
  Synthetic Oligonucleotide; IFNG exon 3; Set B
aagacccucggcaaugaaaccaaagaaagaauuuaa

SEQ ID NO: 9485 - RNA, 18 nt, Artificial Sequence
  Synthetic Oligonucleotide; IFNG exon 3; Set C
ggcaaugaaaccaaagaa

SEQ ID NO: 9486 - RNA, 36 nt, Artificial Sequence
  Synthetic Oligonucleotide; IFNG exon 3; Set B
caagacccucggcaaugaaaccaaagaaagaauuua

SEQ ID NO: 9487 - RNA, 35 nt, Artificial Sequence
  Synthetic Oligonucleotide; IFNG exon 3; Set B
caagacccucggcaaugaaaccaaagaaagaauuu

SEQ ID NO: 9488 - RNA, 38 nt, Artificial Sequence
  Synthetic Oligonucleotide; IFNG exon 3; Set B
ugcaagacccucggcaaugaaaccaaagaaagaauuua

SEQ ID NO: 9489 - RNA, 34 nt, Artificial Sequence
  Synthetic Oligonucleotide; IFNG exon 3; Set B
caagacccucggcaaugaaaccaaagaaagaauu

SEQ ID NO: 9490 - RNA, 40 nt, Artificial Sequence
  Synthetic Oligonucleotide; IFNG exon 3; Set B
uugcaagacccucggcaaugaaaccaaagaaagaauuuaa

SEQ ID NO: 9491 - RNA, 28 nt, Artificial Sequence
  Synthetic Oligonucleotide; IFNG exon 3; Set B
gacccucggcaaugaaaccaaagaaaga

SEQ ID NO: 9492 - RNA, 37 nt, Artificial Sequence
  Synthetic Oligonucleotide; IFNG exon 3; Set B
ugcaagacccucggcaaugaaaccaaagaaagaauuu

SEQ ID NO: 9493 - RNA, 27 nt, Artificial Sequence
  Synthetic Oligonucleotide; IFNG exon 3; Set B
gacccucggcaaugaaaccaaagaaag

SEQ ID NO: 9494 - RNA, 31 nt, Artificial Sequence
  Synthetic Oligonucleotide; IFNG exon 3; Set B
aagacccucggcaaugaaaccaaagaaagaa

SEQ ID NO: 9495 - RNA, 36 nt, Artificial Sequence
  Synthetic Oligonucleotide; IFNG exon 3; Set B
ugcaagacccucggcaaugaaaccaaagaaagaauu

SEQ ID NO: 9496 - RNA, 30 nt, Artificial Sequence
  Synthetic Oligonucleotide; IFNG exon 3; Set B
aagacccucggcaaugaaaccaaagaaaga

SEQ ID NO: 9497 - RNA, 28 nt, Artificial Sequence
  Synthetic Oligonucleotide; IFNG exon 3; Set B
agacccucggcaaugaaaccaaagaaag

SEQ ID NO: 9498 - RNA, 35 nt, Artificial Sequence
  Synthetic Oligonucleotide; IFNG exon 3; Set B
ugcaagacccucggcaaugaaaccaaagaaagaau

SEQ ID NO: 9499 - RNA, 25 nt, Artificial Sequence
  Synthetic Oligonucleotide; IFNG exon 3; Set B
gacccucggcaaugaaaccaaagaa

SEQ ID NO: 9500 - RNA, 28 nt, Artificial Sequence
  Synthetic Oligonucleotide; IFNG exon 3; Set B
aagacccucggcaaugaaaccaaagaaa

SEQ ID NO: 9501 - RNA, 26 nt, Artificial Sequence
  Synthetic Oligonucleotide; IFNG exon 3; Set B
agacccucggcaaugaaaccaaagaa

SEQ ID NO: 9502 - RNA, 24 nt, Artificial Sequence
  Synthetic Oligonucleotide; IFNG exon 3; Set B
gacccucggcaaugaaaccaaaga

SEQ ID NO: 9503 - RNA, 27 nt, Artificial Sequence
  Synthetic Oligonucleotide; IFNG exon 3; Set B
aagacccucggcaaugaaaccaaagaa

SEQ ID NO: 9504 - RNA, 25 nt, Artificial Sequence
  Synthetic Oligonucleotide; IFNG exon 3; Set B
agacccucggcaaugaaaccaaaga

SEQ ID NO: 9505 - RNA, 32 nt, Artificial Sequence
  Synthetic Oligonucleotide; IFNG exon 3; Set B
uugcaagacccucggcaaugaaaccaaagaaa

SEQ ID NO: 9506 - RNA, 19 nt, Artificial Sequence
  Synthetic Oligonucleotide; IFNG exon 3; Set C
caagacccucggcaaugaa

SEQ ID NO: 9507 - RNA, 18 nt, Artificial Sequence
  Synthetic Oligonucleotide; IFNG exon 3; Set C
caagacccucggcaauga

SEQ ID NO: 9508 - RNA, 20 nt, Artificial Sequence
  Synthetic Oligonucleotide; IFNG exon 3; Set B
gcaagacccucggcaaugaa

SEQ ID NO: 9509 - RNA, 17 nt, Artificial Sequence
  Synthetic Oligonucleotide; IFNG exon 3; Set C
caagacccucggcaaug

SEQ ID NO: 9510 - RNA, 19 nt, Artificial Sequence
  Synthetic Oligonucleotide; IFNG exon 3; Set B
gcaagacccucggcaauga

SEQ ID NO: 9511 - RNA, 21 nt, Artificial Sequence
  Synthetic Oligonucleotide; IFNG exon 3; Set B
ugcaagacccucggcaaugaa

SEQ ID NO: 9512 - RNA, 16 nt, Artificial Sequence
  Synthetic Oligonucleotide; IFNG exon 3; Set C
caagacccucggcaau

SEQ ID NO: 9513 - RNA, 20 nt, Artificial Sequence
  Synthetic Oligonucleotide; IFNG exon 3; Set B
ugcaagacccucggcaauga

SEQ ID NO: 9514 - RNA, 18 nt, Artificial Sequence
  Synthetic Oligonucleotide; IFNG exon 3; Set C
gcaagacccucggcaaug

SEQ ID NO: 9515 - RNA, 17 nt, Artificial Sequence
  Synthetic Oligonucleotide; IFNG exon 3; Set C
gcaagacccucggcaau

SEQ ID NO: 9516 - RNA, 19 nt, Artificial Sequence
  Synthetic Oligonucleotide; IFNG exon 3; Set B
ugcaagacccucggcaaug

SEQ ID NO: 9517 - RNA, 18 nt, Artificial Sequence
  Synthetic Oligonucleotide; IFNG exon 3; Set C
ugcaagacccucggcaau

SEQ ID NO: 9518 - RNA, 18 nt, Artificial Sequence
  Synthetic Oligonucleotide; IFNG exon 3; Set B
uugcaagacccucggcaa

SEQ ID NO: 9519 - RNA, 17 nt, Artificial Sequence
  Synthetic Oligonucleotide; IFNG exon 3; Set B
uugcaagacccucggca

SEQ ID NO: 9520 - RNA, 16 nt, Artificial Sequence
  Synthetic Oligonucleotide; IFNG exon 3; Set C
uugcaagacccucggc

SEQ ID NO: 9521 - RNA, 16 nt, Artificial Sequence
  Synthetic Oligonucleotide; IFNG exon 3; Set C
gaauuuauccaucaga

SEQ ID NO: 9522 - RNA, 17 nt, Artificial Sequence
  Synthetic Oligonucleotide; IFNG exon 3; Set C
ugaauuuauccaucaga

SEQ ID NO: 9523 - RNA, 19 nt, Artificial Sequence
  Synthetic Oligonucleotide; IFNG exon 3; Set C
ugugaauuuauccaucaga

SEQ ID NO: 9524 - RNA, 20 nt, Artificial Sequence
  Synthetic Oligonucleotide; IFNG exon 3; Set C
augugaauuuauccaucaga

SEQ ID NO: 9525 - RNA, 24 nt, Artificial Sequence
  Synthetic Oligonucleotide; IFNG exon 3; Set C
ggaugaugugaauuuauccaucag

SEQ ID NO: 9526 - RNA, 15 nt, Artificial Sequence
  Synthetic Oligonucleotide; IFNG exon 3; Set C
augaugugaauuuau

SEQ ID NO: 9527 - RNA, 32 nt, Artificial Sequence
  Synthetic Oligonucleotide; IFNG exon 3; Set A
aaacagaggaugaugugaauuuauccaucaga

SEQ ID NO: 9528 - RNA, 16 nt, Artificial Sequence
  Synthetic Oligonucleotide; IFNG exon 3; Set C
gaugaugugaauuuau

SEQ ID NO: 9529 - RNA, 33 nt, Artificial Sequence
  Synthetic Oligonucleotide; IFNG exon 3; Set A
caaacagaggaugaugugaauuuauccaucaga

SEQ ID NO: 9530 - RNA, 17 nt, Artificial Sequence
  Synthetic Oligonucleotide; IFNG exon 3; Set C
ggaugaugugaauuuau

SEQ ID NO: 9531 - RNA, 33 nt, Artificial Sequence
  Synthetic Oligonucleotide; IFNG exon 3; Set A
acaaacagaggaugaugugaauuuauccaucag

SEQ ID NO: 9532 - RNA, 26 nt, Artificial Sequence
  Synthetic Oligonucleotide; IFNG exon 3; Set C
acaaacagaggaugaugugaauuuau

SEQ ID NO: 9533 - RNA, 19 nt, Artificial Sequence
  Synthetic Oligonucleotide; IFNG exon 3; Set C
aaacagaggaugaugugaa

SEQ ID NO: 9534 - RNA, 18 nt, Artificial Sequence
  Synthetic Oligonucleotide; IFNG exon 3; Set C
aaacagaggaugauguga

SEQ ID NO: 9535 - RNA, 20 nt, Artificial Sequence
  Synthetic Oligonucleotide; IFNG exon 3; Set C
caaacagaggaugaugugaa

SEQ ID NO: 9536 - RNA, 19 nt, Artificial Sequence
  Synthetic Oligonucleotide; IFNG exon 3; Set C
caaacagaggaugauguga

SEQ ID NO: 9537 - RNA, 16 nt, Artificial Sequence
  Synthetic Oligonucleotide; IFNG exon 3; Set C
aaacagaggaugaugu

SEQ ID NO: 9538 - RNA, 15 nt, Artificial Sequence
  Synthetic Oligonucleotide; IFNG exon 3; Set C
aaacagaggaugaug

SEQ ID NO: 9539 - RNA, 16 nt, Artificial Sequence
  Synthetic Oligonucleotide; IFNG exon 3; Set C
caaacagaggaugaug

SEQ ID NO: 9540 - RNA, 20 nt, Artificial Sequence
  Synthetic Oligonucleotide; IFNG exon 3; Set C
cacaaacagaggaugaugug

SEQ ID NO: 9541 - RNA, 21 nt, Artificial Sequence
  Synthetic Oligonucleotide; IFNG exon 3; Set C
gcacaaacagaggaugaugug

SEQ ID NO: 9542 - RNA, 22 nt, Artificial Sequence
  Synthetic Oligonucleotide; IFNG exon 3; Set C
agcacaaacagaggaugaugug

SEQ ID NO: 9543 - RNA, 23 nt, Artificial Sequence
  Synthetic Oligonucleotide; IFNG exon 3; Set C
gagcacaaacagaggaugaugug

SEQ ID NO: 9544 - RNA, 24 nt, Artificial Sequence
  Synthetic Oligonucleotide; IFNG exon 3; Set C
agagcacaaacagaggaugaugug

SEQ ID NO: 9545 - RNA, 25 nt, Artificial Sequence
  Synthetic Oligonucleotide; IFNG exon 3; Set C
aagagcacaaacagaggaugaugug

SEQ ID NO: 9546 - RNA, 39 nt, Artificial Sequence
  Synthetic Oligonucleotide; IFNG exon 3; Set A
ggaaggaaagagcacaaacagaggaugaugugaauuuau

SEQ ID NO: 9547 - RNA, 40 nt, Artificial Sequence
  Synthetic Oligonucleotide; IFNG exon 3; Set A
uggaaggaaagagcacaaacagaggaugaugugaauuuau

SEQ ID NO: 9548 - RNA, 33 nt, Artificial Sequence
  Synthetic Oligonucleotide; IFNG exon 3; Set A
gaaggaaagagcacaaacagaggaugaugugaa

SEQ ID NO: 9549 - RNA, 32 nt, Artificial Sequence
  Synthetic Oligonucleotide; IFNG exon 3; Set A
gaaggaaagagcacaaacagaggaugauguga

SEQ ID NO: 9550 - RNA, 30 nt, Artificial Sequence
  Synthetic Oligonucleotide; IFNG exon 3; Set A
gaaggaaagagcacaaacagaggaugaugu

SEQ ID NO: 9551 - RNA, 32 nt, Artificial Sequence
  Synthetic Oligonucleotide; IFNG exon 3; Set A
ggaaggaaagagcacaaacagaggaugaugug

SEQ ID NO: 9552 - RNA, 29 nt, Artificial Sequence
  Synthetic Oligonucleotide; IFNG exon 3; Set A
gaaggaaagagcacaaacagaggaugaug

SEQ ID NO: 9553 - RNA, 33 nt, Artificial Sequence
  Synthetic Oligonucleotide; IFNG exon 3; Set A
uggaaggaaagagcacaaacagaggaugaugug

SEQ ID NO: 9554 - RNA, 28 nt, Artificial Sequence
  Synthetic Oligonucleotide; IFNG exon 3; Set A
gaaggaaagagcacaaacagaggaugau

SEQ ID NO: 9555 - RNA, 26 nt, Artificial Sequence
  Synthetic Oligonucleotide; IFNG exon 3; Set C
gaaggaaagagcacaaacagaggaug

SEQ ID NO: 9556 - RNA, 23 nt, Artificial Sequence
  Synthetic Oligonucleotide; IFNG exon 3; Set C
gaaggaaagagcacaaacagagg

SEQ ID NO: 9557 - RNA, 22 nt, Artificial Sequence
  Synthetic Oligonucleotide; IFNG exon 3; Set C
gaaggaaagagcacaaacagag

SEQ ID NO: 9558 - RNA, 17 nt, Artificial Sequence
  Synthetic Oligonucleotide; IFNG exon 3; Set C
gaaggaaagagcacaaa

SEQ ID NO: 9559 - RNA, 16 nt, Artificial Sequence
  Synthetic Oligonucleotide; IFNG exon 3; Set C
gaaggaaagagcacaa

SEQ ID NO: 9560 - RNA, 40 nt, Artificial Sequence
  Synthetic Oligonucleotide; IFNG exon 3; Set C
uuucugucacucuccuuggaaggaaagagcacaaacagag

SEQ ID NO: 9561 - RNA, 36 nt, Artificial Sequence
  Synthetic Oligonucleotide; IFNG exon 3; Set A
uuuucugucacucuccuuggaaggaaagagcacaaa

SEQ ID NO: 9562 - RNA, 33 nt, Artificial Sequence
  Synthetic Oligonucleotide; IFNG exon 3; Set C
uuucugucacucuccuuggaaggaaagagcaca

SEQ ID NO: 9563 - RNA, 37 nt, Artificial Sequence
  Synthetic Oligonucleotide; IFNG exon 3; Set A
uuuuucugucacucuccuuggaaggaaagagcacaaa

SEQ ID NO: 9564 - RNA, 35 nt, Artificial Sequence
  Synthetic Oligonucleotide; IFNG exon 3; Set C
uuuucugucacucuccuuggaaggaaagagcacaa

SEQ ID NO: 9565 - RNA, 32 nt, Artificial Sequence
  Synthetic Oligonucleotide; IFNG exon 3; Set A
uuucugucacucuccuuggaaggaaagagcac

SEQ ID NO: 9566 - RNA, 38 nt, Artificial Sequence
  Synthetic Oligonucleotide; IFNG exon 3; Set A
auuuuucugucacucuccuuggaaggaaagagcacaaa

SEQ ID NO: 9567 - RNA, 36 nt, Artificial Sequence
  Synthetic Oligonucleotide; IFNG exon 3; Set C
uuuuucugucacucuccuuggaaggaaagagcacaa

SEQ ID NO: 9568 - RNA, 31 nt, Artificial Sequence
  Synthetic Oligonucleotide; IFNG exon 3; Set A
uuucugucacucuccuuggaaggaaagagca

SEQ ID NO: 9569 - RNA, 33 nt, Artificial Sequence
  Synthetic Oligonucleotide; IFNG exon 3; Set A
uuuucugucacucuccuuggaaggaaagagcac

SEQ ID NO: 9570 - RNA, 39 nt, Artificial Sequence
  Synthetic Oligonucleotide; IFNG exon 3; Set A
uauuuuucugucacucuccuuggaaggaaagagcacaaa

SEQ ID NO: 9571 - RNA, 37 nt, Artificial Sequence
  Synthetic Oligonucleotide; IFNG exon 3; Set C
auuuuucugucacucuccuuggaaggaaagagcacaa

SEQ ID NO: 9572 - RNA, 32 nt, Artificial Sequence
  Synthetic Oligonucleotide; IFNG exon 3; Set A
uuuucugucacucuccuuggaaggaaagagca

SEQ ID NO: 9573 - RNA, 34 nt, Artificial Sequence
  Synthetic Oligonucleotide; IFNG exon 3; Set A
uuuuucugucacucuccuuggaaggaaagagcac

SEQ ID NO: 9574 - RNA, 40 nt, Artificial Sequence
  Synthetic Oligonucleotide; IFNG exon 3; Set C
uuauuuuucugucacucuccuuggaaggaaagagcacaaa

SEQ ID NO: 9575 - RNA, 38 nt, Artificial Sequence
  Synthetic Oligonucleotide; IFNG exon 3; Set C
uauuuuucugucacucuccuuggaaggaaagagcacaa

SEQ ID NO: 9576 - RNA, 31 nt, Artificial Sequence
  Synthetic Oligonucleotide; IFNG exon 3; Set A
uuuucugucacucuccuuggaaggaaagagc

SEQ ID NO: 9577 - RNA, 33 nt, Artificial Sequence
  Synthetic Oligonucleotide; IFNG exon 3; Set A
uuuuucugucacucuccuuggaaggaaagagca

SEQ ID NO: 9578 - RNA, 35 nt, Artificial Sequence
  Synthetic Oligonucleotide; IFNG exon 3; Set A
auuuuucugucacucuccuuggaaggaaagagcac

SEQ ID NO: 9579 - RNA, 39 nt, Artificial Sequence
  Synthetic Oligonucleotide; IFNG exon 3; Set C
uuauuuuucugucacucuccuuggaaggaaagagcacaa

SEQ ID NO: 9580 - RNA, 32 nt, Artificial Sequence
  Synthetic Oligonucleotide; IFNG exon 3; Set A
uuuuucugucacucuccuuggaaggaaagagc

SEQ ID NO: 9581 - RNA, 34 nt, Artificial Sequence
  Synthetic Oligonucleotide; IFNG exon 3; Set A
auuuuucugucacucuccuuggaaggaaagagca

SEQ ID NO: 9582 - RNA, 36 nt, Artificial Sequence
  Synthetic Oligonucleotide; IFNG exon 3; Set A
uauuuuucugucacucuccuuggaaggaaagagcac

SEQ ID NO: 9583 - RNA, 30 nt, Artificial Sequence
  Synthetic Oligonucleotide; IFNG exon 3; Set A
uuuucugucacucuccuuggaaggaaagag

SEQ ID NO: 9584 - RNA, 40 nt, Artificial Sequence
  Synthetic Oligonucleotide; IFNG exon 3; Set C
auuauuuuucugucacucuccuuggaaggaaagagcacaa

SEQ ID NO: 9585 - RNA, 33 nt, Artificial Sequence
  Synthetic Oligonucleotide; IFNG exon 3; Set A
auuuuucugucacucuccuuggaaggaaagagc

SEQ ID NO: 9586 - RNA, 35 nt, Artificial Sequence
  Synthetic Oligonucleotide; IFNG exon 3; Set A
uauuuuucugucacucuccuuggaaggaaagagca

SEQ ID NO: 9587 - RNA, 29 nt, Artificial Sequence
  Synthetic Oligonucleotide; IFNG exon 3; Set A
uuuucugucacucuccuuggaaggaaaga

SEQ ID NO: 9588 - RNA, 31 nt, Artificial Sequence
  Synthetic Oligonucleotide; IFNG exon 3; Set A
uuuuucugucacucuccuuggaaggaaagag

SEQ ID NO: 9589 - RNA, 34 nt, Artificial Sequence
  Synthetic Oligonucleotide; IFNG exon 3; Set A
uauuuuucugucacucuccuuggaaggaaagagc

SEQ ID NO: 9590 - RNA, 30 nt, Artificial Sequence
  Synthetic Oligonucleotide; IFNG exon 3; Set A
uuuuucugucacucuccuuggaaggaaaga

SEQ ID NO: 9591 - RNA, 32 nt, Artificial Sequence
  Synthetic Oligonucleotide; IFNG exon 3; Set A
auuuuucugucacucuccuuggaaggaaagag

SEQ ID NO: 9592 - RNA, 35 nt, Artificial Sequence
  Synthetic Oligonucleotide; IFNG exon 3; Set A
uuauuuuucugucacucuccuuggaaggaaagagc

SEQ ID NO: 9593 - RNA, 31 nt, Artificial Sequence
  Synthetic Oligonucleotide; IFNG exon 3; Set A
auuuuucugucacucuccuuggaaggaaaga

SEQ ID NO: 9594 - RNA, 29 nt, Artificial Sequence
  Synthetic Oligonucleotide; IFNG exon 3; Set A
uuuuucugucacucuccuuggaaggaaag

SEQ ID NO: 9595 - RNA, 33 nt, Artificial Sequence
  Synthetic Oligonucleotide; IFNG exon 3; Set A
uauuuuucugucacucuccuuggaaggaaagag

SEQ ID NO: 9596 - RNA, 36 nt, Artificial Sequence
  Synthetic Oligonucleotide; IFNG exon 3; Set A
auuauuuuucugucacucuccuuggaaggaaagagc

SEQ ID NO: 9597 - RNA, 32 nt, Artificial Sequence
  Synthetic Oligonucleotide; IFNG exon 3; Set A
uauuuuucugucacucuccuuggaaggaaaga

SEQ ID NO: 9598 - RNA, 30 nt, Artificial Sequence
  Synthetic Oligonucleotide; IFNG exon 3; Set A
auuuuucugucacucuccuuggaaggaaag

SEQ ID NO: 9599 - RNA, 34 nt, Artificial Sequence
  Synthetic Oligonucleotide; IFNG exon 3; Set A
uuauuuuucugucacucuccuuggaaggaaagag

SEQ ID NO: 9600 - RNA, 33 nt, Artificial Sequence
  Synthetic Oligonucleotide; IFNG exon 3; Set A
uuauuuuucugucacucuccuuggaaggaaaga

SEQ ID NO: 9601 - RNA, 31 nt, Artificial Sequence
  Synthetic Oligonucleotide; IFNG exon 3; Set A
uauuuuucugucacucuccuuggaaggaaag

SEQ ID NO: 9602 - RNA, 35 nt, Artificial Sequence
  Synthetic Oligonucleotide; IFNG exon 3; Set A
auuauuuuucugucacucuccuuggaaggaaagag

SEQ ID NO: 9603 - RNA, 32 nt, Artificial Sequence
  Synthetic Oligonucleotide; IFNG exon 3; Set A
uuauuuuucugucacucuccuuggaaggaaag

SEQ ID NO: 9604 - RNA, 34 nt, Artificial Sequence
  Synthetic Oligonucleotide; IFNG exon 3; Set A
auuauuuuucugucacucuccuuggaaggaaaga

SEQ ID NO: 9605 - RNA, 33 nt, Artificial Sequence
  Synthetic Oligonucleotide; IFNG exon 3; Set A
auuauuuuucugucacucuccuuggaaggaaag

SEQ ID NO: 9606 - RNA, 20 nt, Artificial Sequence
  Synthetic Oligonucleotide; IFNG exon 3; Set C
uuucugucacucuccuugga

SEQ ID NO: 9607 - RNA, 19 nt, Artificial Sequence
  Synthetic Oligonucleotide; IFNG exon 3; Set C
uuucugucacucuccuugg

SEQ ID NO: 9608 - RNA, 20 nt, Artificial Sequence
  Synthetic Oligonucleotide; IFNG exon 3; Set C
uuuucugucacucuccuugg

SEQ ID NO: 9609 - RNA, 24 nt, Artificial Sequence
  Synthetic Oligonucleotide; IFNG exon 3; Set C
auuuuucugucacucuccuuggaa

SEQ ID NO: 9610 - RNA, 25 nt, Artificial Sequence
  Synthetic Oligonucleotide; IFNG exon 3; Set C
uauuuuucugucacucuccuuggaa

SEQ ID NO: 9611 - RNA, 26 nt, Artificial Sequence
  Synthetic Oligonucleotide; IFNG exon 3; Set C
uuauuuuucugucacucuccuuggaa

SEQ ID NO: 9612 - RNA, 27 nt, Artificial Sequence
  Synthetic Oligonucleotide; IFNG exon 3; Set C
auuauuuuucugucacucuccuuggaa

SEQ ID NO: 9613 - RNA, 35 nt, Artificial Sequence
  Synthetic Oligonucleotide; IFNG exon 3; Set C
uggcucugcauuauuuuucugucacucuccuugga

SEQ ID NO: 9614 - RNA, 34 nt, Artificial Sequence
  Synthetic Oligonucleotide; IFNG exon 3; Set C
uggcucugcauuauuuuucugucacucuccuugg

SEQ ID NO: 9615 - RNA, 38 nt, Artificial Sequence
  Synthetic Oligonucleotide; IFNG exon 3; Set C
uuuggcucugcauuauuuuucugucacucuccuuggaa

SEQ ID NO: 9616 - RNA, 39 nt, Artificial Sequence
  Synthetic Oligonucleotide; IFNG exon 3; Set C
auuuggcucugcauuauuuuucugucacucuccuuggaa

SEQ ID NO: 9617 - RNA, 22 nt, Artificial Sequence
  Synthetic Oligonucleotide; IFNG exon 3; Set C
aauuuggcucugcauuauuuuu

SEQ ID NO: 9618 - RNA, 21 nt, Artificial Sequence
  Synthetic Oligonucleotide; IFNG exon 3; Set C
aauuuggcucugcauuauuuu

SEQ ID NO: 9619 - RNA, 20 nt, Artificial Sequence
  Synthetic Oligonucleotide; IFNG exon 3; Set C
aauuuggcucugcauuauuu

SEQ ID NO: 9620 - RNA, 19 nt, Artificial Sequence
  Synthetic Oligonucleotide; IFNG exon 3; Set C
aauuuggcucugcauuauu

SEQ ID NO: 9621 - RNA, 18 nt, Artificial Sequence
  Synthetic Oligonucleotide; IFNG exon 3; Set C
aauuuggcucugcauuau

SEQ ID NO: 9622 - RNA, 17 nt, Artificial Sequence
  Synthetic Oligonucleotide; IFNG exon 3; Set C
aauuuggcucugcauua

SEQ ID NO: 9623 - RNA, 21 nt, Artificial Sequence
  Synthetic Oligonucleotide; IFNG exon 3; Set C
aaguaaaaggagacaauuugg

SEQ ID NO: 9624 - RNA, 19 nt, Artificial Sequence
  Synthetic Oligonucleotide; IFNG exon 3; Set C
ugaaguaaaaggagacaau

SEQ ID NO: 9625 - RNA, 20 nt, Artificial Sequence
  Synthetic Oligonucleotide; IFNG exon 3; Set C
uugaaguaaaaggagacaau

SEQ ID NO: 9626 - RNA, 23 nt, Artificial Sequence
  Synthetic Oligonucleotide; IFNG exon 3; Set C
aguuugaaguaaaaggagacaau

SEQ ID NO: 9627 - RNA, 24 nt, Artificial Sequence
  Synthetic Oligonucleotide; IFNG exon 3; Set C
aaguuugaaguaaaaggagacaau

SEQ ID NO: 9628 - RNA, 25 nt, Artificial Sequence
  Synthetic Oligonucleotide; IFNG exon 3; Set C
aaaguuugaaguaaaaggagacaau

SEQ ID NO: 9629 - RNA, 26 nt, Artificial Sequence
  Synthetic Oligonucleotide; IFNG exon 3; Set C
aaaaguuugaaguaaaaggagacaau

SEQ ID NO: 9630 - RNA, 27 nt, Artificial Sequence
  Synthetic Oligonucleotide; IFNG exon 3; Set C
aaaaaguuugaaguaaaaggagacaau

SEQ ID NO: 9631 - RNA, 28 nt, Artificial Sequence
  Synthetic Oligonucleotide; IFNG exon 3; Set C
uaaaaaguuugaaguaaaaggagacaau

SEQ ID NO: 9632 - RNA, 37 nt, Artificial Sequence
  Synthetic Oligonucleotide; IFNG exon 3; Set C
guuuuuaaaaaguuugaaguaaaaggagacaauuugg

SEQ ID NO: 9633 - RNA, 29 nt, Artificial Sequence
  Synthetic Oligonucleotide; IFNG exon 3; Set C
uuaaaaaguuugaaguaaaaggagacaau

SEQ ID NO: 9634 - RNA, 37 nt, Artificial Sequence
  Synthetic Oligonucleotide; IFNG exon 3; Set C
aguuuuuaaaaaguuugaaguaaaaggagacaauuug

SEQ ID NO: 9635 - RNA, 36 nt, Artificial Sequence
  Synthetic Oligonucleotide; IFNG exon 3; Set C
aguuuuuaaaaaguuugaaguaaaaggagacaauuu

SEQ ID NO: 9636 - RNA, 38 nt, Artificial Sequence
  Synthetic Oligonucleotide; IFNG exon 3; Set C
aaguuuuuaaaaaguuugaaguaaaaggagacaauuug

SEQ ID NO: 9637 - RNA, 37 nt, Artificial Sequence
  Synthetic Oligonucleotide; IFNG exon 3; Set C
aaguuuuuaaaaaguuugaaguaaaaggagacaauuu

SEQ ID NO: 9638 - RNA, 35 nt, Artificial Sequence
  Synthetic Oligonucleotide; IFNG exon 3; Set C
aguuuuuaaaaaguuugaaguaaaaggagacaauu

SEQ ID NO: 9639 - RNA, 39 nt, Artificial Sequence
  Synthetic Oligonucleotide; IFNG exon 3; Set C
aaaguuuuuaaaaaguuugaaguaaaaggagacaauuug

SEQ ID NO: 9640 - RNA, 38 nt, Artificial Sequence
  Synthetic Oligonucleotide; IFNG exon 3; Set C
aaaguuuuuaaaaaguuugaaguaaaaggagacaauuu

SEQ ID NO: 9641 - RNA, 36 nt, Artificial Sequence
  Synthetic Oligonucleotide; IFNG exon 3; Set C
aaguuuuuaaaaaguuugaaguaaaaggagacaauu

SEQ ID NO: 9642 - RNA, 40 nt, Artificial Sequence
  Synthetic Oligonucleotide; IFNG exon 3; Set C
uaaaguuuuuaaaaaguuugaaguaaaaggagacaauuug

SEQ ID NO: 9643 - RNA, 37 nt, Artificial Sequence
  Synthetic Oligonucleotide; IFNG exon 3; Set C
aaaguuuuuaaaaaguuugaaguaaaaggagacaauu

SEQ ID NO: 9644 - RNA, 39 nt, Artificial Sequence
  Synthetic Oligonucleotide; IFNG exon 3; Set C
uuaaaguuuuuaaaaaguuugaaguaaaaggagacaauu

SEQ ID NO: 9645 - RNA, 40 nt, Artificial Sequence
  Synthetic Oligonucleotide; IFNG exon 3; Set C
uuuaaaguuuuuaaaaaguuugaaguaaaaggagacaauu

SEQ ID NO: 9646 - RNA, 25 nt, Artificial Sequence
  Synthetic Oligonucleotide; IFNG exon 3; Set C
aguuuuuaaaaaguuugaaguaaaa

SEQ ID NO: 9647 - RNA, 26 nt, Artificial Sequence
  Synthetic Oligonucleotide; IFNG exon 3; Set C
aaguuuuuaaaaaguuugaaguaaaa

SEQ ID NO: 9648 - RNA, 24 nt, Artificial Sequence
  Synthetic Oligonucleotide; IFNG exon 3; Set C
aguuuuuaaaaaguuugaaguaaa

SEQ ID NO: 9649 - RNA, 30 nt, Artificial Sequence
  Synthetic Oligonucleotide; IFNG exon 3; Set C
uaaaguuuuuaaaaaguuugaaguaaaagg

SEQ ID NO: 9650 - RNA, 27 nt, Artificial Sequence
  Synthetic Oligonucleotide; IFNG exon 3; Set C
aaaguuuuuaaaaaguuugaaguaaaa

SEQ ID NO: 9651 - RNA, 23 nt, Artificial Sequence
  Synthetic Oligonucleotide; IFNG exon 3; Set C
aguuuuuaaaaaguuugaaguaa

SEQ ID NO: 9652 - RNA, 25 nt, Artificial Sequence
  Synthetic Oligonucleotide; IFNG exon 3; Set C
aaguuuuuaaaaaguuugaaguaaa

SEQ ID NO: 9653 - RNA, 29 nt, Artificial Sequence
  Synthetic Oligonucleotide; IFNG exon 3; Set C
uaaaguuuuuaaaaaguuugaaguaaaag

SEQ ID NO: 9654 - RNA, 31 nt, Artificial Sequence
  Synthetic Oligonucleotide; IFNG exon 3; Set C
uuaaaguuuuuaaaaaguuugaaguaaaagg

SEQ ID NO: 9655 - RNA, 24 nt, Artificial Sequence
  Synthetic Oligonucleotide; IFNG exon 3; Set C
aaguuuuuaaaaaguuugaaguaa

SEQ ID NO: 9656 - RNA, 26 nt, Artificial Sequence
  Synthetic Oligonucleotide; IFNG exon 3; Set C
aaaguuuuuaaaaaguuugaaguaaa

SEQ ID NO: 9657 - RNA, 30 nt, Artificial Sequence
  Synthetic Oligonucleotide; IFNG exon 3; Set C
uuaaaguuuuuaaaaaguuugaaguaaaag

SEQ ID NO: 9658 - RNA, 32 nt, Artificial Sequence
  Synthetic Oligonucleotide; IFNG exon 3; Set C
uuuaaaguuuuuaaaaaguuugaaguaaaagg

SEQ ID NO: 9659 - RNA, 25 nt, Artificial Sequence
  Synthetic Oligonucleotide; IFNG exon 3; Set C
aaaguuuuuaaaaaguuugaaguaa

SEQ ID NO: 9660 - RNA, 23 nt, Artificial Sequence
  Synthetic Oligonucleotide; IFNG exon 3; Set C
aaguuuuuaaaaaguuugaagua

SEQ ID NO: 9661 - RNA, 31 nt, Artificial Sequence
  Synthetic Oligonucleotide; IFNG exon 3; Set C
uuuaaaguuuuuaaaaaguuugaaguaaaag

SEQ ID NO: 9662 - RNA, 28 nt, Artificial Sequence
  Synthetic Oligonucleotide; IFNG exon 3; Set C
uuaaaguuuuuaaaaaguuugaaguaaa

SEQ ID NO: 9663 - RNA, 24 nt, Artificial Sequence
  Synthetic Oligonucleotide; IFNG exon 3; Set C
aaaguuuuuaaaaaguuugaagua

SEQ ID NO: 9664 - RNA, 27 nt, Artificial Sequence
  Synthetic Oligonucleotide; IFNG exon 3; Set C
uuaaaguuuuuaaaaaguuugaaguaa

SEQ ID NO: 9665 - RNA, 29 nt, Artificial Sequence
  Synthetic Oligonucleotide; IFNG exon 3; Set C
uuuaaaguuuuuaaaaaguuugaaguaaa

SEQ ID NO: 9666 - RNA, 25 nt, Artificial Sequence
  Synthetic Oligonucleotide; IFNG exon 3; Set C
uaaaguuuuuaaaaaguuugaagua

SEQ ID NO: 9667 - RNA, 28 nt, Artificial Sequence
  Synthetic Oligonucleotide; IFNG exon 3; Set C
uuuaaaguuuuuaaaaaguuugaaguaa

SEQ ID NO: 9668 - RNA, 18 nt, Artificial Sequence
  Synthetic Oligonucleotide; IFNG exon 3; Set C
aguuuuuaaaaaguuuga

SEQ ID NO: 9669 - RNA, 26 nt, Artificial Sequence
  Synthetic Oligonucleotide; IFNG exon 3; Set C
uuaaaguuuuuaaaaaguuugaagua

SEQ ID NO: 9670 - RNA, 24 nt, Artificial Sequence
  Synthetic Oligonucleotide; IFNG exon 3; Set C
uaaaguuuuuaaaaaguuugaagu

SEQ ID NO: 9671 - RNA, 17 nt, Artificial Sequence
  Synthetic Oligonucleotide; IFNG exon 3; Set C
aguuuuuaaaaaguuug

SEQ ID NO: 9672 - RNA, 19 nt, Artificial Sequence
  Synthetic Oligonucleotide; IFNG exon 3; Set C
aaguuuuuaaaaaguuuga

SEQ ID NO: 9673 - RNA, 27 nt, Artificial Sequence
  Synthetic Oligonucleotide; IFNG exon 3; Set C
uuuaaaguuuuuaaaaaguuugaagua

SEQ ID NO: 9674 - RNA, 25 nt, Artificial Sequence
  Synthetic Oligonucleotide; IFNG exon 3; Set C
uuaaaguuuuuaaaaaguuugaagu

SEQ ID NO: 9675 - RNA, 23 nt, Artificial Sequence
  Synthetic Oligonucleotide; IFNG exon 3; Set C
uaaaguuuuuaaaaaguuugaag

SEQ ID NO: 9676 - RNA, 16 nt, Artificial Sequence
  Synthetic Oligonucleotide; IFNG exon 3; Set C
aguuuuuaaaaaguuu

SEQ ID NO: 9677 - RNA, 18 nt, Artificial Sequence
  Synthetic Oligonucleotide; IFNG exon 3; Set C
aaguuuuuaaaaaguuug

SEQ ID NO: 9678 - RNA, 20 nt, Artificial Sequence
  Synthetic Oligonucleotide; IFNG exon 3; Set C
aaaguuuuuaaaaaguuuga

SEQ ID NO: 9679 - RNA, 26 nt, Artificial Sequence
  Synthetic Oligonucleotide; IFNG exon 3; Set C
uuuaaaguuuuuaaaaaguuugaagu

SEQ ID NO: 9680 - RNA, 22 nt, Artificial Sequence
  Synthetic Oligonucleotide; IFNG exon 3; Set C
uaaaguuuuuaaaaaguuugaa

SEQ ID NO: 9681 - RNA, 24 nt, Artificial Sequence
  Synthetic Oligonucleotide; IFNG exon 3; Set C
uuaaaguuuuuaaaaaguuugaag

SEQ ID NO: 9682 - RNA, 17 nt, Artificial Sequence
  Synthetic Oligonucleotide; IFNG exon 3; Set C
aaguuuuuaaaaaguuu

SEQ ID NO: 9683 - RNA, 15 nt, Artificial Sequence
  Synthetic Oligonucleotide; IFNG exon 3; Set C
aguuuuuaaaaaguu

SEQ ID NO: 9684 - RNA, 19 nt, Artificial Sequence
  Synthetic Oligonucleotide; IFNG exon 3; Set C
aaaguuuuuaaaaaguuug

SEQ ID NO: 9685 - RNA, 21 nt, Artificial Sequence
  Synthetic Oligonucleotide; IFNG exon 3; Set C
uaaaguuuuuaaaaaguuuga

SEQ ID NO: 9686 - RNA, 23 nt, Artificial Sequence
  Synthetic Oligonucleotide; IFNG exon 3; Set C
uuaaaguuuuuaaaaaguuugaa

SEQ ID NO: 9687 - RNA, 25 nt, Artificial Sequence
  Synthetic Oligonucleotide; IFNG exon 3; Set C
uuuaaaguuuuuaaaaaguuugaag

SEQ ID NO: 9688 - RNA, 16 nt, Artificial Sequence
  Synthetic Oligonucleotide; IFNG exon 3; Set C
aaguuuuuaaaaaguu

SEQ ID NO: 9689 - RNA, 18 nt, Artificial Sequence
  Synthetic Oligonucleotide; IFNG exon 3; Set C
aaaguuuuuaaaaaguuu

SEQ ID NO: 9690 - RNA, 22 nt, Artificial Sequence
  Synthetic Oligonucleotide; IFNG exon 3; Set C
uuaaaguuuuuaaaaaguuuga

SEQ ID NO: 9691 - RNA, 40 nt, Artificial Sequence
  Synthetic Oligonucleotide; IFNG exon 3; Set C
uggucaucuuuaaaguuuuuaaaaaguuugaaguaaaagg

SEQ ID NO: 9692 - RNA, 24 nt, Artificial Sequence
  Synthetic Oligonucleotide; IFNG exon 3; Set C
uuuaaaguuuuuaaaaaguuugaa

SEQ ID NO: 9693 - RNA, 17 nt, Artificial Sequence
  Synthetic Oligonucleotide; IFNG exon 3; Set C
aaaguuuuuaaaaaguu

SEQ ID NO: 9694 - RNA, 15 nt, Artificial Sequence
  Synthetic Oligonucleotide; IFNG exon 3; Set C
aaguuuuuaaaaagu

SEQ ID NO: 9695 - RNA, 23 nt, Artificial Sequence
  Synthetic Oligonucleotide; IFNG exon 3; Set C
uuuaaaguuuuuaaaaaguuuga

SEQ ID NO: 9696 - RNA, 16 nt, Artificial Sequence
  Synthetic Oligonucleotide; IFNG exon 3; Set C
aaaguuuuuaaaaagu

SEQ ID NO: 9697 - RNA, 15 nt, Artificial Sequence
  Synthetic Oligonucleotide; IFNG exon 3; Set C
aaaguuuuuaaaaag

SEQ ID NO: 9698 - RNA, 16 nt, Artificial Sequence
  Synthetic Oligonucleotide; IFNG exon 3; Set C
uaaaguuuuuaaaaag

SEQ ID NO: 9699 - RNA, 17 nt, Artificial Sequence
  Synthetic Oligonucleotide; IFNG exon 3; Set C
uuaaaguuuuuaaaaag

SEQ ID NO: 9700 - RNA, 15 nt, Artificial Sequence
  Synthetic Oligonucleotide; IFNG exon 3; Set C
uaaaguuuuuaaaaa

SEQ ID NO: 9701 - RNA, 18 nt, Artificial Sequence
  Synthetic Oligonucleotide; IFNG exon 3; Set C
uuuaaaguuuuuaaaaag

SEQ ID NO: 9702 - RNA, 16 nt, Artificial Sequence
  Synthetic Oligonucleotide; IFNG exon 3; Set C
uuaaaguuuuuaaaaa

SEQ ID NO: 9703 - RNA, 34 nt, Artificial Sequence
  Synthetic Oligonucleotide; IFNG exon 3; Set C
uggucaucuuuaaaguuuuuaaaaaguuugaagu

SEQ ID NO: 9704 - RNA, 15 nt, Artificial Sequence
  Synthetic Oligonucleotide; IFNG exon 3; Set C
uuaaaguuuuuaaaa

SEQ ID NO: 9705 - RNA, 17 nt, Artificial Sequence
  Synthetic Oligonucleotide; IFNG exon 3; Set C
uuuaaaguuuuuaaaaa

SEQ ID NO: 9706 - RNA, 35 nt, Artificial Sequence
  Synthetic Oligonucleotide; IFNG exon 3; Set C
cuggucaucuuuaaaguuuuuaaaaaguuugaagu

SEQ ID NO: 9707 - RNA, 33 nt, Artificial Sequence
  Synthetic Oligonucleotide; IFNG exon 3; Set C
uggucaucuuuaaaguuuuuaaaaaguuugaag

SEQ ID NO: 9708 - RNA, 16 nt, Artificial Sequence
  Synthetic Oligonucleotide; IFNG exon 3; Set C
uuuaaaguuuuuaaaa

SEQ ID NO: 9709 - RNA, 36 nt, Artificial Sequence
  Synthetic Oligonucleotide; IFNG exon 3; Set C
ucuggucaucuuuaaaguuuuuaaaaaguuugaagu

SEQ ID NO: 9710 - RNA, 32 nt, Artificial Sequence
  Synthetic Oligonucleotide; IFNG exon 3; Set C
uggucaucuuuaaaguuuuuaaaaaguuugaa

SEQ ID NO: 9711 - RNA, 34 nt, Artificial Sequence
  Synthetic Oligonucleotide; IFNG exon 3; Set C
cuggucaucuuuaaaguuuuuaaaaaguuugaag

SEQ ID NO: 9712 - RNA, 37 nt, Artificial Sequence
  Synthetic Oligonucleotide; IFNG exon 3; Set C
cucuggucaucuuuaaaguuuuuaaaaaguuugaagu

SEQ ID NO: 9713 - RNA, 33 nt, Artificial Sequence
  Synthetic Oligonucleotide; IFNG exon 3; Set C
cuggucaucuuuaaaguuuuuaaaaaguuugaa

SEQ ID NO: 9714 - RNA, 35 nt, Artificial Sequence
  Synthetic Oligonucleotide; IFNG exon 3; Set C
ucuggucaucuuuaaaguuuuuaaaaaguuugaag

SEQ ID NO: 9715 - RNA, 34 nt, Artificial Sequence
  Synthetic Oligonucleotide; IFNG exon 3; Set C
ucuggucaucuuuaaaguuuuuaaaaaguuugaa

SEQ ID NO: 9716 - RNA, 36 nt, Artificial Sequence
  Synthetic Oligonucleotide; IFNG exon 3; Set C
cucuggucaucuuuaaaguuuuuaaaaaguuugaag

SEQ ID NO: 9717 - RNA, 35 nt, Artificial Sequence
  Synthetic Oligonucleotide; IFNG exon 3; Set C
cucuggucaucuuuaaaguuuuuaaaaaguuugaa

SEQ ID NO: 9718 - RNA, 25 nt, Artificial Sequence
  Synthetic Oligonucleotide; IFNG exon 3; Set C
uggucaucuuuaaaguuuuuaaaaa

SEQ ID NO: 9719 - RNA, 24 nt, Artificial Sequence
  Synthetic Oligonucleotide; IFNG exon 3; Set C
uggucaucuuuaaaguuuuuaaaa

SEQ ID NO: 9720 - RNA, 26 nt, Artificial Sequence
  Synthetic Oligonucleotide; IFNG exon 3; Set C
cuggucaucuuuaaaguuuuuaaaaa

SEQ ID NO: 9721 - RNA, 23 nt, Artificial Sequence
  Synthetic Oligonucleotide; IFNG exon 3; Set C
uggucaucuuuaaaguuuuuaaa

SEQ ID NO: 9722 - RNA, 25 nt, Artificial Sequence
  Synthetic Oligonucleotide; IFNG exon 3; Set C
cuggucaucuuuaaaguuuuuaaaa

SEQ ID NO: 9723 - RNA, 27 nt, Artificial Sequence
  Synthetic Oligonucleotide; IFNG exon 3; Set C
ucuggucaucuuuaaaguuuuuaaaaa

SEQ ID NO: 9724 - RNA, 40 nt, Artificial Sequence
  Synthetic Oligonucleotide; IFNG exon 3; Set A
uggaugcucuggucaucuuuaaaguuuuuaaaaaguuuga

SEQ ID NO: 9725 - RNA, 24 nt, Artificial Sequence
  Synthetic Oligonucleotide; IFNG exon 3; Set C
cuggucaucuuuaaaguuuuuaaa

SEQ ID NO: 9726 - RNA, 26 nt, Artificial Sequence
  Synthetic Oligonucleotide; IFNG exon 3; Set C
ucuggucaucuuuaaaguuuuuaaaa

SEQ ID NO: 9727 - RNA, 28 nt, Artificial Sequence
  Synthetic Oligonucleotide; IFNG exon 3; Set C
cucuggucaucuuuaaaguuuuuaaaaa

SEQ ID NO: 9728 - RNA, 39 nt, Artificial Sequence
  Synthetic Oligonucleotide; IFNG exon 3; Set A
uggaugcucuggucaucuuuaaaguuuuuaaaaaguuug

SEQ ID NO: 9729 - RNA, 25 nt, Artificial Sequence
  Synthetic Oligonucleotide; IFNG exon 3; Set C
ucuggucaucuuuaaaguuuuuaaa

SEQ ID NO: 9730 - RNA, 27 nt, Artificial Sequence
  Synthetic Oligonucleotide; IFNG exon 3; Set C
cucuggucaucuuuaaaguuuuuaaaa

SEQ ID NO: 9731 - RNA, 38 nt, Artificial Sequence
  Synthetic Oligonucleotide; IFNG exon 3; Set A
uggaugcucuggucaucuuuaaaguuuuuaaaaaguuu

SEQ ID NO: 9732 - RNA, 26 nt, Artificial Sequence
  Synthetic Oligonucleotide; IFNG exon 3; Set C
cucuggucaucuuuaaaguuuuuaaa

SEQ ID NO: 9733 - RNA, 37 nt, Artificial Sequence
  Synthetic Oligonucleotide; IFNG exon 3; Set A
uggaugcucuggucaucuuuaaaguuuuuaaaaaguu

SEQ ID NO: 9734 - RNA, 36 nt, Artificial Sequence
  Synthetic Oligonucleotide; IFNG exon 3; Set A
uggaugcucuggucaucuuuaaaguuuuuaaaaagu

SEQ ID NO: 9735 - RNA, 35 nt, Artificial Sequence
  Synthetic Oligonucleotide; IFNG exon 3; Set C
uggaugcucuggucaucuuuaaaguuuuuaaaaag

SEQ ID NO: 9736 - RNA, 31 nt, Artificial Sequence
  Synthetic Oligonucleotide; IFNG exon 3; Set A
uggaugcucuggucaucuuuaaaguuuuuaa

SEQ ID NO: 9737 - RNA, 30 nt, Artificial Sequence
  Synthetic Oligonucleotide; IFNG exon 3; Set A
uggaugcucuggucaucuuuaaaguuuuua

SEQ ID NO: 9738 - RNA, 29 nt, Artificial Sequence
  Synthetic Oligonucleotide; IFNG exon 3; Set A
uggaugcucuggucaucuuuaaaguuuuu

SEQ ID NO: 9739 - RNA, 28 nt, Artificial Sequence
  Synthetic Oligonucleotide; IFNG exon 3; Set A
uggaugcucuggucaucuuuaaaguuuu

SEQ ID NO: 9740 - RNA, 27 nt, Artificial Sequence
  Synthetic Oligonucleotide; IFNG exon 3; Set A
uggaugcucuggucaucuuuaaaguuu

SEQ ID NO: 9741 - RNA, 27 nt, Artificial Sequence
  Synthetic Oligonucleotide; IFNG exon 3; Set A
uuggaugcucuggucaucuuuaaaguu

SEQ ID NO: 9742 - RNA, 28 nt, Artificial Sequence
  Synthetic Oligonucleotide; IFNG exon 3; Set A
uuuggaugcucuggucaucuuuaaaguu

SEQ ID NO: 9743 - RNA, 29 nt, Artificial Sequence
  Synthetic Oligonucleotide; IFNG exon 3; Set A
uuuuggaugcucuggucaucuuuaaaguu

SEQ ID NO: 9744 - RNA, 15 nt, Artificial Sequence
  Synthetic Oligonucleotide; IFNG exon 3; Set C
uuuuggaugcucugg

SEQ ID NO: 9745 - RNA, 31 nt, Artificial Sequence
  Synthetic Oligonucleotide; IFNG exon 3; Set C
ggucuccacacucuuuuggaugcucugguca

SEQ ID NO: 9746 - RNA, 30 nt, Artificial Sequence
  Synthetic Oligonucleotide; IFNG exon 3; Set C
ggucuccacacucuuuuggaugcucugguc

SEQ ID NO: 9747 - RNA, 32 nt, Artificial Sequence
  Synthetic Oligonucleotide; IFNG exon 3; Set C
uggucuccacacucuuuuggaugcucugguca

SEQ ID NO: 9748 - RNA, 29 nt, Artificial Sequence
  Synthetic Oligonucleotide; IFNG exon 3; Set C
ggucuccacacucuuuuggaugcucuggu

SEQ ID NO: 9749 - RNA, 31 nt, Artificial Sequence
  Synthetic Oligonucleotide; IFNG exon 3; Set C
uggucuccacacucuuuuggaugcucugguc

SEQ ID NO: 9750 - RNA, 33 nt, Artificial Sequence
  Synthetic Oligonucleotide; IFNG exon 3; Set C
auggucuccacacucuuuuggaugcucugguca

SEQ ID NO: 9751 - RNA, 30 nt, Artificial Sequence
  Synthetic Oligonucleotide; IFNG exon 3; Set C
uggucuccacacucuuuuggaugcucuggu

SEQ ID NO: 9752 - RNA, 32 nt, Artificial Sequence
  Synthetic Oligonucleotide; IFNG exon 3; Set C
auggucuccacacucuuuuggaugcucugguc

SEQ ID NO: 9753 - RNA, 31 nt, Artificial Sequence
  Synthetic Oligonucleotide; IFNG exon 3; Set C
auggucuccacacucuuuuggaugcucuggu

SEQ ID NO: 9754 - RNA, 31 nt, Artificial Sequence
  Synthetic Oligonucleotide; IFNG exon 3; Set C
gauggucuccacacucuuuuggaugcucugg

SEQ ID NO: 9755 - RNA, 32 nt, Artificial Sequence
  Synthetic Oligonucleotide; IFNG exon 3; Set C
ugauggucuccacacucuuuuggaugcucugg

SEQ ID NO: 9756 - RNA, 30 nt, Artificial Sequence
  Synthetic Oligonucleotide; IFNG exon 3; Set C
gauggucuccacacucuuuuggaugcucug

SEQ ID NO: 9757 - RNA, 33 nt, Artificial Sequence
  Synthetic Oligonucleotide; IFNG exon 3; Set C
uugauggucuccacacucuuuuggaugcucugg

SEQ ID NO: 9758 - RNA, 31 nt, Artificial Sequence
  Synthetic Oligonucleotide; IFNG exon 3; Set C
ugauggucuccacacucuuuuggaugcucug

SEQ ID NO: 9759 - RNA, 29 nt, Artificial Sequence
  Synthetic Oligonucleotide; IFNG exon 3; Set C
gauggucuccacacucuuuuggaugcucu

SEQ ID NO: 9760 - RNA, 32 nt, Artificial Sequence
  Synthetic Oligonucleotide; IFNG exon 3; Set C
uugauggucuccacacucuuuuggaugcucug

SEQ ID NO: 9761 - RNA, 30 nt, Artificial Sequence
  Synthetic Oligonucleotide; IFNG exon 3; Set C
ugauggucuccacacucuuuuggaugcucu

SEQ ID NO: 9762 - RNA, 28 nt, Artificial Sequence
  Synthetic Oligonucleotide; IFNG exon 3; Set C
gauggucuccacacucuuuuggaugcuc

SEQ ID NO: 9763 - RNA, 31 nt, Artificial Sequence
  Synthetic Oligonucleotide; IFNG exon 3; Set C
uugauggucuccacacucuuuuggaugcucu

SEQ ID NO: 9764 - RNA, 29 nt, Artificial Sequence
  Synthetic Oligonucleotide; IFNG exon 3; Set C
ugauggucuccacacucuuuuggaugcuc

SEQ ID NO: 9765 - RNA, 30 nt, Artificial Sequence
  Synthetic Oligonucleotide; IFNG exon 3; Set C
uugauggucuccacacucuuuuggaugcuc

SEQ ID NO: 9766 - RNA, 18 nt, Artificial Sequence
  Synthetic Oligonucleotide; IFNG exon 3; Set C
ggucuccacacucuuuug

SEQ ID NO: 9767 - RNA, 17 nt, Artificial Sequence
  Synthetic Oligonucleotide; IFNG exon 3; Set C
ggucuccacacucuuuu

SEQ ID NO: 9768 - RNA, 18 nt, Artificial Sequence
  Synthetic Oligonucleotide; IFNG exon 3; Set C
uggucuccacacucuuuu

SEQ ID NO: 9769 - RNA, 16 nt, Artificial Sequence
  Synthetic Oligonucleotide; IFNG exon 3; Set C
ggucuccacacucuuu

SEQ ID NO: 9770 - RNA, 19 nt, Artificial Sequence
  Synthetic Oligonucleotide; IFNG exon 3; Set C
auggucuccacacucuuuu

SEQ ID NO: 9771 - RNA, 17 nt, Artificial Sequence
  Synthetic Oligonucleotide; IFNG exon 3; Set C
uggucuccacacucuuu

SEQ ID NO: 9772 - RNA, 18 nt, Artificial Sequence
  Synthetic Oligonucleotide; IFNG exon 3; Set C
auggucuccacacucuuu

SEQ ID NO: 9773 - RNA, 20 nt, Artificial Sequence
  Synthetic Oligonucleotide; IFNG exon 3; Set C
uauugaaaaacuugacauuc

SEQ ID NO: 9774 - RNA, 25 nt, Artificial Sequence
  Synthetic Oligonucleotide; IFNG exon 3; Set C
guugcuauugaaaaacuugacauuc

SEQ ID NO: 9775 - RNA, 26 nt, Artificial Sequence
  Synthetic Oligonucleotide; IFNG exon 3; Set C
uguugcuauugaaaaacuugacauuc

SEQ ID NO: 9776 - RNA, 27 nt, Artificial Sequence
  Synthetic Oligonucleotide; IFNG exon 3; Set C
uuguugcuauugaaaaacuugacauuc

SEQ ID NO: 9777 - RNA, 28 nt, Artificial Sequence
  Synthetic Oligonucleotide; IFNG exon 3; Set C
uuuguugcuauugaaaaacuugacauuc

SEQ ID NO: 9778 - RNA, 29 nt, Artificial Sequence
  Synthetic Oligonucleotide; IFNG exon 3; Set C
uuuuguugcuauugaaaaacuugacauuc

SEQ ID NO: 9779 - RNA, 30 nt, Artificial Sequence
  Synthetic Oligonucleotide; IFNG exon 3; Set C
uuuuuguugcuauugaaaaacuugacauuc

SEQ ID NO: 9780 - RNA, 35 nt, Artificial Sequence
  Synthetic Oligonucleotide; IFNG exon 3; Set A
guuucuuuuuguugcuauugaaaaacuugacauuc

SEQ ID NO: 9781 - RNA, 36 nt, Artificial Sequence
  Synthetic Oligonucleotide; IFNG exon 3; Set A
cguuucuuuuuguugcuauugaaaaacuugacauuc

SEQ ID NO: 9782 - RNA, 36 nt, Artificial Sequence
  Synthetic Oligonucleotide; IFNG exon 3; Set A
cucguuucuuuuuguugcuauugaaaaacuugacau

SEQ ID NO: 9783 - RNA, 35 nt, Artificial Sequence
  Synthetic Oligonucleotide; IFNG exon 3; Set A
cucguuucuuuuuguugcuauugaaaaacuugaca

SEQ ID NO: 9784 - RNA, 24 nt, Artificial Sequence
  Synthetic Oligonucleotide; IFNG exon 3; Set C
ucucguuucuuuuuguugcuauug

SEQ ID NO: 9785 - RNA, 25 nt, Artificial Sequence
  Synthetic Oligonucleotide; IFNG exon 3; Set C
aucucguuucuuuuuguugcuauug

SEQ ID NO: 9786 - RNA, 22 nt, Artificial Sequence
  Synthetic Oligonucleotide; IFNG exon 3; Set C
ucucguuucuuuuuguugcuau

SEQ ID NO: 9787 - RNA, 23 nt, Artificial Sequence
  Synthetic Oligonucleotide; IFNG exon 3; Set C
aucucguuucuuuuuguugcuau

SEQ ID NO: 9788 - RNA, 21 nt, Artificial Sequence
  Synthetic Oligonucleotide; IFNG exon 3; Set C
ucucguuucuuuuuguugcua

SEQ ID NO: 9789 - RNA, 22 nt, Artificial Sequence
  Synthetic Oligonucleotide; IFNG exon 3; Set C
aucucguuucuuuuuguugcua

SEQ ID NO: 9790 - RNA, 17 nt, Artificial Sequence
  Synthetic Oligonucleotide; IFNG exon 3; Set C
ucucguuucuuuuuguu

SEQ ID NO: 9791 - RNA, 16 nt, Artificial Sequence
  Synthetic Oligonucleotide; IFNG exon 3; Set C
ucucguuucuuuuugu

SEQ ID NO: 9792 - RNA, 18 nt, Artificial Sequence
  Synthetic Oligonucleotide; IFNG exon 3; Set C
aucucguuucuuuuuguu

SEQ ID NO: 9793 - RNA, 32 nt, Artificial Sequence
  Synthetic Oligonucleotide; IFNG exon 3; Set A
cgaagucaucucguuucuuuuuguugcuauug

SEQ ID NO: 9794 - RNA, 15 nt, Artificial Sequence
  Synthetic Oligonucleotide; IFNG exon 3; Set C
ucucguuucuuuuug

SEQ ID NO: 9795 - RNA, 17 nt, Artificial Sequence
  Synthetic Oligonucleotide; IFNG exon 3; Set C
aucucguuucuuuuugu

SEQ ID NO: 9796 - RNA, 16 nt, Artificial Sequence
  Synthetic Oligonucleotide; IFNG exon 3; Set C
aucucguuucuuuuug

SEQ ID NO: 9797 - RNA, 15 nt, Artificial Sequence
  Synthetic Oligonucleotide; IFNG exon 3; Set C
aucucguuucuuuuu

SEQ ID NO: 9798 - RNA, 29 nt, Artificial Sequence
  Synthetic Oligonucleotide; IFNG exon 3; Set A
cgaagucaucucguuucuuuuuguugcua

SEQ ID NO: 9799 - RNA, 28 nt, Artificial Sequence
  Synthetic Oligonucleotide; IFNG exon 3; Set A
cgaagucaucucguuucuuuuuguugcu

SEQ ID NO: 9800 - RNA, 27 nt, Artificial Sequence
  Synthetic Oligonucleotide; IFNG exon 3; Set A
cgaagucaucucguuucuuuuuguugc

SEQ ID NO: 9801 - RNA, 26 nt, Artificial Sequence
  Synthetic Oligonucleotide; IFNG exon 3; Set C
cgaagucaucucguuucuuuuuguug

SEQ ID NO: 9802 - RNA, 25 nt, Artificial Sequence
  Synthetic Oligonucleotide; IFNG exon 3; Set C
cgaagucaucucguuucuuuuuguu

SEQ ID NO: 9803 - RNA, 40 nt, Artificial Sequence
  Synthetic Oligonucleotide; IFNG exon 3; Set C
ucagcuuuucgaagucaucucguuucuuuuuguugcuauu

SEQ ID NO: 9804 - RNA, 22 nt, Artificial Sequence
  Synthetic Oligonucleotide; IFNG exon 3; Set C
cgaagucaucucguuucuuuuu

SEQ ID NO: 9805 - RNA, 39 nt, Artificial Sequence
  Synthetic Oligonucleotide; IFNG exon 3; Set C
ucagcuuuucgaagucaucucguuucuuuuuguugcuau

SEQ ID NO: 9806 - RNA, 21 nt, Artificial Sequence
  Synthetic Oligonucleotide; IFNG exon 3; Set C
cgaagucaucucguuucuuuu

SEQ ID NO: 9807 - RNA, 20 nt, Artificial Sequence
  Synthetic Oligonucleotide; IFNG exon 3; Set C
cgaagucaucucguuucuuu

SEQ ID NO: 9808 - RNA, 34 nt, Artificial Sequence
  Synthetic Oligonucleotide; IFNG exon 3; Set B
ucagcuuuucgaagucaucucguuucuuuuuguu

SEQ ID NO: 9809 - RNA, 33 nt, Artificial Sequence
  Synthetic Oligonucleotide; IFNG exon 3; Set B
ucagcuuuucgaagucaucucguuucuuuuugu

SEQ ID NO: 9810 - RNA, 15 nt, Artificial Sequence
  Synthetic Oligonucleotide; IFNG exon 3; Set C
cgaagucaucucguu

SEQ ID NO: 9811 - RNA, 32 nt, Artificial Sequence
  Synthetic Oligonucleotide; IFNG exon 3; Set B
ucagcuuuucgaagucaucucguuucuuuuug

SEQ ID NO: 9812 - RNA, 31 nt, Artificial Sequence
  Synthetic Oligonucleotide; IFNG exon 3; Set B
ucagcuuuucgaagucaucucguuucuuuuu

SEQ ID NO: 9813 - RNA, 29 nt, Artificial Sequence
  Synthetic Oligonucleotide; IFNG exon 3; Set B
gucagcuuuucgaagucaucucguuucuu

SEQ ID NO: 9814 - RNA, 28 nt, Artificial Sequence
  Synthetic Oligonucleotide; IFNG exon 3; Set B
gucagcuuuucgaagucaucucguuucu

SEQ ID NO: 9815 - RNA, 29 nt, Artificial Sequence
  Synthetic Oligonucleotide; IFNG exon 3; Set B
agucagcuuuucgaagucaucucguuucu

SEQ ID NO: 9816 - RNA, 27 nt, Artificial Sequence
  Synthetic Oligonucleotide; IFNG exon 3; Set B
gucagcuuuucgaagucaucucguuuc

SEQ ID NO: 9817 - RNA, 15 nt, Artificial Sequence
  Synthetic Oligonucleotide; IFNG exon 3; Set C
uuuucgaagucaucu

SEQ ID NO: 9818 - RNA, 26 nt, Artificial Sequence
  Synthetic Oligonucleotide; IFNG exon 3; Set B
gucagcuuuucgaagucaucucguuu

SEQ ID NO: 9819 - RNA, 28 nt, Artificial Sequence
  Synthetic Oligonucleotide; IFNG exon 3; Set B
agucagcuuuucgaagucaucucguuuc

SEQ ID NO: 9820 - RNA, 23 nt, Artificial Sequence
  Synthetic Oligonucleotide; IFNG exon 3; Set C
gucagcuuuucgaagucaucucg

SEQ ID NO: 9821 - RNA, 24 nt, Artificial Sequence
  Synthetic Oligonucleotide; IFNG exon 3; Set B
agucagcuuuucgaagucaucucg

SEQ ID NO: 9822 - RNA, 23 nt, Artificial Sequence
  Synthetic Oligonucleotide; IFNG exon 3; Set C
agucagcuuuucgaagucaucuc

SEQ ID NO: 9823 - RNA, 19 nt, Artificial Sequence
  Synthetic Oligonucleotide; IFNG exon 3; Set C
gucagcuuuucgaagucau

SEQ ID NO: 9824 - RNA, 23 nt, Artificial Sequence
  Synthetic Oligonucleotide; IFNG exon 3; Set C
uagucagcuuuucgaagucaucu

SEQ ID NO: 9825 - RNA, 20 nt, Artificial Sequence
  Synthetic Oligonucleotide; IFNG exon 3; Set C
agucagcuuuucgaagucau

SEQ ID NO: 9826 - RNA, 24 nt, Artificial Sequence
  Synthetic Oligonucleotide; IFNG exon 3; Set C
uuagucagcuuuucgaagucaucu

SEQ ID NO: 9827 - RNA, 22 nt, Artificial Sequence
  Synthetic Oligonucleotide; IFNG exon 3; Set C
uagucagcuuuucgaagucauc

SEQ ID NO: 9828 - RNA, 25 nt, Artificial Sequence
  Synthetic Oligonucleotide; IFNG exon 3; Set C
auuagucagcuuuucgaagucaucu

SEQ ID NO: 9829 - RNA, 23 nt, Artificial Sequence
  Synthetic Oligonucleotide; IFNG exon 3; Set C
uuagucagcuuuucgaagucauc

SEQ ID NO: 9830 - RNA, 26 nt, Artificial Sequence
  Synthetic Oligonucleotide; IFNG exon 3; Set C
aauuagucagcuuuucgaagucaucu

SEQ ID NO: 9831 - RNA, 24 nt, Artificial Sequence
  Synthetic Oligonucleotide; IFNG exon 3; Set C
auuagucagcuuuucgaagucauc

SEQ ID NO: 9832 - RNA, 27 nt, Artificial Sequence
  Synthetic Oligonucleotide; IFNG exon 3; Set C
uaauuagucagcuuuucgaagucaucu

SEQ ID NO: 9833 - RNA, 25 nt, Artificial Sequence
  Synthetic Oligonucleotide; IFNG exon 3; Set C
aauuagucagcuuuucgaagucauc

SEQ ID NO: 9834 - RNA, 30 nt, Artificial Sequence
  Synthetic Oligonucleotide; IFNG exon 3; Set C
aauaauuagucagcuuuucgaagucaucuc

SEQ ID NO: 9835 - RNA, 28 nt, Artificial Sequence
  Synthetic Oligonucleotide; IFNG exon 3; Set C
auaauuagucagcuuuucgaagucaucu

SEQ ID NO: 9836 - RNA, 26 nt, Artificial Sequence
  Synthetic Oligonucleotide; IFNG exon 3; Set C
uaauuagucagcuuuucgaagucauc

SEQ ID NO: 9837 - RNA, 31 nt, Artificial Sequence
  Synthetic Oligonucleotide; IFNG exon 3; Set B
gaauaauuagucagcuuuucgaagucaucuc

SEQ ID NO: 9838 - RNA, 27 nt, Artificial Sequence
  Synthetic Oligonucleotide; IFNG exon 3; Set C
auaauuagucagcuuuucgaagucauc

SEQ ID NO: 9839 - RNA, 15 nt, Artificial Sequence
  Synthetic Oligonucleotide; IFNG exon 3; Set C
uagucagcuuuucga

SEQ ID NO: 9840 - RNA, 16 nt, Artificial Sequence
  Synthetic Oligonucleotide; IFNG exon 3; Set C
uuagucagcuuuucga

SEQ ID NO: 9841 - RNA, 17 nt, Artificial Sequence
  Synthetic Oligonucleotide; IFNG exon 3; Set C
auuagucagcuuuucga

SEQ ID NO: 9842 - RNA, 38 nt, Artificial Sequence
  Synthetic Oligonucleotide; IFNG exon 3; Set C
cucaccgaauaauuagucagcuuuucgaagucaucucg

SEQ ID NO: 9843 - RNA, 18 nt, Artificial Sequence
  Synthetic Oligonucleotide; IFNG exon 3; Set C
aauuagucagcuuuucga

SEQ ID NO: 9844 - RNA, 19 nt, Artificial Sequence
  Synthetic Oligonucleotide; IFNG exon 3; Set C
uaauuagucagcuuuucga

SEQ ID NO: 9845 - RNA, 20 nt, Artificial Sequence
  Synthetic Oligonucleotide; IFNG exon 3; Set C
auaauuagucagcuuuucga

SEQ ID NO: 9846 - RNA, 21 nt, Artificial Sequence
  Synthetic Oligonucleotide; IFNG exon 3; Set C
aauaauuagucagcuuuucga

SEQ ID NO: 9847 - RNA, 34 nt, Artificial Sequence
  Synthetic Oligonucleotide; IFNG exon 3; Set B
cucaccgaauaauuagucagcuuuucgaagucau

SEQ ID NO: 9848 - RNA, 22 nt, Artificial Sequence
  Synthetic Oligonucleotide; IFNG exon 3; Set C
gaauaauuagucagcuuuucga

SEQ ID NO: 9849 - RNA, 36 nt, Artificial Sequence
  Synthetic Oligonucleotide; IFNG exon 3; Set C
agccucaccgaauaauuagucagcuuuucgaaguca

SEQ ID NO: 9850 - RNA, 35 nt, Artificial Sequence
  Synthetic Oligonucleotide; IFNG exon 3; Set B
agccucaccgaauaauuagucagcuuuucgaaguc

SEQ ID NO: 9851 - RNA, 39 nt, Artificial Sequence
  Synthetic Oligonucleotide; IFNG exon 3; Set C
auagccucaccgaauaauuagucagcuuuucgaagucau

SEQ ID NO: 9852 - RNA, 40 nt, Artificial Sequence
  Synthetic Oligonucleotide; IFNG exon 3; Set C
aauagccucaccgaauaauuagucagcuuuucgaagucau

SEQ ID NO: 9853 - RNA, 27 nt, Artificial Sequence
  Synthetic Oligonucleotide; IFNG exon 3; Set B
cucaccgaauaauuagucagcuuuucg

SEQ ID NO: 9854 - RNA, 28 nt, Artificial Sequence
  Synthetic Oligonucleotide; IFNG exon 3; Set B
gccucaccgaauaauuagucagcuuuuc

SEQ ID NO: 9855 - RNA, 29 nt, Artificial Sequence
  Synthetic Oligonucleotide; IFNG exon 3; Set B
agccucaccgaauaauuagucagcuuuuc

SEQ ID NO: 9856 - RNA, 28 nt, Artificial Sequence
  Synthetic Oligonucleotide; IFNG exon 3; Set B
agccucaccgaauaauuagucagcuuuu

SEQ ID NO: 9857 - RNA, 32 nt, Artificial Sequence
  Synthetic Oligonucleotide; IFNG exon 3; Set B
auagccucaccgaauaauuagucagcuuuucg

SEQ ID NO: 9858 - RNA, 27 nt, Artificial Sequence
  Synthetic Oligonucleotide; IFNG exon 3; Set B
agccucaccgaauaauuagucagcuuu

SEQ ID NO: 9859 - RNA, 37 nt, Artificial Sequence
  Synthetic Oligonucleotide; IFNG exon 3; Set B
uuaaauagccucaccgaauaauuagucagcuuuucga

SEQ ID NO: 9860 - RNA, 18 nt, Artificial Sequence
  Synthetic Oligonucleotide; IFNG exon 3; Set C
cucaccgaauaauuaguc

SEQ ID NO: 9861 - RNA, 38 nt, Artificial Sequence
  Synthetic Oligonucleotide; IFNG exon 3; Set B
uuuaaauagccucaccgaauaauuagucagcuuuucga

SEQ ID NO: 9862 - RNA, 17 nt, Artificial Sequence
  Synthetic Oligonucleotide; IFNG exon 3; Set C
cucaccgaauaauuagu

SEQ ID NO: 9863 - RNA, 39 nt, Artificial Sequence
  Synthetic Oligonucleotide; IFNG exon 3; Set B
auuuaaauagccucaccgaauaauuagucagcuuuucga

SEQ ID NO: 9864 - RNA, 40 nt, Artificial Sequence
  Synthetic Oligonucleotide; IFNG exon 3; Set B
aauuuaaauagccucaccgaauaauuagucagcuuuucga

SEQ ID NO: 9865 - RNA, 17 nt, Artificial Sequence
  Synthetic Oligonucleotide; IFNG exon 3; Set C
ccucaccgaauaauuag

SEQ ID NO: 9866 - RNA, 16 nt, Artificial Sequence
  Synthetic Oligonucleotide; IFNG exon 3; Set C
ccucaccgaauaauua

SEQ ID NO: 9867 - RNA, 18 nt, Artificial Sequence
  Synthetic Oligonucleotide; IFNG exon 3; Set C
gccucaccgaauaauuag

SEQ ID NO: 9868 - RNA, 15 nt, Artificial Sequence
  Synthetic Oligonucleotide; IFNG exon 3; Set C
ccucaccgaauaauu

SEQ ID NO: 9869 - RNA, 17 nt, Artificial Sequence
  Synthetic Oligonucleotide; IFNG exon 3; Set C
gccucaccgaauaauua

SEQ ID NO: 9870 - RNA, 19 nt, Artificial Sequence
  Synthetic Oligonucleotide; IFNG exon 3; Set C
agccucaccgaauaauuag

SEQ ID NO: 9871 - RNA, 23 nt, Artificial Sequence
  Synthetic Oligonucleotide; IFNG exon 3; Set C
auagccucaccgaauaauuaguc

SEQ ID NO: 9872 - RNA, 16 nt, Artificial Sequence
  Synthetic Oligonucleotide; IFNG exon 3; Set C
gccucaccgaauaauu

SEQ ID NO: 9873 - RNA, 18 nt, Artificial Sequence
  Synthetic Oligonucleotide; IFNG exon 3; Set C
agccucaccgaauaauua

SEQ ID NO: 9874 - RNA, 22 nt, Artificial Sequence
  Synthetic Oligonucleotide; IFNG exon 3; Set C
auagccucaccgaauaauuagu

SEQ ID NO: 9875 - RNA, 24 nt, Artificial Sequence
  Synthetic Oligonucleotide; IFNG exon 3; Set C
aauagccucaccgaauaauuaguc

SEQ ID NO: 9876 - RNA, 17 nt, Artificial Sequence
  Synthetic Oligonucleotide; IFNG exon 3; Set C
agccucaccgaauaauu

SEQ ID NO: 9877 - RNA, 15 nt, Artificial Sequence
  Synthetic Oligonucleotide; IFNG exon 3; Set C
gccucaccgaauaau

SEQ ID NO: 9878 - RNA, 23 nt, Artificial Sequence
  Synthetic Oligonucleotide; IFNG exon 3; Set C
aauagccucaccgaauaauuagu

SEQ ID NO: 9879 - RNA, 25 nt, Artificial Sequence
  Synthetic Oligonucleotide; IFNG exon 3; Set C
aaauagccucaccgaauaauuaguc

SEQ ID NO: 9880 - RNA, 16 nt, Artificial Sequence
  Synthetic Oligonucleotide; IFNG exon 3; Set C
agccucaccgaauaau

SEQ ID NO: 9881 - RNA, 26 nt, Artificial Sequence
  Synthetic Oligonucleotide; IFNG exon 3; Set C
uaaauagccucaccgaauaauuaguc

SEQ ID NO: 9882 - RNA, 28 nt, Artificial Sequence
  Synthetic Oligonucleotide; IFNG exon 3; Set C
uuaaauagccucaccgaauaauuaguca

SEQ ID NO: 9883 - RNA, 15 nt, Artificial Sequence
  Synthetic Oligonucleotide; IFNG exon 3; Set C
agccucaccgaauaa

SEQ ID NO: 9884 - RNA, 29 nt, Artificial Sequence
  Synthetic Oligonucleotide; IFNG exon 3; Set C
uuuaaauagccucaccgaauaauuaguca

SEQ ID NO: 9885 - RNA, 30 nt, Artificial Sequence
  Synthetic Oligonucleotide; IFNG exon 3; Set C
auuuaaauagccucaccgaauaauuaguca

SEQ ID NO: 9886 - RNA, 31 nt, Artificial Sequence
  Synthetic Oligonucleotide; IFNG exon 3; Set C
aauuuaaauagccucaccgaauaauuaguca

SEQ ID NO: 9887 - RNA, 15 nt, Artificial Sequence
  Synthetic Oligonucleotide; IFNG exon 3; Set C
auagccucaccgaau

SEQ ID NO: 9888 - RNA, 31 nt, Artificial Sequence
  Synthetic Oligonucleotide; IFNG exon 3; Set C
gaauuuaaauagccucaccgaauaauuaguc

SEQ ID NO: 9889 - RNA, 32 nt, Artificial Sequence
  Synthetic Oligonucleotide; IFNG exon 3; Set C
agaauuuaaauagccucaccgaauaauuaguc

SEQ ID NO: 9890 - RNA, 15 nt, Artificial Sequence
  Synthetic Oligonucleotide; IFNG exon 3; Set C
aauagccucaccgaa

SEQ ID NO: 9891 - RNA, 33 nt, Artificial Sequence
  Synthetic Oligonucleotide; IFNG exon 3; Set C
aagaauuuaaauagccucaccgaauaauuaguc

SEQ ID NO: 9892 - RNA, 35 nt, Artificial Sequence
  Synthetic Oligonucleotide; IFNG exon 3; Set C
gaaagaauuuaaauagccucaccgaauaauuaguc

SEQ ID NO: 9893 - RNA, 36 nt, Artificial Sequence
  Synthetic Oligonucleotide; IFNG exon 3; Set C
agaaagaauuuaaauagccucaccgaauaauuaguc

SEQ ID NO: 9894 - RNA, 35 nt, Artificial Sequence
  Synthetic Oligonucleotide; IFNG exon 3; Set C
agaaagaauuuaaauagccucaccgaauaauuagu

SEQ ID NO: 9895 - RNA, 35 nt, Artificial Sequence
  Synthetic Oligonucleotide; IFNG exon 3; Set C
aagaaagaauuuaaauagccucaccgaauaauuag

SEQ ID NO: 9896 - RNA, 34 nt, Artificial Sequence
  Synthetic Oligonucleotide; IFNG exon 3; Set C
aagaaagaauuuaaauagccucaccgaauaauua

SEQ ID NO: 9897 - RNA, 33 nt, Artificial Sequence
  Synthetic Oligonucleotide; IFNG exon 3; Set C
aagaaagaauuuaaauagccucaccgaauaauu

SEQ ID NO: 9898 - RNA, 37 nt, Artificial Sequence
  Synthetic Oligonucleotide; IFNG exon 3; Set C
caaagaaagaauuuaaauagccucaccgaauaauuag

SEQ ID NO: 9899 - RNA, 32 nt, Artificial Sequence
  Synthetic Oligonucleotide; IFNG exon 3; Set C
aagaaagaauuuaaauagccucaccgaauaau

SEQ ID NO: 9900 - RNA, 36 nt, Artificial Sequence
  Synthetic Oligonucleotide; IFNG exon 3; Set C
caaagaaagaauuuaaauagccucaccgaauaauua

SEQ ID NO: 9901 - RNA, 31 nt, Artificial Sequence
  Synthetic Oligonucleotide; IFNG exon 3; Set C
aagaaagaauuuaaauagccucaccgaauaa

SEQ ID NO: 9902 - RNA, 35 nt, Artificial Sequence
  Synthetic Oligonucleotide; IFNG exon 3; Set C
caaagaaagaauuuaaauagccucaccgaauaauu

SEQ ID NO: 9903 - RNA, 30 nt, Artificial Sequence
  Synthetic Oligonucleotide; IFNG exon 3; Set C
aagaaagaauuuaaauagccucaccgaaua

SEQ ID NO: 9904 - RNA, 34 nt, Artificial Sequence
  Synthetic Oligonucleotide; IFNG exon 3; Set C
caaagaaagaauuuaaauagccucaccgaauaau

SEQ ID NO: 9905 - RNA, 33 nt, Artificial Sequence
  Synthetic Oligonucleotide; IFNG exon 3; Set C
caaagaaagaauuuaaauagccucaccgaauaa

SEQ ID NO: 9906 - RNA, 32 nt, Artificial Sequence
  Synthetic Oligonucleotide; IFNG exon 3; Set C
caaagaaagaauuuaaauagccucaccgaaua

SEQ ID NO: 9907 - RNA, 16 nt, Artificial Sequence
  Synthetic Oligonucleotide; IFNG exon 3; Set C
gaauuuaaauagccuc

SEQ ID NO: 9908 - RNA, 18 nt, Artificial Sequence
  Synthetic Oligonucleotide; IFNG exon 3; Set C
aagaauuuaaauagccuc

SEQ ID NO: 9909 - RNA, 21 nt, Artificial Sequence
  Synthetic Oligonucleotide; IFNG exon 3; Set C
agaaagaauuuaaauagccuc

SEQ ID NO: 9910 - RNA, 18 nt, Artificial Sequence
  Synthetic Oligonucleotide; IFNG exon 3; Set C
aagaaagaauuuaaauag

SEQ ID NO: 9911 - RNA, 16 nt, Artificial Sequence
  Synthetic Oligonucleotide; IFNG exon 3; Set C
agaaagaauuuaaaua

SEQ ID NO: 9912 - RNA, 15 nt, Artificial Sequence
  Synthetic Oligonucleotide; IFNG exon 3; Set C
agaaagaauuuaaau

SEQ ID NO: 9913 - RNA, 28 nt, Artificial Sequence
  Synthetic Oligonucleotide; IFNG exon 3; Set C
gaaaccaaagaaagaauuuaaauagccu

SEQ ID NO: 9914 - RNA, 27 nt, Artificial Sequence
  Synthetic Oligonucleotide; IFNG exon 3; Set C
gaaaccaaagaaagaauuuaaauagcc

SEQ ID NO: 9915 - RNA, 29 nt, Artificial Sequence
  Synthetic Oligonucleotide; IFNG exon 3; Set C
ugaaaccaaagaaagaauuuaaauagccu

SEQ ID NO: 9916 - RNA, 26 nt, Artificial Sequence
  Synthetic Oligonucleotide; IFNG exon 3; Set C
gaaaccaaagaaagaauuuaaauagc

SEQ ID NO: 9917 - RNA, 28 nt, Artificial Sequence
  Synthetic Oligonucleotide; IFNG exon 3; Set C
ugaaaccaaagaaagaauuuaaauagcc

SEQ ID NO: 9918 - RNA, 30 nt, Artificial Sequence
  Synthetic Oligonucleotide; IFNG exon 3; Set C
augaaaccaaagaaagaauuuaaauagccu

SEQ ID NO: 9919 - RNA, 15 nt, Artificial Sequence
  Synthetic Oligonucleotide; IFNG exon 3; Set C
caaagaaagaauuua

SEQ ID NO: 9920 - RNA, 27 nt, Artificial Sequence
  Synthetic Oligonucleotide; IFNG exon 3; Set C
ugaaaccaaagaaagaauuuaaauagc

SEQ ID NO: 9921 - RNA, 29 nt, Artificial Sequence
  Synthetic Oligonucleotide; IFNG exon 3; Set C
augaaaccaaagaaagaauuuaaauagcc

SEQ ID NO: 9922 - RNA, 31 nt, Artificial Sequence
  Synthetic Oligonucleotide; IFNG exon 3; Set C
aaugaaaccaaagaaagaauuuaaauagccu

SEQ ID NO: 9923 - RNA, 28 nt, Artificial Sequence
  Synthetic Oligonucleotide; IFNG exon 3; Set C
augaaaccaaagaaagaauuuaaauagc

SEQ ID NO: 9924 - RNA, 30 nt, Artificial Sequence
  Synthetic Oligonucleotide; IFNG exon 3; Set C
aaugaaaccaaagaaagaauuuaaauagcc

SEQ ID NO: 9925 - RNA, 29 nt, Artificial Sequence
  Synthetic Oligonucleotide; IFNG exon 3; Set C
aaugaaaccaaagaaagaauuuaaauagc

SEQ ID NO: 9926 - RNA, 40 nt, Artificial Sequence
  Synthetic Oligonucleotide; IFNG exon 3; Set B
gacccucggcaaugaaaccaaagaaagaauuuaaauagcc

SEQ ID NO: 9927 - RNA, 39 nt, Artificial Sequence
  Synthetic Oligonucleotide; IFNG exon 3; Set B
gacccucggcaaugaaaccaaagaaagaauuuaaauagc

SEQ ID NO: 9928 - RNA, 36 nt, Artificial Sequence
  Synthetic Oligonucleotide; IFNG exon 3; Set B
acccucggcaaugaaaccaaagaaagaauuuaaaua

SEQ ID NO: 9929 - RNA, 40 nt, Artificial Sequence
  Synthetic Oligonucleotide; IFNG exon 3; Set B
agacccucggcaaugaaaccaaagaaagaauuuaaauagc

SEQ ID NO: 9930 - RNA, 35 nt, Artificial Sequence
  Synthetic Oligonucleotide; IFNG exon 3; Set B
acccucggcaaugaaaccaaagaaagaauuuaaau

SEQ ID NO: 9931 - RNA, 34 nt, Artificial Sequence
  Synthetic Oligonucleotide; IFNG exon 3; Set B
acccucggcaaugaaaccaaagaaagaauuuaaa

SEQ ID NO: 9932 - RNA, 15 nt, Artificial Sequence
  Synthetic Oligonucleotide; IFNG exon 3; Set C
caaugaaaccaaaga

SEQ ID NO: 9933 - RNA, 16 nt, Artificial Sequence
  Synthetic Oligonucleotide; IFNG exon 3; Set C
gcaaugaaaccaaaga

SEQ ID NO: 9934 - RNA, 17 nt, Artificial Sequence
  Synthetic Oligonucleotide; IFNG exon 3; Set C
ggcaaugaaaccaaaga

SEQ ID NO: 9935 - RNA, 28 nt, Artificial Sequence
  Synthetic Oligonucleotide; IFNG exon 3; Set B
acccucggcaaugaaaccaaagaaagaa

SEQ ID NO: 9936 - RNA, 37 nt, Artificial Sequence
  Synthetic Oligonucleotide; IFNG exon 3; Set B
gcaagacccucggcaaugaaaccaaagaaagaauuua

SEQ ID NO: 9937 - RNA, 39 nt, Artificial Sequence
  Synthetic Oligonucleotide; IFNG exon 3; Set B
ugcaagacccucggcaaugaaaccaaagaaagaauuuaa

SEQ ID NO: 9938 - RNA, 27 nt, Artificial Sequence
  Synthetic Oligonucleotide; IFNG exon 3; Set B
acccucggcaaugaaaccaaagaaaga

SEQ ID NO: 9939 - RNA, 36 nt, Artificial Sequence
  Synthetic Oligonucleotide; IFNG exon 3; Set B
gcaagacccucggcaaugaaaccaaagaaagaauuu

SEQ ID NO: 9940 - RNA, 26 nt, Artificial Sequence
  Synthetic Oligonucleotide; IFNG exon 3; Set C
acccucggcaaugaaaccaaagaaag

SEQ ID NO: 9941 - RNA, 35 nt, Artificial Sequence
  Synthetic Oligonucleotide; IFNG exon 3; Set B
gcaagacccucggcaaugaaaccaaagaaagaauu

SEQ ID NO: 9942 - RNA, 33 nt, Artificial Sequence
  Synthetic Oligonucleotide; IFNG exon 3; Set B
caagacccucggcaaugaaaccaaagaaagaau

SEQ ID NO: 9943 - RNA, 25 nt, Artificial Sequence
  Synthetic Oligonucleotide; IFNG exon 3; Set C
acccucggcaaugaaaccaaagaaa

SEQ ID NO: 9944 - RNA, 34 nt, Artificial Sequence
  Synthetic Oligonucleotide; IFNG exon 3; Set B
gcaagacccucggcaaugaaaccaaagaaagaau

SEQ ID NO: 9945 - RNA, 24 nt, Artificial Sequence
  Synthetic Oligonucleotide; IFNG exon 3; Set C
acccucggcaaugaaaccaaagaa

SEQ ID NO: 9946 - RNA, 29 nt, Artificial Sequence
  Synthetic Oligonucleotide; IFNG exon 3; Set B
aagacccucggcaaugaaaccaaagaaag

SEQ ID NO: 9947 - RNA, 23 nt, Artificial Sequence
  Synthetic Oligonucleotide; IFNG exon 3; Set B
acccucggcaaugaaaccaaaga

SEQ ID NO: 9948 - RNA, 35 nt, Artificial Sequence
  Synthetic Oligonucleotide; IFNG exon 3; Set B
uugcaagacccucggcaaugaaaccaaagaaagaa

SEQ ID NO: 9949 - RNA, 34 nt, Artificial Sequence
  Synthetic Oligonucleotide; IFNG exon 3; Set B
uugcaagacccucggcaaugaaaccaaagaaaga

SEQ ID NO: 9950 - RNA, 26 nt, Artificial Sequence
  Synthetic Oligonucleotide; IFNG exon 3; Set B
aagacccucggcaaugaaaccaaaga

SEQ ID NO: 9951 - RNA, 33 nt, Artificial Sequence
  Synthetic Oligonucleotide; IFNG exon 3; Set B
uugcaagacccucggcaaugaaaccaaagaaag

SEQ ID NO: 9952 - RNA, 31 nt, Artificial Sequence
  Synthetic Oligonucleotide; IFNG exon 3; Set B
uugcaagacccucggcaaugaaaccaaagaa

SEQ ID NO: 9953 - RNA, 30 nt, Artificial Sequence
  Synthetic Oligonucleotide; IFNG exon 3; Set B
uugcaagacccucggcaaugaaaccaaaga

SEQ ID NO: 9954 - RNA, 15 nt, Artificial Sequence
  Synthetic Oligonucleotide; IFNG exon 3; Set C
caagacccucggcaa

SEQ ID NO: 9955 - RNA, 16 nt, Artificial Sequence
  Synthetic Oligonucleotide; IFNG exon 3; Set C
gcaagacccucggcaa

SEQ ID NO: 9956 - RNA, 17 nt, Artificial Sequence
  Synthetic Oligonucleotide; IFNG exon 3; Set C
ugcaagacccucggcaa

SEQ ID NO: 9957 - RNA, 16 nt, Artificial Sequence
  Synthetic Oligonucleotide; IFNG exon 3; Set B
ugcaagacccucggca

SEQ ID NO: 9958 - RNA, 15 nt, Artificial Sequence
  Synthetic Oligonucleotide; IFNG exon 3; Set C
ugcaagacccucggc

SEQ ID NO: 9959 - RNA, 15 nt, Artificial Sequence
  Synthetic Oligonucleotide; GZMB exon 2; Set C
aggaaaagucugucu

SEQ ID NO: 9960 - RNA, 16 nt, Artificial Sequence
  Synthetic Oligonucleotide; GZMB exon 2; Set C
aaggaaaagucugucu

SEQ ID NO: 9961 - RNA, 15 nt, Artificial Sequence
  Synthetic Oligonucleotide; GZMB exon 2; Set C
aaggaaaagucuguc

SEQ ID NO: 9962 - RNA, 17 nt, Artificial Sequence
  Synthetic Oligonucleotide; GZMB exon 2; Set C
gaaggaaaagucugucu

SEQ ID NO: 9963 - RNA, 16 nt, Artificial Sequence
  Synthetic Oligonucleotide; GZMB exon 2; Set C
gaaggaaaagucuguc

SEQ ID NO: 9964 - RNA, 18 nt, Artificial Sequence
  Synthetic Oligonucleotide; GZMB exon 2; Set C
ugaaggaaaagucugucu

SEQ ID NO: 9965 - RNA, 17 nt, Artificial Sequence
  Synthetic Oligonucleotide; GZMB exon 2; Set C
ugaaggaaaagucuguc

SEQ ID NO: 9966 - RNA, 19 nt, Artificial Sequence
  Synthetic Oligonucleotide; GZMB exon 2; Set C
cugaaggaaaagucugucu

SEQ ID NO: 9967 - RNA, 15 nt, Artificial Sequence
  Synthetic Oligonucleotide; GZMB exon 2; Set C
gaaggaaaagucugu

SEQ ID NO: 9968 - RNA, 18 nt, Artificial Sequence
  Synthetic Oligonucleotide; GZMB exon 2; Set C
cugaaggaaaagucuguc

SEQ ID NO: 9969 - RNA, 16 nt, Artificial Sequence
  Synthetic Oligonucleotide; GZMB exon 2; Set C
ugaaggaaaagucugu

SEQ ID NO: 9970 - RNA, 15 nt, Artificial Sequence
  Synthetic Oligonucleotide; GZMB exon 2; Set C
ugaaggaaaagucug

SEQ ID NO: 9971 - RNA, 17 nt, Artificial Sequence
  Synthetic Oligonucleotide; GZMB exon 2; Set C
cugaaggaaaagucugu

SEQ ID NO: 9972 - RNA, 16 nt, Artificial Sequence
  Synthetic Oligonucleotide; GZMB exon 2; Set C
cugaaggaaaagucug

SEQ ID NO: 9973 - RNA, 15 nt, Artificial Sequence
  Synthetic Oligonucleotide; GZMB exon 2; Set C
cugaaggaaaagucu

SEQ ID NO: 9974 - RNA, 16 nt, Artificial Sequence
  Synthetic Oligonucleotide; GZMB exon 2; Set C
agugagcagcugucag

SEQ ID NO: 9975 - RNA, 15 nt, Artificial Sequence
  Synthetic Oligonucleotide; GZMB exon 2; Set C
agugagcagcuguca

SEQ ID NO: 9976 - RNA, 17 nt, Artificial Sequence
  Synthetic Oligonucleotide; GZMB exon 2; Set C
cagugagcagcugucag

SEQ ID NO: 9977 - RNA, 16 nt, Artificial Sequence
  Synthetic Oligonucleotide; GZMB exon 2; Set C
cagugagcagcuguca

SEQ ID NO: 9978 - RNA, 15 nt, Artificial Sequence
  Synthetic Oligonucleotide; GZMB exon 2; Set C
cagugagcagcuguc

SEQ ID NO: 9979 - RNA, 40 nt, Artificial Sequence
  Synthetic Oligonucleotide; GZMB exon 2; Set C
gaaggaaaagucugucugcuugugggcacccauggaaucu

SEQ ID NO: 9980 - RNA, 15 nt, Artificial Sequence
  Synthetic Oligonucleotide; GZMB exon 2; Set C
aagucugucugcuug

SEQ ID NO: 9981 - RNA, 16 nt, Artificial Sequence
  Synthetic Oligonucleotide; GZMB exon 2; Set C
aaagucugucugcuug

SEQ ID NO: 9982 - RNA, 17 nt, Artificial Sequence
  Synthetic Oligonucleotide; GZMB exon 2; Set C
aaaagucugucugcuug

SEQ ID NO: 9983 - RNA, 15 nt, Artificial Sequence
  Synthetic Oligonucleotide; GZMB exon 2; Set C
aaagucugucugcuu

SEQ ID NO: 9984 - RNA, 18 nt, Artificial Sequence
  Synthetic Oligonucleotide; GZMB exon 2; Set C
gaaaagucugucugcuug

SEQ ID NO: 9985 - RNA, 16 nt, Artificial Sequence
  Synthetic Oligonucleotide; GZMB exon 2; Set C
aaaagucugucugcuu

SEQ ID NO: 9986 - RNA, 19 nt, Artificial Sequence
  Synthetic Oligonucleotide; GZMB exon 2; Set C
ggaaaagucugucugcuug

SEQ ID NO: 9987 - RNA, 20 nt, Artificial Sequence
  Synthetic Oligonucleotide; GZMB exon 2; Set C
aggaaaagucugucugcuug

SEQ ID NO: 9988 - RNA, 21 nt, Artificial Sequence
  Synthetic Oligonucleotide; GZMB exon 2; Set C
aaggaaaagucugucugcuug

SEQ ID NO: 9989 - RNA, 22 nt, Artificial Sequence
  Synthetic Oligonucleotide; GZMB exon 2; Set C
gaaggaaaagucugucugcuug

SEQ ID NO: 9990 - RNA, 20 nt, Artificial Sequence
  Synthetic Oligonucleotide; GZMB exon 2; Set C
aaggaaaagucugucugcuu

SEQ ID NO: 9991 - RNA, 23 nt, Artificial Sequence
  Synthetic Oligonucleotide; GZMB exon 2; Set C
ugaaggaaaagucugucugcuug

SEQ ID NO: 9992 - RNA, 21 nt, Artificial Sequence
  Synthetic Oligonucleotide; GZMB exon 2; Set C
gaaggaaaagucugucugcuu

SEQ ID NO: 9993 - RNA, 24 nt, Artificial Sequence
  Synthetic Oligonucleotide; GZMB exon 2; Set C
cugaaggaaaagucugucugcuug

SEQ ID NO: 9994 - RNA, 22 nt, Artificial Sequence
  Synthetic Oligonucleotide; GZMB exon 2; Set C
ugaaggaaaagucugucugcuu

SEQ ID NO: 9995 - RNA, 20 nt, Artificial Sequence
  Synthetic Oligonucleotide; GZMB exon 2; Set C
gaaggaaaagucugucugcu

SEQ ID NO: 9996 - RNA, 19 nt, Artificial Sequence
  Synthetic Oligonucleotide; GZMB exon 2; Set C
gaaggaaaagucugucugc

SEQ ID NO: 9997 - RNA, 18 nt, Artificial Sequence
  Synthetic Oligonucleotide; GZMB exon 2; Set C
gaaggaaaagucugucug

SEQ ID NO: 9998 - RNA, 26 nt, Artificial Sequence
  Synthetic Oligonucleotide; GZMB exon 2; Set A
aucuccccugaaggaaaagucugucu

SEQ ID NO: 9999 - RNA, 27 nt, Artificial Sequence
  Synthetic Oligonucleotide; GZMB exon 2; Set A
gaucuccccugaaggaaaagucugucu

SEQ ID NO: 10000 - RNA, 26 nt, Artificial Sequence
  Synthetic Oligonucleotide; GZMB exon 2; Set A
gaucuccccugaaggaaaagucuguc

SEQ ID NO: 10001 - RNA, 28 nt, Artificial Sequence
  Synthetic Oligonucleotide; GZMB exon 2; Set A
ugaucuccccugaaggaaaagucugucu

SEQ ID NO: 10002 - RNA, 27 nt, Artificial Sequence
  Synthetic Oligonucleotide; GZMB exon 2; Set A
ugaucuccccugaaggaaaagucuguc

SEQ ID NO: 10003 - RNA, 29 nt, Artificial Sequence
  Synthetic Oligonucleotide; GZMB exon 2; Set A
augaucuccccugaaggaaaagucugucu

SEQ ID NO: 10004 - RNA, 25 nt, Artificial Sequence
  Synthetic Oligonucleotide; GZMB exon 2; Set A
gaucuccccugaaggaaaagucugu

SEQ ID NO: 10005 - RNA, 28 nt, Artificial Sequence
  Synthetic Oligonucleotide; GZMB exon 2; Set A
augaucuccccugaaggaaaagucuguc

SEQ ID NO: 10006 - RNA, 30 nt, Artificial Sequence
  Synthetic Oligonucleotide; GZMB exon 2; Set A
gaugaucuccccugaaggaaaagucugucu

SEQ ID NO: 10007 - RNA, 24 nt, Artificial Sequence
  Synthetic Oligonucleotide; GZMB exon 2; Set C
gaucuccccugaaggaaaagucug

SEQ ID NO: 10008 - RNA, 26 nt, Artificial Sequence
  Synthetic Oligonucleotide; GZMB exon 2; Set A
ugaucuccccugaaggaaaagucugu

SEQ ID NO: 10009 - RNA, 29 nt, Artificial Sequence
  Synthetic Oligonucleotide; GZMB exon 2; Set A
gaugaucuccccugaaggaaaagucuguc

SEQ ID NO: 10010 - RNA, 25 nt, Artificial Sequence
  Synthetic Oligonucleotide; GZMB exon 2; Set C
ugaucuccccugaaggaaaagucug

SEQ ID NO: 10011 - RNA, 23 nt, Artificial Sequence
  Synthetic Oligonucleotide; GZMB exon 2; Set C
gaucuccccugaaggaaaagucu

SEQ ID NO: 10012 - RNA, 27 nt, Artificial Sequence
  Synthetic Oligonucleotide; GZMB exon 2; Set A
augaucuccccugaaggaaaagucugu

SEQ ID NO: 10013 - RNA, 22 nt, Artificial Sequence
  Synthetic Oligonucleotide; GZMB exon 2; Set C
gaucuccccugaaggaaaaguc

SEQ ID NO: 10014 - RNA, 26 nt, Artificial Sequence
  Synthetic Oligonucleotide; GZMB exon 2; Set C
augaucuccccugaaggaaaagucug

SEQ ID NO: 10015 - RNA, 24 nt, Artificial Sequence
  Synthetic Oligonucleotide; GZMB exon 2; Set C
ugaucuccccugaaggaaaagucu

SEQ ID NO: 10016 - RNA, 28 nt, Artificial Sequence
  Synthetic Oligonucleotide; GZMB exon 2; Set A
gaugaucuccccugaaggaaaagucugu

SEQ ID NO: 10017 - RNA, 23 nt, Artificial Sequence
  Synthetic Oligonucleotide; GZMB exon 2; Set C
ugaucuccccugaaggaaaaguc

SEQ ID NO: 10018 - RNA, 21 nt, Artificial Sequence
  Synthetic Oligonucleotide; GZMB exon 2; Set C
gaucuccccugaaggaaaagu

SEQ ID NO: 10019 - RNA, 25 nt, Artificial Sequence
  Synthetic Oligonucleotide; GZMB exon 2; Set C
augaucuccccugaaggaaaagucu

SEQ ID NO: 10020 - RNA, 27 nt, Artificial Sequence
  Synthetic Oligonucleotide; GZMB exon 2; Set A
gaugaucuccccugaaggaaaagucug

SEQ ID NO: 10021 - RNA, 24 nt, Artificial Sequence
  Synthetic Oligonucleotide; GZMB exon 2; Set C
augaucuccccugaaggaaaaguc

SEQ ID NO: 10022 - RNA, 22 nt, Artificial Sequence
  Synthetic Oligonucleotide; GZMB exon 2; Set C
ugaucuccccugaaggaaaagu

SEQ ID NO: 10023 - RNA, 26 nt, Artificial Sequence
  Synthetic Oligonucleotide; GZMB exon 2; Set A
gaugaucuccccugaaggaaaagucu

SEQ ID NO: 10024 - RNA, 20 nt, Artificial Sequence
  Synthetic Oligonucleotide; GZMB exon 2; Set C
gaucuccccugaaggaaaag

SEQ ID NO: 10025 - RNA, 25 nt, Artificial Sequence
  Synthetic Oligonucleotide; GZMB exon 2; Set C
gaugaucuccccugaaggaaaaguc

SEQ ID NO: 10026 - RNA, 23 nt, Artificial Sequence
  Synthetic Oligonucleotide; GZMB exon 2; Set C
augaucuccccugaaggaaaagu

SEQ ID NO: 10027 - RNA, 21 nt, Artificial Sequence
  Synthetic Oligonucleotide; GZMB exon 2; Set C
ugaucuccccugaaggaaaag

SEQ ID NO: 10028 - RNA, 19 nt, Artificial Sequence
  Synthetic Oligonucleotide; GZMB exon 2; Set C
gaucuccccugaaggaaaa

SEQ ID NO: 10029 - RNA, 24 nt, Artificial Sequence
  Synthetic Oligonucleotide; GZMB exon 2; Set C
gaugaucuccccugaaggaaaagu

SEQ ID NO: 10030 - RNA, 22 nt, Artificial Sequence
  Synthetic Oligonucleotide; GZMB exon 2; Set C
augaucuccccugaaggaaaag

SEQ ID NO: 10031 - RNA, 20 nt, Artificial Sequence
  Synthetic Oligonucleotide; GZMB exon 2; Set C
ugaucuccccugaaggaaaa

SEQ ID NO: 10032 - RNA, 18 nt, Artificial Sequence
  Synthetic Oligonucleotide; GZMB exon 2; Set C
gaucuccccugaaggaaa

SEQ ID NO: 10033 - RNA, 21 nt, Artificial Sequence
  Synthetic Oligonucleotide; GZMB exon 2; Set C
augaucuccccugaaggaaaa

SEQ ID NO: 10034 - RNA, 19 nt, Artificial Sequence
  Synthetic Oligonucleotide; GZMB exon 2; Set C
ugaucuccccugaaggaaa

SEQ ID NO: 10035 - RNA, 38 nt, Artificial Sequence
  Synthetic Oligonucleotide; GZMB exon 2; Set C
ugucccccgaugaucuccccugaaggaaaagucugucu

SEQ ID NO: 10036 - RNA, 20 nt, Artificial Sequence
  Synthetic Oligonucleotide; GZMB exon 2; Set C
augaucuccccugaaggaaa

SEQ ID NO: 10037 - RNA, 18 nt, Artificial Sequence
  Synthetic Oligonucleotide; GZMB exon 2; Set C
ugaucuccccugaaggaa

SEQ ID NO: 10038 - RNA, 37 nt, Artificial Sequence
  Synthetic Oligonucleotide; GZMB exon 2; Set C
ugucccccgaugaucuccccugaaggaaaagucuguc

SEQ ID NO: 10039 - RNA, 19 nt, Artificial Sequence
  Synthetic Oligonucleotide; GZMB exon 2; Set C
augaucuccccugaaggaa

SEQ ID NO: 10040 - RNA, 18 nt, Artificial Sequence
  Synthetic Oligonucleotide; GZMB exon 2; Set C
augaucuccccugaagga

SEQ ID NO: 10041 - RNA, 21 nt, Artificial Sequence
  Synthetic Oligonucleotide; GZMB exon 2; Set C
uaggggcgggaguggggcuug

SEQ ID NO: 10042 - RNA, 22 nt, Artificial Sequence
  Synthetic Oligonucleotide; GZMB exon 2; Set C
guaggggcgggaguggggcuug

SEQ ID NO: 10043 - RNA, 23 nt, Artificial Sequence
  Synthetic Oligonucleotide; GZMB exon 2; Set C
uguaggggcgggaguggggcuug

SEQ ID NO: 10044 - RNA, 24 nt, Artificial Sequence
  Synthetic Oligonucleotide; GZMB exon 2; Set C
auguaggggcgggaguggggcuug

SEQ ID NO: 10045 - RNA, 28 nt, Artificial Sequence
  Synthetic Oligonucleotide; GZMB exon 2; Set A
ccagaucauaagauaagccauguagggg

SEQ ID NO: 10046 - RNA, 27 nt, Artificial Sequence
  Synthetic Oligonucleotide; GZMB exon 2; Set A
ccagaucauaagauaagccauguaggg

SEQ ID NO: 10047 - RNA, 26 nt, Artificial Sequence
  Synthetic Oligonucleotide; GZMB exon 2; Set C
ccagaucauaagauaagccauguagg

SEQ ID NO: 10048 - RNA, 25 nt, Artificial Sequence
  Synthetic Oligonucleotide; GZMB exon 2; Set C
ccagaucauaagauaagccauguag

SEQ ID NO: 10049 - RNA, 24 nt, Artificial Sequence
  Synthetic Oligonucleotide; GZMB exon 2; Set C
ccagaucauaagauaagccaugua

SEQ ID NO: 10050 - RNA, 15 nt, Artificial Sequence
  Synthetic Oligonucleotide; GZMB exon 2; Set C
ccagaucauaagaua

SEQ ID NO: 10051 - RNA, 40 nt, Artificial Sequence
  Synthetic Oligonucleotide; GZMB exon 2; Set C
uucagagacuucugaucccagaucauaagauaagccaugu

SEQ ID NO: 10052 - RNA, 18 nt, Artificial Sequence
  Synthetic Oligonucleotide; GZMB exon 2; Set C
cagagacuucugauccca

SEQ ID NO: 10053 - RNA, 19 nt, Artificial Sequence
  Synthetic Oligonucleotide; GZMB exon 2; Set C
ucagagacuucugauccca

SEQ ID NO: 10054 - RNA, 20 nt, Artificial Sequence
  Synthetic Oligonucleotide; GZMB exon 2; Set C
uucagagacuucugauccca

SEQ ID NO: 10055 - RNA, 15 nt, Artificial Sequence
  Synthetic Oligonucleotide; GZMB exon 2; Set C
ucagcacgaagucgu

SEQ ID NO: 10056 - RNA, 16 nt, Artificial Sequence
  Synthetic Oligonucleotide; GZMB exon 2; Set C
gucagcacgaagucgu

SEQ ID NO: 10057 - RNA, 17 nt, Artificial Sequence
  Synthetic Oligonucleotide; GZMB exon 2; Set C
ugucagcacgaagucgu

SEQ ID NO: 10058 - RNA, 15 nt, Artificial Sequence
  Synthetic Oligonucleotide; GZMB exon 2; Set C
gucagcacgaagucg

SEQ ID NO: 10059 - RNA, 18 nt, Artificial Sequence
  Synthetic Oligonucleotide; GZMB exon 2; Set C
cugucagcacgaagucgu

SEQ ID NO: 10060 - RNA, 16 nt, Artificial Sequence
  Synthetic Oligonucleotide; GZMB exon 2; Set C
ugucagcacgaagucg

SEQ ID NO: 10061 - RNA, 17 nt, Artificial Sequence
  Synthetic Oligonucleotide; GZMB exon 2; Set C
cugucagcacgaagucg

SEQ ID NO: 10062 - RNA, 25 nt, Artificial Sequence
  Synthetic Oligonucleotide; GZMB exon 2; Set C
ugagcagcugucagcacgaagucgu

SEQ ID NO: 10063 - RNA, 26 nt, Artificial Sequence
  Synthetic Oligonucleotide; GZMB exon 2; Set C
gugagcagcugucagcacgaagucgu

SEQ ID NO: 10064 - RNA, 24 nt, Artificial Sequence
  Synthetic Oligonucleotide; GZMB exon 2; Set B
ugagcagcugucagcacgaagucg

SEQ ID NO: 10065 - RNA, 27 nt, Artificial Sequence
  Synthetic Oligonucleotide; GZMB exon 2; Set C
agugagcagcugucagcacgaagucgu

SEQ ID NO: 10066 - RNA, 23 nt, Artificial Sequence
  Synthetic Oligonucleotide; GZMB exon 2; Set B
ugagcagcugucagcacgaaguc

SEQ ID NO: 10067 - RNA, 25 nt, Artificial Sequence
  Synthetic Oligonucleotide; GZMB exon 2; Set C
gugagcagcugucagcacgaagucg

SEQ ID NO: 10068 - RNA, 28 nt, Artificial Sequence
  Synthetic Oligonucleotide; GZMB exon 2; Set C
cagugagcagcugucagcacgaagucgu

SEQ ID NO: 10069 - RNA, 26 nt, Artificial Sequence
  Synthetic Oligonucleotide; GZMB exon 2; Set C
agugagcagcugucagcacgaagucg

SEQ ID NO: 10070 - RNA, 24 nt, Artificial Sequence
  Synthetic Oligonucleotide; GZMB exon 2; Set B
gugagcagcugucagcacgaaguc

SEQ ID NO: 10071 - RNA, 29 nt, Artificial Sequence
  Synthetic Oligonucleotide; GZMB exon 2; Set C
acagugagcagcugucagcacgaagucgu

SEQ ID NO: 10072 - RNA, 25 nt, Artificial Sequence
  Synthetic Oligonucleotide; GZMB exon 2; Set B
agugagcagcugucagcacgaaguc

SEQ ID NO: 10073 - RNA, 27 nt, Artificial Sequence
  Synthetic Oligonucleotide; GZMB exon 2; Set C
cagugagcagcugucagcacgaagucg

SEQ ID NO: 10074 - RNA, 30 nt, Artificial Sequence
  Synthetic Oligonucleotide; GZMB exon 2; Set C
aacagugagcagcugucagcacgaagucgu

SEQ ID NO: 10075 - RNA, 26 nt, Artificial Sequence
  Synthetic Oligonucleotide; GZMB exon 2; Set C
cagugagcagcugucagcacgaaguc

SEQ ID NO: 10076 - RNA, 28 nt, Artificial Sequence
  Synthetic Oligonucleotide; GZMB exon 2; Set C
acagugagcagcugucagcacgaagucg

SEQ ID NO: 10077 - RNA, 31 nt, Artificial Sequence
  Synthetic Oligonucleotide; GZMB exon 2; Set C
caacagugagcagcugucagcacgaagucgu

SEQ ID NO: 10078 - RNA, 27 nt, Artificial Sequence
  Synthetic Oligonucleotide; GZMB exon 2; Set C
acagugagcagcugucagcacgaaguc

SEQ ID NO: 10079 - RNA, 29 nt, Artificial Sequence
  Synthetic Oligonucleotide; GZMB exon 2; Set C
aacagugagcagcugucagcacgaagucg

SEQ ID NO: 10080 - RNA, 28 nt, Artificial Sequence
  Synthetic Oligonucleotide; GZMB exon 2; Set C
aacagugagcagcugucagcacgaaguc

SEQ ID NO: 10081 - RNA, 30 nt, Artificial Sequence
  Synthetic Oligonucleotide; GZMB exon 2; Set C
caacagugagcagcugucagcacgaagucg

SEQ ID NO: 10082 - RNA, 15 nt, Artificial Sequence
  Synthetic Oligonucleotide; GZMB exon 2; Set C
gugagcagcugucag

SEQ ID NO: 10083 - RNA, 18 nt, Artificial Sequence
  Synthetic Oligonucleotide; GZMB exon 2; Set C
acagugagcagcugucag

SEQ ID NO: 10084 - RNA, 17 nt, Artificial Sequence
  Synthetic Oligonucleotide; GZMB exon 2; Set C
acagugagcagcuguca

SEQ ID NO: 10085 - RNA, 19 nt, Artificial Sequence
  Synthetic Oligonucleotide; GZMB exon 2; Set C
aacagugagcagcugucag

SEQ ID NO: 10086 - RNA, 16 nt, Artificial Sequence
  Synthetic Oligonucleotide; GZMB exon 2; Set C
acagugagcagcuguc

SEQ ID NO: 10087 - RNA, 18 nt, Artificial Sequence
  Synthetic Oligonucleotide; GZMB exon 2; Set C
aacagugagcagcuguca

SEQ ID NO: 10088 - RNA, 20 nt, Artificial Sequence
  Synthetic Oligonucleotide; GZMB exon 2; Set C
caacagugagcagcugucag

SEQ ID NO: 10089 - RNA, 17 nt, Artificial Sequence
  Synthetic Oligonucleotide; GZMB exon 2; Set C
aacagugagcagcuguc

SEQ ID NO: 10090 - RNA, 19 nt, Artificial Sequence
  Synthetic Oligonucleotide; GZMB exon 2; Set C
caacagugagcagcuguca

SEQ ID NO: 10091 - RNA, 15 nt, Artificial Sequence
  Synthetic Oligonucleotide; GZMB exon 2; Set C
acagugagcagcugu

SEQ ID NO: 10092 - RNA, 18 nt, Artificial Sequence
  Synthetic Oligonucleotide; GZMB exon 2; Set C
caacagugagcagcuguc

SEQ ID NO: 10093 - RNA, 16 nt, Artificial Sequence
  Synthetic Oligonucleotide; GZMB exon 2; Set C
aacagugagcagcugu

SEQ ID NO: 10094 - RNA, 17 nt, Artificial Sequence
  Synthetic Oligonucleotide; GZMB exon 2; Set C
caacagugagcagcugu

SEQ ID NO: 10095 - RNA, 15 nt, Artificial Sequence
  Synthetic Oligonucleotide; GZMB exon 2; Set C
aacagugagcagcug

SEQ ID NO: 10096 - RNA, 40 nt, Artificial Sequence
  Synthetic Oligonucleotide; GZMB exon 2; Set C
uuucugcuccucaccuuccccaacagugagcagcugucag

SEQ ID NO: 10097 - RNA, 39 nt, Artificial Sequence
  Synthetic Oligonucleotide; GZMB exon 2; Set C
uuucugcuccucaccuuccccaacagugagcagcuguca

SEQ ID NO: 10098 - RNA, 15 nt, Artificial Sequence
  Synthetic Oligonucleotide; GZMB exon 2; Set C
ugugggcuguuuucu

SEQ ID NO: 10099 - RNA, 24 nt, Artificial Sequence
  Synthetic Oligonucleotide; GZMB exon 2; Set C
uuccaggagggugugggcuguuuu

SEQ ID NO: 10100 - RNA, 28 nt, Artificial Sequence
  Synthetic Oligonucleotide; GZMB exon 2; Set C
guuuccaggagggugugggcuguuuucu

SEQ ID NO: 10101 - RNA, 25 nt, Artificial Sequence
  Synthetic Oligonucleotide; GZMB exon 2; Set C
uuuccaggagggugugggcuguuuu

SEQ ID NO: 10102 - RNA, 29 nt, Artificial Sequence
  Synthetic Oligonucleotide; GZMB exon 2; Set C
uguuuccaggagggugugggcuguuuucu

SEQ ID NO: 10103 - RNA, 26 nt, Artificial Sequence
  Synthetic Oligonucleotide; GZMB exon 2; Set C
guuuccaggagggugugggcuguuuu

SEQ ID NO: 10104 - RNA, 24 nt, Artificial Sequence
  Synthetic Oligonucleotide; GZMB exon 2; Set C
uuuccaggagggugugggcuguuu

SEQ ID NO: 10105 - RNA, 28 nt, Artificial Sequence
  Synthetic Oligonucleotide; GZMB exon 2; Set C
uguuuccaggagggugugggcuguuuuc

SEQ ID NO: 10106 - RNA, 30 nt, Artificial Sequence
  Synthetic Oligonucleotide; GZMB exon 2; Set C
guguuuccaggagggugugggcuguuuucu

SEQ ID NO: 10107 - RNA, 27 nt, Artificial Sequence
  Synthetic Oligonucleotide; GZMB exon 2; Set C
uguuuccaggagggugugggcuguuuu

SEQ ID NO: 10108 - RNA, 25 nt, Artificial Sequence
  Synthetic Oligonucleotide; GZMB exon 2; Set C
guuuccaggagggugugggcuguuu

SEQ ID NO: 10109 - RNA, 29 nt, Artificial Sequence
  Synthetic Oligonucleotide; GZMB exon 2; Set C
guguuuccaggagggugugggcuguuuuc

SEQ ID NO: 10110 - RNA, 28 nt, Artificial Sequence
  Synthetic Oligonucleotide; GZMB exon 2; Set C
guguuuccaggagggugugggcuguuuu

SEQ ID NO: 10111 - RNA, 26 nt, Artificial Sequence
  Synthetic Oligonucleotide; GZMB exon 2; Set C
uguuuccaggagggugugggcuguuu

SEQ ID NO: 10112 - RNA, 27 nt, Artificial Sequence
  Synthetic Oligonucleotide; GZMB exon 2; Set C
guguuuccaggagggugugggcuguuu

SEQ ID NO: 10113 - RNA, 16 nt, Artificial Sequence
  Synthetic Oligonucleotide; GZMB exon 2; Set C
guuuccaggagggugu

SEQ ID NO: 10114 - RNA, 17 nt, Artificial Sequence
  Synthetic Oligonucleotide; GZMB exon 2; Set C
uguuuccaggagggugu

SEQ ID NO: 10115 - RNA, 18 nt, Artificial Sequence
  Synthetic Oligonucleotide; GZMB exon 2; Set C
guguuuccaggagggugu

SEQ ID NO: 10116 - RNA, 23 nt, Artificial Sequence
  Synthetic Oligonucleotide; GZMB exon 2; Set C
cugcugggugggcaccugcuuag

SEQ ID NO: 10117 - RNA, 24 nt, Artificial Sequence
  Synthetic Oligonucleotide; GZMB exon 2; Set C
ucugcugggugggcaccugcuuag

SEQ ID NO: 10118 - RNA, 25 nt, Artificial Sequence
  Synthetic Oligonucleotide; GZMB exon 2; Set C
aucugcugggugggcaccugcuuag

SEQ ID NO: 10119 - RNA, 26 nt, Artificial Sequence
  Synthetic Oligonucleotide; GZMB exon 2; Set C
aaucugcugggugggcaccugcuuag

SEQ ID NO: 10120 - RNA, 24 nt, Artificial Sequence
  Synthetic Oligonucleotide; GZMB exon 2; Set C
aucugcugggugggcaccugcuua

SEQ ID NO: 10121 - RNA, 27 nt, Artificial Sequence
  Synthetic Oligonucleotide; GZMB exon 2; Set C
gaaucugcugggugggcaccugcuuag

SEQ ID NO: 10122 - RNA, 25 nt, Artificial Sequence
  Synthetic Oligonucleotide; GZMB exon 2; Set C
aaucugcugggugggcaccugcuua

SEQ ID NO: 10123 - RNA, 28 nt, Artificial Sequence
  Synthetic Oligonucleotide; GZMB exon 2; Set C
ggaaucugcugggugggcaccugcuuag

SEQ ID NO: 10124 - RNA, 26 nt, Artificial Sequence
  Synthetic Oligonucleotide; GZMB exon 2; Set C
gaaucugcugggugggcaccugcuua

SEQ ID NO: 10125 - RNA, 29 nt, Artificial Sequence
  Synthetic Oligonucleotide; GZMB exon 2; Set C
uggaaucugcugggugggcaccugcuuag

SEQ ID NO: 10126 - RNA, 27 nt, Artificial Sequence
  Synthetic Oligonucleotide; GZMB exon 2; Set C
ggaaucugcugggugggcaccugcuua

SEQ ID NO: 10127 - RNA, 28 nt, Artificial Sequence
  Synthetic Oligonucleotide; GZMB exon 2; Set C
uggaaucugcugggugggcaccugcuua

SEQ ID NO: 10128 - RNA, 28 nt, Artificial Sequence
  Synthetic Oligonucleotide; GZMB exon 2; Set C
ucugcuugugggcacccauggaaucugc

SEQ ID NO: 10129 - RNA, 29 nt, Artificial Sequence
  Synthetic Oligonucleotide; GZMB exon 2; Set C
gucugcuugugggcacccauggaaucugc

SEQ ID NO: 10130 - RNA, 27 nt, Artificial Sequence
  Synthetic Oligonucleotide; GZMB exon 2; Set C
ucugcuugugggcacccauggaaucug

SEQ ID NO: 10131 - RNA, 28 nt, Artificial Sequence
  Synthetic Oligonucleotide; GZMB exon 2; Set C
gucugcuugugggcacccauggaaucug

SEQ ID NO: 10132 - RNA, 30 nt, Artificial Sequence
  Synthetic Oligonucleotide; GZMB exon 2; Set C
ugucugcuugugggcacccauggaaucugc

SEQ ID NO: 10133 - RNA, 26 nt, Artificial Sequence
  Synthetic Oligonucleotide; GZMB exon 2; Set C
ucugcuugugggcacccauggaaucu

SEQ ID NO: 10134 - RNA, 31 nt, Artificial Sequence
  Synthetic Oligonucleotide; GZMB exon 2; Set C
cugucugcuugugggcacccauggaaucugc

SEQ ID NO: 10135 - RNA, 29 nt, Artificial Sequence
  Synthetic Oligonucleotide; GZMB exon 2; Set C
ugucugcuugugggcacccauggaaucug

SEQ ID NO: 10136 - RNA, 27 nt, Artificial Sequence
  Synthetic Oligonucleotide; GZMB exon 2; Set C
gucugcuugugggcacccauggaaucu

SEQ ID NO: 10137 - RNA, 32 nt, Artificial Sequence
  Synthetic Oligonucleotide; GZMB exon 2; Set C
ucugucugcuugugggcacccauggaaucugc

SEQ ID NO: 10138 - RNA, 30 nt, Artificial Sequence
  Synthetic Oligonucleotide; GZMB exon 2; Set C
cugucugcuugugggcacccauggaaucug

SEQ ID NO: 10139 - RNA, 26 nt, Artificial Sequence
  Synthetic Oligonucleotide; GZMB exon 2; Set C
gucugcuugugggcacccauggaauc

SEQ ID NO: 10140 - RNA, 28 nt, Artificial Sequence
  Synthetic Oligonucleotide; GZMB exon 2; Set C
ugucugcuugugggcacccauggaaucu

SEQ ID NO: 10141 - RNA, 33 nt, Artificial Sequence
  Synthetic Oligonucleotide; GZMB exon 2; Set C
gucugucugcuugugggcacccauggaaucugc

SEQ ID NO: 10142 - RNA, 31 nt, Artificial Sequence
  Synthetic Oligonucleotide; GZMB exon 2; Set C
ucugucugcuugugggcacccauggaaucug

SEQ ID NO: 10143 - RNA, 29 nt, Artificial Sequence
  Synthetic Oligonucleotide; GZMB exon 2; Set C
cugucugcuugugggcacccauggaaucu

SEQ ID NO: 10144 - RNA, 27 nt, Artificial Sequence
  Synthetic Oligonucleotide; GZMB exon 2; Set C
ugucugcuugugggcacccauggaauc

SEQ ID NO: 10145 - RNA, 32 nt, Artificial Sequence
  Synthetic Oligonucleotide; GZMB exon 2; Set C
gucugucugcuugugggcacccauggaaucug

SEQ ID NO: 10146 - RNA, 34 nt, Artificial Sequence
  Synthetic Oligonucleotide; GZMB exon 2; Set C
agucugucugcuugugggcacccauggaaucugc

SEQ ID NO: 10147 - RNA, 30 nt, Artificial Sequence
  Synthetic Oligonucleotide; GZMB exon 2; Set C
ucugucugcuugugggcacccauggaaucu

SEQ ID NO: 10148 - RNA, 28 nt, Artificial Sequence
  Synthetic Oligonucleotide; GZMB exon 2; Set C
cugucugcuugugggcacccauggaauc

SEQ ID NO: 10149 - RNA, 26 nt, Artificial Sequence
  Synthetic Oligonucleotide; GZMB exon 2; Set C
ugucugcuugugggcacccauggaau

SEQ ID NO: 10150 - RNA, 33 nt, Artificial Sequence
  Synthetic Oligonucleotide; GZMB exon 2; Set C
agucugucugcuugugggcacccauggaaucug

SEQ ID NO: 10151 - RNA, 35 nt, Artificial Sequence
  Synthetic Oligonucleotide; GZMB exon 2; Set C
aagucugucugcuugugggcacccauggaaucugc

SEQ ID NO: 10152 - RNA, 31 nt, Artificial Sequence
  Synthetic Oligonucleotide; GZMB exon 2; Set C
gucugucugcuugugggcacccauggaaucu

SEQ ID NO: 10153 - RNA, 29 nt, Artificial Sequence
  Synthetic Oligonucleotide; GZMB exon 2; Set C
ucugucugcuugugggcacccauggaauc

SEQ ID NO: 10154 - RNA, 27 nt, Artificial Sequence
  Synthetic Oligonucleotide; GZMB exon 2; Set C
cugucugcuugugggcacccauggaau

SEQ ID NO: 10155 - RNA, 34 nt, Artificial Sequence
  Synthetic Oligonucleotide; GZMB exon 2; Set C
aagucugucugcuugugggcacccauggaaucug

SEQ ID NO: 10156 - RNA, 36 nt, Artificial Sequence
  Synthetic Oligonucleotide; GZMB exon 2; Set C
aaagucugucugcuugugggcacccauggaaucugc

SEQ ID NO: 10157 - RNA, 30 nt, Artificial Sequence
  Synthetic Oligonucleotide; GZMB exon 2; Set C
gucugucugcuugugggcacccauggaauc

SEQ ID NO: 10158 - RNA, 32 nt, Artificial Sequence
  Synthetic Oligonucleotide; GZMB exon 2; Set C
agucugucugcuugugggcacccauggaaucu

SEQ ID NO: 10159 - RNA, 28 nt, Artificial Sequence
  Synthetic Oligonucleotide; GZMB exon 2; Set C
ucugucugcuugugggcacccauggaau

SEQ ID NO: 10160 - RNA, 26 nt, Artificial Sequence
  Synthetic Oligonucleotide; GZMB exon 2; Set C
cugucugcuugugggcacccauggaa

SEQ ID NO: 10161 - RNA, 35 nt, Artificial Sequence
  Synthetic Oligonucleotide; GZMB exon 2; Set C
aaagucugucugcuugugggcacccauggaaucug

SEQ ID NO: 10162 - RNA, 37 nt, Artificial Sequence
  Synthetic Oligonucleotide; GZMB exon 2; Set C
aaaagucugucugcuugugggcacccauggaaucugc

SEQ ID NO: 10163 - RNA, 29 nt, Artificial Sequence
  Synthetic Oligonucleotide; GZMB exon 2; Set C
gucugucugcuugugggcacccauggaau

SEQ ID NO: 10164 - RNA, 31 nt, Artificial Sequence
  Synthetic Oligonucleotide; GZMB exon 2; Set C
agucugucugcuugugggcacccauggaauc

SEQ ID NO: 10165 - RNA, 27 nt, Artificial Sequence
  Synthetic Oligonucleotide; GZMB exon 2; Set C
ucugucugcuugugggcacccauggaa

SEQ ID NO: 10166 - RNA, 33 nt, Artificial Sequence
  Synthetic Oligonucleotide; GZMB exon 2; Set C
aagucugucugcuugugggcacccauggaaucu

SEQ ID NO: 10167 - RNA, 26 nt, Artificial Sequence
  Synthetic Oligonucleotide; GZMB exon 2; Set C
ucugucugcuugugggcacccaugga

SEQ ID NO: 10168 - RNA, 36 nt, Artificial Sequence
  Synthetic Oligonucleotide; GZMB exon 2; Set C
aaaagucugucugcuugugggcacccauggaaucug

SEQ ID NO: 10169 - RNA, 38 nt, Artificial Sequence
  Synthetic Oligonucleotide; GZMB exon 2; Set C
gaaaagucugucugcuugugggcacccauggaaucugc

SEQ ID NO: 10170 - RNA, 28 nt, Artificial Sequence
  Synthetic Oligonucleotide; GZMB exon 2; Set C
gucugucugcuugugggcacccauggaa

SEQ ID NO: 10171 - RNA, 30 nt, Artificial Sequence
  Synthetic Oligonucleotide; GZMB exon 2; Set C
agucugucugcuugugggcacccauggaau

SEQ ID NO: 10172 - RNA, 32 nt, Artificial Sequence
  Synthetic Oligonucleotide; GZMB exon 2; Set C
aagucugucugcuugugggcacccauggaauc

SEQ ID NO: 10173 - RNA, 34 nt, Artificial Sequence
  Synthetic Oligonucleotide; GZMB exon 2; Set C
aaagucugucugcuugugggcacccauggaaucu

SEQ ID NO: 10174 - RNA, 27 nt, Artificial Sequence
  Synthetic Oligonucleotide; GZMB exon 2; Set C
gucugucugcuugugggcacccaugga

SEQ ID NO: 10175 - RNA, 37 nt, Artificial Sequence
  Synthetic Oligonucleotide; GZMB exon 2; Set C
gaaaagucugucugcuugugggcacccauggaaucug

SEQ ID NO: 10176 - RNA, 39 nt, Artificial Sequence
  Synthetic Oligonucleotide; GZMB exon 2; Set C
ggaaaagucugucugcuugugggcacccauggaaucugc

SEQ ID NO: 10177 - RNA, 29 nt, Artificial Sequence
  Synthetic Oligonucleotide; GZMB exon 2; Set C
agucugucugcuugugggcacccauggaa

SEQ ID NO: 10178 - RNA, 31 nt, Artificial Sequence
  Synthetic Oligonucleotide; GZMB exon 2; Set C
aagucugucugcuugugggcacccauggaau

SEQ ID NO: 10179 - RNA, 33 nt, Artificial Sequence
  Synthetic Oligonucleotide; GZMB exon 2; Set C
aaagucugucugcuugugggcacccauggaauc

SEQ ID NO: 10180 - RNA, 35 nt, Artificial Sequence
  Synthetic Oligonucleotide; GZMB exon 2; Set C
aaaagucugucugcuugugggcacccauggaaucu

SEQ ID NO: 10181 - RNA, 26 nt, Artificial Sequence
  Synthetic Oligonucleotide; GZMB exon 2; Set C
gucugucugcuugugggcacccaugg

SEQ ID NO: 10182 - RNA, 28 nt, Artificial Sequence
  Synthetic Oligonucleotide; GZMB exon 2; Set C
agucugucugcuugugggcacccaugga

SEQ ID NO: 10183 - RNA, 40 nt, Artificial Sequence
  Synthetic Oligonucleotide; GZMB exon 2; Set C
aggaaaagucugucugcuugugggcacccauggaaucugc

SEQ ID NO: 10184 - RNA, 38 nt, Artificial Sequence
  Synthetic Oligonucleotide; GZMB exon 2; Set C
ggaaaagucugucugcuugugggcacccauggaaucug

SEQ ID NO: 10185 - RNA, 30 nt, Artificial Sequence
  Synthetic Oligonucleotide; GZMB exon 2; Set C
aagucugucugcuugugggcacccauggaa

SEQ ID NO: 10186 - RNA, 32 nt, Artificial Sequence
  Synthetic Oligonucleotide; GZMB exon 2; Set C
aaagucugucugcuugugggcacccauggaau

SEQ ID NO: 10187 - RNA, 34 nt, Artificial Sequence
  Synthetic Oligonucleotide; GZMB exon 2; Set C
aaaagucugucugcuugugggcacccauggaauc

SEQ ID NO: 10188 - RNA, 36 nt, Artificial Sequence
  Synthetic Oligonucleotide; GZMB exon 2; Set C
gaaaagucugucugcuugugggcacccauggaaucu

SEQ ID NO: 10189 - RNA, 27 nt, Artificial Sequence
  Synthetic Oligonucleotide; GZMB exon 2; Set C
agucugucugcuugugggcacccaugg

SEQ ID NO: 10190 - RNA, 29 nt, Artificial Sequence
  Synthetic Oligonucleotide; GZMB exon 2; Set C
aagucugucugcuugugggcacccaugga

SEQ ID NO: 10191 - RNA, 39 nt, Artificial Sequence
  Synthetic Oligonucleotide; GZMB exon 2; Set C
aggaaaagucugucugcuugugggcacccauggaaucug

SEQ ID NO: 10192 - RNA, 31 nt, Artificial Sequence
  Synthetic Oligonucleotide; GZMB exon 2; Set C
aaagucugucugcuugugggcacccauggaa

SEQ ID NO: 10193 - RNA, 33 nt, Artificial Sequence
  Synthetic Oligonucleotide; GZMB exon 2; Set C
aaaagucugucugcuugugggcacccauggaau

SEQ ID NO: 10194 - RNA, 35 nt, Artificial Sequence
  Synthetic Oligonucleotide; GZMB exon 2; Set C
gaaaagucugucugcuugugggcacccauggaauc

SEQ ID NO: 10195 - RNA, 37 nt, Artificial Sequence
  Synthetic Oligonucleotide; GZMB exon 2; Set C
ggaaaagucugucugcuugugggcacccauggaaucu

SEQ ID NO: 10196 - RNA, 28 nt, Artificial Sequence
  Synthetic Oligonucleotide; GZMB exon 2; Set C
aagucugucugcuugugggcacccaugg

SEQ ID NO: 10197 - RNA, 30 nt, Artificial Sequence
  Synthetic Oligonucleotide; GZMB exon 2; Set C
aaagucugucugcuugugggcacccaugga

SEQ ID NO: 10198 - RNA, 40 nt, Artificial Sequence
  Synthetic Oligonucleotide; GZMB exon 2; Set C
aaggaaaagucugucugcuugugggcacccauggaaucug

SEQ ID NO: 10199 - RNA, 32 nt, Artificial Sequence
  Synthetic Oligonucleotide; GZMB exon 2; Set C
aaaagucugucugcuugugggcacccauggaa

SEQ ID NO: 10200 - RNA, 34 nt, Artificial Sequence
  Synthetic Oligonucleotide; GZMB exon 2; Set C
gaaaagucugucugcuugugggcacccauggaau

SEQ ID NO: 10201 - RNA, 38 nt, Artificial Sequence
  Synthetic Oligonucleotide; GZMB exon 2; Set C
aggaaaagucugucugcuugugggcacccauggaaucu

SEQ ID NO: 10202 - RNA, 36 nt, Artificial Sequence
  Synthetic Oligonucleotide; GZMB exon 2; Set C
ggaaaagucugucugcuugugggcacccauggaauc

SEQ ID NO: 10203 - RNA, 29 nt, Artificial Sequence
  Synthetic Oligonucleotide; GZMB exon 2; Set C
aaagucugucugcuugugggcacccaugg

SEQ ID NO: 10204 - RNA, 31 nt, Artificial Sequence
  Synthetic Oligonucleotide; GZMB exon 2; Set C
aaaagucugucugcuugugggcacccaugga

SEQ ID NO: 10205 - RNA, 39 nt, Artificial Sequence
  Synthetic Oligonucleotide; GZMB exon 2; Set C
aaggaaaagucugucugcuugugggcacccauggaaucu

SEQ ID NO: 10206 - RNA, 33 nt, Artificial Sequence
  Synthetic Oligonucleotide; GZMB exon 2; Set C
gaaaagucugucugcuugugggcacccauggaa

SEQ ID NO: 10207 - RNA, 37 nt, Artificial Sequence
  Synthetic Oligonucleotide; GZMB exon 2; Set C
aggaaaagucugucugcuugugggcacccauggaauc

SEQ ID NO: 10208 - RNA, 35 nt, Artificial Sequence
  Synthetic Oligonucleotide; GZMB exon 2; Set C
ggaaaagucugucugcuugugggcacccauggaau

SEQ ID NO: 10209 - RNA, 30 nt, Artificial Sequence
  Synthetic Oligonucleotide; GZMB exon 2; Set C
aaaagucugucugcuugugggcacccaugg

SEQ ID NO: 10210 - RNA, 32 nt, Artificial Sequence
  Synthetic Oligonucleotide; GZMB exon 2; Set C
gaaaagucugucugcuugugggcacccaugga

SEQ ID NO: 10211 - RNA, 38 nt, Artificial Sequence
  Synthetic Oligonucleotide; GZMB exon 2; Set C
aaggaaaagucugucugcuugugggcacccauggaauc

SEQ ID NO: 10212 - RNA, 36 nt, Artificial Sequence
  Synthetic Oligonucleotide; GZMB exon 2; Set C
aggaaaagucugucugcuugugggcacccauggaau

SEQ ID NO: 10213 - RNA, 34 nt, Artificial Sequence
  Synthetic Oligonucleotide; GZMB exon 2; Set C
ggaaaagucugucugcuugugggcacccauggaa

SEQ ID NO: 10214 - RNA, 31 nt, Artificial Sequence
  Synthetic Oligonucleotide; GZMB exon 2; Set C
gaaaagucugucugcuugugggcacccaugg

SEQ ID NO: 10215 - RNA, 33 nt, Artificial Sequence
  Synthetic Oligonucleotide; GZMB exon 2; Set C
ggaaaagucugucugcuugugggcacccaugga

SEQ ID NO: 10216 - RNA, 39 nt, Artificial Sequence
  Synthetic Oligonucleotide; GZMB exon 2; Set C
gaaggaaaagucugucugcuugugggcacccauggaauc

SEQ ID NO: 10217 - RNA, 37 nt, Artificial Sequence
  Synthetic Oligonucleotide; GZMB exon 2; Set C
aaggaaaagucugucugcuugugggcacccauggaau

SEQ ID NO: 10218 - RNA, 35 nt, Artificial Sequence
  Synthetic Oligonucleotide; GZMB exon 2; Set C
aggaaaagucugucugcuugugggcacccauggaa

SEQ ID NO: 10219 - RNA, 34 nt, Artificial Sequence
  Synthetic Oligonucleotide; GZMB exon 2; Set C
aggaaaagucugucugcuugugggcacccaugga

SEQ ID NO: 10220 - RNA, 32 nt, Artificial Sequence
  Synthetic Oligonucleotide; GZMB exon 2; Set C
ggaaaagucugucugcuugugggcacccaugg

SEQ ID NO: 10221 - RNA, 38 nt, Artificial Sequence
  Synthetic Oligonucleotide; GZMB exon 2; Set C
gaaggaaaagucugucugcuugugggcacccauggaau

SEQ ID NO: 10222 - RNA, 36 nt, Artificial Sequence
  Synthetic Oligonucleotide; GZMB exon 2; Set C
aaggaaaagucugucugcuugugggcacccauggaa

SEQ ID NO: 10223 - RNA, 40 nt, Artificial Sequence
  Synthetic Oligonucleotide; GZMB exon 2; Set C
ugaaggaaaagucugucugcuugugggcacccauggaauc

SEQ ID NO: 10224 - RNA, 35 nt, Artificial Sequence
  Synthetic Oligonucleotide; GZMB exon 2; Set C
aaggaaaagucugucugcuugugggcacccaugga

SEQ ID NO: 10225 - RNA, 33 nt, Artificial Sequence
  Synthetic Oligonucleotide; GZMB exon 2; Set C
aggaaaagucugucugcuugugggcacccaugg

SEQ ID NO: 10226 - RNA, 37 nt, Artificial Sequence
  Synthetic Oligonucleotide; GZMB exon 2; Set C
gaaggaaaagucugucugcuugugggcacccauggaa

SEQ ID NO: 10227 - RNA, 39 nt, Artificial Sequence
  Synthetic Oligonucleotide; GZMB exon 2; Set C
ugaaggaaaagucugucugcuugugggcacccauggaau

SEQ ID NO: 10228 - RNA, 36 nt, Artificial Sequence
  Synthetic Oligonucleotide; GZMB exon 2; Set C
gaaggaaaagucugucugcuugugggcacccaugga

SEQ ID NO: 10229 - RNA, 34 nt, Artificial Sequence
  Synthetic Oligonucleotide; GZMB exon 2; Set C
aaggaaaagucugucugcuugugggcacccaugg

SEQ ID NO: 10230 - RNA, 38 nt, Artificial Sequence
  Synthetic Oligonucleotide; GZMB exon 2; Set C
ugaaggaaaagucugucugcuugugggcacccauggaa

SEQ ID NO: 10231 - RNA, 40 nt, Artificial Sequence
  Synthetic Oligonucleotide; GZMB exon 2; Set C
cugaaggaaaagucugucugcuugugggcacccauggaau

SEQ ID NO: 10232 - RNA, 35 nt, Artificial Sequence
  Synthetic Oligonucleotide; GZMB exon 2; Set C
gaaggaaaagucugucugcuugugggcacccaugg

SEQ ID NO: 10233 - RNA, 37 nt, Artificial Sequence
  Synthetic Oligonucleotide; GZMB exon 2; Set C
ugaaggaaaagucugucugcuugugggcacccaugga

SEQ ID NO: 10234 - RNA, 39 nt, Artificial Sequence
  Synthetic Oligonucleotide; GZMB exon 2; Set C
cugaaggaaaagucugucugcuugugggcacccauggaa

SEQ ID NO: 10235 - RNA, 36 nt, Artificial Sequence
  Synthetic Oligonucleotide; GZMB exon 2; Set C
ugaaggaaaagucugucugcuugugggcacccaugg

SEQ ID NO: 10236 - RNA, 38 nt, Artificial Sequence
  Synthetic Oligonucleotide; GZMB exon 2; Set C
cugaaggaaaagucugucugcuugugggcacccaugga

SEQ ID NO: 10237 - RNA, 37 nt, Artificial Sequence
  Synthetic Oligonucleotide; GZMB exon 2; Set C
cugaaggaaaagucugucugcuugugggcacccaugg

SEQ ID NO: 10238 - RNA, 17 nt, Artificial Sequence
  Synthetic Oligonucleotide; GZMB exon 2; Set C
gaaaagucugucugcuu

SEQ ID NO: 10239 - RNA, 15 nt, Artificial Sequence
  Synthetic Oligonucleotide; GZMB exon 2; Set C
aaaagucugucugcu

SEQ ID NO: 10240 - RNA, 18 nt, Artificial Sequence
  Synthetic Oligonucleotide; GZMB exon 2; Set C
ggaaaagucugucugcuu

SEQ ID NO: 10241 - RNA, 16 nt, Artificial Sequence
  Synthetic Oligonucleotide; GZMB exon 2; Set C
gaaaagucugucugcu

SEQ ID NO: 10242 - RNA, 19 nt, Artificial Sequence
  Synthetic Oligonucleotide; GZMB exon 2; Set C
aggaaaagucugucugcuu

SEQ ID NO: 10243 - RNA, 17 nt, Artificial Sequence
  Synthetic Oligonucleotide; GZMB exon 2; Set C
ggaaaagucugucugcu

SEQ ID NO: 10244 - RNA, 15 nt, Artificial Sequence
  Synthetic Oligonucleotide; GZMB exon 2; Set C
gaaaagucugucugc

SEQ ID NO: 10245 - RNA, 18 nt, Artificial Sequence
  Synthetic Oligonucleotide; GZMB exon 2; Set C
aggaaaagucugucugcu

SEQ ID NO: 10246 - RNA, 16 nt, Artificial Sequence
  Synthetic Oligonucleotide; GZMB exon 2; Set C
ggaaaagucugucugc

SEQ ID NO: 10247 - RNA, 19 nt, Artificial Sequence
  Synthetic Oligonucleotide; GZMB exon 2; Set C
aaggaaaagucugucugcu

SEQ ID NO: 10248 - RNA, 15 nt, Artificial Sequence
  Synthetic Oligonucleotide; GZMB exon 2; Set C
ggaaaagucugucug

SEQ ID NO: 10249 - RNA, 17 nt, Artificial Sequence
  Synthetic Oligonucleotide; GZMB exon 2; Set C
aggaaaagucugucugc

SEQ ID NO: 10250 - RNA, 16 nt, Artificial Sequence
  Synthetic Oligonucleotide; GZMB exon 2; Set C
aggaaaagucugucug

SEQ ID NO: 10251 - RNA, 18 nt, Artificial Sequence
  Synthetic Oligonucleotide; GZMB exon 2; Set C
aaggaaaagucugucugc

SEQ ID NO: 10252 - RNA, 23 nt, Artificial Sequence
  Synthetic Oligonucleotide; GZMB exon 2; Set C
cugaaggaaaagucugucugcuu

SEQ ID NO: 10253 - RNA, 17 nt, Artificial Sequence
  Synthetic Oligonucleotide; GZMB exon 2; Set C
aaggaaaagucugucug

SEQ ID NO: 10254 - RNA, 21 nt, Artificial Sequence
  Synthetic Oligonucleotide; GZMB exon 2; Set C
ugaaggaaaagucugucugcu

SEQ ID NO: 10255 - RNA, 22 nt, Artificial Sequence
  Synthetic Oligonucleotide; GZMB exon 2; Set C
cugaaggaaaagucugucugcu

SEQ ID NO: 10256 - RNA, 20 nt, Artificial Sequence
  Synthetic Oligonucleotide; GZMB exon 2; Set C
ugaaggaaaagucugucugc

SEQ ID NO: 10257 - RNA, 19 nt, Artificial Sequence
  Synthetic Oligonucleotide; GZMB exon 2; Set C
ugaaggaaaagucugucug

SEQ ID NO: 10258 - RNA, 21 nt, Artificial Sequence
  Synthetic Oligonucleotide; GZMB exon 2; Set C
cugaaggaaaagucugucugc

SEQ ID NO: 10259 - RNA, 20 nt, Artificial Sequence
  Synthetic Oligonucleotide; GZMB exon 2; Set C
cugaaggaaaagucugucug

SEQ ID NO: 10260 - RNA, 31 nt, Artificial Sequence
  Synthetic Oligonucleotide; GZMB exon 2; Set A
aucuccccugaaggaaaagucugucugcuug

SEQ ID NO: 10261 - RNA, 32 nt, Artificial Sequence
  Synthetic Oligonucleotide; GZMB exon 2; Set A
gaucuccccugaaggaaaagucugucugcuug

SEQ ID NO: 10262 - RNA, 33 nt, Artificial Sequence
  Synthetic Oligonucleotide; GZMB exon 2; Set A
ugaucuccccugaaggaaaagucugucugcuug

SEQ ID NO: 10263 - RNA, 31 nt, Artificial Sequence
  Synthetic Oligonucleotide; GZMB exon 2; Set A
gaucuccccugaaggaaaagucugucugcuu

SEQ ID NO: 10264 - RNA, 34 nt, Artificial Sequence
  Synthetic Oligonucleotide; GZMB exon 2; Set A
augaucuccccugaaggaaaagucugucugcuug

SEQ ID NO: 10265 - RNA, 32 nt, Artificial Sequence
  Synthetic Oligonucleotide; GZMB exon 2; Set A
ugaucuccccugaaggaaaagucugucugcuu

SEQ ID NO: 10266 - RNA, 30 nt, Artificial Sequence
  Synthetic Oligonucleotide; GZMB exon 2; Set A
gaucuccccugaaggaaaagucugucugcu

SEQ ID NO: 10267 - RNA, 25 nt, Artificial Sequence
  Synthetic Oligonucleotide; GZMB exon 2; Set A
ucuccccugaaggaaaagucugucu

SEQ ID NO: 10268 - RNA, 35 nt, Artificial Sequence
  Synthetic Oligonucleotide; GZMB exon 2; Set C
gaugaucuccccugaaggaaaagucugucugcuug

SEQ ID NO: 10269 - RNA, 33 nt, Artificial Sequence
  Synthetic Oligonucleotide; GZMB exon 2; Set A
augaucuccccugaaggaaaagucugucugcuu

SEQ ID NO: 10270 - RNA, 31 nt, Artificial Sequence
  Synthetic Oligonucleotide; GZMB exon 2; Set A
ugaucuccccugaaggaaaagucugucugcu

SEQ ID NO: 10271 - RNA, 29 nt, Artificial Sequence
  Synthetic Oligonucleotide; GZMB exon 2; Set A
gaucuccccugaaggaaaagucugucugc

SEQ ID NO: 10272 - RNA, 24 nt, Artificial Sequence
  Synthetic Oligonucleotide; GZMB exon 2; Set A
ucuccccugaaggaaaagucuguc

SEQ ID NO: 10273 - RNA, 32 nt, Artificial Sequence
  Synthetic Oligonucleotide; GZMB exon 2; Set A
augaucuccccugaaggaaaagucugucugcu

SEQ ID NO: 10274 - RNA, 28 nt, Artificial Sequence
  Synthetic Oligonucleotide; GZMB exon 2; Set A
gaucuccccugaaggaaaagucugucug

SEQ ID NO: 10275 - RNA, 30 nt, Artificial Sequence
  Synthetic Oligonucleotide; GZMB exon 2; Set A
ugaucuccccugaaggaaaagucugucugc

SEQ ID NO: 10276 - RNA, 25 nt, Artificial Sequence
  Synthetic Oligonucleotide; GZMB exon 2; Set A
aucuccccugaaggaaaagucuguc

SEQ ID NO: 10277 - RNA, 23 nt, Artificial Sequence
  Synthetic Oligonucleotide; GZMB exon 2; Set C
ucuccccugaaggaaaagucugu

SEQ ID NO: 10278 - RNA, 29 nt, Artificial Sequence
  Synthetic Oligonucleotide; GZMB exon 2; Set A
ugaucuccccugaaggaaaagucugucug

SEQ ID NO: 10279 - RNA, 31 nt, Artificial Sequence
  Synthetic Oligonucleotide; GZMB exon 2; Set A
augaucuccccugaaggaaaagucugucugc

SEQ ID NO: 10280 - RNA, 22 nt, Artificial Sequence
  Synthetic Oligonucleotide; GZMB exon 2; Set C
ucuccccugaaggaaaagucug

SEQ ID NO: 10281 - RNA, 24 nt, Artificial Sequence
  Synthetic Oligonucleotide; GZMB exon 2; Set C
aucuccccugaaggaaaagucugu

SEQ ID NO: 10282 - RNA, 30 nt, Artificial Sequence
  Synthetic Oligonucleotide; GZMB exon 2; Set A
augaucuccccugaaggaaaagucugucug

SEQ ID NO: 10283 - RNA, 23 nt, Artificial Sequence
  Synthetic Oligonucleotide; GZMB exon 2; Set C
aucuccccugaaggaaaagucug

SEQ ID NO: 10284 - RNA, 21 nt, Artificial Sequence
  Synthetic Oligonucleotide; GZMB exon 2; Set C
ucuccccugaaggaaaagucu

SEQ ID NO: 10285 - RNA, 20 nt, Artificial Sequence
  Synthetic Oligonucleotide; GZMB exon 2; Set C
ucuccccugaaggaaaaguc

SEQ ID NO: 10286 - RNA, 22 nt, Artificial Sequence
  Synthetic Oligonucleotide; GZMB exon 2; Set C
aucuccccugaaggaaaagucu

SEQ ID NO: 10287 - RNA, 21 nt, Artificial Sequence
  Synthetic Oligonucleotide; GZMB exon 2; Set C
aucuccccugaaggaaaaguc

SEQ ID NO: 10288 - RNA, 19 nt, Artificial Sequence
  Synthetic Oligonucleotide; GZMB exon 2; Set C
ucuccccugaaggaaaagu

SEQ ID NO: 10289 - RNA, 20 nt, Artificial Sequence
  Synthetic Oligonucleotide; GZMB exon 2; Set C
aucuccccugaaggaaaagu

SEQ ID NO: 10290 - RNA, 18 nt, Artificial Sequence
  Synthetic Oligonucleotide; GZMB exon 2; Set C
ucuccccugaaggaaaag

SEQ ID NO: 10291 - RNA, 19 nt, Artificial Sequence
  Synthetic Oligonucleotide; GZMB exon 2; Set C
aucuccccugaaggaaaag

SEQ ID NO: 10292 - RNA, 17 nt, Artificial Sequence
  Synthetic Oligonucleotide; GZMB exon 2; Set C
ucuccccugaaggaaaa

SEQ ID NO: 10293 - RNA, 18 nt, Artificial Sequence
  Synthetic Oligonucleotide; GZMB exon 2; Set C
aucuccccugaaggaaaa

SEQ ID NO: 10294 - RNA, 17 nt, Artificial Sequence
  Synthetic Oligonucleotide; GZMB exon 2; Set C
aucuccccugaaggaaa

SEQ ID NO: 10295 - RNA, 16 nt, Artificial Sequence
  Synthetic Oligonucleotide; GZMB exon 2; Set C
aucuccccugaaggaa

SEQ ID NO: 10296 - RNA, 23 nt, Artificial Sequence
  Synthetic Oligonucleotide; GZMB exon 2; Set C
gaugaucuccccugaaggaaaag

SEQ ID NO: 10297 - RNA, 17 nt, Artificial Sequence
  Synthetic Oligonucleotide; GZMB exon 2; Set C
gaucuccccugaaggaa

SEQ ID NO: 10298 - RNA, 22 nt, Artificial Sequence
  Synthetic Oligonucleotide; GZMB exon 2; Set C
gaugaucuccccugaaggaaaa

SEQ ID NO: 10299 - RNA, 16 nt, Artificial Sequence
  Synthetic Oligonucleotide; GZMB exon 2; Set C
gaucuccccugaagga

SEQ ID NO: 10300 - RNA, 21 nt, Artificial Sequence
  Synthetic Oligonucleotide; GZMB exon 2; Set C
gaugaucuccccugaaggaaa

SEQ ID NO: 10301 - RNA, 15 nt, Artificial Sequence
  Synthetic Oligonucleotide; GZMB exon 2; Set C
gaucuccccugaagg

SEQ ID NO: 10302 - RNA, 17 nt, Artificial Sequence
  Synthetic Oligonucleotide; GZMB exon 2; Set C
ugaucuccccugaagga

SEQ ID NO: 10303 - RNA, 36 nt, Artificial Sequence
  Synthetic Oligonucleotide; GZMB exon 2; Set C
ugucccccgaugaucuccccugaaggaaaagucugu

SEQ ID NO: 10304 - RNA, 20 nt, Artificial Sequence
  Synthetic Oligonucleotide; GZMB exon 2; Set C
gaugaucuccccugaaggaa

SEQ ID NO: 10305 - RNA, 16 nt, Artificial Sequence
  Synthetic Oligonucleotide; GZMB exon 2; Set C
ugaucuccccugaagg

SEQ ID NO: 10306 - RNA, 35 nt, Artificial Sequence
  Synthetic Oligonucleotide; GZMB exon 2; Set C
ugucccccgaugaucuccccugaaggaaaagucug

SEQ ID NO: 10307 - RNA, 15 nt, Artificial Sequence
  Synthetic Oligonucleotide; GZMB exon 2; Set C
ugaucuccccugaag

SEQ ID NO: 10308 - RNA, 17 nt, Artificial Sequence
  Synthetic Oligonucleotide; GZMB exon 2; Set C
augaucuccccugaagg

SEQ ID NO: 10309 - RNA, 19 nt, Artificial Sequence
  Synthetic Oligonucleotide; GZMB exon 2; Set C
gaugaucuccccugaagga

SEQ ID NO: 10310 - RNA, 34 nt, Artificial Sequence
  Synthetic Oligonucleotide; GZMB exon 2; Set C
ugucccccgaugaucuccccugaaggaaaagucu

SEQ ID NO: 10311 - RNA, 16 nt, Artificial Sequence
  Synthetic Oligonucleotide; GZMB exon 2; Set C
augaucuccccugaag

SEQ ID NO: 10312 - RNA, 18 nt, Artificial Sequence
  Synthetic Oligonucleotide; GZMB exon 2; Set C
gaugaucuccccugaagg

SEQ ID NO: 10313 - RNA, 33 nt, Artificial Sequence
  Synthetic Oligonucleotide; GZMB exon 2; Set C
ugucccccgaugaucuccccugaaggaaaaguc

SEQ ID NO: 10314 - RNA, 15 nt, Artificial Sequence
  Synthetic Oligonucleotide; GZMB exon 2; Set C
augaucuccccugaa

SEQ ID NO: 10315 - RNA, 17 nt, Artificial Sequence
  Synthetic Oligonucleotide; GZMB exon 2; Set C
gaugaucuccccugaag

SEQ ID NO: 10316 - RNA, 32 nt, Artificial Sequence
  Synthetic Oligonucleotide; GZMB exon 2; Set C
ugucccccgaugaucuccccugaaggaaaagu

SEQ ID NO: 10317 - RNA, 16 nt, Artificial Sequence
  Synthetic Oligonucleotide; GZMB exon 2; Set C
gaugaucuccccugaa

SEQ ID NO: 10318 - RNA, 31 nt, Artificial Sequence
  Synthetic Oligonucleotide; GZMB exon 2; Set C
ugucccccgaugaucuccccugaaggaaaag

SEQ ID NO: 10319 - RNA, 15 nt, Artificial Sequence
  Synthetic Oligonucleotide; GZMB exon 2; Set C
gaugaucuccccuga

SEQ ID NO: 10320 - RNA, 30 nt, Artificial Sequence
  Synthetic Oligonucleotide; GZMB exon 2; Set C
ugucccccgaugaucuccccugaaggaaaa

SEQ ID NO: 10321 - RNA, 29 nt, Artificial Sequence
  Synthetic Oligonucleotide; GZMB exon 2; Set C
ugucccccgaugaucuccccugaaggaaa

SEQ ID NO: 10322 - RNA, 28 nt, Artificial Sequence
  Synthetic Oligonucleotide; GZMB exon 2; Set C
ugucccccgaugaucuccccugaaggaa

SEQ ID NO: 10323 - RNA, 27 nt, Artificial Sequence
  Synthetic Oligonucleotide; GZMB exon 2; Set C
ugucccccgaugaucuccccugaagga

SEQ ID NO: 10324 - RNA, 26 nt, Artificial Sequence
  Synthetic Oligonucleotide; GZMB exon 2; Set C
ugucccccgaugaucuccccugaagg

SEQ ID NO: 10325 - RNA, 25 nt, Artificial Sequence
  Synthetic Oligonucleotide; GZMB exon 2; Set C
ugucccccgaugaucuccccugaag

SEQ ID NO: 10326 - RNA, 24 nt, Artificial Sequence
  Synthetic Oligonucleotide; GZMB exon 2; Set C
ugucccccgaugaucuccccugaa

SEQ ID NO: 10327 - RNA, 40 nt, Artificial Sequence
  Synthetic Oligonucleotide; GZMB exon 2; Set C
uuggccucaugucccccgaugaucuccccugaaggaaaag

SEQ ID NO: 10328 - RNA, 39 nt, Artificial Sequence
  Synthetic Oligonucleotide; GZMB exon 2; Set C
uuggccucaugucccccgaugaucuccccugaaggaaaa

SEQ ID NO: 10329 - RNA, 40 nt, Artificial Sequence
  Synthetic Oligonucleotide; GZMB exon 2; Set C
aggggcgggaguggggcuuggccucaugucccccgaugau

SEQ ID NO: 10330 - RNA, 40 nt, Artificial Sequence
  Synthetic Oligonucleotide; GZMB exon 2; Set C
uaggggcgggaguggggcuuggccucaugucccccgauga

SEQ ID NO: 10331 - RNA, 39 nt, Artificial Sequence
  Synthetic Oligonucleotide; GZMB exon 2; Set C
uaggggcgggaguggggcuuggccucaugucccccgaug

SEQ ID NO: 10332 - RNA, 40 nt, Artificial Sequence
  Synthetic Oligonucleotide; GZMB exon 2; Set C
guaggggcgggaguggggcuuggccucaugucccccgaug

SEQ ID NO: 10333 - RNA, 27 nt, Artificial Sequence
  Synthetic Oligonucleotide; GZMB exon 2; Set C
gggcgggaguggggcuuggccucaugu

SEQ ID NO: 10334 - RNA, 28 nt, Artificial Sequence
  Synthetic Oligonucleotide; GZMB exon 2; Set C
ggggcgggaguggggcuuggccucaugu

SEQ ID NO: 10335 - RNA, 29 nt, Artificial Sequence
  Synthetic Oligonucleotide; GZMB exon 2; Set C
aggggcgggaguggggcuuggccucaugu

SEQ ID NO: 10336 - RNA, 30 nt, Artificial Sequence
  Synthetic Oligonucleotide; GZMB exon 2; Set C
uaggggcgggaguggggcuuggccucaugu

SEQ ID NO: 10337 - RNA, 31 nt, Artificial Sequence
  Synthetic Oligonucleotide; GZMB exon 2; Set C
guaggggcgggaguggggcuuggccucaugu

SEQ ID NO: 10338 - RNA, 32 nt, Artificial Sequence
  Synthetic Oligonucleotide; GZMB exon 2; Set C
uguaggggcgggaguggggcuuggccucaugu

SEQ ID NO: 10339 - RNA, 33 nt, Artificial Sequence
  Synthetic Oligonucleotide; GZMB exon 2; Set C
auguaggggcgggaguggggcuuggccucaugu

SEQ ID NO: 10340 - RNA, 18 nt, Artificial Sequence
  Synthetic Oligonucleotide; GZMB exon 2; Set C
gggcgggaguggggcuug

SEQ ID NO: 10341 - RNA, 19 nt, Artificial Sequence
  Synthetic Oligonucleotide; GZMB exon 2; Set C
ggggcgggaguggggcuug

SEQ ID NO: 10342 - RNA, 20 nt, Artificial Sequence
  Synthetic Oligonucleotide; GZMB exon 2; Set C
aggggcgggaguggggcuug

SEQ ID NO: 10343 - RNA, 40 nt, Artificial Sequence
  Synthetic Oligonucleotide; GZMB exon 2; Set C
auaagccauguaggggcgggaguggggcuuggccucaugu

SEQ ID NO: 10344 - RNA, 31 nt, Artificial Sequence
  Synthetic Oligonucleotide; GZMB exon 2; Set C
auaagccauguaggggcgggaguggggcuug

SEQ ID NO: 10345 - RNA, 15 nt, Artificial Sequence
  Synthetic Oligonucleotide; GZMB exon 2; Set C
uguaggggcgggagu

SEQ ID NO: 10346 - RNA, 16 nt, Artificial Sequence
  Synthetic Oligonucleotide; GZMB exon 2; Set C
auguaggggcgggagu

SEQ ID NO: 10347 - RNA, 15 nt, Artificial Sequence
  Synthetic Oligonucleotide; GZMB exon 2; Set C
auguaggggcgggag

SEQ ID NO: 10348 - RNA, 16 nt, Artificial Sequence
  Synthetic Oligonucleotide; GZMB exon 2; Set C
auaagccauguagggg

SEQ ID NO: 10349 - RNA, 15 nt, Artificial Sequence
  Synthetic Oligonucleotide; GZMB exon 2; Set C
auaagccauguaggg

SEQ ID NO: 10350 - RNA, 18 nt, Artificial Sequence
  Synthetic Oligonucleotide; GZMB exon 2; Set C
agauaagccauguagggg

SEQ ID NO: 10351 - RNA, 17 nt, Artificial Sequence
  Synthetic Oligonucleotide; GZMB exon 2; Set C
agauaagccauguaggg

SEQ ID NO: 10352 - RNA, 16 nt, Artificial Sequence
  Synthetic Oligonucleotide; GZMB exon 2; Set C
agauaagccauguagg

SEQ ID NO: 10353 - RNA, 15 nt, Artificial Sequence
  Synthetic Oligonucleotide; GZMB exon 2; Set C
agauaagccauguag

SEQ ID NO: 10354 - RNA, 27 nt, Artificial Sequence
  Synthetic Oligonucleotide; GZMB exon 2; Set A
cagaucauaagauaagccauguagggg

SEQ ID NO: 10355 - RNA, 26 nt, Artificial Sequence
  Synthetic Oligonucleotide; GZMB exon 2; Set C
cagaucauaagauaagccauguaggg

SEQ ID NO: 10356 - RNA, 25 nt, Artificial Sequence
  Synthetic Oligonucleotide; GZMB exon 2; Set C
cagaucauaagauaagccauguagg

SEQ ID NO: 10357 - RNA, 24 nt, Artificial Sequence
  Synthetic Oligonucleotide; GZMB exon 2; Set C
cagaucauaagauaagccauguag

SEQ ID NO: 10358 - RNA, 23 nt, Artificial Sequence
  Synthetic Oligonucleotide; GZMB exon 2; Set C
cagaucauaagauaagccaugua

SEQ ID NO: 10359 - RNA, 23 nt, Artificial Sequence
  Synthetic Oligonucleotide; GZMB exon 2; Set C
ccagaucauaagauaagccaugu

SEQ ID NO: 10360 - RNA, 22 nt, Artificial Sequence
  Synthetic Oligonucleotide; GZMB exon 2; Set C
ccagaucauaagauaagccaug

SEQ ID NO: 10361 - RNA, 40 nt, Artificial Sequence
  Synthetic Oligonucleotide; GZMB exon 2; Set C
agacuucugaucccagaucauaagauaagccauguagggg

SEQ ID NO: 10362 - RNA, 39 nt, Artificial Sequence
  Synthetic Oligonucleotide; GZMB exon 2; Set C
agacuucugaucccagaucauaagauaagccauguaggg

SEQ ID NO: 10363 - RNA, 38 nt, Artificial Sequence
  Synthetic Oligonucleotide; GZMB exon 2; Set C
agacuucugaucccagaucauaagauaagccauguagg

SEQ ID NO: 10364 - RNA, 37 nt, Artificial Sequence
  Synthetic Oligonucleotide; GZMB exon 2; Set A
agacuucugaucccagaucauaagauaagccauguag

SEQ ID NO: 10365 - RNA, 39 nt, Artificial Sequence
  Synthetic Oligonucleotide; GZMB exon 2; Set C
gagacuucugaucccagaucauaagauaagccauguagg

SEQ ID NO: 10366 - RNA, 36 nt, Artificial Sequence
  Synthetic Oligonucleotide; GZMB exon 2; Set A
agacuucugaucccagaucauaagauaagccaugua

SEQ ID NO: 10367 - RNA, 38 nt, Artificial Sequence
  Synthetic Oligonucleotide; GZMB exon 2; Set C
gagacuucugaucccagaucauaagauaagccauguag

SEQ ID NO: 10368 - RNA, 40 nt, Artificial Sequence
  Synthetic Oligonucleotide; GZMB exon 2; Set C
agagacuucugaucccagaucauaagauaagccauguagg

SEQ ID NO: 10369 - RNA, 35 nt, Artificial Sequence
  Synthetic Oligonucleotide; GZMB exon 2; Set A
agacuucugaucccagaucauaagauaagccaugu

SEQ ID NO: 10370 - RNA, 37 nt, Artificial Sequence
  Synthetic Oligonucleotide; GZMB exon 2; Set C
gagacuucugaucccagaucauaagauaagccaugua

SEQ ID NO: 10371 - RNA, 39 nt, Artificial Sequence
  Synthetic Oligonucleotide; GZMB exon 2; Set C
agagacuucugaucccagaucauaagauaagccauguag

SEQ ID NO: 10372 - RNA, 38 nt, Artificial Sequence
  Synthetic Oligonucleotide; GZMB exon 2; Set C
agagacuucugaucccagaucauaagauaagccaugua

SEQ ID NO: 10373 - RNA, 40 nt, Artificial Sequence
  Synthetic Oligonucleotide; GZMB exon 2; Set C
cagagacuucugaucccagaucauaagauaagccauguag

SEQ ID NO: 10374 - RNA, 39 nt, Artificial Sequence
  Synthetic Oligonucleotide; GZMB exon 2; Set C
cagagacuucugaucccagaucauaagauaagccaugua

SEQ ID NO: 10375 - RNA, 37 nt, Artificial Sequence
  Synthetic Oligonucleotide; GZMB exon 2; Set C
agagacuucugaucccagaucauaagauaagccaugu

SEQ ID NO: 10376 - RNA, 40 nt, Artificial Sequence
  Synthetic Oligonucleotide; GZMB exon 2; Set C
ucagagacuucugaucccagaucauaagauaagccaugua

SEQ ID NO: 10377 - RNA, 38 nt, Artificial Sequence
  Synthetic Oligonucleotide; GZMB exon 2; Set C
cagagacuucugaucccagaucauaagauaagccaugu

SEQ ID NO: 10378 - RNA, 39 nt, Artificial Sequence
  Synthetic Oligonucleotide; GZMB exon 2; Set C
ucagagacuucugaucccagaucauaagauaagccaugu

SEQ ID NO: 10379 - RNA, 37 nt, Artificial Sequence
  Synthetic Oligonucleotide; GZMB exon 2; Set C
cagagacuucugaucccagaucauaagauaagccaug

SEQ ID NO: 10380 - RNA, 38 nt, Artificial Sequence
  Synthetic Oligonucleotide; GZMB exon 2; Set C
ucagagacuucugaucccagaucauaagauaagccaug

SEQ ID NO: 10381 - RNA, 39 nt, Artificial Sequence
  Synthetic Oligonucleotide; GZMB exon 2; Set C
uucagagacuucugaucccagaucauaagauaagccaug

SEQ ID NO: 10382 - RNA, 40 nt, Artificial Sequence
  Synthetic Oligonucleotide; GZMB exon 2; Set C
cuucagagacuucugaucccagaucauaagauaagccaug

SEQ ID NO: 10383 - RNA, 30 nt, Artificial Sequence
  Synthetic Oligonucleotide; GZMB exon 2; Set A
cagagacuucugaucccagaucauaagaua

SEQ ID NO: 10384 - RNA, 31 nt, Artificial Sequence
  Synthetic Oligonucleotide; GZMB exon 2; Set A
ucagagacuucugaucccagaucauaagaua

SEQ ID NO: 10385 - RNA, 32 nt, Artificial Sequence
  Synthetic Oligonucleotide; GZMB exon 2; Set A
uucagagacuucugaucccagaucauaagaua

SEQ ID NO: 10386 - RNA, 33 nt, Artificial Sequence
  Synthetic Oligonucleotide; GZMB exon 2; Set A
cuucagagacuucugaucccagaucauaagaua

SEQ ID NO: 10387 - RNA, 31 nt, Artificial Sequence
  Synthetic Oligonucleotide; GZMB exon 2; Set A
uucagagacuucugaucccagaucauaagau

SEQ ID NO: 10388 - RNA, 34 nt, Artificial Sequence
  Synthetic Oligonucleotide; GZMB exon 2; Set A
ucuucagagacuucugaucccagaucauaagaua

SEQ ID NO: 10389 - RNA, 30 nt, Artificial Sequence
  Synthetic Oligonucleotide; GZMB exon 2; Set A
uucagagacuucugaucccagaucauaaga

SEQ ID NO: 10390 - RNA, 15 nt, Artificial Sequence
  Synthetic Oligonucleotide; GZMB exon 2; Set C
agacuucugauccca

SEQ ID NO: 10391 - RNA, 16 nt, Artificial Sequence
  Synthetic Oligonucleotide; GZMB exon 2; Set C
gagacuucugauccca

SEQ ID NO: 10392 - RNA, 17 nt, Artificial Sequence
  Synthetic Oligonucleotide; GZMB exon 2; Set C
agagacuucugauccca

SEQ ID NO: 10393 - RNA, 19 nt, Artificial Sequence
  Synthetic Oligonucleotide; GZMB exon 2; Set C
cagagacuucugaucccag

SEQ ID NO: 10394 - RNA, 20 nt, Artificial Sequence
  Synthetic Oligonucleotide; GZMB exon 2; Set C
ucagagacuucugaucccag

SEQ ID NO: 10395 - RNA, 21 nt, Artificial Sequence
  Synthetic Oligonucleotide; GZMB exon 2; Set C
uucagagacuucugaucccag

SEQ ID NO: 10396 - RNA, 21 nt, Artificial Sequence
  Synthetic Oligonucleotide; GZMB exon 2; Set C
cuucagagacuucugauccca

SEQ ID NO: 10397 - RNA, 22 nt, Artificial Sequence
  Synthetic Oligonucleotide; GZMB exon 2; Set A
ucuucagagacuucugauccca

SEQ ID NO: 10398 - RNA, 27 nt, Artificial Sequence
  Synthetic Oligonucleotide; GZMB exon 2; Set C
gcaccucuucagagacuucugauccca

SEQ ID NO: 10399 - RNA, 36 nt, Artificial Sequence
  Synthetic Oligonucleotide; GZMB exon 2; Set C
gaagccaccgcaccucuucagagacuucugauccca

SEQ ID NO: 10400 - RNA, 37 nt, Artificial Sequence
  Synthetic Oligonucleotide; GZMB exon 2; Set C
ggaagccaccgcaccucuucagagacuucugauccca

SEQ ID NO: 10401 - RNA, 39 nt, Artificial Sequence
  Synthetic Oligonucleotide; GZMB exon 2; Set C
caggaagccaccgcaccucuucagagacuucugauccca

SEQ ID NO: 10402 - RNA, 40 nt, Artificial Sequence
  Synthetic Oligonucleotide; GZMB exon 2; Set C
ucaggaagccaccgcaccucuucagagacuucugauccca

SEQ ID NO: 10403 - RNA, 21 nt, Artificial Sequence
  Synthetic Oligonucleotide; GZMB exon 2; Set A
gaagccaccgcaccucuucag

SEQ ID NO: 10404 - RNA, 25 nt, Artificial Sequence
  Synthetic Oligonucleotide; GZMB exon 2; Set C
ucaggaagccaccgcaccucuucag

SEQ ID NO: 10405 - RNA, 27 nt, Artificial Sequence
  Synthetic Oligonucleotide; GZMB exon 2; Set C
uaucaggaagccaccgcaccucuucag

SEQ ID NO: 10406 - RNA, 26 nt, Artificial Sequence
  Synthetic Oligonucleotide; GZMB exon 2; Set C
uaucaggaagccaccgcaccucuuca

SEQ ID NO: 10407 - RNA, 28 nt, Artificial Sequence
  Synthetic Oligonucleotide; GZMB exon 2; Set C
guaucaggaagccaccgcaccucuucag

SEQ ID NO: 10408 - RNA, 25 nt, Artificial Sequence
  Synthetic Oligonucleotide; GZMB exon 2; Set C
uaucaggaagccaccgcaccucuuc

SEQ ID NO: 10409 - RNA, 27 nt, Artificial Sequence
  Synthetic Oligonucleotide; GZMB exon 2; Set C
guaucaggaagccaccgcaccucuuca

SEQ ID NO: 10410 - RNA, 26 nt, Artificial Sequence
  Synthetic Oligonucleotide; GZMB exon 2; Set C
guaucaggaagccaccgcaccucuuc

SEQ ID NO: 10411 - RNA, 37 nt, Artificial Sequence
  Synthetic Oligonucleotide; GZMB exon 2; Set C
cgucucguaucaggaagccaccgcaccucuucagaga

SEQ ID NO: 10412 - RNA, 38 nt, Artificial Sequence
  Synthetic Oligonucleotide; GZMB exon 2; Set C
ucgucucguaucaggaagccaccgcaccucuucagaga

SEQ ID NO: 10413 - RNA, 36 nt, Artificial Sequence
  Synthetic Oligonucleotide; GZMB exon 2; Set C
cgucucguaucaggaagccaccgcaccucuucagag

SEQ ID NO: 10414 - RNA, 39 nt, Artificial Sequence
  Synthetic Oligonucleotide; GZMB exon 2; Set C
gucgucucguaucaggaagccaccgcaccucuucagaga

SEQ ID NO: 10415 - RNA, 35 nt, Artificial Sequence
  Synthetic Oligonucleotide; GZMB exon 2; Set C
cgucucguaucaggaagccaccgcaccucuucaga

SEQ ID NO: 10416 - RNA, 37 nt, Artificial Sequence
  Synthetic Oligonucleotide; GZMB exon 2; Set C
ucgucucguaucaggaagccaccgcaccucuucagag

SEQ ID NO: 10417 - RNA, 34 nt, Artificial Sequence
  Synthetic Oligonucleotide; GZMB exon 2; Set C
cgucucguaucaggaagccaccgcaccucuucag

SEQ ID NO: 10418 - RNA, 36 nt, Artificial Sequence
  Synthetic Oligonucleotide; GZMB exon 2; Set C
ucgucucguaucaggaagccaccgcaccucuucaga

SEQ ID NO: 10419 - RNA, 38 nt, Artificial Sequence
  Synthetic Oligonucleotide; GZMB exon 2; Set C
gucgucucguaucaggaagccaccgcaccucuucagag

SEQ ID NO: 10420 - RNA, 33 nt, Artificial Sequence
  Synthetic Oligonucleotide; GZMB exon 2; Set C
cgucucguaucaggaagccaccgcaccucuuca

SEQ ID NO: 10421 - RNA, 35 nt, Artificial Sequence
  Synthetic Oligonucleotide; GZMB exon 2; Set C
ucgucucguaucaggaagccaccgcaccucuucag

SEQ ID NO: 10422 - RNA, 37 nt, Artificial Sequence
  Synthetic Oligonucleotide; GZMB exon 2; Set C
gucgucucguaucaggaagccaccgcaccucuucaga

SEQ ID NO: 10423 - RNA, 32 nt, Artificial Sequence
  Synthetic Oligonucleotide; GZMB exon 2; Set C
cgucucguaucaggaagccaccgcaccucuuc

SEQ ID NO: 10424 - RNA, 34 nt, Artificial Sequence
  Synthetic Oligonucleotide; GZMB exon 2; Set C
ucgucucguaucaggaagccaccgcaccucuuca

SEQ ID NO: 10425 - RNA, 36 nt, Artificial Sequence
  Synthetic Oligonucleotide; GZMB exon 2; Set C
gucgucucguaucaggaagccaccgcaccucuucag

SEQ ID NO: 10426 - RNA, 33 nt, Artificial Sequence
  Synthetic Oligonucleotide; GZMB exon 2; Set C
ucgucucguaucaggaagccaccgcaccucuuc

SEQ ID NO: 10427 - RNA, 35 nt, Artificial Sequence
  Synthetic Oligonucleotide; GZMB exon 2; Set C
gucgucucguaucaggaagccaccgcaccucuuca

SEQ ID NO: 10428 - RNA, 34 nt, Artificial Sequence
  Synthetic Oligonucleotide; GZMB exon 2; Set C
gucgucucguaucaggaagccaccgcaccucuuc

SEQ ID NO: 10429 - RNA, 32 nt, Artificial Sequence
  Synthetic Oligonucleotide; GZMB exon 2; Set C
ucgucucguaucaggaagccaccgcaccucuu

SEQ ID NO: 10430 - RNA, 33 nt, Artificial Sequence
  Synthetic Oligonucleotide; GZMB exon 2; Set C
gucgucucguaucaggaagccaccgcaccucuu

SEQ ID NO: 10431 - RNA, 32 nt, Artificial Sequence
  Synthetic Oligonucleotide; GZMB exon 2; Set C
gucgucucguaucaggaagccaccgcaccucu

SEQ ID NO: 10432 - RNA, 27 nt, Artificial Sequence
  Synthetic Oligonucleotide; GZMB exon 2; Set C
gucgucucguaucaggaagccaccgca

SEQ ID NO: 10433 - RNA, 16 nt, Artificial Sequence
  Synthetic Oligonucleotide; GZMB exon 2; Set C
cgucucguaucaggaa

SEQ ID NO: 10434 - RNA, 17 nt, Artificial Sequence
  Synthetic Oligonucleotide; GZMB exon 2; Set C
ucgucucguaucaggaa

SEQ ID NO: 10435 - RNA, 15 nt, Artificial Sequence
  Synthetic Oligonucleotide; GZMB exon 2; Set C
cgucucguaucagga

SEQ ID NO: 10436 - RNA, 18 nt, Artificial Sequence
  Synthetic Oligonucleotide; GZMB exon 2; Set C
gucgucucguaucaggaa

SEQ ID NO: 10437 - RNA, 16 nt, Artificial Sequence
  Synthetic Oligonucleotide; GZMB exon 2; Set C
ucgucucguaucagga

SEQ ID NO: 10438 - RNA, 17 nt, Artificial Sequence
  Synthetic Oligonucleotide; GZMB exon 2; Set C
gucgucucguaucagga

SEQ ID NO: 10439 - RNA, 15 nt, Artificial Sequence
  Synthetic Oligonucleotide; GZMB exon 2; Set C
gucgucucguaucag

SEQ ID NO: 10440 - RNA, 27 nt, Artificial Sequence
  Synthetic Oligonucleotide; GZMB exon 2; Set A
cagcacgaagucgucucguaucaggaa

SEQ ID NO: 10441 - RNA, 28 nt, Artificial Sequence
  Synthetic Oligonucleotide; GZMB exon 2; Set A
ucagcacgaagucgucucguaucaggaa

SEQ ID NO: 10442 - RNA, 26 nt, Artificial Sequence
  Synthetic Oligonucleotide; GZMB exon 2; Set C
cagcacgaagucgucucguaucagga

SEQ ID NO: 10443 - RNA, 29 nt, Artificial Sequence
  Synthetic Oligonucleotide; GZMB exon 2; Set C
gucagcacgaagucgucucguaucaggaa

SEQ ID NO: 10444 - RNA, 27 nt, Artificial Sequence
  Synthetic Oligonucleotide; GZMB exon 2; Set C
ucagcacgaagucgucucguaucagga

SEQ ID NO: 10445 - RNA, 30 nt, Artificial Sequence
  Synthetic Oligonucleotide; GZMB exon 2; Set C
ugucagcacgaagucgucucguaucaggaa

SEQ ID NO: 10446 - RNA, 28 nt, Artificial Sequence
  Synthetic Oligonucleotide; GZMB exon 2; Set C
gucagcacgaagucgucucguaucagga

SEQ ID NO: 10447 - RNA, 31 nt, Artificial Sequence
  Synthetic Oligonucleotide; GZMB exon 2; Set C
cugucagcacgaagucgucucguaucaggaa

SEQ ID NO: 10448 - RNA, 25 nt, Artificial Sequence
  Synthetic Oligonucleotide; GZMB exon 2; Set A
gucagcacgaagucgucucguauca

SEQ ID NO: 10449 - RNA, 23 nt, Artificial Sequence
  Synthetic Oligonucleotide; GZMB exon 2; Set A
gucagcacgaagucgucucguau

SEQ ID NO: 10450 - RNA, 38 nt, Artificial Sequence
  Synthetic Oligonucleotide; GZMB exon 2; Set C
ugagcagcugucagcacgaagucgucucguaucaggaa

SEQ ID NO: 10451 - RNA, 39 nt, Artificial Sequence
  Synthetic Oligonucleotide; GZMB exon 2; Set C
gugagcagcugucagcacgaagucgucucguaucaggaa

SEQ ID NO: 10452 - RNA, 40 nt, Artificial Sequence
  Synthetic Oligonucleotide; GZMB exon 2; Set C
agugagcagcugucagcacgaagucgucucguaucaggaa

SEQ ID NO: 10453 - RNA, 39 nt, Artificial Sequence
  Synthetic Oligonucleotide; GZMB exon 2; Set C
agugagcagcugucagcacgaagucgucucguaucagga

SEQ ID NO: 10454 - RNA, 40 nt, Artificial Sequence
  Synthetic Oligonucleotide; GZMB exon 2; Set C
cagugagcagcugucagcacgaagucgucucguaucagga

SEQ ID NO: 10455 - RNA, 37 nt, Artificial Sequence
  Synthetic Oligonucleotide; GZMB exon 2; Set C
agugagcagcugucagcacgaagucgucucguaucag

SEQ ID NO: 10456 - RNA, 36 nt, Artificial Sequence
  Synthetic Oligonucleotide; GZMB exon 2; Set C
agugagcagcugucagcacgaagucgucucguauca

SEQ ID NO: 10457 - RNA, 38 nt, Artificial Sequence
  Synthetic Oligonucleotide; GZMB exon 2; Set C
cagugagcagcugucagcacgaagucgucucguaucag

SEQ ID NO: 10458 - RNA, 19 nt, Artificial Sequence
  Synthetic Oligonucleotide; GZMB exon 2; Set B
gcugucagcacgaagucgu

SEQ ID NO: 10459 - RNA, 15 nt, Artificial Sequence
  Synthetic Oligonucleotide; GZMB exon 2; Set C
ugucagcacgaaguc

SEQ ID NO: 10460 - RNA, 37 nt, Artificial Sequence
  Synthetic Oligonucleotide; GZMB exon 2; Set C
cagugagcagcugucagcacgaagucgucucguauca

SEQ ID NO: 10461 - RNA, 20 nt, Artificial Sequence
  Synthetic Oligonucleotide; GZMB exon 2; Set B
agcugucagcacgaagucgu

SEQ ID NO: 10462 - RNA, 16 nt, Artificial Sequence
  Synthetic Oligonucleotide; GZMB exon 2; Set C
cugucagcacgaaguc

SEQ ID NO: 10463 - RNA, 18 nt, Artificial Sequence
  Synthetic Oligonucleotide; GZMB exon 2; Set C
gcugucagcacgaagucg

SEQ ID NO: 10464 - RNA, 34 nt, Artificial Sequence
  Synthetic Oligonucleotide; GZMB exon 2; Set C
agugagcagcugucagcacgaagucgucucguau

SEQ ID NO: 10465 - RNA, 38 nt, Artificial Sequence
  Synthetic Oligonucleotide; GZMB exon 2; Set C
acagugagcagcugucagcacgaagucgucucguauca

SEQ ID NO: 10466 - RNA, 21 nt, Artificial Sequence
  Synthetic Oligonucleotide; GZMB exon 2; Set B
cagcugucagcacgaagucgu

SEQ ID NO: 10467 - RNA, 19 nt, Artificial Sequence
  Synthetic Oligonucleotide; GZMB exon 2; Set C
agcugucagcacgaagucg

SEQ ID NO: 10468 - RNA, 17 nt, Artificial Sequence
  Synthetic Oligonucleotide; GZMB exon 2; Set C
gcugucagcacgaaguc

SEQ ID NO: 10469 - RNA, 35 nt, Artificial Sequence
  Synthetic Oligonucleotide; GZMB exon 2; Set C
cagugagcagcugucagcacgaagucgucucguau

SEQ ID NO: 10470 - RNA, 33 nt, Artificial Sequence
  Synthetic Oligonucleotide; GZMB exon 2; Set C
agugagcagcugucagcacgaagucgucucgua

SEQ ID NO: 10471 - RNA, 18 nt, Artificial Sequence
  Synthetic Oligonucleotide; GZMB exon 2; Set C
agcugucagcacgaaguc

SEQ ID NO: 10472 - RNA, 20 nt, Artificial Sequence
  Synthetic Oligonucleotide; GZMB exon 2; Set B
cagcugucagcacgaagucg

SEQ ID NO: 10473 - RNA, 36 nt, Artificial Sequence
  Synthetic Oligonucleotide; GZMB exon 2; Set C
acagugagcagcugucagcacgaagucgucucguau

SEQ ID NO: 10474 - RNA, 34 nt, Artificial Sequence
  Synthetic Oligonucleotide; GZMB exon 2; Set C
cagugagcagcugucagcacgaagucgucucgua

SEQ ID NO: 10475 - RNA, 19 nt, Artificial Sequence
  Synthetic Oligonucleotide; GZMB exon 2; Set C
cagcugucagcacgaaguc

SEQ ID NO: 10476 - RNA, 35 nt, Artificial Sequence
  Synthetic Oligonucleotide; GZMB exon 2; Set C
acagugagcagcugucagcacgaagucgucucgua

SEQ ID NO: 10477 - RNA, 24 nt, Artificial Sequence
  Synthetic Oligonucleotide; GZMB exon 2; Set C
gagcagcugucagcacgaagucgu

SEQ ID NO: 10478 - RNA, 29 nt, Artificial Sequence
  Synthetic Oligonucleotide; GZMB exon 2; Set C
caacagugagcagcugucagcacgaaguc

SEQ ID NO: 10479 - RNA, 16 nt, Artificial Sequence
  Synthetic Oligonucleotide; GZMB exon 2; Set C
caacagugagcagcug

SEQ ID NO: 10480 - RNA, 15 nt, Artificial Sequence
  Synthetic Oligonucleotide; GZMB exon 2; Set C
caacagugagcagcu

SEQ ID NO: 10481 - RNA, 38 nt, Artificial Sequence
  Synthetic Oligonucleotide; GZMB exon 2; Set C
ucugcuccucaccuuccccaacagugagcagcugucag

SEQ ID NO: 10482 - RNA, 37 nt, Artificial Sequence
  Synthetic Oligonucleotide; GZMB exon 2; Set C
ucugcuccucaccuuccccaacagugagcagcuguca

SEQ ID NO: 10483 - RNA, 39 nt, Artificial Sequence
  Synthetic Oligonucleotide; GZMB exon 2; Set C
uucugcuccucaccuuccccaacagugagcagcugucag

SEQ ID NO: 10484 - RNA, 38 nt, Artificial Sequence
  Synthetic Oligonucleotide; GZMB exon 2; Set C
uucugcuccucaccuuccccaacagugagcagcuguca

SEQ ID NO: 10485 - RNA, 36 nt, Artificial Sequence
  Synthetic Oligonucleotide; GZMB exon 2; Set C
ucugcuccucaccuuccccaacagugagcagcuguc

SEQ ID NO: 10486 - RNA, 37 nt, Artificial Sequence
  Synthetic Oligonucleotide; GZMB exon 2; Set C
uucugcuccucaccuuccccaacagugagcagcuguc

SEQ ID NO: 10487 - RNA, 38 nt, Artificial Sequence
  Synthetic Oligonucleotide; GZMB exon 2; Set C
uuucugcuccucaccuuccccaacagugagcagcuguc

SEQ ID NO: 10488 - RNA, 40 nt, Artificial Sequence
  Synthetic Oligonucleotide; GZMB exon 2; Set C
uuuucugcuccucaccuuccccaacagugagcagcuguca

SEQ ID NO: 10489 - RNA, 39 nt, Artificial Sequence
  Synthetic Oligonucleotide; GZMB exon 2; Set C
uuuucugcuccucaccuuccccaacagugagcagcuguc

SEQ ID NO: 10490 - RNA, 37 nt, Artificial Sequence
  Synthetic Oligonucleotide; GZMB exon 2; Set C
uuucugcuccucaccuuccccaacagugagcagcugu

SEQ ID NO: 10491 - RNA, 40 nt, Artificial Sequence
  Synthetic Oligonucleotide; GZMB exon 2; Set C
guuuucugcuccucaccuuccccaacagugagcagcuguc

SEQ ID NO: 10492 - RNA, 38 nt, Artificial Sequence
  Synthetic Oligonucleotide; GZMB exon 2; Set C
uuuucugcuccucaccuuccccaacagugagcagcugu

SEQ ID NO: 10493 - RNA, 36 nt, Artificial Sequence
  Synthetic Oligonucleotide; GZMB exon 2; Set C
uuucugcuccucaccuuccccaacagugagcagcug

SEQ ID NO: 10494 - RNA, 37 nt, Artificial Sequence
  Synthetic Oligonucleotide; GZMB exon 2; Set C
uuuucugcuccucaccuuccccaacagugagcagcug

SEQ ID NO: 10495 - RNA, 29 nt, Artificial Sequence
  Synthetic Oligonucleotide; GZMB exon 2; Set C
uuucugcuccucaccuuccccaacaguga

SEQ ID NO: 10496 - RNA, 27 nt, Artificial Sequence
  Synthetic Oligonucleotide; GZMB exon 2; Set C
uuucugcuccucaccuuccccaacagu

SEQ ID NO: 10497 - RNA, 28 nt, Artificial Sequence
  Synthetic Oligonucleotide; GZMB exon 2; Set C
uuuucugcuccucaccuuccccaacagu

SEQ ID NO: 10498 - RNA, 26 nt, Artificial Sequence
  Synthetic Oligonucleotide; GZMB exon 2; Set C
uuucugcuccucaccuuccccaacag

SEQ ID NO: 10499 - RNA, 27 nt, Artificial Sequence
  Synthetic Oligonucleotide; GZMB exon 2; Set C
uuuucugcuccucaccuuccccaacag

SEQ ID NO: 10500 - RNA, 39 nt, Artificial Sequence
  Synthetic Oligonucleotide; GZMB exon 2; Set C
ugugggcuguuuucugcuccucaccuuccccaacaguga

SEQ ID NO: 10501 - RNA, 37 nt, Artificial Sequence
  Synthetic Oligonucleotide; GZMB exon 2; Set C
ugugggcuguuuucugcuccucaccuuccccaacagu

SEQ ID NO: 10502 - RNA, 36 nt, Artificial Sequence
  Synthetic Oligonucleotide; GZMB exon 2; Set C
ugugggcuguuuucugcuccucaccuuccccaacag

SEQ ID NO: 10503 - RNA, 26 nt, Artificial Sequence
  Synthetic Oligonucleotide; GZMB exon 2; Set C
uuccaggagggugugggcuguuuucu

SEQ ID NO: 10504 - RNA, 27 nt, Artificial Sequence
  Synthetic Oligonucleotide; GZMB exon 2; Set C
uuuccaggagggugugggcuguuuucu

SEQ ID NO: 10505 - RNA, 25 nt, Artificial Sequence
  Synthetic Oligonucleotide; GZMB exon 2; Set C
uuccaggagggugugggcuguuuuc

SEQ ID NO: 10506 - RNA, 26 nt, Artificial Sequence
  Synthetic Oligonucleotide; GZMB exon 2; Set C
uuuccaggagggugugggcuguuuuc

SEQ ID NO: 10507 - RNA, 23 nt, Artificial Sequence
  Synthetic Oligonucleotide; GZMB exon 2; Set C
uuccaggagggugugggcuguuu

SEQ ID NO: 10508 - RNA, 27 nt, Artificial Sequence
  Synthetic Oligonucleotide; GZMB exon 2; Set C
guuuccaggagggugugggcuguuuuc

SEQ ID NO: 10509 - RNA, 22 nt, Artificial Sequence
  Synthetic Oligonucleotide; GZMB exon 2; Set C
uuccaggagggugugggcuguu

SEQ ID NO: 10510 - RNA, 23 nt, Artificial Sequence
  Synthetic Oligonucleotide; GZMB exon 2; Set C
uuuccaggagggugugggcuguu

SEQ ID NO: 10511 - RNA, 21 nt, Artificial Sequence
  Synthetic Oligonucleotide; GZMB exon 2; Set C
uuccaggagggugugggcugu

SEQ ID NO: 10512 - RNA, 24 nt, Artificial Sequence
  Synthetic Oligonucleotide; GZMB exon 2; Set C
guuuccaggagggugugggcuguu

SEQ ID NO: 10513 - RNA, 22 nt, Artificial Sequence
  Synthetic Oligonucleotide; GZMB exon 2; Set C
uuuccaggagggugugggcugu

SEQ ID NO: 10514 - RNA, 25 nt, Artificial Sequence
  Synthetic Oligonucleotide; GZMB exon 2; Set C
uguuuccaggagggugugggcuguu

SEQ ID NO: 10515 - RNA, 23 nt, Artificial Sequence
  Synthetic Oligonucleotide; GZMB exon 2; Set C
guuuccaggagggugugggcugu

SEQ ID NO: 10516 - RNA, 24 nt, Artificial Sequence
  Synthetic Oligonucleotide; GZMB exon 2; Set C
uguuuccaggagggugugggcugu

SEQ ID NO: 10517 - RNA, 26 nt, Artificial Sequence
  Synthetic Oligonucleotide; GZMB exon 2; Set C
guguuuccaggagggugugggcuguu

SEQ ID NO: 10518 - RNA, 25 nt, Artificial Sequence
  Synthetic Oligonucleotide; GZMB exon 2; Set C
guguuuccaggagggugugggcugu

SEQ ID NO: 10519 - RNA, 15 nt, Artificial Sequence
  Synthetic Oligonucleotide; GZMB exon 2; Set C
uuccaggagggugug

SEQ ID NO: 10520 - RNA, 16 nt, Artificial Sequence
  Synthetic Oligonucleotide; GZMB exon 2; Set C
uuuccaggagggugug

SEQ ID NO: 10521 - RNA, 18 nt, Artificial Sequence
  Synthetic Oligonucleotide; GZMB exon 2; Set C
guuuccaggagggugugg

SEQ ID NO: 10522 - RNA, 15 nt, Artificial Sequence
  Synthetic Oligonucleotide; GZMB exon 2; Set C
uuuccaggagggugu

SEQ ID NO: 10523 - RNA, 17 nt, Artificial Sequence
  Synthetic Oligonucleotide; GZMB exon 2; Set C
guuuccaggagggugug

SEQ ID NO: 10524 - RNA, 19 nt, Artificial Sequence
  Synthetic Oligonucleotide; GZMB exon 2; Set B
uguuuccaggagggugugg

SEQ ID NO: 10525 - RNA, 18 nt, Artificial Sequence
  Synthetic Oligonucleotide; GZMB exon 2; Set C
uguuuccaggagggugug

SEQ ID NO: 10526 - RNA, 20 nt, Artificial Sequence
  Synthetic Oligonucleotide; GZMB exon 2; Set B
guguuuccaggagggugugg

SEQ ID NO: 10527 - RNA, 19 nt, Artificial Sequence
  Synthetic Oligonucleotide; GZMB exon 2; Set B
guguuuccaggagggugug

SEQ ID NO: 10528 - RNA, 39 nt, Artificial Sequence
  Synthetic Oligonucleotide; GZMB exon 2; Set C
gucucuguggaguguuuccaggagggugugggcuguuuu

SEQ ID NO: 10529 - RNA, 38 nt, Artificial Sequence
  Synthetic Oligonucleotide; GZMB exon 2; Set C
gucucuguggaguguuuccaggagggugugggcuguuu

SEQ ID NO: 10530 - RNA, 22 nt, Artificial Sequence
  Synthetic Oligonucleotide; GZMB exon 2; Set C
ugcugggugggcaccugcuuag

SEQ ID NO: 10531 - RNA, 21 nt, Artificial Sequence
  Synthetic Oligonucleotide; GZMB exon 2; Set C
ugcugggugggcaccugcuua

SEQ ID NO: 10532 - RNA, 22 nt, Artificial Sequence
  Synthetic Oligonucleotide; GZMB exon 2; Set C
cugcugggugggcaccugcuua

SEQ ID NO: 10533 - RNA, 23 nt, Artificial Sequence
  Synthetic Oligonucleotide; GZMB exon 2; Set C
ucugcugggugggcaccugcuua

SEQ ID NO: 10534 - RNA, 15 nt, Artificial Sequence
  Synthetic Oligonucleotide; GZMB exon 2; Set C
aaucugcuggguggg

SEQ ID NO: 10535 - RNA, 16 nt, Artificial Sequence
  Synthetic Oligonucleotide; GZMB exon 2; Set C
gaaucugcuggguggg

SEQ ID NO: 10536 - RNA, 17 nt, Artificial Sequence
  Synthetic Oligonucleotide; GZMB exon 2; Set C
ggaaucugcuggguggg

SEQ ID NO: 10537 - RNA, 18 nt, Artificial Sequence
  Synthetic Oligonucleotide; GZMB exon 2; Set A
uggaaucugcuggguggg

SEQ ID NO: 10538 - RNA, 25 nt, Artificial Sequence
  Synthetic Oligonucleotide; GZMB exon 2; Set C
ucugcuugugggcacccauggaauc

SEQ ID NO: 10539 - RNA, 35 nt, Artificial Sequence
  Synthetic Oligonucleotide; GZMB exon 2; Set C
gucugucugcuugugggcacccauggaaucugcug

SEQ ID NO: 10540 - RNA, 24 nt, Artificial Sequence
  Synthetic Oligonucleotide; GZMB exon 2; Set C
ucugcuugugggcacccauggaau

SEQ ID NO: 10541 - RNA, 34 nt, Artificial Sequence
  Synthetic Oligonucleotide; GZMB exon 2; Set C
gucugucugcuugugggcacccauggaaucugcu

SEQ ID NO: 10542 - RNA, 36 nt, Artificial Sequence
  Synthetic Oligonucleotide; GZMB exon 2; Set C
agucugucugcuugugggcacccauggaaucugcug

SEQ ID NO: 10543 - RNA, 25 nt, Artificial Sequence
  Synthetic Oligonucleotide; GZMB exon 2; Set C
gucugcuugugggcacccauggaau

SEQ ID NO: 10544 - RNA, 23 nt, Artificial Sequence
  Synthetic Oligonucleotide; GZMB exon 2; Set C
ucugcuugugggcacccauggaa

SEQ ID NO: 10545 - RNA, 35 nt, Artificial Sequence
  Synthetic Oligonucleotide; GZMB exon 2; Set C
agucugucugcuugugggcacccauggaaucugcu

SEQ ID NO: 10546 - RNA, 37 nt, Artificial Sequence
  Synthetic Oligonucleotide; GZMB exon 2; Set C
aagucugucugcuugugggcacccauggaaucugcug

SEQ ID NO: 10547 - RNA, 22 nt, Artificial Sequence
  Synthetic Oligonucleotide; GZMB exon 2; Set C
ucugcuugugggcacccaugga

SEQ ID NO: 10548 - RNA, 24 nt, Artificial Sequence
  Synthetic Oligonucleotide; GZMB exon 2; Set C
gucugcuugugggcacccauggaa

SEQ ID NO: 10549 - RNA, 36 nt, Artificial Sequence
  Synthetic Oligonucleotide; GZMB exon 2; Set C
aagucugucugcuugugggcacccauggaaucugcu

SEQ ID NO: 10550 - RNA, 38 nt, Artificial Sequence
  Synthetic Oligonucleotide; GZMB exon 2; Set C
aaagucugucugcuugugggcacccauggaaucugcug

SEQ ID NO: 10551 - RNA, 23 nt, Artificial Sequence
  Synthetic Oligonucleotide; GZMB exon 2; Set C
gucugcuugugggcacccaugga

SEQ ID NO: 10552 - RNA, 21 nt, Artificial Sequence
  Synthetic Oligonucleotide; GZMB exon 2; Set C
ucugcuugugggcacccaugg

SEQ ID NO: 10553 - RNA, 25 nt, Artificial Sequence
  Synthetic Oligonucleotide; GZMB exon 2; Set C
ugucugcuugugggcacccauggaa

SEQ ID NO: 10554 - RNA, 37 nt, Artificial Sequence
  Synthetic Oligonucleotide; GZMB exon 2; Set C
aaagucugucugcuugugggcacccauggaaucugcu

SEQ ID NO: 10555 - RNA, 39 nt, Artificial Sequence
  Synthetic Oligonucleotide; GZMB exon 2; Set C
aaaagucugucugcuugugggcacccauggaaucugcug

SEQ ID NO: 10556 - RNA, 22 nt, Artificial Sequence
  Synthetic Oligonucleotide; GZMB exon 2; Set C
gucugcuugugggcacccaugg

SEQ ID NO: 10557 - RNA, 24 nt, Artificial Sequence
  Synthetic Oligonucleotide; GZMB exon 2; Set C
ugucugcuugugggcacccaugga

SEQ ID NO: 10558 - RNA, 38 nt, Artificial Sequence
  Synthetic Oligonucleotide; GZMB exon 2; Set C
aaaagucugucugcuugugggcacccauggaaucugcu

SEQ ID NO: 10559 - RNA, 40 nt, Artificial Sequence
  Synthetic Oligonucleotide; GZMB exon 2; Set C
gaaaagucugucugcuugugggcacccauggaaucugcug

SEQ ID NO: 10560 - RNA, 25 nt, Artificial Sequence
  Synthetic Oligonucleotide; GZMB exon 2; Set C
cugucugcuugugggcacccaugga

SEQ ID NO: 10561 - RNA, 23 nt, Artificial Sequence
  Synthetic Oligonucleotide; GZMB exon 2; Set C
ugucugcuugugggcacccaugg

SEQ ID NO: 10562 - RNA, 39 nt, Artificial Sequence
  Synthetic Oligonucleotide; GZMB exon 2; Set C
gaaaagucugucugcuugugggcacccauggaaucugcu

SEQ ID NO: 10563 - RNA, 24 nt, Artificial Sequence
  Synthetic Oligonucleotide; GZMB exon 2; Set C
cugucugcuugugggcacccaugg

SEQ ID NO: 10564 - RNA, 40 nt, Artificial Sequence
  Synthetic Oligonucleotide; GZMB exon 2; Set C
ggaaaagucugucugcuugugggcacccauggaaucugcu

SEQ ID NO: 10565 - RNA, 25 nt, Artificial Sequence
  Synthetic Oligonucleotide; GZMB exon 2; Set C
ucugucugcuugugggcacccaugg

SEQ ID NO: 10566 - RNA, 30 nt, Artificial Sequence
  Synthetic Oligonucleotide; GZMB exon 2; Set A
ucuccccugaaggaaaagucugucugcuug

SEQ ID NO: 10567 - RNA, 29 nt, Artificial Sequence
  Synthetic Oligonucleotide; GZMB exon 2; Set A
ucuccccugaaggaaaagucugucugcuu

SEQ ID NO: 10568 - RNA, 30 nt, Artificial Sequence
  Synthetic Oligonucleotide; GZMB exon 2; Set A
aucuccccugaaggaaaagucugucugcuu

SEQ ID NO: 10569 - RNA, 28 nt, Artificial Sequence
  Synthetic Oligonucleotide; GZMB exon 2; Set A
ucuccccugaaggaaaagucugucugcu

SEQ ID NO: 10570 - RNA, 29 nt, Artificial Sequence
  Synthetic Oligonucleotide; GZMB exon 2; Set A
aucuccccugaaggaaaagucugucugcu

SEQ ID NO: 10571 - RNA, 27 nt, Artificial Sequence
  Synthetic Oligonucleotide; GZMB exon 2; Set A
ucuccccugaaggaaaagucugucugc

SEQ ID NO: 10572 - RNA, 26 nt, Artificial Sequence
  Synthetic Oligonucleotide; GZMB exon 2; Set A
ucuccccugaaggaaaagucugucug

SEQ ID NO: 10573 - RNA, 28 nt, Artificial Sequence
  Synthetic Oligonucleotide; GZMB exon 2; Set A
aucuccccugaaggaaaagucugucugc

SEQ ID NO: 10574 - RNA, 27 nt, Artificial Sequence
  Synthetic Oligonucleotide; GZMB exon 2; Set A
aucuccccugaaggaaaagucugucug

SEQ ID NO: 10575 - RNA, 34 nt, Artificial Sequence
  Synthetic Oligonucleotide; GZMB exon 2; Set C
gaugaucuccccugaaggaaaagucugucugcuu

SEQ ID NO: 10576 - RNA, 33 nt, Artificial Sequence
  Synthetic Oligonucleotide; GZMB exon 2; Set C
gaugaucuccccugaaggaaaagucugucugcu

SEQ ID NO: 10577 - RNA, 32 nt, Artificial Sequence
  Synthetic Oligonucleotide; GZMB exon 2; Set A
gaugaucuccccugaaggaaaagucugucugc

SEQ ID NO: 10578 - RNA, 31 nt, Artificial Sequence
  Synthetic Oligonucleotide; GZMB exon 2; Set A
gaugaucuccccugaaggaaaagucugucug

SEQ ID NO: 10579 - RNA, 16 nt, Artificial Sequence
  Synthetic Oligonucleotide; GZMB exon 2; Set C
ucuccccugaaggaaa

SEQ ID NO: 10580 - RNA, 15 nt, Artificial Sequence
  Synthetic Oligonucleotide; GZMB exon 2; Set C
ucuccccugaaggaa

SEQ ID NO: 10581 - RNA, 40 nt, Artificial Sequence
  Synthetic Oligonucleotide; GZMB exon 2; Set C
ugucccccgaugaucuccccugaaggaaaagucugucugc

SEQ ID NO: 10582 - RNA, 15 nt, Artificial Sequence
  Synthetic Oligonucleotide; GZMB exon 2; Set C
aucuccccugaagga

SEQ ID NO: 10583 - RNA, 39 nt, Artificial Sequence
  Synthetic Oligonucleotide; GZMB exon 2; Set C
ugucccccgaugaucuccccugaaggaaaagucugucug

SEQ ID NO: 10584 - RNA, 23 nt, Artificial Sequence
  Synthetic Oligonucleotide; GZMB exon 2; Set C
ugucccccgaugaucuccccuga

SEQ ID NO: 10585 - RNA, 22 nt, Artificial Sequence
  Synthetic Oligonucleotide; GZMB exon 2; Set C
ugucccccgaugaucuccccug

SEQ ID NO: 10586 - RNA, 38 nt, Artificial Sequence
  Synthetic Oligonucleotide; GZMB exon 2; Set C
uuggccucaugucccccgaugaucuccccugaaggaaa

SEQ ID NO: 10587 - RNA, 37 nt, Artificial Sequence
  Synthetic Oligonucleotide; GZMB exon 2; Set C
uuggccucaugucccccgaugaucuccccugaaggaa

SEQ ID NO: 10588 - RNA, 36 nt, Artificial Sequence
  Synthetic Oligonucleotide; GZMB exon 2; Set C
uuggccucaugucccccgaugaucuccccugaagga

SEQ ID NO: 10589 - RNA, 35 nt, Artificial Sequence
  Synthetic Oligonucleotide; GZMB exon 2; Set C
uuggccucaugucccccgaugaucuccccugaagg

SEQ ID NO: 10590 - RNA, 34 nt, Artificial Sequence
  Synthetic Oligonucleotide; GZMB exon 2; Set C
uuggccucaugucccccgaugaucuccccugaag

SEQ ID NO: 10591 - RNA, 16 nt, Artificial Sequence
  Synthetic Oligonucleotide; GZMB exon 2; Set C
ugucccccgaugaucu

SEQ ID NO: 10592 - RNA, 33 nt, Artificial Sequence
  Synthetic Oligonucleotide; GZMB exon 2; Set C
uuggccucaugucccccgaugaucuccccugaa

SEQ ID NO: 10593 - RNA, 15 nt, Artificial Sequence
  Synthetic Oligonucleotide; GZMB exon 2; Set C
ugucccccgaugauc

SEQ ID NO: 10594 - RNA, 32 nt, Artificial Sequence
  Synthetic Oligonucleotide; GZMB exon 2; Set C
uuggccucaugucccccgaugaucuccccuga

SEQ ID NO: 10595 - RNA, 23 nt, Artificial Sequence
  Synthetic Oligonucleotide; GZMB exon 2; Set C
uuggccucaugucccccgaugau

SEQ ID NO: 10596 - RNA, 22 nt, Artificial Sequence
  Synthetic Oligonucleotide; GZMB exon 2; Set C
uuggccucaugucccccgauga

SEQ ID NO: 10597 - RNA, 21 nt, Artificial Sequence
  Synthetic Oligonucleotide; GZMB exon 2; Set A
uuggccucaugucccccgaug

SEQ ID NO: 10598 - RNA, 39 nt, Artificial Sequence
  Synthetic Oligonucleotide; GZMB exon 2; Set C
gggcgggaguggggcuuggccucaugucccccgaugauc

SEQ ID NO: 10599 - RNA, 38 nt, Artificial Sequence
  Synthetic Oligonucleotide; GZMB exon 2; Set C
gggcgggaguggggcuuggccucaugucccccgaugau

SEQ ID NO: 10600 - RNA, 40 nt, Artificial Sequence
  Synthetic Oligonucleotide; GZMB exon 2; Set C
ggggcgggaguggggcuuggccucaugucccccgaugauc

SEQ ID NO: 10601 - RNA, 39 nt, Artificial Sequence
  Synthetic Oligonucleotide; GZMB exon 2; Set C
ggggcgggaguggggcuuggccucaugucccccgaugau

SEQ ID NO: 10602 - RNA, 37 nt, Artificial Sequence
  Synthetic Oligonucleotide; GZMB exon 2; Set C
gggcgggaguggggcuuggccucaugucccccgauga

SEQ ID NO: 10603 - RNA, 38 nt, Artificial Sequence
  Synthetic Oligonucleotide; GZMB exon 2; Set C
ggggcgggaguggggcuuggccucaugucccccgauga

SEQ ID NO: 10604 - RNA, 36 nt, Artificial Sequence
  Synthetic Oligonucleotide; GZMB exon 2; Set C
gggcgggaguggggcuuggccucaugucccccgaug

SEQ ID NO: 10605 - RNA, 39 nt, Artificial Sequence
  Synthetic Oligonucleotide; GZMB exon 2; Set C
aggggcgggaguggggcuuggccucaugucccccgauga

SEQ ID NO: 10606 - RNA, 37 nt, Artificial Sequence
  Synthetic Oligonucleotide; GZMB exon 2; Set C
ggggcgggaguggggcuuggccucaugucccccgaug

SEQ ID NO: 10607 - RNA, 38 nt, Artificial Sequence
  Synthetic Oligonucleotide; GZMB exon 2; Set C
aggggcgggaguggggcuuggccucaugucccccgaug

SEQ ID NO: 10608 - RNA, 36 nt, Artificial Sequence
  Synthetic Oligonucleotide; GZMB exon 2; Set C
ggggcgggaguggggcuuggccucaugucccccgau

SEQ ID NO: 10609 - RNA, 37 nt, Artificial Sequence
  Synthetic Oligonucleotide; GZMB exon 2; Set C
aggggcgggaguggggcuuggccucaugucccccgau

SEQ ID NO: 10610 - RNA, 38 nt, Artificial Sequence
  Synthetic Oligonucleotide; GZMB exon 2; Set C
uaggggcgggaguggggcuuggccucaugucccccgau

SEQ ID NO: 10611 - RNA, 39 nt, Artificial Sequence
  Synthetic Oligonucleotide; GZMB exon 2; Set C
guaggggcgggaguggggcuuggccucaugucccccgau

SEQ ID NO: 10612 - RNA, 40 nt, Artificial Sequence
  Synthetic Oligonucleotide; GZMB exon 2; Set C
uguaggggcgggaguggggcuuggccucaugucccccgau

SEQ ID NO: 10613 - RNA, 15 nt, Artificial Sequence
  Synthetic Oligonucleotide; GZMB exon 2; Set C
uaggggcgggagugg

SEQ ID NO: 10614 - RNA, 16 nt, Artificial Sequence
  Synthetic Oligonucleotide; GZMB exon 2; Set A
guaggggcgggagugg

SEQ ID NO: 10615 - RNA, 17 nt, Artificial Sequence
  Synthetic Oligonucleotide; GZMB exon 2; Set A
uguaggggcgggagugg

SEQ ID NO: 10616 - RNA, 15 nt, Artificial Sequence
  Synthetic Oligonucleotide; GZMB exon 2; Set C
guaggggcgggagug

SEQ ID NO: 10617 - RNA, 18 nt, Artificial Sequence
  Synthetic Oligonucleotide; GZMB exon 2; Set A
auguaggggcgggagugg

SEQ ID NO: 10618 - RNA, 16 nt, Artificial Sequence
  Synthetic Oligonucleotide; GZMB exon 2; Set A
uguaggggcgggagug

SEQ ID NO: 10619 - RNA, 17 nt, Artificial Sequence
  Synthetic Oligonucleotide; GZMB exon 2; Set A
auguaggggcgggagug

SEQ ID NO: 10620 - RNA, 32 nt, Artificial Sequence
  Synthetic Oligonucleotide; GZMB exon 2; Set C
gauaagccauguaggggcgggaguggggcuug

SEQ ID NO: 10621 - RNA, 33 nt, Artificial Sequence
  Synthetic Oligonucleotide; GZMB exon 2; Set C
agauaagccauguaggggcgggaguggggcuug

SEQ ID NO: 10622 - RNA, 17 nt, Artificial Sequence
  Synthetic Oligonucleotide; GZMB exon 2; Set C
gauaagccauguagggg

SEQ ID NO: 10623 - RNA, 16 nt, Artificial Sequence
  Synthetic Oligonucleotide; GZMB exon 2; Set C
gauaagccauguaggg

SEQ ID NO: 10624 - RNA, 15 nt, Artificial Sequence
  Synthetic Oligonucleotide; GZMB exon 2; Set C
gauaagccauguagg

SEQ ID NO: 10625 - RNA, 37 nt, Artificial Sequence
  Synthetic Oligonucleotide; GZMB exon 2; Set C
ccagaucauaagauaagccauguaggggcgggagugg

SEQ ID NO: 10626 - RNA, 35 nt, Artificial Sequence
  Synthetic Oligonucleotide; GZMB exon 2; Set C
ccagaucauaagauaagccauguaggggcgggagu

SEQ ID NO: 10627 - RNA, 34 nt, Artificial Sequence
  Synthetic Oligonucleotide; GZMB exon 2; Set C
ccagaucauaagauaagccauguaggggcgggag

SEQ ID NO: 10628 - RNA, 33 nt, Artificial Sequence
  Synthetic Oligonucleotide; GZMB exon 2; Set C
ccagaucauaagauaagccauguaggggcggga

SEQ ID NO: 10629 - RNA, 32 nt, Artificial Sequence
  Synthetic Oligonucleotide; GZMB exon 2; Set C
ccagaucauaagauaagccauguaggggcggg

SEQ ID NO: 10630 - RNA, 29 nt, Artificial Sequence
  Synthetic Oligonucleotide; GZMB exon 2; Set A
cccagaucauaagauaagccauguagggg

SEQ ID NO: 10631 - RNA, 28 nt, Artificial Sequence
  Synthetic Oligonucleotide; GZMB exon 2; Set A
cccagaucauaagauaagccauguaggg

SEQ ID NO: 10632 - RNA, 27 nt, Artificial Sequence
  Synthetic Oligonucleotide; GZMB exon 2; Set A
cccagaucauaagauaagccauguagg

SEQ ID NO: 10633 - RNA, 22 nt, Artificial Sequence
  Synthetic Oligonucleotide; GZMB exon 2; Set C
cagaucauaagauaagccaugu

SEQ ID NO: 10634 - RNA, 26 nt, Artificial Sequence
  Synthetic Oligonucleotide; GZMB exon 2; Set C
cccagaucauaagauaagccauguag

SEQ ID NO: 10635 - RNA, 25 nt, Artificial Sequence
  Synthetic Oligonucleotide; GZMB exon 2; Set C
cccagaucauaagauaagccaugua

SEQ ID NO: 10636 - RNA, 21 nt, Artificial Sequence
  Synthetic Oligonucleotide; GZMB exon 2; Set C
cagaucauaagauaagccaug

SEQ ID NO: 10637 - RNA, 24 nt, Artificial Sequence
  Synthetic Oligonucleotide; GZMB exon 2; Set C
cccagaucauaagauaagccaugu

SEQ ID NO: 10638 - RNA, 23 nt, Artificial Sequence
  Synthetic Oligonucleotide; GZMB exon 2; Set C
cccagaucauaagauaagccaug

SEQ ID NO: 10639 - RNA, 38 nt, Artificial Sequence
  Synthetic Oligonucleotide; GZMB exon 2; Set C
acuucugaucccagaucauaagauaagccauguagggg

SEQ ID NO: 10640 - RNA, 37 nt, Artificial Sequence
  Synthetic Oligonucleotide; GZMB exon 2; Set C
acuucugaucccagaucauaagauaagccauguaggg

SEQ ID NO: 10641 - RNA, 39 nt, Artificial Sequence
  Synthetic Oligonucleotide; GZMB exon 2; Set C
gacuucugaucccagaucauaagauaagccauguagggg

SEQ ID NO: 10642 - RNA, 36 nt, Artificial Sequence
  Synthetic Oligonucleotide; GZMB exon 2; Set A
acuucugaucccagaucauaagauaagccauguagg

SEQ ID NO: 10643 - RNA, 38 nt, Artificial Sequence
  Synthetic Oligonucleotide; GZMB exon 2; Set C
gacuucugaucccagaucauaagauaagccauguaggg

SEQ ID NO: 10644 - RNA, 35 nt, Artificial Sequence
  Synthetic Oligonucleotide; GZMB exon 2; Set A
acuucugaucccagaucauaagauaagccauguag

SEQ ID NO: 10645 - RNA, 37 nt, Artificial Sequence
  Synthetic Oligonucleotide; GZMB exon 2; Set C
gacuucugaucccagaucauaagauaagccauguagg

SEQ ID NO: 10646 - RNA, 34 nt, Artificial Sequence
  Synthetic Oligonucleotide; GZMB exon 2; Set A
acuucugaucccagaucauaagauaagccaugua

SEQ ID NO: 10647 - RNA, 36 nt, Artificial Sequence
  Synthetic Oligonucleotide; GZMB exon 2; Set A
gacuucugaucccagaucauaagauaagccauguag

SEQ ID NO: 10648 - RNA, 40 nt, Artificial Sequence
  Synthetic Oligonucleotide; GZMB exon 2; Set C
gagacuucugaucccagaucauaagauaagccauguaggg

SEQ ID NO: 10649 - RNA, 16 nt, Artificial Sequence
  Synthetic Oligonucleotide; GZMB exon 2; Set C
cccagaucauaagaua

SEQ ID NO: 10650 - RNA, 35 nt, Artificial Sequence
  Synthetic Oligonucleotide; GZMB exon 2; Set A
gacuucugaucccagaucauaagauaagccaugua

SEQ ID NO: 10651 - RNA, 33 nt, Artificial Sequence
  Synthetic Oligonucleotide; GZMB exon 2; Set A
acuucugaucccagaucauaagauaagccaugu

SEQ ID NO: 10652 - RNA, 34 nt, Artificial Sequence
  Synthetic Oligonucleotide; GZMB exon 2; Set A
gacuucugaucccagaucauaagauaagccaugu

SEQ ID NO: 10653 - RNA, 32 nt, Artificial Sequence
  Synthetic Oligonucleotide; GZMB exon 2; Set A
acuucugaucccagaucauaagauaagccaug

SEQ ID NO: 10654 - RNA, 33 nt, Artificial Sequence
  Synthetic Oligonucleotide; GZMB exon 2; Set A
gacuucugaucccagaucauaagauaagccaug

SEQ ID NO: 10655 - RNA, 36 nt, Artificial Sequence
  Synthetic Oligonucleotide; GZMB exon 2; Set C
gagacuucugaucccagaucauaagauaagccaugu

SEQ ID NO: 10656 - RNA, 34 nt, Artificial Sequence
  Synthetic Oligonucleotide; GZMB exon 2; Set A
agacuucugaucccagaucauaagauaagccaug

SEQ ID NO: 10657 - RNA, 35 nt, Artificial Sequence
  Synthetic Oligonucleotide; GZMB exon 2; Set A
gagacuucugaucccagaucauaagauaagccaug

SEQ ID NO: 10658 - RNA, 36 nt, Artificial Sequence
  Synthetic Oligonucleotide; GZMB exon 2; Set A
agagacuucugaucccagaucauaagauaagccaug

SEQ ID NO: 10659 - RNA, 25 nt, Artificial Sequence
  Synthetic Oligonucleotide; GZMB exon 2; Set C
acuucugaucccagaucauaagaua

SEQ ID NO: 10660 - RNA, 26 nt, Artificial Sequence
  Synthetic Oligonucleotide; GZMB exon 2; Set A
gacuucugaucccagaucauaagaua

SEQ ID NO: 10661 - RNA, 27 nt, Artificial Sequence
  Synthetic Oligonucleotide; GZMB exon 2; Set A
agacuucugaucccagaucauaagaua

SEQ ID NO: 10662 - RNA, 28 nt, Artificial Sequence
  Synthetic Oligonucleotide; GZMB exon 2; Set A
gagacuucugaucccagaucauaagaua

SEQ ID NO: 10663 - RNA, 29 nt, Artificial Sequence
  Synthetic Oligonucleotide; GZMB exon 2; Set A
agagacuucugaucccagaucauaagaua

SEQ ID NO: 10664 - RNA, 28 nt, Artificial Sequence
  Synthetic Oligonucleotide; GZMB exon 2; Set A
agagacuucugaucccagaucauaagau

SEQ ID NO: 10665 - RNA, 29 nt, Artificial Sequence
  Synthetic Oligonucleotide; GZMB exon 2; Set A
cagagacuucugaucccagaucauaagau

SEQ ID NO: 10666 - RNA, 28 nt, Artificial Sequence
  Synthetic Oligonucleotide; GZMB exon 2; Set A
cagagacuucugaucccagaucauaaga

SEQ ID NO: 10667 - RNA, 30 nt, Artificial Sequence
  Synthetic Oligonucleotide; GZMB exon 2; Set A
ucagagacuucugaucccagaucauaagau

SEQ ID NO: 10668 - RNA, 29 nt, Artificial Sequence
  Synthetic Oligonucleotide; GZMB exon 2; Set A
ucagagacuucugaucccagaucauaaga

SEQ ID NO: 10669 - RNA, 32 nt, Artificial Sequence
  Synthetic Oligonucleotide; GZMB exon 2; Set A
cuucagagacuucugaucccagaucauaagau

SEQ ID NO: 10670 - RNA, 31 nt, Artificial Sequence
  Synthetic Oligonucleotide; GZMB exon 2; Set A
cuucagagacuucugaucccagaucauaaga

SEQ ID NO: 10671 - RNA, 33 nt, Artificial Sequence
  Synthetic Oligonucleotide; GZMB exon 2; Set A
ucuucagagacuucugaucccagaucauaagau

SEQ ID NO: 10672 - RNA, 32 nt, Artificial Sequence
  Synthetic Oligonucleotide; GZMB exon 2; Set A
ucuucagagacuucugaucccagaucauaaga

SEQ ID NO: 10673 - RNA, 16 nt, Artificial Sequence
  Synthetic Oligonucleotide; GZMB exon 2; Set C
agacuucugaucccag

SEQ ID NO: 10674 - RNA, 39 nt, Artificial Sequence
  Synthetic Oligonucleotide; GZMB exon 2; Set C
gcaccucuucagagacuucugaucccagaucauaagaua

SEQ ID NO: 10675 - RNA, 17 nt, Artificial Sequence
  Synthetic Oligonucleotide; GZMB exon 2; Set C
gagacuucugaucccag

SEQ ID NO: 10676 - RNA, 18 nt, Artificial Sequence
  Synthetic Oligonucleotide; GZMB exon 2; Set C
agagacuucugaucccag

SEQ ID NO: 10677 - RNA, 38 nt, Artificial Sequence
  Synthetic Oligonucleotide; GZMB exon 2; Set C
gcaccucuucagagacuucugaucccagaucauaagau

SEQ ID NO: 10678 - RNA, 37 nt, Artificial Sequence
  Synthetic Oligonucleotide; GZMB exon 2; Set C
gcaccucuucagagacuucugaucccagaucauaaga

SEQ ID NO: 10679 - RNA, 17 nt, Artificial Sequence
  Synthetic Oligonucleotide; GZMB exon 2; Set C
cagagacuucugauccc

SEQ ID NO: 10680 - RNA, 22 nt, Artificial Sequence
  Synthetic Oligonucleotide; GZMB exon 2; Set C
cuucagagacuucugaucccag

SEQ ID NO: 10681 - RNA, 18 nt, Artificial Sequence
  Synthetic Oligonucleotide; GZMB exon 2; Set C
ucagagacuucugauccc

SEQ ID NO: 10682 - RNA, 23 nt, Artificial Sequence
  Synthetic Oligonucleotide; GZMB exon 2; Set A
ucuucagagacuucugaucccag

SEQ ID NO: 10683 - RNA, 19 nt, Artificial Sequence
  Synthetic Oligonucleotide; GZMB exon 2; Set C
uucagagacuucugauccc

SEQ ID NO: 10684 - RNA, 28 nt, Artificial Sequence
  Synthetic Oligonucleotide; GZMB exon 2; Set C
gcaccucuucagagacuucugaucccag

SEQ ID NO: 10685 - RNA, 37 nt, Artificial Sequence
  Synthetic Oligonucleotide; GZMB exon 2; Set C
gaagccaccgcaccucuucagagacuucugaucccag

SEQ ID NO: 10686 - RNA, 38 nt, Artificial Sequence
  Synthetic Oligonucleotide; GZMB exon 2; Set C
ggaagccaccgcaccucuucagagacuucugaucccag

SEQ ID NO: 10687 - RNA, 17 nt, Artificial Sequence
  Synthetic Oligonucleotide; GZMB exon 2; Set C
gcaccucuucagagacu

SEQ ID NO: 10688 - RNA, 38 nt, Artificial Sequence
  Synthetic Oligonucleotide; GZMB exon 2; Set C
aggaagccaccgcaccucuucagagacuucugauccca

SEQ ID NO: 10689 - RNA, 40 nt, Artificial Sequence
  Synthetic Oligonucleotide; GZMB exon 2; Set C
caggaagccaccgcaccucuucagagacuucugaucccag

SEQ ID NO: 10690 - RNA, 16 nt, Artificial Sequence
  Synthetic Oligonucleotide; GZMB exon 2; Set C
gcaccucuucagagac

SEQ ID NO: 10691 - RNA, 15 nt, Artificial Sequence
  Synthetic Oligonucleotide; GZMB exon 2; Set C
gcaccucuucagaga

SEQ ID NO: 10692 - RNA, 24 nt, Artificial Sequence
  Synthetic Oligonucleotide; GZMB exon 2; Set C
gaagccaccgcaccucuucagaga

SEQ ID NO: 10693 - RNA, 25 nt, Artificial Sequence
  Synthetic Oligonucleotide; GZMB exon 2; Set C
ggaagccaccgcaccucuucagaga

SEQ ID NO: 10694 - RNA, 23 nt, Artificial Sequence
  Synthetic Oligonucleotide; GZMB exon 2; Set C
gaagccaccgcaccucuucagag

SEQ ID NO: 10695 - RNA, 22 nt, Artificial Sequence
  Synthetic Oligonucleotide; GZMB exon 2; Set C
gaagccaccgcaccucuucaga

SEQ ID NO: 10696 - RNA, 24 nt, Artificial Sequence
  Synthetic Oligonucleotide; GZMB exon 2; Set C
ggaagccaccgcaccucuucagag

SEQ ID NO: 10697 - RNA, 27 nt, Artificial Sequence
  Synthetic Oligonucleotide; GZMB exon 2; Set C
caggaagccaccgcaccucuucagaga

SEQ ID NO: 10698 - RNA, 23 nt, Artificial Sequence
  Synthetic Oligonucleotide; GZMB exon 2; Set C
ggaagccaccgcaccucuucaga

SEQ ID NO: 10699 - RNA, 20 nt, Artificial Sequence
  Synthetic Oligonucleotide; GZMB exon 2; Set A
gaagccaccgcaccucuuca

SEQ ID NO: 10700 - RNA, 22 nt, Artificial Sequence
  Synthetic Oligonucleotide; GZMB exon 2; Set C
ggaagccaccgcaccucuucag

SEQ ID NO: 10701 - RNA, 28 nt, Artificial Sequence
  Synthetic Oligonucleotide; GZMB exon 2; Set C
ucaggaagccaccgcaccucuucagaga

SEQ ID NO: 10702 - RNA, 26 nt, Artificial Sequence
  Synthetic Oligonucleotide; GZMB exon 2; Set C
caggaagccaccgcaccucuucagag

SEQ ID NO: 10703 - RNA, 19 nt, Artificial Sequence
  Synthetic Oligonucleotide; GZMB exon 2; Set A
gaagccaccgcaccucuuc

SEQ ID NO: 10704 - RNA, 21 nt, Artificial Sequence
  Synthetic Oligonucleotide; GZMB exon 2; Set C
ggaagccaccgcaccucuuca

SEQ ID NO: 10705 - RNA, 23 nt, Artificial Sequence
  Synthetic Oligonucleotide; GZMB exon 2; Set C
aggaagccaccgcaccucuucag

SEQ ID NO: 10706 - RNA, 25 nt, Artificial Sequence
  Synthetic Oligonucleotide; GZMB exon 2; Set C
caggaagccaccgcaccucuucaga

SEQ ID NO: 10707 - RNA, 27 nt, Artificial Sequence
  Synthetic Oligonucleotide; GZMB exon 2; Set C
ucaggaagccaccgcaccucuucagag

SEQ ID NO: 10708 - RNA, 20 nt, Artificial Sequence
  Synthetic Oligonucleotide; GZMB exon 2; Set A
ggaagccaccgcaccucuuc

SEQ ID NO: 10709 - RNA, 22 nt, Artificial Sequence
  Synthetic Oligonucleotide; GZMB exon 2; Set C
aggaagccaccgcaccucuuca

SEQ ID NO: 10710 - RNA, 24 nt, Artificial Sequence
  Synthetic Oligonucleotide; GZMB exon 2; Set C
caggaagccaccgcaccucuucag

SEQ ID NO: 10711 - RNA, 18 nt, Artificial Sequence
  Synthetic Oligonucleotide; GZMB exon 2; Set A
gaagccaccgcaccucuu

SEQ ID NO: 10712 - RNA, 30 nt, Artificial Sequence
  Synthetic Oligonucleotide; GZMB exon 2; Set C
uaucaggaagccaccgcaccucuucagaga

SEQ ID NO: 10713 - RNA, 26 nt, Artificial Sequence
  Synthetic Oligonucleotide; GZMB exon 2; Set C
ucaggaagccaccgcaccucuucaga

SEQ ID NO: 10714 - RNA, 21 nt, Artificial Sequence
  Synthetic Oligonucleotide; GZMB exon 2; Set A
aggaagccaccgcaccucuuc

SEQ ID NO: 10715 - RNA, 23 nt, Artificial Sequence
  Synthetic Oligonucleotide; GZMB exon 2; Set C
caggaagccaccgcaccucuuca

SEQ ID NO: 10716 - RNA, 19 nt, Artificial Sequence
  Synthetic Oligonucleotide; GZMB exon 2; Set A
ggaagccaccgcaccucuu

SEQ ID NO: 10717 - RNA, 31 nt, Artificial Sequence
  Synthetic Oligonucleotide; GZMB exon 2; Set C
guaucaggaagccaccgcaccucuucagaga

SEQ ID NO: 10718 - RNA, 29 nt, Artificial Sequence
  Synthetic Oligonucleotide; GZMB exon 2; Set C
uaucaggaagccaccgcaccucuucagag

SEQ ID NO: 10719 - RNA, 22 nt, Artificial Sequence
  Synthetic Oligonucleotide; GZMB exon 2; Set C
caggaagccaccgcaccucuuc

SEQ ID NO: 10720 - RNA, 24 nt, Artificial Sequence
  Synthetic Oligonucleotide; GZMB exon 2; Set C
ucaggaagccaccgcaccucuuca

SEQ ID NO: 10721 - RNA, 26 nt, Artificial Sequence
  Synthetic Oligonucleotide; GZMB exon 2; Set C
aucaggaagccaccgcaccucuucag

SEQ ID NO: 10722 - RNA, 28 nt, Artificial Sequence
  Synthetic Oligonucleotide; GZMB exon 2; Set C
uaucaggaagccaccgcaccucuucaga

SEQ ID NO: 10723 - RNA, 30 nt, Artificial Sequence
  Synthetic Oligonucleotide; GZMB exon 2; Set C
guaucaggaagccaccgcaccucuucagag

SEQ ID NO: 10724 - RNA, 23 nt, Artificial Sequence
  Synthetic Oligonucleotide; GZMB exon 2; Set C
ucaggaagccaccgcaccucuuc

SEQ ID NO: 10725 - RNA, 25 nt, Artificial Sequence
  Synthetic Oligonucleotide; GZMB exon 2; Set C
aucaggaagccaccgcaccucuuca

SEQ ID NO: 10726 - RNA, 29 nt, Artificial Sequence
  Synthetic Oligonucleotide; GZMB exon 2; Set C
guaucaggaagccaccgcaccucuucaga

SEQ ID NO: 10727 - RNA, 24 nt, Artificial Sequence
  Synthetic Oligonucleotide; GZMB exon 2; Set C
aucaggaagccaccgcaccucuuc

SEQ ID NO: 10728 - RNA, 22 nt, Artificial Sequence
  Synthetic Oligonucleotide; GZMB exon 2; Set C
ucaggaagccaccgcaccucuu

SEQ ID NO: 10729 - RNA, 21 nt, Artificial Sequence
  Synthetic Oligonucleotide; GZMB exon 2; Set C
ucaggaagccaccgcaccucu

SEQ ID NO: 10730 - RNA, 39 nt, Artificial Sequence
  Synthetic Oligonucleotide; GZMB exon 2; Set C
cgucucguaucaggaagccaccgcaccucuucagagacu

SEQ ID NO: 10731 - RNA, 24 nt, Artificial Sequence
  Synthetic Oligonucleotide; GZMB exon 2; Set C
uaucaggaagccaccgcaccucuu

SEQ ID NO: 10732 - RNA, 38 nt, Artificial Sequence
  Synthetic Oligonucleotide; GZMB exon 2; Set C
cgucucguaucaggaagccaccgcaccucuucagagac

SEQ ID NO: 10733 - RNA, 40 nt, Artificial Sequence
  Synthetic Oligonucleotide; GZMB exon 2; Set C
ucgucucguaucaggaagccaccgcaccucuucagagacu

SEQ ID NO: 10734 - RNA, 23 nt, Artificial Sequence
  Synthetic Oligonucleotide; GZMB exon 2; Set C
uaucaggaagccaccgcaccucu

SEQ ID NO: 10735 - RNA, 25 nt, Artificial Sequence
  Synthetic Oligonucleotide; GZMB exon 2; Set C
guaucaggaagccaccgcaccucuu

SEQ ID NO: 10736 - RNA, 39 nt, Artificial Sequence
  Synthetic Oligonucleotide; GZMB exon 2; Set C
ucgucucguaucaggaagccaccgcaccucuucagagac

SEQ ID NO: 10737 - RNA, 24 nt, Artificial Sequence
  Synthetic Oligonucleotide; GZMB exon 2; Set C
guaucaggaagccaccgcaccucu

SEQ ID NO: 10738 - RNA, 40 nt, Artificial Sequence
  Synthetic Oligonucleotide; GZMB exon 2; Set C
gucgucucguaucaggaagccaccgcaccucuucagagac

SEQ ID NO: 10739 - RNA, 16 nt, Artificial Sequence
  Synthetic Oligonucleotide; GZMB exon 2; Set A
ucaggaagccaccgca

SEQ ID NO: 10740 - RNA, 18 nt, Artificial Sequence
  Synthetic Oligonucleotide; GZMB exon 2; Set A
uaucaggaagccaccgca

SEQ ID NO: 10741 - RNA, 31 nt, Artificial Sequence
  Synthetic Oligonucleotide; GZMB exon 2; Set C
cgucucguaucaggaagccaccgcaccucuu

SEQ ID NO: 10742 - RNA, 19 nt, Artificial Sequence
  Synthetic Oligonucleotide; GZMB exon 2; Set A
guaucaggaagccaccgca

SEQ ID NO: 10743 - RNA, 30 nt, Artificial Sequence
  Synthetic Oligonucleotide; GZMB exon 2; Set C
cgucucguaucaggaagccaccgcaccucu

SEQ ID NO: 10744 - RNA, 31 nt, Artificial Sequence
  Synthetic Oligonucleotide; GZMB exon 2; Set C
ucgucucguaucaggaagccaccgcaccucu

SEQ ID NO: 10745 - RNA, 25 nt, Artificial Sequence
  Synthetic Oligonucleotide; GZMB exon 2; Set C
cgucucguaucaggaagccaccgca

SEQ ID NO: 10746 - RNA, 26 nt, Artificial Sequence
  Synthetic Oligonucleotide; GZMB exon 2; Set C
ucgucucguaucaggaagccaccgca

SEQ ID NO: 10747 - RNA, 36 nt, Artificial Sequence
  Synthetic Oligonucleotide; GZMB exon 2; Set C
cagcacgaagucgucucguaucaggaagccaccgca

SEQ ID NO: 10748 - RNA, 37 nt, Artificial Sequence
  Synthetic Oligonucleotide; GZMB exon 2; Set C
ucagcacgaagucgucucguaucaggaagccaccgca

SEQ ID NO: 10749 - RNA, 15 nt, Artificial Sequence
  Synthetic Oligonucleotide; GZMB exon 2; Set C
ucgucucguaucagg

SEQ ID NO: 10750 - RNA, 38 nt, Artificial Sequence
  Synthetic Oligonucleotide; GZMB exon 2; Set C
gucagcacgaagucgucucguaucaggaagccaccgca

SEQ ID NO: 10751 - RNA, 16 nt, Artificial Sequence
  Synthetic Oligonucleotide; GZMB exon 2; Set C
gucgucucguaucagg

SEQ ID NO: 10752 - RNA, 39 nt, Artificial Sequence
  Synthetic Oligonucleotide; GZMB exon 2; Set C
ugucagcacgaagucgucucguaucaggaagccaccgca

SEQ ID NO: 10753 - RNA, 40 nt, Artificial Sequence
  Synthetic Oligonucleotide; GZMB exon 2; Set C
cugucagcacgaagucgucucguaucaggaagccaccgca

SEQ ID NO: 10754 - RNA, 25 nt, Artificial Sequence
  Synthetic Oligonucleotide; GZMB exon 2; Set A
cagcacgaagucgucucguaucagg

SEQ ID NO: 10755 - RNA, 24 nt, Artificial Sequence
  Synthetic Oligonucleotide; GZMB exon 2; Set A
cagcacgaagucgucucguaucag

SEQ ID NO: 10756 - RNA, 26 nt, Artificial Sequence
  Synthetic Oligonucleotide; GZMB exon 2; Set A
ucagcacgaagucgucucguaucagg

SEQ ID NO: 10757 - RNA, 29 nt, Artificial Sequence
  Synthetic Oligonucleotide; GZMB exon 2; Set C
ugucagcacgaagucgucucguaucagga

SEQ ID NO: 10758 - RNA, 23 nt, Artificial Sequence
  Synthetic Oligonucleotide; GZMB exon 2; Set A
cagcacgaagucgucucguauca

SEQ ID NO: 10759 - RNA, 25 nt, Artificial Sequence
  Synthetic Oligonucleotide; GZMB exon 2; Set A
ucagcacgaagucgucucguaucag

SEQ ID NO: 10760 - RNA, 27 nt, Artificial Sequence
  Synthetic Oligonucleotide; GZMB exon 2; Set C
gucagcacgaagucgucucguaucagg

SEQ ID NO: 10761 - RNA, 32 nt, Artificial Sequence
  Synthetic Oligonucleotide; GZMB exon 2; Set C
gcugucagcacgaagucgucucguaucaggaa

SEQ ID NO: 10762 - RNA, 30 nt, Artificial Sequence
  Synthetic Oligonucleotide; GZMB exon 2; Set C
cugucagcacgaagucgucucguaucagga

SEQ ID NO: 10763 - RNA, 24 nt, Artificial Sequence
  Synthetic Oligonucleotide; GZMB exon 2; Set A
ucagcacgaagucgucucguauca

SEQ ID NO: 10764 - RNA, 26 nt, Artificial Sequence
  Synthetic Oligonucleotide; GZMB exon 2; Set A
gucagcacgaagucgucucguaucag

SEQ ID NO: 10765 - RNA, 22 nt, Artificial Sequence
  Synthetic Oligonucleotide; GZMB exon 2; Set A
cagcacgaagucgucucguauc

SEQ ID NO: 10766 - RNA, 28 nt, Artificial Sequence
  Synthetic Oligonucleotide; GZMB exon 2; Set C
ugucagcacgaagucgucucguaucagg

SEQ ID NO: 10767 - RNA, 33 nt, Artificial Sequence
  Synthetic Oligonucleotide; GZMB exon 2; Set C
agcugucagcacgaagucgucucguaucaggaa

SEQ ID NO: 10768 - RNA, 21 nt, Artificial Sequence
  Synthetic Oligonucleotide; GZMB exon 2; Set A
cagcacgaagucgucucguau

SEQ ID NO: 10769 - RNA, 31 nt, Artificial Sequence
  Synthetic Oligonucleotide; GZMB exon 2; Set C
gcugucagcacgaagucgucucguaucagga

SEQ ID NO: 10770 - RNA, 27 nt, Artificial Sequence
  Synthetic Oligonucleotide; GZMB exon 2; Set A
ugucagcacgaagucgucucguaucag

SEQ ID NO: 10771 - RNA, 23 nt, Artificial Sequence
  Synthetic Oligonucleotide; GZMB exon 2; Set A
ucagcacgaagucgucucguauc

SEQ ID NO: 10772 - RNA, 29 nt, Artificial Sequence
  Synthetic Oligonucleotide; GZMB exon 2; Set C
cugucagcacgaagucgucucguaucagg

SEQ ID NO: 10773 - RNA, 34 nt, Artificial Sequence
  Synthetic Oligonucleotide; GZMB exon 2; Set C
cagcugucagcacgaagucgucucguaucaggaa

SEQ ID NO: 10774 - RNA, 22 nt, Artificial Sequence
  Synthetic Oligonucleotide; GZMB exon 2; Set A
ucagcacgaagucgucucguau

SEQ ID NO: 10775 - RNA, 32 nt, Artificial Sequence
  Synthetic Oligonucleotide; GZMB exon 2; Set C
agcugucagcacgaagucgucucguaucagga

SEQ ID NO: 10776 - RNA, 20 nt, Artificial Sequence
  Synthetic Oligonucleotide; GZMB exon 2; Set A
cagcacgaagucgucucgua

SEQ ID NO: 10777 - RNA, 26 nt, Artificial Sequence
  Synthetic Oligonucleotide; GZMB exon 2; Set A
ugucagcacgaagucgucucguauca

SEQ ID NO: 10778 - RNA, 28 nt, Artificial Sequence
  Synthetic Oligonucleotide; GZMB exon 2; Set A
cugucagcacgaagucgucucguaucag

SEQ ID NO: 10779 - RNA, 24 nt, Artificial Sequence
  Synthetic Oligonucleotide; GZMB exon 2; Set A
gucagcacgaagucgucucguauc

SEQ ID NO: 10780 - RNA, 33 nt, Artificial Sequence
  Synthetic Oligonucleotide; GZMB exon 2; Set C
cagcugucagcacgaagucgucucguaucagga

SEQ ID NO: 10781 - RNA, 21 nt, Artificial Sequence
  Synthetic Oligonucleotide; GZMB exon 2; Set A
ucagcacgaagucgucucgua

SEQ ID NO: 10782 - RNA, 27 nt, Artificial Sequence
  Synthetic Oligonucleotide; GZMB exon 2; Set C
cugucagcacgaagucgucucguauca

SEQ ID NO: 10783 - RNA, 29 nt, Artificial Sequence
  Synthetic Oligonucleotide; GZMB exon 2; Set C
gcugucagcacgaagucgucucguaucag

SEQ ID NO: 10784 - RNA, 25 nt, Artificial Sequence
  Synthetic Oligonucleotide; GZMB exon 2; Set A
ugucagcacgaagucgucucguauc

SEQ ID NO: 10785 - RNA, 24 nt, Artificial Sequence
  Synthetic Oligonucleotide; GZMB exon 2; Set A
ugucagcacgaagucgucucguau

SEQ ID NO: 10786 - RNA, 22 nt, Artificial Sequence
  Synthetic Oligonucleotide; GZMB exon 2; Set A
gucagcacgaagucgucucgua

SEQ ID NO: 10787 - RNA, 28 nt, Artificial Sequence
  Synthetic Oligonucleotide; GZMB exon 2; Set C
gcugucagcacgaagucgucucguauca

SEQ ID NO: 10788 - RNA, 30 nt, Artificial Sequence
  Synthetic Oligonucleotide; GZMB exon 2; Set C
agcugucagcacgaagucgucucguaucag

SEQ ID NO: 10789 - RNA, 26 nt, Artificial Sequence
  Synthetic Oligonucleotide; GZMB exon 2; Set A
cugucagcacgaagucgucucguauc

SEQ ID NO: 10790 - RNA, 25 nt, Artificial Sequence
  Synthetic Oligonucleotide; GZMB exon 2; Set A
cugucagcacgaagucgucucguau

SEQ ID NO: 10791 - RNA, 23 nt, Artificial Sequence
  Synthetic Oligonucleotide; GZMB exon 2; Set A
ugucagcacgaagucgucucgua

SEQ ID NO: 10792 - RNA, 29 nt, Artificial Sequence
  Synthetic Oligonucleotide; GZMB exon 2; Set C
agcugucagcacgaagucgucucguauca

SEQ ID NO: 10793 - RNA, 26 nt, Artificial Sequence
  Synthetic Oligonucleotide; GZMB exon 2; Set C
gcugucagcacgaagucgucucguau

SEQ ID NO: 10794 - RNA, 24 nt, Artificial Sequence
  Synthetic Oligonucleotide; GZMB exon 2; Set A
cugucagcacgaagucgucucgua

SEQ ID NO: 10795 - RNA, 37 nt, Artificial Sequence
  Synthetic Oligonucleotide; GZMB exon 2; Set C
ugagcagcugucagcacgaagucgucucguaucagga

SEQ ID NO: 10796 - RNA, 27 nt, Artificial Sequence
  Synthetic Oligonucleotide; GZMB exon 2; Set C
agcugucagcacgaagucgucucguau

SEQ ID NO: 10797 - RNA, 25 nt, Artificial Sequence
  Synthetic Oligonucleotide; GZMB exon 2; Set C
gcugucagcacgaagucgucucgua

SEQ ID NO: 10798 - RNA, 38 nt, Artificial Sequence
  Synthetic Oligonucleotide; GZMB exon 2; Set C
gugagcagcugucagcacgaagucgucucguaucagga

SEQ ID NO: 10799 - RNA, 26 nt, Artificial Sequence
  Synthetic Oligonucleotide; GZMB exon 2; Set C
agcugucagcacgaagucgucucgua

SEQ ID NO: 10800 - RNA, 36 nt, Artificial Sequence
  Synthetic Oligonucleotide; GZMB exon 2; Set C
ugagcagcugucagcacgaagucgucucguaucagg

SEQ ID NO: 10801 - RNA, 35 nt, Artificial Sequence
  Synthetic Oligonucleotide; GZMB exon 2; Set C
ugagcagcugucagcacgaagucgucucguaucag

SEQ ID NO: 10802 - RNA, 37 nt, Artificial Sequence
  Synthetic Oligonucleotide; GZMB exon 2; Set C
gugagcagcugucagcacgaagucgucucguaucagg

SEQ ID NO: 10803 - RNA, 34 nt, Artificial Sequence
  Synthetic Oligonucleotide; GZMB exon 2; Set C
ugagcagcugucagcacgaagucgucucguauca

SEQ ID NO: 10804 - RNA, 36 nt, Artificial Sequence
  Synthetic Oligonucleotide; GZMB exon 2; Set C
gugagcagcugucagcacgaagucgucucguaucag

SEQ ID NO: 10805 - RNA, 38 nt, Artificial Sequence
  Synthetic Oligonucleotide; GZMB exon 2; Set C
agugagcagcugucagcacgaagucgucucguaucagg

SEQ ID NO: 10806 - RNA, 35 nt, Artificial Sequence
  Synthetic Oligonucleotide; GZMB exon 2; Set C
gugagcagcugucagcacgaagucgucucguauca

SEQ ID NO: 10807 - RNA, 33 nt, Artificial Sequence
  Synthetic Oligonucleotide; GZMB exon 2; Set C
ugagcagcugucagcacgaagucgucucguauc

SEQ ID NO: 10808 - RNA, 39 nt, Artificial Sequence
  Synthetic Oligonucleotide; GZMB exon 2; Set C
cagugagcagcugucagcacgaagucgucucguaucagg

SEQ ID NO: 10809 - RNA, 32 nt, Artificial Sequence
  Synthetic Oligonucleotide; GZMB exon 2; Set C
ugagcagcugucagcacgaagucgucucguau

SEQ ID NO: 10810 - RNA, 34 nt, Artificial Sequence
  Synthetic Oligonucleotide; GZMB exon 2; Set C
gugagcagcugucagcacgaagucgucucguauc

SEQ ID NO: 10811 - RNA, 40 nt, Artificial Sequence
  Synthetic Oligonucleotide; GZMB exon 2; Set C
acagugagcagcugucagcacgaagucgucucguaucagg

SEQ ID NO: 10812 - RNA, 33 nt, Artificial Sequence
  Synthetic Oligonucleotide; GZMB exon 2; Set C
gugagcagcugucagcacgaagucgucucguau

SEQ ID NO: 10813 - RNA, 31 nt, Artificial Sequence
  Synthetic Oligonucleotide; GZMB exon 2; Set C
ugagcagcugucagcacgaagucgucucgua

SEQ ID NO: 10814 - RNA, 39 nt, Artificial Sequence
  Synthetic Oligonucleotide; GZMB exon 2; Set C
acagugagcagcugucagcacgaagucgucucguaucag

SEQ ID NO: 10815 - RNA, 35 nt, Artificial Sequence
  Synthetic Oligonucleotide; GZMB exon 2; Set C
agugagcagcugucagcacgaagucgucucguauc

SEQ ID NO: 10816 - RNA, 32 nt, Artificial Sequence
  Synthetic Oligonucleotide; GZMB exon 2; Set C
gugagcagcugucagcacgaagucgucucgua

SEQ ID NO: 10817 - RNA, 40 nt, Artificial Sequence
  Synthetic Oligonucleotide; GZMB exon 2; Set C
aacagugagcagcugucagcacgaagucgucucguaucag

SEQ ID NO: 10818 - RNA, 36 nt, Artificial Sequence
  Synthetic Oligonucleotide; GZMB exon 2; Set C
cagugagcagcugucagcacgaagucgucucguauc

SEQ ID NO: 10819 - RNA, 39 nt, Artificial Sequence
  Synthetic Oligonucleotide; GZMB exon 2; Set C
aacagugagcagcugucagcacgaagucgucucguauca

SEQ ID NO: 10820 - RNA, 37 nt, Artificial Sequence
  Synthetic Oligonucleotide; GZMB exon 2; Set C
acagugagcagcugucagcacgaagucgucucguauc

SEQ ID NO: 10821 - RNA, 22 nt, Artificial Sequence
  Synthetic Oligonucleotide; GZMB exon 2; Set B
gcagcugucagcacgaagucgu

SEQ ID NO: 10822 - RNA, 40 nt, Artificial Sequence
  Synthetic Oligonucleotide; GZMB exon 2; Set C
caacagugagcagcugucagcacgaagucgucucguauca

SEQ ID NO: 10823 - RNA, 38 nt, Artificial Sequence
  Synthetic Oligonucleotide; GZMB exon 2; Set C
aacagugagcagcugucagcacgaagucgucucguauc

SEQ ID NO: 10824 - RNA, 32 nt, Artificial Sequence
  Synthetic Oligonucleotide; GZMB exon 2; Set C
agugagcagcugucagcacgaagucgucucgu

SEQ ID NO: 10825 - RNA, 23 nt, Artificial Sequence
  Synthetic Oligonucleotide; GZMB exon 2; Set B
agcagcugucagcacgaagucgu

SEQ ID NO: 10826 - RNA, 21 nt, Artificial Sequence
  Synthetic Oligonucleotide; GZMB exon 2; Set B
gcagcugucagcacgaagucg

SEQ ID NO: 10827 - RNA, 37 nt, Artificial Sequence
  Synthetic Oligonucleotide; GZMB exon 2; Set C
aacagugagcagcugucagcacgaagucgucucguau

SEQ ID NO: 10828 - RNA, 39 nt, Artificial Sequence
  Synthetic Oligonucleotide; GZMB exon 2; Set C
caacagugagcagcugucagcacgaagucgucucguauc

SEQ ID NO: 10829 - RNA, 22 nt, Artificial Sequence
  Synthetic Oligonucleotide; GZMB exon 2; Set B
agcagcugucagcacgaagucg

SEQ ID NO: 10830 - RNA, 20 nt, Artificial Sequence
  Synthetic Oligonucleotide; GZMB exon 2; Set B
gcagcugucagcacgaaguc

SEQ ID NO: 10831 - RNA, 38 nt, Artificial Sequence
  Synthetic Oligonucleotide; GZMB exon 2; Set C
caacagugagcagcugucagcacgaagucgucucguau

SEQ ID NO: 10832 - RNA, 36 nt, Artificial Sequence
  Synthetic Oligonucleotide; GZMB exon 2; Set C
aacagugagcagcugucagcacgaagucgucucgua

SEQ ID NO: 10833 - RNA, 23 nt, Artificial Sequence
  Synthetic Oligonucleotide; GZMB exon 2; Set B
gagcagcugucagcacgaagucg

SEQ ID NO: 10834 - RNA, 21 nt, Artificial Sequence
  Synthetic Oligonucleotide; GZMB exon 2; Set B
agcagcugucagcacgaaguc

SEQ ID NO: 10835 - RNA, 37 nt, Artificial Sequence
  Synthetic Oligonucleotide; GZMB exon 2; Set C
caacagugagcagcugucagcacgaagucgucucgua

SEQ ID NO: 10836 - RNA, 22 nt, Artificial Sequence
  Synthetic Oligonucleotide; GZMB exon 2; Set B
gagcagcugucagcacgaaguc

SEQ ID NO: 10837 - RNA, 32 nt, Artificial Sequence
  Synthetic Oligonucleotide; GZMB exon 2; Set C
ccaacagugagcagcugucagcacgaagucgu

SEQ ID NO: 10838 - RNA, 33 nt, Artificial Sequence
  Synthetic Oligonucleotide; GZMB exon 2; Set C
cccaacagugagcagcugucagcacgaagucgu

SEQ ID NO: 10839 - RNA, 31 nt, Artificial Sequence
  Synthetic Oligonucleotide; GZMB exon 2; Set C
ccaacagugagcagcugucagcacgaagucg

SEQ ID NO: 10840 - RNA, 32 nt, Artificial Sequence
  Synthetic Oligonucleotide; GZMB exon 2; Set C
cccaacagugagcagcugucagcacgaagucg

SEQ ID NO: 10841 - RNA, 30 nt, Artificial Sequence
  Synthetic Oligonucleotide; GZMB exon 2; Set C
ccaacagugagcagcugucagcacgaaguc

SEQ ID NO: 10842 - RNA, 31 nt, Artificial Sequence
  Synthetic Oligonucleotide; GZMB exon 2; Set C
cccaacagugagcagcugucagcacgaaguc

SEQ ID NO: 10843 - RNA, 21 nt, Artificial Sequence
  Synthetic Oligonucleotide; GZMB exon 2; Set B
ccaacagugagcagcugucag

SEQ ID NO: 10844 - RNA, 20 nt, Artificial Sequence
  Synthetic Oligonucleotide; GZMB exon 2; Set B
ccaacagugagcagcuguca

SEQ ID NO: 10845 - RNA, 22 nt, Artificial Sequence
  Synthetic Oligonucleotide; GZMB exon 2; Set B
cccaacagugagcagcugucag

SEQ ID NO: 10846 - RNA, 21 nt, Artificial Sequence
  Synthetic Oligonucleotide; GZMB exon 2; Set B
cccaacagugagcagcuguca

SEQ ID NO: 10847 - RNA, 19 nt, Artificial Sequence
  Synthetic Oligonucleotide; GZMB exon 2; Set B
ccaacagugagcagcuguc

SEQ ID NO: 10848 - RNA, 20 nt, Artificial Sequence
  Synthetic Oligonucleotide; GZMB exon 2; Set B
cccaacagugagcagcuguc

SEQ ID NO: 10849 - RNA, 18 nt, Artificial Sequence
  Synthetic Oligonucleotide; GZMB exon 2; Set C
ccaacagugagcagcugu

SEQ ID NO: 10850 - RNA, 19 nt, Artificial Sequence
  Synthetic Oligonucleotide; GZMB exon 2; Set B
cccaacagugagcagcugu

SEQ ID NO: 10851 - RNA, 17 nt, Artificial Sequence
  Synthetic Oligonucleotide; GZMB exon 2; Set C
ccaacagugagcagcug

SEQ ID NO: 10852 - RNA, 26 nt, Artificial Sequence
  Synthetic Oligonucleotide; GZMB exon 2; Set C
cuuccccaacagugagcagcugucag

SEQ ID NO: 10853 - RNA, 18 nt, Artificial Sequence
  Synthetic Oligonucleotide; GZMB exon 2; Set C
cccaacagugagcagcug

SEQ ID NO: 10854 - RNA, 25 nt, Artificial Sequence
  Synthetic Oligonucleotide; GZMB exon 2; Set C
cuuccccaacagugagcagcuguca

SEQ ID NO: 10855 - RNA, 24 nt, Artificial Sequence
  Synthetic Oligonucleotide; GZMB exon 2; Set B
cuuccccaacagugagcagcuguc

SEQ ID NO: 10856 - RNA, 35 nt, Artificial Sequence
  Synthetic Oligonucleotide; GZMB exon 2; Set C
ucugcuccucaccuuccccaacagugagcagcugu

SEQ ID NO: 10857 - RNA, 36 nt, Artificial Sequence
  Synthetic Oligonucleotide; GZMB exon 2; Set C
uucugcuccucaccuuccccaacagugagcagcugu

SEQ ID NO: 10858 - RNA, 34 nt, Artificial Sequence
  Synthetic Oligonucleotide; GZMB exon 2; Set C
ucugcuccucaccuuccccaacagugagcagcug

SEQ ID NO: 10859 - RNA, 35 nt, Artificial Sequence
  Synthetic Oligonucleotide; GZMB exon 2; Set C
uucugcuccucaccuuccccaacagugagcagcug

SEQ ID NO: 10860 - RNA, 33 nt, Artificial Sequence
  Synthetic Oligonucleotide; GZMB exon 2; Set C
ucugcuccucaccuuccccaacagugagcagcu

SEQ ID NO: 10861 - RNA, 34 nt, Artificial Sequence
  Synthetic Oligonucleotide; GZMB exon 2; Set C
uucugcuccucaccuuccccaacagugagcagcu

SEQ ID NO: 10862 - RNA, 39 nt, Artificial Sequence
  Synthetic Oligonucleotide; GZMB exon 2; Set C
guuuucugcuccucaccuuccccaacagugagcagcugu

SEQ ID NO: 10863 - RNA, 35 nt, Artificial Sequence
  Synthetic Oligonucleotide; GZMB exon 2; Set C
uuucugcuccucaccuuccccaacagugagcagcu

SEQ ID NO: 10864 - RNA, 33 nt, Artificial Sequence
  Synthetic Oligonucleotide; GZMB exon 2; Set C
uucugcuccucaccuuccccaacagugagcagc

SEQ ID NO: 10865 - RNA, 40 nt, Artificial Sequence
  Synthetic Oligonucleotide; GZMB exon 2; Set C
uguuuucugcuccucaccuuccccaacagugagcagcugu

SEQ ID NO: 10866 - RNA, 38 nt, Artificial Sequence
  Synthetic Oligonucleotide; GZMB exon 2; Set C
guuuucugcuccucaccuuccccaacagugagcagcug

SEQ ID NO: 10867 - RNA, 34 nt, Artificial Sequence
  Synthetic Oligonucleotide; GZMB exon 2; Set C
uuucugcuccucaccuuccccaacagugagcagc

SEQ ID NO: 10868 - RNA, 36 nt, Artificial Sequence
  Synthetic Oligonucleotide; GZMB exon 2; Set C
uuuucugcuccucaccuuccccaacagugagcagcu

SEQ ID NO: 10869 - RNA, 39 nt, Artificial Sequence
  Synthetic Oligonucleotide; GZMB exon 2; Set C
uguuuucugcuccucaccuuccccaacagugagcagcug

SEQ ID NO: 10870 - RNA, 35 nt, Artificial Sequence
  Synthetic Oligonucleotide; GZMB exon 2; Set C
uuuucugcuccucaccuuccccaacagugagcagc

SEQ ID NO: 10871 - RNA, 33 nt, Artificial Sequence
  Synthetic Oligonucleotide; GZMB exon 2; Set C
uuucugcuccucaccuuccccaacagugagcag

SEQ ID NO: 10872 - RNA, 34 nt, Artificial Sequence
  Synthetic Oligonucleotide; GZMB exon 2; Set C
uuuucugcuccucaccuuccccaacagugagcag

SEQ ID NO: 10873 - RNA, 27 nt, Artificial Sequence
  Synthetic Oligonucleotide; GZMB exon 2; Set C
ucugcuccucaccuuccccaacaguga

SEQ ID NO: 10874 - RNA, 28 nt, Artificial Sequence
  Synthetic Oligonucleotide; GZMB exon 2; Set C
uucugcuccucaccuuccccaacaguga

SEQ ID NO: 10875 - RNA, 26 nt, Artificial Sequence
  Synthetic Oligonucleotide; GZMB exon 2; Set C
ucugcuccucaccuuccccaacagug

SEQ ID NO: 10876 - RNA, 25 nt, Artificial Sequence
  Synthetic Oligonucleotide; GZMB exon 2; Set C
ucugcuccucaccuuccccaacagu

SEQ ID NO: 10877 - RNA, 27 nt, Artificial Sequence
  Synthetic Oligonucleotide; GZMB exon 2; Set C
uucugcuccucaccuuccccaacagug

SEQ ID NO: 10878 - RNA, 26 nt, Artificial Sequence
  Synthetic Oligonucleotide; GZMB exon 2; Set C
uucugcuccucaccuuccccaacagu

SEQ ID NO: 10879 - RNA, 24 nt, Artificial Sequence
  Synthetic Oligonucleotide; GZMB exon 2; Set C
ucugcuccucaccuuccccaacag

SEQ ID NO: 10880 - RNA, 30 nt, Artificial Sequence
  Synthetic Oligonucleotide; GZMB exon 2; Set C
uuuucugcuccucaccuuccccaacaguga

SEQ ID NO: 10881 - RNA, 28 nt, Artificial Sequence
  Synthetic Oligonucleotide; GZMB exon 2; Set C
uuucugcuccucaccuuccccaacagug

SEQ ID NO: 10882 - RNA, 25 nt, Artificial Sequence
  Synthetic Oligonucleotide; GZMB exon 2; Set C
uucugcuccucaccuuccccaacag

SEQ ID NO: 10883 - RNA, 31 nt, Artificial Sequence
  Synthetic Oligonucleotide; GZMB exon 2; Set C
guuuucugcuccucaccuuccccaacaguga

SEQ ID NO: 10884 - RNA, 29 nt, Artificial Sequence
  Synthetic Oligonucleotide; GZMB exon 2; Set C
uuuucugcuccucaccuuccccaacagug

SEQ ID NO: 10885 - RNA, 24 nt, Artificial Sequence
  Synthetic Oligonucleotide; GZMB exon 2; Set C
uucugcuccucaccuuccccaaca

SEQ ID NO: 10886 - RNA, 32 nt, Artificial Sequence
  Synthetic Oligonucleotide; GZMB exon 2; Set C
uguuuucugcuccucaccuuccccaacaguga

SEQ ID NO: 10887 - RNA, 30 nt, Artificial Sequence
  Synthetic Oligonucleotide; GZMB exon 2; Set C
guuuucugcuccucaccuuccccaacagug

SEQ ID NO: 10888 - RNA, 29 nt, Artificial Sequence
  Synthetic Oligonucleotide; GZMB exon 2; Set C
guuuucugcuccucaccuuccccaacagu

SEQ ID NO: 10889 - RNA, 25 nt, Artificial Sequence
  Synthetic Oligonucleotide; GZMB exon 2; Set C
uuucugcuccucaccuuccccaaca

SEQ ID NO: 10890 - RNA, 31 nt, Artificial Sequence
  Synthetic Oligonucleotide; GZMB exon 2; Set C
uguuuucugcuccucaccuuccccaacagug

SEQ ID NO: 10891 - RNA, 30 nt, Artificial Sequence
  Synthetic Oligonucleotide; GZMB exon 2; Set C
uguuuucugcuccucaccuuccccaacagu

SEQ ID NO: 10892 - RNA, 28 nt, Artificial Sequence
  Synthetic Oligonucleotide; GZMB exon 2; Set C
guuuucugcuccucaccuuccccaacag

SEQ ID NO: 10893 - RNA, 26 nt, Artificial Sequence
  Synthetic Oligonucleotide; GZMB exon 2; Set C
uuuucugcuccucaccuuccccaaca

SEQ ID NO: 10894 - RNA, 24 nt, Artificial Sequence
  Synthetic Oligonucleotide; GZMB exon 2; Set C
uuucugcuccucaccuuccccaac

SEQ ID NO: 10895 - RNA, 29 nt, Artificial Sequence
  Synthetic Oligonucleotide; GZMB exon 2; Set C
uguuuucugcuccucaccuuccccaacag

SEQ ID NO: 10896 - RNA, 27 nt, Artificial Sequence
  Synthetic Oligonucleotide; GZMB exon 2; Set C
guuuucugcuccucaccuuccccaaca

SEQ ID NO: 10897 - RNA, 25 nt, Artificial Sequence
  Synthetic Oligonucleotide; GZMB exon 2; Set C
uuuucugcuccucaccuuccccaac

SEQ ID NO: 10898 - RNA, 23 nt, Artificial Sequence
  Synthetic Oligonucleotide; GZMB exon 2; Set B
uuucugcuccucaccuuccccaa

SEQ ID NO: 10899 - RNA, 28 nt, Artificial Sequence
  Synthetic Oligonucleotide; GZMB exon 2; Set C
uguuuucugcuccucaccuuccccaaca

SEQ ID NO: 10900 - RNA, 24 nt, Artificial Sequence
  Synthetic Oligonucleotide; GZMB exon 2; Set B
uuuucugcuccucaccuuccccaa

SEQ ID NO: 10901 - RNA, 37 nt, Artificial Sequence
  Synthetic Oligonucleotide; GZMB exon 2; Set C
ugggcuguuuucugcuccucaccuuccccaacaguga

SEQ ID NO: 10902 - RNA, 38 nt, Artificial Sequence
  Synthetic Oligonucleotide; GZMB exon 2; Set C
gugggcuguuuucugcuccucaccuuccccaacaguga

SEQ ID NO: 10903 - RNA, 36 nt, Artificial Sequence
  Synthetic Oligonucleotide; GZMB exon 2; Set C
ugggcuguuuucugcuccucaccuuccccaacagug

SEQ ID NO: 10904 - RNA, 35 nt, Artificial Sequence
  Synthetic Oligonucleotide; GZMB exon 2; Set C
ugggcuguuuucugcuccucaccuuccccaacagu

SEQ ID NO: 10905 - RNA, 37 nt, Artificial Sequence
  Synthetic Oligonucleotide; GZMB exon 2; Set C
gugggcuguuuucugcuccucaccuuccccaacagug

SEQ ID NO: 10906 - RNA, 36 nt, Artificial Sequence
  Synthetic Oligonucleotide; GZMB exon 2; Set C
gugggcuguuuucugcuccucaccuuccccaacagu

SEQ ID NO: 10907 - RNA, 34 nt, Artificial Sequence
  Synthetic Oligonucleotide; GZMB exon 2; Set C
ugggcuguuuucugcuccucaccuuccccaacag

SEQ ID NO: 10908 - RNA, 38 nt, Artificial Sequence
  Synthetic Oligonucleotide; GZMB exon 2; Set C
ugugggcuguuuucugcuccucaccuuccccaacagug

SEQ ID NO: 10909 - RNA, 35 nt, Artificial Sequence
  Synthetic Oligonucleotide; GZMB exon 2; Set C
gugggcuguuuucugcuccucaccuuccccaacag

SEQ ID NO: 10910 - RNA, 33 nt, Artificial Sequence
  Synthetic Oligonucleotide; GZMB exon 2; Set C
ugggcuguuuucugcuccucaccuuccccaaca

SEQ ID NO: 10911 - RNA, 34 nt, Artificial Sequence
  Synthetic Oligonucleotide; GZMB exon 2; Set C
gugggcuguuuucugcuccucaccuuccccaaca

SEQ ID NO: 10912 - RNA, 35 nt, Artificial Sequence
  Synthetic Oligonucleotide; GZMB exon 2; Set C
ugugggcuguuuucugcuccucaccuuccccaaca

SEQ ID NO: 10913 - RNA, 33 nt, Artificial Sequence
  Synthetic Oligonucleotide; GZMB exon 2; Set C
gugggcuguuuucugcuccucaccuuccccaac

SEQ ID NO: 10914 - RNA, 34 nt, Artificial Sequence
  Synthetic Oligonucleotide; GZMB exon 2; Set C
ugugggcuguuuucugcuccucaccuuccccaac

SEQ ID NO: 10915 - RNA, 32 nt, Artificial Sequence
  Synthetic Oligonucleotide; GZMB exon 2; Set C
gugggcuguuuucugcuccucaccuuccccaa

SEQ ID NO: 10916 - RNA, 33 nt, Artificial Sequence
  Synthetic Oligonucleotide; GZMB exon 2; Set C
ugugggcuguuuucugcuccucaccuuccccaa

SEQ ID NO: 10917 - RNA, 16 nt, Artificial Sequence
  Synthetic Oligonucleotide; GZMB exon 2; Set C
uuccaggagggugugg

SEQ ID NO: 10918 - RNA, 17 nt, Artificial Sequence
  Synthetic Oligonucleotide; GZMB exon 2; Set C
uuuccaggagggugugg

SEQ ID NO: 10919 - RNA, 40 nt, Artificial Sequence
  Synthetic Oligonucleotide; GZMB exon 2; Set C
gucucuguggaguguuuccaggagggugugggcuguuuuc

SEQ ID NO: 10920 - RNA, 37 nt, Artificial Sequence
  Synthetic Oligonucleotide; GZMB exon 2; Set C
gucucuguggaguguuuccaggagggugugggcuguu

SEQ ID NO: 10921 - RNA, 36 nt, Artificial Sequence
  Synthetic Oligonucleotide; GZMB exon 2; Set C
gucucuguggaguguuuccaggagggugugggcugu

SEQ ID NO: 10922 - RNA, 30 nt, Artificial Sequence
  Synthetic Oligonucleotide; GZMB exon 2; Set C
gucucuguggaguguuuccaggagggugug

SEQ ID NO: 10923 - RNA, 29 nt, Artificial Sequence
  Synthetic Oligonucleotide; GZMB exon 2; Set C
gucucuguggaguguuuccaggagggugu

SEQ ID NO: 10924 - RNA, 18 nt, Artificial Sequence
  Synthetic Oligonucleotide; GZMB exon 2; Set C
gucucuguggaguguuuc

SEQ ID NO: 10925 - RNA, 17 nt, Artificial Sequence
  Synthetic Oligonucleotide; GZMB exon 2; Set C
gucucuguggaguguuu

SEQ ID NO: 10926 - RNA, 16 nt, Artificial Sequence
  Synthetic Oligonucleotide; GZMB exon 2; Set C
gucucuguggaguguu

SEQ ID NO: 10927 - RNA, 15 nt, Artificial Sequence
  Synthetic Oligonucleotide; GZMB exon 2; Set C
gucucuguggagugu

SEQ ID NO: 10928 - RNA, 21 nt, Artificial Sequence
  Synthetic Oligonucleotide; GZMB exon 2; Set C
gcugggugggcaccugcuuag

SEQ ID NO: 10929 - RNA, 15 nt, Artificial Sequence
  Synthetic Oligonucleotide; GZMB exon 2; Set C
aucugcugggugggc

SEQ ID NO: 10930 - RNA, 16 nt, Artificial Sequence
  Synthetic Oligonucleotide; GZMB exon 2; Set C
aaucugcugggugggc

SEQ ID NO: 10931 - RNA, 17 nt, Artificial Sequence
  Synthetic Oligonucleotide; GZMB exon 2; Set A
gaaucugcugggugggc

SEQ ID NO: 10932 - RNA, 18 nt, Artificial Sequence
  Synthetic Oligonucleotide; GZMB exon 2; Set A
ggaaucugcugggugggc

SEQ ID NO: 10933 - RNA, 19 nt, Artificial Sequence
  Synthetic Oligonucleotide; GZMB exon 2; Set A
uggaaucugcugggugggc

SEQ ID NO: 10934 - RNA, 36 nt, Artificial Sequence
  Synthetic Oligonucleotide; GZMB exon 2; Set C
ucugcuugugggcacccauggaaucugcuggguggg

SEQ ID NO: 10935 - RNA, 37 nt, Artificial Sequence
  Synthetic Oligonucleotide; GZMB exon 2; Set C
gucugcuugugggcacccauggaaucugcuggguggg

SEQ ID NO: 10936 - RNA, 38 nt, Artificial Sequence
  Synthetic Oligonucleotide; GZMB exon 2; Set C
ugucugcuugugggcacccauggaaucugcuggguggg

SEQ ID NO: 10937 - RNA, 23 nt, Artificial Sequence
  Synthetic Oligonucleotide; GZMB exon 2; Set A
uugugggcacccauggaaucugc

SEQ ID NO: 10938 - RNA, 39 nt, Artificial Sequence
  Synthetic Oligonucleotide; GZMB exon 2; Set C
cugucugcuugugggcacccauggaaucugcuggguggg

SEQ ID NO: 10939 - RNA, 22 nt, Artificial Sequence
  Synthetic Oligonucleotide; GZMB exon 2; Set A
uugugggcacccauggaaucug

SEQ ID NO: 10940 - RNA, 24 nt, Artificial Sequence
  Synthetic Oligonucleotide; GZMB exon 2; Set C
cuugugggcacccauggaaucugc

SEQ ID NO: 10941 - RNA, 40 nt, Artificial Sequence
  Synthetic Oligonucleotide; GZMB exon 2; Set C
ucugucugcuugugggcacccauggaaucugcuggguggg

SEQ ID NO: 10942 - RNA, 23 nt, Artificial Sequence
  Synthetic Oligonucleotide; GZMB exon 2; Set A
cuugugggcacccauggaaucug

SEQ ID NO: 10943 - RNA, 25 nt, Artificial Sequence
  Synthetic Oligonucleotide; GZMB exon 2; Set C
gcuugugggcacccauggaaucugc

SEQ ID NO: 10944 - RNA, 21 nt, Artificial Sequence
  Synthetic Oligonucleotide; GZMB exon 2; Set A
uugugggcacccauggaaucu

SEQ ID NO: 10945 - RNA, 24 nt, Artificial Sequence
  Synthetic Oligonucleotide; GZMB exon 2; Set C
gcuugugggcacccauggaaucug

SEQ ID NO: 10946 - RNA, 26 nt, Artificial Sequence
  Synthetic Oligonucleotide; GZMB exon 2; Set C
ugcuugugggcacccauggaaucugc

SEQ ID NO: 10947 - RNA, 20 nt, Artificial Sequence
  Synthetic Oligonucleotide; GZMB exon 2; Set A
uugugggcacccauggaauc

SEQ ID NO: 10948 - RNA, 22 nt, Artificial Sequence
  Synthetic Oligonucleotide; GZMB exon 2; Set A
cuugugggcacccauggaaucu

SEQ ID NO: 10949 - RNA, 30 nt, Artificial Sequence
  Synthetic Oligonucleotide; GZMB exon 2; Set C
ucugcuugugggcacccauggaaucugcug

SEQ ID NO: 10950 - RNA, 27 nt, Artificial Sequence
  Synthetic Oligonucleotide; GZMB exon 2; Set C
cugcuugugggcacccauggaaucugc

SEQ ID NO: 10951 - RNA, 25 nt, Artificial Sequence
  Synthetic Oligonucleotide; GZMB exon 2; Set C
ugcuugugggcacccauggaaucug

SEQ ID NO: 10952 - RNA, 19 nt, Artificial Sequence
  Synthetic Oligonucleotide; GZMB exon 2; Set A
uugugggcacccauggaau

SEQ ID NO: 10953 - RNA, 21 nt, Artificial Sequence
  Synthetic Oligonucleotide; GZMB exon 2; Set A
cuugugggcacccauggaauc

SEQ ID NO: 10954 - RNA, 23 nt, Artificial Sequence
  Synthetic Oligonucleotide; GZMB exon 2; Set C
gcuugugggcacccauggaaucu

SEQ ID NO: 10955 - RNA, 31 nt, Artificial Sequence
  Synthetic Oligonucleotide; GZMB exon 2; Set C
gucugcuugugggcacccauggaaucugcug

SEQ ID NO: 10956 - RNA, 29 nt, Artificial Sequence
  Synthetic Oligonucleotide; GZMB exon 2; Set C
ucugcuugugggcacccauggaaucugcu

SEQ ID NO: 10957 - RNA, 26 nt, Artificial Sequence
  Synthetic Oligonucleotide; GZMB exon 2; Set C
cugcuugugggcacccauggaaucug

SEQ ID NO: 10958 - RNA, 18 nt, Artificial Sequence
  Synthetic Oligonucleotide; GZMB exon 2; Set A
uugugggcacccauggaa

SEQ ID NO: 10959 - RNA, 24 nt, Artificial Sequence
  Synthetic Oligonucleotide; GZMB exon 2; Set C
ugcuugugggcacccauggaaucu

SEQ ID NO: 10960 - RNA, 30 nt, Artificial Sequence
  Synthetic Oligonucleotide; GZMB exon 2; Set C
gucugcuugugggcacccauggaaucugcu

SEQ ID NO: 10961 - RNA, 32 nt, Artificial Sequence
  Synthetic Oligonucleotide; GZMB exon 2; Set C
ugucugcuugugggcacccauggaaucugcug

SEQ ID NO: 10962 - RNA, 25 nt, Artificial Sequence
  Synthetic Oligonucleotide; GZMB exon 2; Set C
cugcuugugggcacccauggaaucu

SEQ ID NO: 10963 - RNA, 23 nt, Artificial Sequence
  Synthetic Oligonucleotide; GZMB exon 2; Set A
ugcuugugggcacccauggaauc

SEQ ID NO: 10964 - RNA, 33 nt, Artificial Sequence
  Synthetic Oligonucleotide; GZMB exon 2; Set C
cugucugcuugugggcacccauggaaucugcug

SEQ ID NO: 10965 - RNA, 31 nt, Artificial Sequence
  Synthetic Oligonucleotide; GZMB exon 2; Set C
ugucugcuugugggcacccauggaaucugcu

SEQ ID NO: 10966 - RNA, 24 nt, Artificial Sequence
  Synthetic Oligonucleotide; GZMB exon 2; Set C
cugcuugugggcacccauggaauc

SEQ ID NO: 10967 - RNA, 34 nt, Artificial Sequence
  Synthetic Oligonucleotide; GZMB exon 2; Set C
ucugucugcuugugggcacccauggaaucugcug

SEQ ID NO: 10968 - RNA, 32 nt, Artificial Sequence
  Synthetic Oligonucleotide; GZMB exon 2; Set C
cugucugcuugugggcacccauggaaucugcu

SEQ ID NO: 10969 - RNA, 23 nt, Artificial Sequence
  Synthetic Oligonucleotide; GZMB exon 2; Set C
cugcuugugggcacccauggaau

SEQ ID NO: 10970 - RNA, 33 nt, Artificial Sequence
  Synthetic Oligonucleotide; GZMB exon 2; Set C
ucugucugcuugugggcacccauggaaucugcu

SEQ ID NO: 10971 - RNA, 31 nt, Artificial Sequence
  Synthetic Oligonucleotide; GZMB exon 2; Set C
uuggccucaugucccccgaugaucuccccug

SEQ ID NO: 10972 - RNA, 25 nt, Artificial Sequence
  Synthetic Oligonucleotide; GZMB exon 2; Set C
uuggccucaugucccccgaugaucu

SEQ ID NO: 10973 - RNA, 24 nt, Artificial Sequence
  Synthetic Oligonucleotide; GZMB exon 2; Set C
uuggccucaugucccccgaugauc

SEQ ID NO: 10974 - RNA, 20 nt, Artificial Sequence
  Synthetic Oligonucleotide; GZMB exon 2; Set A
uuggccucaugucccccgau

SEQ ID NO: 10975 - RNA, 40 nt, Artificial Sequence
  Synthetic Oligonucleotide; GZMB exon 2; Set C
gggcgggaguggggcuuggccucaugucccccgaugaucu

SEQ ID NO: 10976 - RNA, 35 nt, Artificial Sequence
  Synthetic Oligonucleotide; GZMB exon 2; Set C
gggcgggaguggggcuuggccucaugucccccgau

SEQ ID NO: 10977 - RNA, 15 nt, Artificial Sequence
  Synthetic Oligonucleotide; GZMB exon 2; Set C
cgggaguggggcuug

SEQ ID NO: 10978 - RNA, 16 nt, Artificial Sequence
  Synthetic Oligonucleotide; GZMB exon 2; Set A
gcgggaguggggcuug

SEQ ID NO: 10979 - RNA, 17 nt, Artificial Sequence
  Synthetic Oligonucleotide; GZMB exon 2; Set A
ggcgggaguggggcuug

SEQ ID NO: 10980 - RNA, 19 nt, Artificial Sequence
  Synthetic Oligonucleotide; GZMB exon 2; Set C
gggcgggaguggggcuugg

SEQ ID NO: 10981 - RNA, 20 nt, Artificial Sequence
  Synthetic Oligonucleotide; GZMB exon 2; Set C
ggggcgggaguggggcuugg

SEQ ID NO: 10982 - RNA, 21 nt, Artificial Sequence
  Synthetic Oligonucleotide; GZMB exon 2; Set C
aggggcgggaguggggcuugg

SEQ ID NO: 10983 - RNA, 22 nt, Artificial Sequence
  Synthetic Oligonucleotide; GZMB exon 2; Set C
uaggggcgggaguggggcuugg

SEQ ID NO: 10984 - RNA, 23 nt, Artificial Sequence
  Synthetic Oligonucleotide; GZMB exon 2; Set C
guaggggcgggaguggggcuugg

SEQ ID NO: 10985 - RNA, 24 nt, Artificial Sequence
  Synthetic Oligonucleotide; GZMB exon 2; Set C
uguaggggcgggaguggggcuugg

SEQ ID NO: 10986 - RNA, 25 nt, Artificial Sequence
  Synthetic Oligonucleotide; GZMB exon 2; Set C
auguaggggcgggaguggggcuugg

SEQ ID NO: 10987 - RNA, 25 nt, Artificial Sequence
  Synthetic Oligonucleotide; GZMB exon 2; Set C
auaagccauguaggggcgggagugg

SEQ ID NO: 10988 - RNA, 24 nt, Artificial Sequence
  Synthetic Oligonucleotide; GZMB exon 2; Set A
auaagccauguaggggcgggagug

SEQ ID NO: 10989 - RNA, 23 nt, Artificial Sequence
  Synthetic Oligonucleotide; GZMB exon 2; Set A
auaagccauguaggggcgggagu

SEQ ID NO: 10990 - RNA, 27 nt, Artificial Sequence
  Synthetic Oligonucleotide; GZMB exon 2; Set C
agauaagccauguaggggcgggagugg

SEQ ID NO: 10991 - RNA, 22 nt, Artificial Sequence
  Synthetic Oligonucleotide; GZMB exon 2; Set A
auaagccauguaggggcgggag

SEQ ID NO: 10992 - RNA, 24 nt, Artificial Sequence
  Synthetic Oligonucleotide; GZMB exon 2; Set C
gauaagccauguaggggcgggagu

SEQ ID NO: 10993 - RNA, 21 nt, Artificial Sequence
  Synthetic Oligonucleotide; GZMB exon 2; Set A
auaagccauguaggggcggga

SEQ ID NO: 10994 - RNA, 23 nt, Artificial Sequence
  Synthetic Oligonucleotide; GZMB exon 2; Set A
gauaagccauguaggggcgggag

SEQ ID NO: 10995 - RNA, 25 nt, Artificial Sequence
  Synthetic Oligonucleotide; GZMB exon 2; Set C
agauaagccauguaggggcgggagu

SEQ ID NO: 10996 - RNA, 24 nt, Artificial Sequence
  Synthetic Oligonucleotide; GZMB exon 2; Set A
agauaagccauguaggggcgggag

SEQ ID NO: 10997 - RNA, 22 nt, Artificial Sequence
  Synthetic Oligonucleotide; GZMB exon 2; Set A
gauaagccauguaggggcggga

SEQ ID NO: 10998 - RNA, 20 nt, Artificial Sequence
  Synthetic Oligonucleotide; GZMB exon 2; Set A
auaagccauguaggggcggg

SEQ ID NO: 10999 - RNA, 23 nt, Artificial Sequence
  Synthetic Oligonucleotide; GZMB exon 2; Set A
agauaagccauguaggggcggga

SEQ ID NO: 11000 - RNA, 21 nt, Artificial Sequence
  Synthetic Oligonucleotide; GZMB exon 2; Set A
gauaagccauguaggggcggg

SEQ ID NO: 11001 - RNA, 19 nt, Artificial Sequence
  Synthetic Oligonucleotide; GZMB exon 2; Set A
auaagccauguaggggcgg

SEQ ID NO: 11002 - RNA, 22 nt, Artificial Sequence
  Synthetic Oligonucleotide; GZMB exon 2; Set A
agauaagccauguaggggcggg

SEQ ID NO: 11003 - RNA, 18 nt, Artificial Sequence
  Synthetic Oligonucleotide; GZMB exon 2; Set C
auaagccauguaggggcg

SEQ ID NO: 11004 - RNA, 17 nt, Artificial Sequence
  Synthetic Oligonucleotide; GZMB exon 2; Set C
auaagccauguaggggc

SEQ ID NO: 11005 - RNA, 36 nt, Artificial Sequence
  Synthetic Oligonucleotide; GZMB exon 2; Set C
cagaucauaagauaagccauguaggggcgggagugg

SEQ ID NO: 11006 - RNA, 34 nt, Artificial Sequence
  Synthetic Oligonucleotide; GZMB exon 2; Set C
cagaucauaagauaagccauguaggggcgggagu

SEQ ID NO: 11007 - RNA, 36 nt, Artificial Sequence
  Synthetic Oligonucleotide; GZMB exon 2; Set C
ccagaucauaagauaagccauguaggggcgggagug

SEQ ID NO: 11008 - RNA, 33 nt, Artificial Sequence
  Synthetic Oligonucleotide; GZMB exon 2; Set C
cagaucauaagauaagccauguaggggcgggag

SEQ ID NO: 11009 - RNA, 32 nt, Artificial Sequence
  Synthetic Oligonucleotide; GZMB exon 2; Set C
cagaucauaagauaagccauguaggggcggga

SEQ ID NO: 11010 - RNA, 31 nt, Artificial Sequence
  Synthetic Oligonucleotide; GZMB exon 2; Set C
cagaucauaagauaagccauguaggggcggg

SEQ ID NO: 11011 - RNA, 31 nt, Artificial Sequence
  Synthetic Oligonucleotide; GZMB exon 2; Set C
ccagaucauaagauaagccauguaggggcgg

SEQ ID NO: 11012 - RNA, 30 nt, Artificial Sequence
  Synthetic Oligonucleotide; GZMB exon 2; Set A
ccagaucauaagauaagccauguaggggcg

SEQ ID NO: 11013 - RNA, 29 nt, Artificial Sequence
  Synthetic Oligonucleotide; GZMB exon 2; Set A
ccagaucauaagauaagccauguaggggc

SEQ ID NO: 11014 - RNA, 30 nt, Artificial Sequence
  Synthetic Oligonucleotide; GZMB exon 2; Set A
ucccagaucauaagauaagccauguagggg

SEQ ID NO: 11015 - RNA, 29 nt, Artificial Sequence
  Synthetic Oligonucleotide; GZMB exon 2; Set A
ucccagaucauaagauaagccauguaggg

SEQ ID NO: 11016 - RNA, 28 nt, Artificial Sequence
  Synthetic Oligonucleotide; GZMB exon 2; Set A
ucccagaucauaagauaagccauguagg

SEQ ID NO: 11017 - RNA, 27 nt, Artificial Sequence
  Synthetic Oligonucleotide; GZMB exon 2; Set A
ucccagaucauaagauaagccauguag

SEQ ID NO: 11018 - RNA, 26 nt, Artificial Sequence
  Synthetic Oligonucleotide; GZMB exon 2; Set A
ucccagaucauaagauaagccaugua

SEQ ID NO: 11019 - RNA, 25 nt, Artificial Sequence
  Synthetic Oligonucleotide; GZMB exon 2; Set A
ucccagaucauaagauaagccaugu

SEQ ID NO: 11020 - RNA, 35 nt, Artificial Sequence
  Synthetic Oligonucleotide; GZMB exon 2; Set C
ucugaucccagaucauaagauaagccauguagggg

SEQ ID NO: 11021 - RNA, 24 nt, Artificial Sequence
  Synthetic Oligonucleotide; GZMB exon 2; Set C
ucccagaucauaagauaagccaug

SEQ ID NO: 11022 - RNA, 34 nt, Artificial Sequence
  Synthetic Oligonucleotide; GZMB exon 2; Set A
ucugaucccagaucauaagauaagccauguaggg

SEQ ID NO: 11023 - RNA, 33 nt, Artificial Sequence
  Synthetic Oligonucleotide; GZMB exon 2; Set A
ucugaucccagaucauaagauaagccauguagg

SEQ ID NO: 11024 - RNA, 32 nt, Artificial Sequence
  Synthetic Oligonucleotide; GZMB exon 2; Set A
ucugaucccagaucauaagauaagccauguag

SEQ ID NO: 11025 - RNA, 31 nt, Artificial Sequence
  Synthetic Oligonucleotide; GZMB exon 2; Set A
ucugaucccagaucauaagauaagccaugua

SEQ ID NO: 11026 - RNA, 30 nt, Artificial Sequence
  Synthetic Oligonucleotide; GZMB exon 2; Set A
ucugaucccagaucauaagauaagccaugu

SEQ ID NO: 11027 - RNA, 29 nt, Artificial Sequence
  Synthetic Oligonucleotide; GZMB exon 2; Set A
ucugaucccagaucauaagauaagccaug

SEQ ID NO: 11028 - RNA, 17 nt, Artificial Sequence
  Synthetic Oligonucleotide; GZMB exon 2; Set C
ucccagaucauaagaua

SEQ ID NO: 11029 - RNA, 15 nt, Artificial Sequence
  Synthetic Oligonucleotide; GZMB exon 2; Set C
cccagaucauaagau

SEQ ID NO: 11030 - RNA, 22 nt, Artificial Sequence
  Synthetic Oligonucleotide; GZMB exon 2; Set C
ucugaucccagaucauaagaua

SEQ ID NO: 11031 - RNA, 24 nt, Artificial Sequence
  Synthetic Oligonucleotide; GZMB exon 2; Set C
acuucugaucccagaucauaagau

SEQ ID NO: 11032 - RNA, 23 nt, Artificial Sequence
  Synthetic Oligonucleotide; GZMB exon 2; Set C
acuucugaucccagaucauaaga

SEQ ID NO: 11033 - RNA, 25 nt, Artificial Sequence
  Synthetic Oligonucleotide; GZMB exon 2; Set C
gacuucugaucccagaucauaagau

SEQ ID NO: 11034 - RNA, 24 nt, Artificial Sequence
  Synthetic Oligonucleotide; GZMB exon 2; Set C
gacuucugaucccagaucauaaga

SEQ ID NO: 11035 - RNA, 26 nt, Artificial Sequence
  Synthetic Oligonucleotide; GZMB exon 2; Set C
agacuucugaucccagaucauaagau

SEQ ID NO: 11036 - RNA, 25 nt, Artificial Sequence
  Synthetic Oligonucleotide; GZMB exon 2; Set C
agacuucugaucccagaucauaaga

SEQ ID NO: 11037 - RNA, 27 nt, Artificial Sequence
  Synthetic Oligonucleotide; GZMB exon 2; Set A
gagacuucugaucccagaucauaagau

SEQ ID NO: 11038 - RNA, 26 nt, Artificial Sequence
  Synthetic Oligonucleotide; GZMB exon 2; Set A
gagacuucugaucccagaucauaaga

SEQ ID NO: 11039 - RNA, 27 nt, Artificial Sequence
  Synthetic Oligonucleotide; GZMB exon 2; Set A
agagacuucugaucccagaucauaaga

SEQ ID NO: 11040 - RNA, 15 nt, Artificial Sequence
  Synthetic Oligonucleotide; GZMB exon 2; Set C
gacuucugaucccag

SEQ ID NO: 11041 - RNA, 15 nt, Artificial Sequence
  Synthetic Oligonucleotide; GZMB exon 2; Set C
gagacuucugauccc

SEQ ID NO: 11042 - RNA, 16 nt, Artificial Sequence
  Synthetic Oligonucleotide; GZMB exon 2; Set C
agagacuucugauccc

SEQ ID NO: 11043 - RNA, 16 nt, Artificial Sequence
  Synthetic Oligonucleotide; GZMB exon 2; Set C
cagagacuucugaucc

SEQ ID NO: 11044 - RNA, 17 nt, Artificial Sequence
  Synthetic Oligonucleotide; GZMB exon 2; Set C
ucagagacuucugaucc

SEQ ID NO: 11045 - RNA, 20 nt, Artificial Sequence
  Synthetic Oligonucleotide; GZMB exon 2; Set C
cuucagagacuucugauccc

SEQ ID NO: 11046 - RNA, 18 nt, Artificial Sequence
  Synthetic Oligonucleotide; GZMB exon 2; Set C
uucagagacuucugaucc

SEQ ID NO: 11047 - RNA, 21 nt, Artificial Sequence
  Synthetic Oligonucleotide; GZMB exon 2; Set C
ucuucagagacuucugauccc

SEQ ID NO: 11048 - RNA, 19 nt, Artificial Sequence
  Synthetic Oligonucleotide; GZMB exon 2; Set C
cuucagagacuucugaucc

SEQ ID NO: 11049 - RNA, 20 nt, Artificial Sequence
  Synthetic Oligonucleotide; GZMB exon 2; Set C
ucuucagagacuucugaucc

SEQ ID NO: 11050 - RNA, 26 nt, Artificial Sequence
  Synthetic Oligonucleotide; GZMB exon 2; Set C
gcaccucuucagagacuucugauccc

SEQ ID NO: 11051 - RNA, 25 nt, Artificial Sequence
  Synthetic Oligonucleotide; GZMB exon 2; Set A
gcaccucuucagagacuucugaucc

SEQ ID NO: 11052 - RNA, 15 nt, Artificial Sequence
  Synthetic Oligonucleotide; GZMB exon 2; Set C
ucuucagagacuucu

SEQ ID NO: 11053 - RNA, 20 nt, Artificial Sequence
  Synthetic Oligonucleotide; GZMB exon 2; Set A
gcaccucuucagagacuucu

SEQ ID NO: 11054 - RNA, 39 nt, Artificial Sequence
  Synthetic Oligonucleotide; GZMB exon 2; Set C
aggaagccaccgcaccucuucagagacuucugaucccag

SEQ ID NO: 11055 - RNA, 35 nt, Artificial Sequence
  Synthetic Oligonucleotide; GZMB exon 2; Set C
gaagccaccgcaccucuucagagacuucugauccc

SEQ ID NO: 11056 - RNA, 36 nt, Artificial Sequence
  Synthetic Oligonucleotide; GZMB exon 2; Set C
ggaagccaccgcaccucuucagagacuucugauccc

SEQ ID NO: 11057 - RNA, 38 nt, Artificial Sequence
  Synthetic Oligonucleotide; GZMB exon 2; Set C
caggaagccaccgcaccucuucagagacuucugauccc

SEQ ID NO: 11058 - RNA, 39 nt, Artificial Sequence
  Synthetic Oligonucleotide; GZMB exon 2; Set C
ucaggaagccaccgcaccucuucagagacuucugauccc

SEQ ID NO: 11059 - RNA, 29 nt, Artificial Sequence
  Synthetic Oligonucleotide; GZMB exon 2; Set C
gaagccaccgcaccucuucagagacuucu

SEQ ID NO: 11060 - RNA, 40 nt, Artificial Sequence
  Synthetic Oligonucleotide; GZMB exon 2; Set C
uaucaggaagccaccgcaccucuucagagacuucugaucc

SEQ ID NO: 11061 - RNA, 30 nt, Artificial Sequence
  Synthetic Oligonucleotide; GZMB exon 2; Set C
ggaagccaccgcaccucuucagagacuucu

SEQ ID NO: 11062 - RNA, 26 nt, Artificial Sequence
  Synthetic Oligonucleotide; GZMB exon 2; Set C
gaagccaccgcaccucuucagagacu

SEQ ID NO: 11063 - RNA, 25 nt, Artificial Sequence
  Synthetic Oligonucleotide; GZMB exon 2; Set C
gaagccaccgcaccucuucagagac

SEQ ID NO: 11064 - RNA, 27 nt, Artificial Sequence
  Synthetic Oligonucleotide; GZMB exon 2; Set C
ggaagccaccgcaccucuucagagacu

SEQ ID NO: 11065 - RNA, 33 nt, Artificial Sequence
  Synthetic Oligonucleotide; GZMB exon 2; Set C
ucaggaagccaccgcaccucuucagagacuucu

SEQ ID NO: 11066 - RNA, 26 nt, Artificial Sequence
  Synthetic Oligonucleotide; GZMB exon 2; Set C
ggaagccaccgcaccucuucagagac

SEQ ID NO: 11067 - RNA, 29 nt, Artificial Sequence
  Synthetic Oligonucleotide; GZMB exon 2; Set C
caggaagccaccgcaccucuucagagacu

SEQ ID NO: 11068 - RNA, 35 nt, Artificial Sequence
  Synthetic Oligonucleotide; GZMB exon 2; Set C
uaucaggaagccaccgcaccucuucagagacuucu

SEQ ID NO: 11069 - RNA, 26 nt, Artificial Sequence
  Synthetic Oligonucleotide; GZMB exon 2; Set C
aggaagccaccgcaccucuucagaga

SEQ ID NO: 11070 - RNA, 28 nt, Artificial Sequence
  Synthetic Oligonucleotide; GZMB exon 2; Set C
caggaagccaccgcaccucuucagagac

SEQ ID NO: 11071 - RNA, 30 nt, Artificial Sequence
  Synthetic Oligonucleotide; GZMB exon 2; Set C
ucaggaagccaccgcaccucuucagagacu

SEQ ID NO: 11072 - RNA, 36 nt, Artificial Sequence
  Synthetic Oligonucleotide; GZMB exon 2; Set C
guaucaggaagccaccgcaccucuucagagacuucu

SEQ ID NO: 11073 - RNA, 25 nt, Artificial Sequence
  Synthetic Oligonucleotide; GZMB exon 2; Set C
aggaagccaccgcaccucuucagag

SEQ ID NO: 11074 - RNA, 29 nt, Artificial Sequence
  Synthetic Oligonucleotide; GZMB exon 2; Set C
ucaggaagccaccgcaccucuucagagac

SEQ ID NO: 11075 - RNA, 31 nt, Artificial Sequence
  Synthetic Oligonucleotide; GZMB exon 2; Set C
aucaggaagccaccgcaccucuucagagacu

SEQ ID NO: 11076 - RNA, 24 nt, Artificial Sequence
  Synthetic Oligonucleotide; GZMB exon 2; Set C
aggaagccaccgcaccucuucaga

SEQ ID NO: 11077 - RNA, 30 nt, Artificial Sequence
  Synthetic Oligonucleotide; GZMB exon 2; Set C
aucaggaagccaccgcaccucuucagagac

SEQ ID NO: 11078 - RNA, 32 nt, Artificial Sequence
  Synthetic Oligonucleotide; GZMB exon 2; Set C
uaucaggaagccaccgcaccucuucagagacu

SEQ ID NO: 11079 - RNA, 29 nt, Artificial Sequence
  Synthetic Oligonucleotide; GZMB exon 2; Set C
aucaggaagccaccgcaccucuucagaga

SEQ ID NO: 11080 - RNA, 31 nt, Artificial Sequence
  Synthetic Oligonucleotide; GZMB exon 2; Set C
uaucaggaagccaccgcaccucuucagagac

SEQ ID NO: 11081 - RNA, 33 nt, Artificial Sequence
  Synthetic Oligonucleotide; GZMB exon 2; Set C
guaucaggaagccaccgcaccucuucagagacu

SEQ ID NO: 11082 - RNA, 28 nt, Artificial Sequence
  Synthetic Oligonucleotide; GZMB exon 2; Set C
aucaggaagccaccgcaccucuucagag

SEQ ID NO: 11083 - RNA, 32 nt, Artificial Sequence
  Synthetic Oligonucleotide; GZMB exon 2; Set C
guaucaggaagccaccgcaccucuucagagac

SEQ ID NO: 11084 - RNA, 17 nt, Artificial Sequence
  Synthetic Oligonucleotide; GZMB exon 2; Set A
gaagccaccgcaccucu

SEQ ID NO: 11085 - RNA, 27 nt, Artificial Sequence
  Synthetic Oligonucleotide; GZMB exon 2; Set C
aucaggaagccaccgcaccucuucaga

SEQ ID NO: 11086 - RNA, 18 nt, Artificial Sequence
  Synthetic Oligonucleotide; GZMB exon 2; Set A
ggaagccaccgcaccucu

SEQ ID NO: 11087 - RNA, 20 nt, Artificial Sequence
  Synthetic Oligonucleotide; GZMB exon 2; Set A
aggaagccaccgcaccucuu

SEQ ID NO: 11088 - RNA, 32 nt, Artificial Sequence
  Synthetic Oligonucleotide; GZMB exon 2; Set C
cguaucaggaagccaccgcaccucuucagaga

SEQ ID NO: 11089 - RNA, 19 nt, Artificial Sequence
  Synthetic Oligonucleotide; GZMB exon 2; Set A
aggaagccaccgcaccucu

SEQ ID NO: 11090 - RNA, 21 nt, Artificial Sequence
  Synthetic Oligonucleotide; GZMB exon 2; Set C
caggaagccaccgcaccucuu

SEQ ID NO: 11091 - RNA, 31 nt, Artificial Sequence
  Synthetic Oligonucleotide; GZMB exon 2; Set C
cguaucaggaagccaccgcaccucuucagag

SEQ ID NO: 11092 - RNA, 20 nt, Artificial Sequence
  Synthetic Oligonucleotide; GZMB exon 2; Set C
caggaagccaccgcaccucu

SEQ ID NO: 11093 - RNA, 30 nt, Artificial Sequence
  Synthetic Oligonucleotide; GZMB exon 2; Set C
cguaucaggaagccaccgcaccucuucaga

SEQ ID NO: 11094 - RNA, 29 nt, Artificial Sequence
  Synthetic Oligonucleotide; GZMB exon 2; Set C
cguaucaggaagccaccgcaccucuucag

SEQ ID NO: 11095 - RNA, 23 nt, Artificial Sequence
  Synthetic Oligonucleotide; GZMB exon 2; Set C
aucaggaagccaccgcaccucuu

SEQ ID NO: 11096 - RNA, 28 nt, Artificial Sequence
  Synthetic Oligonucleotide; GZMB exon 2; Set C
cguaucaggaagccaccgcaccucuuca

SEQ ID NO: 11097 - RNA, 22 nt, Artificial Sequence
  Synthetic Oligonucleotide; GZMB exon 2; Set C
aucaggaagccaccgcaccucu

SEQ ID NO: 11098 - RNA, 27 nt, Artificial Sequence
  Synthetic Oligonucleotide; GZMB exon 2; Set C
cguaucaggaagccaccgcaccucuuc

SEQ ID NO: 11099 - RNA, 26 nt, Artificial Sequence
  Synthetic Oligonucleotide; GZMB exon 2; Set C
cguaucaggaagccaccgcaccucuu

SEQ ID NO: 11100 - RNA, 25 nt, Artificial Sequence
  Synthetic Oligonucleotide; GZMB exon 2; Set C
cguaucaggaagccaccgcaccucu

SEQ ID NO: 11101 - RNA, 15 nt, Artificial Sequence
  Synthetic Oligonucleotide; GZMB exon 2; Set C
caggaagccaccgca

SEQ ID NO: 11102 - RNA, 17 nt, Artificial Sequence
  Synthetic Oligonucleotide; GZMB exon 2; Set A
aucaggaagccaccgca

SEQ ID NO: 11103 - RNA, 20 nt, Artificial Sequence
  Synthetic Oligonucleotide; GZMB exon 2; Set A
cguaucaggaagccaccgca

SEQ ID NO: 11104 - RNA, 30 nt, Artificial Sequence
  Synthetic Oligonucleotide; GZMB exon 2; Set C
gcugucagcacgaagucgucucguaucagg

SEQ ID NO: 11105 - RNA, 35 nt, Artificial Sequence
  Synthetic Oligonucleotide; GZMB exon 2; Set C
gcagcugucagcacgaagucgucucguaucaggaa

SEQ ID NO: 11106 - RNA, 31 nt, Artificial Sequence
  Synthetic Oligonucleotide; GZMB exon 2; Set C
agcugucagcacgaagucgucucguaucagg

SEQ ID NO: 11107 - RNA, 19 nt, Artificial Sequence
  Synthetic Oligonucleotide; GZMB exon 2; Set A
cagcacgaagucgucucgu

SEQ ID NO: 11108 - RNA, 36 nt, Artificial Sequence
  Synthetic Oligonucleotide; GZMB exon 2; Set C
agcagcugucagcacgaagucgucucguaucaggaa

SEQ ID NO: 11109 - RNA, 34 nt, Artificial Sequence
  Synthetic Oligonucleotide; GZMB exon 2; Set C
gcagcugucagcacgaagucgucucguaucagga

SEQ ID NO: 11110 - RNA, 32 nt, Artificial Sequence
  Synthetic Oligonucleotide; GZMB exon 2; Set C
cagcugucagcacgaagucgucucguaucagg

SEQ ID NO: 11111 - RNA, 20 nt, Artificial Sequence
  Synthetic Oligonucleotide; GZMB exon 2; Set A
ucagcacgaagucgucucgu

SEQ ID NO: 11112 - RNA, 37 nt, Artificial Sequence
  Synthetic Oligonucleotide; GZMB exon 2; Set C
gagcagcugucagcacgaagucgucucguaucaggaa

SEQ ID NO: 11113 - RNA, 35 nt, Artificial Sequence
  Synthetic Oligonucleotide; GZMB exon 2; Set C
agcagcugucagcacgaagucgucucguaucagga

SEQ ID NO: 11114 - RNA, 31 nt, Artificial Sequence
  Synthetic Oligonucleotide; GZMB exon 2; Set C
cagcugucagcacgaagucgucucguaucag

SEQ ID NO: 11115 - RNA, 27 nt, Artificial Sequence
  Synthetic Oligonucleotide; GZMB exon 2; Set C
gcugucagcacgaagucgucucguauc

SEQ ID NO: 11116 - RNA, 21 nt, Artificial Sequence
  Synthetic Oligonucleotide; GZMB exon 2; Set A
gucagcacgaagucgucucgu

SEQ ID NO: 11117 - RNA, 36 nt, Artificial Sequence
  Synthetic Oligonucleotide; GZMB exon 2; Set C
gagcagcugucagcacgaagucgucucguaucagga

SEQ ID NO: 11118 - RNA, 30 nt, Artificial Sequence
  Synthetic Oligonucleotide; GZMB exon 2; Set C
cagcugucagcacgaagucgucucguauca

SEQ ID NO: 11119 - RNA, 32 nt, Artificial Sequence
  Synthetic Oligonucleotide; GZMB exon 2; Set C
gcagcugucagcacgaagucgucucguaucag

SEQ ID NO: 11120 - RNA, 28 nt, Artificial Sequence
  Synthetic Oligonucleotide; GZMB exon 2; Set C
agcugucagcacgaagucgucucguauc

SEQ ID NO: 11121 - RNA, 22 nt, Artificial Sequence
  Synthetic Oligonucleotide; GZMB exon 2; Set A
ugucagcacgaagucgucucgu

SEQ ID NO: 11122 - RNA, 31 nt, Artificial Sequence
  Synthetic Oligonucleotide; GZMB exon 2; Set C
gcagcugucagcacgaagucgucucguauca

SEQ ID NO: 11123 - RNA, 33 nt, Artificial Sequence
  Synthetic Oligonucleotide; GZMB exon 2; Set C
agcagcugucagcacgaagucgucucguaucag

SEQ ID NO: 11124 - RNA, 29 nt, Artificial Sequence
  Synthetic Oligonucleotide; GZMB exon 2; Set C
cagcugucagcacgaagucgucucguauc

SEQ ID NO: 11125 - RNA, 23 nt, Artificial Sequence
  Synthetic Oligonucleotide; GZMB exon 2; Set A
cugucagcacgaagucgucucgu

SEQ ID NO: 11126 - RNA, 28 nt, Artificial Sequence
  Synthetic Oligonucleotide; GZMB exon 2; Set C
cagcugucagcacgaagucgucucguau

SEQ ID NO: 11127 - RNA, 32 nt, Artificial Sequence
  Synthetic Oligonucleotide; GZMB exon 2; Set C
agcagcugucagcacgaagucgucucguauca

SEQ ID NO: 11128 - RNA, 34 nt, Artificial Sequence
  Synthetic Oligonucleotide; GZMB exon 2; Set C
gagcagcugucagcacgaagucgucucguaucag

SEQ ID NO: 11129 - RNA, 29 nt, Artificial Sequence
  Synthetic Oligonucleotide; GZMB exon 2; Set C
gcagcugucagcacgaagucgucucguau

SEQ ID NO: 11130 - RNA, 27 nt, Artificial Sequence
  Synthetic Oligonucleotide; GZMB exon 2; Set C
cagcugucagcacgaagucgucucgua

SEQ ID NO: 11131 - RNA, 33 nt, Artificial Sequence
  Synthetic Oligonucleotide; GZMB exon 2; Set C
gagcagcugucagcacgaagucgucucguauca

SEQ ID NO: 11132 - RNA, 30 nt, Artificial Sequence
  Synthetic Oligonucleotide; GZMB exon 2; Set C
agcagcugucagcacgaagucgucucguau

SEQ ID NO: 11133 - RNA, 28 nt, Artificial Sequence
  Synthetic Oligonucleotide; GZMB exon 2; Set C
gcagcugucagcacgaagucgucucgua

SEQ ID NO: 11134 - RNA, 32 nt, Artificial Sequence
  Synthetic Oligonucleotide; GZMB exon 2; Set C
gagcagcugucagcacgaagucgucucguauc

SEQ ID NO: 11135 - RNA, 31 nt, Artificial Sequence
  Synthetic Oligonucleotide; GZMB exon 2; Set C
gagcagcugucagcacgaagucgucucguau

SEQ ID NO: 11136 - RNA, 29 nt, Artificial Sequence
  Synthetic Oligonucleotide; GZMB exon 2; Set C
agcagcugucagcacgaagucgucucgua

SEQ ID NO: 11137 - RNA, 30 nt, Artificial Sequence
  Synthetic Oligonucleotide; GZMB exon 2; Set C
gagcagcugucagcacgaagucgucucgua

SEQ ID NO: 11138 - RNA, 30 nt, Artificial Sequence
  Synthetic Oligonucleotide; GZMB exon 2; Set C
ugagcagcugucagcacgaagucgucucgu

SEQ ID NO: 11139 - RNA, 31 nt, Artificial Sequence
  Synthetic Oligonucleotide; GZMB exon 2; Set C
gugagcagcugucagcacgaagucgucucgu

SEQ ID NO: 11140 - RNA, 33 nt, Artificial Sequence
  Synthetic Oligonucleotide; GZMB exon 2; Set C
cagugagcagcugucagcacgaagucgucucgu

SEQ ID NO: 11141 - RNA, 34 nt, Artificial Sequence
  Synthetic Oligonucleotide; GZMB exon 2; Set C
acagugagcagcugucagcacgaagucgucucgu

SEQ ID NO: 11142 - RNA, 39 nt, Artificial Sequence
  Synthetic Oligonucleotide; GZMB exon 2; Set C
ccaacagugagcagcugucagcacgaagucgucucguau

SEQ ID NO: 11143 - RNA, 35 nt, Artificial Sequence
  Synthetic Oligonucleotide; GZMB exon 2; Set C
aacagugagcagcugucagcacgaagucgucucgu

SEQ ID NO: 11144 - RNA, 40 nt, Artificial Sequence
  Synthetic Oligonucleotide; GZMB exon 2; Set C
cccaacagugagcagcugucagcacgaagucgucucguau

SEQ ID NO: 11145 - RNA, 38 nt, Artificial Sequence
  Synthetic Oligonucleotide; GZMB exon 2; Set C
ccaacagugagcagcugucagcacgaagucgucucgua

SEQ ID NO: 11146 - RNA, 36 nt, Artificial Sequence
  Synthetic Oligonucleotide; GZMB exon 2; Set C
caacagugagcagcugucagcacgaagucgucucgu

SEQ ID NO: 11147 - RNA, 39 nt, Artificial Sequence
  Synthetic Oligonucleotide; GZMB exon 2; Set C
cccaacagugagcagcugucagcacgaagucgucucgua

SEQ ID NO: 11148 - RNA, 24 nt, Artificial Sequence
  Synthetic Oligonucleotide; GZMB exon 2; Set B
agugagcagcugucagcacgaagu

SEQ ID NO: 11149 - RNA, 25 nt, Artificial Sequence
  Synthetic Oligonucleotide; GZMB exon 2; Set C
cagugagcagcugucagcacgaagu

SEQ ID NO: 11150 - RNA, 23 nt, Artificial Sequence
  Synthetic Oligonucleotide; GZMB exon 2; Set B
agugagcagcugucagcacgaag

SEQ ID NO: 11151 - RNA, 26 nt, Artificial Sequence
  Synthetic Oligonucleotide; GZMB exon 2; Set C
acagugagcagcugucagcacgaagu

SEQ ID NO: 11152 - RNA, 24 nt, Artificial Sequence
  Synthetic Oligonucleotide; GZMB exon 2; Set B
cagugagcagcugucagcacgaag

SEQ ID NO: 11153 - RNA, 37 nt, Artificial Sequence
  Synthetic Oligonucleotide; GZMB exon 2; Set C
cuuccccaacagugagcagcugucagcacgaagucgu

SEQ ID NO: 11154 - RNA, 17 nt, Artificial Sequence
  Synthetic Oligonucleotide; GZMB exon 2; Set C
agugagcagcugucagc

SEQ ID NO: 11155 - RNA, 36 nt, Artificial Sequence
  Synthetic Oligonucleotide; GZMB exon 2; Set C
cuuccccaacagugagcagcugucagcacgaagucg

SEQ ID NO: 11156 - RNA, 18 nt, Artificial Sequence
  Synthetic Oligonucleotide; GZMB exon 2; Set B
cagugagcagcugucagc

SEQ ID NO: 11157 - RNA, 35 nt, Artificial Sequence
  Synthetic Oligonucleotide; GZMB exon 2; Set C
cuuccccaacagugagcagcugucagcacgaaguc

SEQ ID NO: 11158 - RNA, 16 nt, Artificial Sequence
  Synthetic Oligonucleotide; GZMB exon 2; Set C
ccaacagugagcagcu

SEQ ID NO: 11159 - RNA, 15 nt, Artificial Sequence
  Synthetic Oligonucleotide; GZMB exon 2; Set C
ccaacagugagcagc

SEQ ID NO: 11160 - RNA, 17 nt, Artificial Sequence
  Synthetic Oligonucleotide; GZMB exon 2; Set C
cccaacagugagcagcu

SEQ ID NO: 11161 - RNA, 16 nt, Artificial Sequence
  Synthetic Oligonucleotide; GZMB exon 2; Set C
cccaacagugagcagc

SEQ ID NO: 11162 - RNA, 23 nt, Artificial Sequence
  Synthetic Oligonucleotide; GZMB exon 2; Set B
cuuccccaacagugagcagcugu

SEQ ID NO: 11163 - RNA, 15 nt, Artificial Sequence
  Synthetic Oligonucleotide; GZMB exon 2; Set C
cccaacagugagcag

SEQ ID NO: 11164 - RNA, 22 nt, Artificial Sequence
  Synthetic Oligonucleotide; GZMB exon 2; Set B
cuuccccaacagugagcagcug

SEQ ID NO: 11165 - RNA, 15 nt, Artificial Sequence
  Synthetic Oligonucleotide; GZMB exon 2; Set C
cuuccccaacaguga

SEQ ID NO: 11166 - RNA, 32 nt, Artificial Sequence
  Synthetic Oligonucleotide; GZMB exon 2; Set C
ucugcuccucaccuuccccaacagugagcagc

SEQ ID NO: 11167 - RNA, 31 nt, Artificial Sequence
  Synthetic Oligonucleotide; GZMB exon 2; Set C
ucugcuccucaccuuccccaacagugagcag

SEQ ID NO: 11168 - RNA, 32 nt, Artificial Sequence
  Synthetic Oligonucleotide; GZMB exon 2; Set C
uucugcuccucaccuuccccaacagugagcag

SEQ ID NO: 11169 - RNA, 30 nt, Artificial Sequence
  Synthetic Oligonucleotide; GZMB exon 2; Set C
ucugcuccucaccuuccccaacagugagca

SEQ ID NO: 11170 - RNA, 37 nt, Artificial Sequence
  Synthetic Oligonucleotide; GZMB exon 2; Set C
guuuucugcuccucaccuuccccaacagugagcagcu

SEQ ID NO: 11171 - RNA, 29 nt, Artificial Sequence
  Synthetic Oligonucleotide; GZMB exon 2; Set C
ucugcuccucaccuuccccaacagugagc

SEQ ID NO: 11172 - RNA, 31 nt, Artificial Sequence
  Synthetic Oligonucleotide; GZMB exon 2; Set C
uucugcuccucaccuuccccaacagugagca

SEQ ID NO: 11173 - RNA, 38 nt, Artificial Sequence
  Synthetic Oligonucleotide; GZMB exon 2; Set C
uguuuucugcuccucaccuuccccaacagugagcagcu

SEQ ID NO: 11174 - RNA, 36 nt, Artificial Sequence
  Synthetic Oligonucleotide; GZMB exon 2; Set C
guuuucugcuccucaccuuccccaacagugagcagc

SEQ ID NO: 11175 - RNA, 28 nt, Artificial Sequence
  Synthetic Oligonucleotide; GZMB exon 2; Set C
ucugcuccucaccuuccccaacagugag

SEQ ID NO: 11176 - RNA, 30 nt, Artificial Sequence
  Synthetic Oligonucleotide; GZMB exon 2; Set C
uucugcuccucaccuuccccaacagugagc

SEQ ID NO: 11177 - RNA, 32 nt, Artificial Sequence
  Synthetic Oligonucleotide; GZMB exon 2; Set C
uuucugcuccucaccuuccccaacagugagca

SEQ ID NO: 11178 - RNA, 37 nt, Artificial Sequence
  Synthetic Oligonucleotide; GZMB exon 2; Set C
uguuuucugcuccucaccuuccccaacagugagcagc

SEQ ID NO: 11179 - RNA, 35 nt, Artificial Sequence
  Synthetic Oligonucleotide; GZMB exon 2; Set C
guuuucugcuccucaccuuccccaacagugagcag

SEQ ID NO: 11180 - RNA, 29 nt, Artificial Sequence
  Synthetic Oligonucleotide; GZMB exon 2; Set C
uucugcuccucaccuuccccaacagugag

SEQ ID NO: 11181 - RNA, 31 nt, Artificial Sequence
  Synthetic Oligonucleotide; GZMB exon 2; Set C
uuucugcuccucaccuuccccaacagugagc

SEQ ID NO: 11182 - RNA, 33 nt, Artificial Sequence
  Synthetic Oligonucleotide; GZMB exon 2; Set C
uuuucugcuccucaccuuccccaacagugagca

SEQ ID NO: 11183 - RNA, 36 nt, Artificial Sequence
  Synthetic Oligonucleotide; GZMB exon 2; Set C
uguuuucugcuccucaccuuccccaacagugagcag

SEQ ID NO: 11184 - RNA, 30 nt, Artificial Sequence
  Synthetic Oligonucleotide; GZMB exon 2; Set C
uuucugcuccucaccuuccccaacagugag

SEQ ID NO: 11185 - RNA, 32 nt, Artificial Sequence
  Synthetic Oligonucleotide; GZMB exon 2; Set C
uuuucugcuccucaccuuccccaacagugagc

SEQ ID NO: 11186 - RNA, 34 nt, Artificial Sequence
  Synthetic Oligonucleotide; GZMB exon 2; Set C
guuuucugcuccucaccuuccccaacagugagca

SEQ ID NO: 11187 - RNA, 31 nt, Artificial Sequence
  Synthetic Oligonucleotide; GZMB exon 2; Set C
uuuucugcuccucaccuuccccaacagugag

SEQ ID NO: 11188 - RNA, 33 nt, Artificial Sequence
  Synthetic Oligonucleotide; GZMB exon 2; Set C
guuuucugcuccucaccuuccccaacagugagc

SEQ ID NO: 11189 - RNA, 35 nt, Artificial Sequence
  Synthetic Oligonucleotide; GZMB exon 2; Set C
uguuuucugcuccucaccuuccccaacagugagca

SEQ ID NO: 11190 - RNA, 32 nt, Artificial Sequence
  Synthetic Oligonucleotide; GZMB exon 2; Set C
guuuucugcuccucaccuuccccaacagugag

SEQ ID NO: 11191 - RNA, 34 nt, Artificial Sequence
  Synthetic Oligonucleotide; GZMB exon 2; Set C
uguuuucugcuccucaccuuccccaacagugagc

SEQ ID NO: 11192 - RNA, 23 nt, Artificial Sequence
  Synthetic Oligonucleotide; GZMB exon 2; Set C
ucugcuccucaccuuccccaaca

SEQ ID NO: 11193 - RNA, 33 nt, Artificial Sequence
  Synthetic Oligonucleotide; GZMB exon 2; Set C
uguuuucugcuccucaccuuccccaacagugag

SEQ ID NO: 11194 - RNA, 22 nt, Artificial Sequence
  Synthetic Oligonucleotide; GZMB exon 2; Set B
ucugcuccucaccuuccccaac

SEQ ID NO: 11195 - RNA, 23 nt, Artificial Sequence
  Synthetic Oligonucleotide; GZMB exon 2; Set C
uucugcuccucaccuuccccaac

SEQ ID NO: 11196 - RNA, 21 nt, Artificial Sequence
  Synthetic Oligonucleotide; GZMB exon 2; Set B
ucugcuccucaccuuccccaa

SEQ ID NO: 11197 - RNA, 22 nt, Artificial Sequence
  Synthetic Oligonucleotide; GZMB exon 2; Set B
uucugcuccucaccuuccccaa

SEQ ID NO: 11198 - RNA, 26 nt, Artificial Sequence
  Synthetic Oligonucleotide; GZMB exon 2; Set C
guuuucugcuccucaccuuccccaac

SEQ ID NO: 11199 - RNA, 38 nt, Artificial Sequence
  Synthetic Oligonucleotide; GZMB exon 2; Set C
ugggcuguuuucugcuccucaccuuccccaacagugag

SEQ ID NO: 11200 - RNA, 40 nt, Artificial Sequence
  Synthetic Oligonucleotide; GZMB exon 2; Set C
gugggcuguuuucugcuccucaccuuccccaacagugagc

SEQ ID NO: 11201 - RNA, 27 nt, Artificial Sequence
  Synthetic Oligonucleotide; GZMB exon 2; Set C
uguuuucugcuccucaccuuccccaac

SEQ ID NO: 11202 - RNA, 25 nt, Artificial Sequence
  Synthetic Oligonucleotide; GZMB exon 2; Set C
guuuucugcuccucaccuuccccaa

SEQ ID NO: 11203 - RNA, 39 nt, Artificial Sequence
  Synthetic Oligonucleotide; GZMB exon 2; Set C
gugggcuguuuucugcuccucaccuuccccaacagugag

SEQ ID NO: 11204 - RNA, 26 nt, Artificial Sequence
  Synthetic Oligonucleotide; GZMB exon 2; Set C
uguuuucugcuccucaccuuccccaa

SEQ ID NO: 11205 - RNA, 40 nt, Artificial Sequence
  Synthetic Oligonucleotide; GZMB exon 2; Set C
ugugggcuguuuucugcuccucaccuuccccaacagugag

SEQ ID NO: 11206 - RNA, 32 nt, Artificial Sequence
  Synthetic Oligonucleotide; GZMB exon 2; Set C
ugggcuguuuucugcuccucaccuuccccaac

SEQ ID NO: 11207 - RNA, 31 nt, Artificial Sequence
  Synthetic Oligonucleotide; GZMB exon 2; Set C
ugggcuguuuucugcuccucaccuuccccaa

SEQ ID NO: 11208 - RNA, 16 nt, Artificial Sequence
  Synthetic Oligonucleotide; GZMB exon 2; Set C
gugugggcuguuuucu

SEQ ID NO: 11209 - RNA, 15 nt, Artificial Sequence
  Synthetic Oligonucleotide; GZMB exon 2; Set C
gugugggcuguuuuc

SEQ ID NO: 11210 - RNA, 15 nt, Artificial Sequence
  Synthetic Oligonucleotide; GZMB exon 2; Set C
ggugugggcuguuuu

SEQ ID NO: 11211 - RNA, 16 nt, Artificial Sequence
  Synthetic Oligonucleotide; GZMB exon 2; Set C
gggugugggcuguuuu

SEQ ID NO: 11212 - RNA, 18 nt, Artificial Sequence
  Synthetic Oligonucleotide; GZMB exon 2; Set B
gagggugugggcuguuuu

SEQ ID NO: 11213 - RNA, 19 nt, Artificial Sequence
  Synthetic Oligonucleotide; GZMB exon 2; Set B
ggagggugugggcuguuuu

SEQ ID NO: 11214 - RNA, 20 nt, Artificial Sequence
  Synthetic Oligonucleotide; GZMB exon 2; Set B
aggagggugugggcuguuuu

SEQ ID NO: 11215 - RNA, 18 nt, Artificial Sequence
  Synthetic Oligonucleotide; GZMB exon 2; Set B
ggagggugugggcuguuu

SEQ ID NO: 11216 - RNA, 23 nt, Artificial Sequence
  Synthetic Oligonucleotide; GZMB exon 2; Set C
uguuuccaggagggugugggcug

SEQ ID NO: 11217 - RNA, 24 nt, Artificial Sequence
  Synthetic Oligonucleotide; GZMB exon 2; Set C
guguuuccaggagggugugggcug

SEQ ID NO: 11218 - RNA, 16 nt, Artificial Sequence
  Synthetic Oligonucleotide; GZMB exon 2; Set C
uguuuccaggagggug

SEQ ID NO: 11219 - RNA, 17 nt, Artificial Sequence
  Synthetic Oligonucleotide; GZMB exon 2; Set C
guguuuccaggagggug

SEQ ID NO: 11220 - RNA, 31 nt, Artificial Sequence
  Synthetic Oligonucleotide; GZMB exon 2; Set C
gucucuguggaguguuuccaggagggugugg

SEQ ID NO: 11221 - RNA, 18 nt, Artificial Sequence
  Synthetic Oligonucleotide; GZMB exon 3; Set C
gagucacaggguauacag

SEQ ID NO: 11222 - RNA, 17 nt, Artificial Sequence
  Synthetic Oligonucleotide; GZMB exon 3; Set C
gagucacaggguauaca

SEQ ID NO: 11223 - RNA, 19 nt, Artificial Sequence
  Synthetic Oligonucleotide; GZMB exon 3; Set C
ggagucacaggguauacag

SEQ ID NO: 11224 - RNA, 16 nt, Artificial Sequence
  Synthetic Oligonucleotide; GZMB exon 3; Set C
gagucacaggguauac

SEQ ID NO: 11225 - RNA, 18 nt, Artificial Sequence
  Synthetic Oligonucleotide; GZMB exon 3; Set C
ggagucacaggguauaca

SEQ ID NO: 11226 - RNA, 20 nt, Artificial Sequence
  Synthetic Oligonucleotide; GZMB exon 3; Set C
uggagucacaggguauacag

SEQ ID NO: 11227 - RNA, 15 nt, Artificial Sequence
  Synthetic Oligonucleotide; GZMB exon 3; Set C
gagucacaggguaua

SEQ ID NO: 11228 - RNA, 17 nt, Artificial Sequence
  Synthetic Oligonucleotide; GZMB exon 3; Set C
ggagucacaggguauac

SEQ ID NO: 11229 - RNA, 19 nt, Artificial Sequence
  Synthetic Oligonucleotide; GZMB exon 3; Set C
uggagucacaggguauaca

SEQ ID NO: 11230 - RNA, 21 nt, Artificial Sequence
  Synthetic Oligonucleotide; GZMB exon 3; Set A
guggagucacaggguauacag

SEQ ID NO: 11231 - RNA, 16 nt, Artificial Sequence
  Synthetic Oligonucleotide; GZMB exon 3; Set C
ggagucacaggguaua

SEQ ID NO: 11232 - RNA, 18 nt, Artificial Sequence
  Synthetic Oligonucleotide; GZMB exon 3; Set C
uggagucacaggguauac

SEQ ID NO: 11233 - RNA, 20 nt, Artificial Sequence
  Synthetic Oligonucleotide; GZMB exon 3; Set A
guggagucacaggguauaca

SEQ ID NO: 11234 - RNA, 22 nt, Artificial Sequence
  Synthetic Oligonucleotide; GZMB exon 3; Set A
gguggagucacaggguauacag

SEQ ID NO: 11235 - RNA, 15 nt, Artificial Sequence
  Synthetic Oligonucleotide; GZMB exon 3; Set C
ggagucacaggguau

SEQ ID NO: 11236 - RNA, 17 nt, Artificial Sequence
  Synthetic Oligonucleotide; GZMB exon 3; Set C
uggagucacaggguaua

SEQ ID NO: 11237 - RNA, 19 nt, Artificial Sequence
  Synthetic Oligonucleotide; GZMB exon 3; Set C
guggagucacaggguauac

SEQ ID NO: 11238 - RNA, 21 nt, Artificial Sequence
  Synthetic Oligonucleotide; GZMB exon 3; Set A
gguggagucacaggguauaca

SEQ ID NO: 11239 - RNA, 23 nt, Artificial Sequence
  Synthetic Oligonucleotide; GZMB exon 3; Set A
ggguggagucacaggguauacag

SEQ ID NO: 11240 - RNA, 16 nt, Artificial Sequence
  Synthetic Oligonucleotide; GZMB exon 3; Set C
uggagucacaggguau

SEQ ID NO: 11241 - RNA, 18 nt, Artificial Sequence
  Synthetic Oligonucleotide; GZMB exon 3; Set C
guggagucacaggguaua

SEQ ID NO: 11242 - RNA, 20 nt, Artificial Sequence
  Synthetic Oligonucleotide; GZMB exon 3; Set A
gguggagucacaggguauac

SEQ ID NO: 11243 - RNA, 22 nt, Artificial Sequence
  Synthetic Oligonucleotide; GZMB exon 3; Set A
ggguggagucacaggguauaca

SEQ ID NO: 11244 - RNA, 24 nt, Artificial Sequence
  Synthetic Oligonucleotide; GZMB exon 3; Set C
gggguggagucacaggguauacag

SEQ ID NO: 11245 - RNA, 17 nt, Artificial Sequence
  Synthetic Oligonucleotide; GZMB exon 3; Set C
guggagucacaggguau

SEQ ID NO: 11246 - RNA, 19 nt, Artificial Sequence
  Synthetic Oligonucleotide; GZMB exon 3; Set A
gguggagucacaggguaua

SEQ ID NO: 11247 - RNA, 21 nt, Artificial Sequence
  Synthetic Oligonucleotide; GZMB exon 3; Set A
ggguggagucacaggguauac

SEQ ID NO: 11248 - RNA, 23 nt, Artificial Sequence
  Synthetic Oligonucleotide; GZMB exon 3; Set C
gggguggagucacaggguauaca

SEQ ID NO: 11249 - RNA, 25 nt, Artificial Sequence
  Synthetic Oligonucleotide; GZMB exon 3; Set C
ggggguggagucacaggguauacag

SEQ ID NO: 11250 - RNA, 18 nt, Artificial Sequence
  Synthetic Oligonucleotide; GZMB exon 3; Set C
gguggagucacaggguau

SEQ ID NO: 11251 - RNA, 20 nt, Artificial Sequence
  Synthetic Oligonucleotide; GZMB exon 3; Set A
ggguggagucacaggguaua

SEQ ID NO: 11252 - RNA, 22 nt, Artificial Sequence
  Synthetic Oligonucleotide; GZMB exon 3; Set A
gggguggagucacaggguauac

SEQ ID NO: 11253 - RNA, 24 nt, Artificial Sequence
  Synthetic Oligonucleotide; GZMB exon 3; Set C
ggggguggagucacaggguauaca

SEQ ID NO: 11254 - RNA, 26 nt, Artificial Sequence
  Synthetic Oligonucleotide; GZMB exon 3; Set C
uggggguggagucacaggguauacag

SEQ ID NO: 11255 - RNA, 19 nt, Artificial Sequence
  Synthetic Oligonucleotide; GZMB exon 3; Set A
ggguggagucacaggguau

SEQ ID NO: 11256 - RNA, 21 nt, Artificial Sequence
  Synthetic Oligonucleotide; GZMB exon 3; Set A
gggguggagucacaggguaua

SEQ ID NO: 11257 - RNA, 23 nt, Artificial Sequence
  Synthetic Oligonucleotide; GZMB exon 3; Set C
ggggguggagucacaggguauac

SEQ ID NO: 11258 - RNA, 25 nt, Artificial Sequence
  Synthetic Oligonucleotide; GZMB exon 3; Set C
uggggguggagucacaggguauaca

SEQ ID NO: 11259 - RNA, 27 nt, Artificial Sequence
  Synthetic Oligonucleotide; GZMB exon 3; Set C
auggggguggagucacaggguauacag

SEQ ID NO: 11260 - RNA, 20 nt, Artificial Sequence
  Synthetic Oligonucleotide; GZMB exon 3; Set A
gggguggagucacaggguau

SEQ ID NO: 11261 - RNA, 22 nt, Artificial Sequence
  Synthetic Oligonucleotide; GZMB exon 3; Set C
ggggguggagucacaggguaua

SEQ ID NO: 11262 - RNA, 24 nt, Artificial Sequence
  Synthetic Oligonucleotide; GZMB exon 3; Set C
uggggguggagucacaggguauac

SEQ ID NO: 11263 - RNA, 26 nt, Artificial Sequence
  Synthetic Oligonucleotide; GZMB exon 3; Set C
auggggguggagucacaggguauaca

SEQ ID NO: 11264 - RNA, 28 nt, Artificial Sequence
  Synthetic Oligonucleotide; GZMB exon 3; Set C
gauggggguggagucacaggguauacag

SEQ ID NO: 11265 - RNA, 21 nt, Artificial Sequence
  Synthetic Oligonucleotide; GZMB exon 3; Set C
ggggguggagucacaggguau

SEQ ID NO: 11266 - RNA, 23 nt, Artificial Sequence
  Synthetic Oligonucleotide; GZMB exon 3; Set C
uggggguggagucacaggguaua

SEQ ID NO: 11267 - RNA, 25 nt, Artificial Sequence
  Synthetic Oligonucleotide; GZMB exon 3; Set C
auggggguggagucacaggguauac

SEQ ID NO: 11268 - RNA, 27 nt, Artificial Sequence
  Synthetic Oligonucleotide; GZMB exon 3; Set C
gauggggguggagucacaggguauaca

SEQ ID NO: 11269 - RNA, 29 nt, Artificial Sequence
  Synthetic Oligonucleotide; GZMB exon 3; Set C
ggauggggguggagucacaggguauacag

SEQ ID NO: 11270 - RNA, 22 nt, Artificial Sequence
  Synthetic Oligonucleotide; GZMB exon 3; Set C
uggggguggagucacaggguau

SEQ ID NO: 11271 - RNA, 24 nt, Artificial Sequence
  Synthetic Oligonucleotide; GZMB exon 3; Set C
auggggguggagucacaggguaua

SEQ ID NO: 11272 - RNA, 26 nt, Artificial Sequence
  Synthetic Oligonucleotide; GZMB exon 3; Set C
gauggggguggagucacaggguauac

SEQ ID NO: 11273 - RNA, 28 nt, Artificial Sequence
  Synthetic Oligonucleotide; GZMB exon 3; Set C
ggauggggguggagucacaggguauaca

SEQ ID NO: 11274 - RNA, 30 nt, Artificial Sequence
  Synthetic Oligonucleotide; GZMB exon 3; Set C
aggauggggguggagucacaggguauacag

SEQ ID NO: 11275 - RNA, 23 nt, Artificial Sequence
  Synthetic Oligonucleotide; GZMB exon 3; Set C
auggggguggagucacaggguau

SEQ ID NO: 11276 - RNA, 25 nt, Artificial Sequence
  Synthetic Oligonucleotide; GZMB exon 3; Set C
gauggggguggagucacaggguaua

SEQ ID NO: 11277 - RNA, 27 nt, Artificial Sequence
  Synthetic Oligonucleotide; GZMB exon 3; Set C
ggauggggguggagucacaggguauac

SEQ ID NO: 11278 - RNA, 29 nt, Artificial Sequence
  Synthetic Oligonucleotide; GZMB exon 3; Set C
aggauggggguggagucacaggguauaca

SEQ ID NO: 11279 - RNA, 31 nt, Artificial Sequence
  Synthetic Oligonucleotide; GZMB exon 3; Set C
gaggauggggguggagucacaggguauacag

SEQ ID NO: 11280 - RNA, 24 nt, Artificial Sequence
  Synthetic Oligonucleotide; GZMB exon 3; Set C
gauggggguggagucacaggguau

SEQ ID NO: 11281 - RNA, 26 nt, Artificial Sequence
  Synthetic Oligonucleotide; GZMB exon 3; Set C
ggauggggguggagucacaggguaua

SEQ ID NO: 11282 - RNA, 28 nt, Artificial Sequence
  Synthetic Oligonucleotide; GZMB exon 3; Set C
aggauggggguggagucacaggguauac

SEQ ID NO: 11283 - RNA, 30 nt, Artificial Sequence
  Synthetic Oligonucleotide; GZMB exon 3; Set C
gaggauggggguggagucacaggguauaca

SEQ ID NO: 11284 - RNA, 32 nt, Artificial Sequence
  Synthetic Oligonucleotide; GZMB exon 3; Set C
ugaggauggggguggagucacaggguauacag

SEQ ID NO: 11285 - RNA, 25 nt, Artificial Sequence
  Synthetic Oligonucleotide; GZMB exon 3; Set C
ggauggggguggagucacaggguau

SEQ ID NO: 11286 - RNA, 27 nt, Artificial Sequence
  Synthetic Oligonucleotide; GZMB exon 3; Set C
aggauggggguggagucacaggguaua

SEQ ID NO: 11287 - RNA, 29 nt, Artificial Sequence
  Synthetic Oligonucleotide; GZMB exon 3; Set C
gaggauggggguggagucacaggguauac

SEQ ID NO: 11288 - RNA, 31 nt, Artificial Sequence
  Synthetic Oligonucleotide; GZMB exon 3; Set C
ugaggauggggguggagucacaggguauaca

SEQ ID NO: 11289 - RNA, 33 nt, Artificial Sequence
  Synthetic Oligonucleotide; GZMB exon 3; Set C
gugaggauggggguggagucacaggguauacag

SEQ ID NO: 11290 - RNA, 26 nt, Artificial Sequence
  Synthetic Oligonucleotide; GZMB exon 3; Set C
aggauggggguggagucacaggguau

SEQ ID NO: 11291 - RNA, 28 nt, Artificial Sequence
  Synthetic Oligonucleotide; GZMB exon 3; Set C
gaggauggggguggagucacaggguaua

SEQ ID NO: 11292 - RNA, 30 nt, Artificial Sequence
  Synthetic Oligonucleotide; GZMB exon 3; Set C
ugaggauggggguggagucacaggguauac

SEQ ID NO: 11293 - RNA, 32 nt, Artificial Sequence
  Synthetic Oligonucleotide; GZMB exon 3; Set C
gugaggauggggguggagucacaggguauaca

SEQ ID NO: 11294 - RNA, 34 nt, Artificial Sequence
  Synthetic Oligonucleotide; GZMB exon 3; Set C
agugaggauggggguggagucacaggguauacag

SEQ ID NO: 11295 - RNA, 27 nt, Artificial Sequence
  Synthetic Oligonucleotide; GZMB exon 3; Set C
gaggauggggguggagucacaggguau

SEQ ID NO: 11296 - RNA, 29 nt, Artificial Sequence
  Synthetic Oligonucleotide; GZMB exon 3; Set C
ugaggauggggguggagucacaggguaua

SEQ ID NO: 11297 - RNA, 31 nt, Artificial Sequence
  Synthetic Oligonucleotide; GZMB exon 3; Set C
gugaggauggggguggagucacaggguauac

SEQ ID NO: 11298 - RNA, 33 nt, Artificial Sequence
  Synthetic Oligonucleotide; GZMB exon 3; Set C
agugaggauggggguggagucacaggguauaca

SEQ ID NO: 11299 - RNA, 15 nt, Artificial Sequence
  Synthetic Oligonucleotide; GZMB exon 3; Set C
ggggguggagucaca

SEQ ID NO: 11300 - RNA, 28 nt, Artificial Sequence
  Synthetic Oligonucleotide; GZMB exon 3; Set C
ugaggauggggguggagucacaggguau

SEQ ID NO: 11301 - RNA, 30 nt, Artificial Sequence
  Synthetic Oligonucleotide; GZMB exon 3; Set C
gugaggauggggguggagucacaggguaua

SEQ ID NO: 11302 - RNA, 32 nt, Artificial Sequence
  Synthetic Oligonucleotide; GZMB exon 3; Set C
agugaggauggggguggagucacaggguauac

SEQ ID NO: 11303 - RNA, 16 nt, Artificial Sequence
  Synthetic Oligonucleotide; GZMB exon 3; Set A
uggggguggagucaca

SEQ ID NO: 11304 - RNA, 29 nt, Artificial Sequence
  Synthetic Oligonucleotide; GZMB exon 3; Set C
gugaggauggggguggagucacaggguau

SEQ ID NO: 11305 - RNA, 31 nt, Artificial Sequence
  Synthetic Oligonucleotide; GZMB exon 3; Set C
agugaggauggggguggagucacaggguaua

SEQ ID NO: 11306 - RNA, 17 nt, Artificial Sequence
  Synthetic Oligonucleotide; GZMB exon 3; Set A
auggggguggagucaca

SEQ ID NO: 11307 - RNA, 30 nt, Artificial Sequence
  Synthetic Oligonucleotide; GZMB exon 3; Set C
agugaggauggggguggagucacaggguau

SEQ ID NO: 11308 - RNA, 18 nt, Artificial Sequence
  Synthetic Oligonucleotide; GZMB exon 3; Set A
gauggggguggagucaca

SEQ ID NO: 11309 - RNA, 19 nt, Artificial Sequence
  Synthetic Oligonucleotide; GZMB exon 3; Set A
ggauggggguggagucaca

SEQ ID NO: 11310 - RNA, 20 nt, Artificial Sequence
  Synthetic Oligonucleotide; GZMB exon 3; Set A
aggauggggguggagucaca

SEQ ID NO: 11311 - RNA, 21 nt, Artificial Sequence
  Synthetic Oligonucleotide; GZMB exon 3; Set A
gaggauggggguggagucaca

SEQ ID NO: 11312 - RNA, 40 nt, Artificial Sequence
  Synthetic Oligonucleotide; GZMB exon 3; Set C
agagcagagugaggauggggguggagucacaggguauaca

SEQ ID NO: 11313 - RNA, 22 nt, Artificial Sequence
  Synthetic Oligonucleotide; GZMB exon 3; Set C
ugaggauggggguggagucaca

SEQ ID NO: 11314 - RNA, 39 nt, Artificial Sequence
  Synthetic Oligonucleotide; GZMB exon 3; Set C
agagcagagugaggauggggguggagucacaggguauac

SEQ ID NO: 11315 - RNA, 23 nt, Artificial Sequence
  Synthetic Oligonucleotide; GZMB exon 3; Set C
gugaggauggggguggagucaca

SEQ ID NO: 11316 - RNA, 15 nt, Artificial Sequence
  Synthetic Oligonucleotide; GZMB exon 3; Set C
ggauggggguggagu

SEQ ID NO: 11317 - RNA, 38 nt, Artificial Sequence
  Synthetic Oligonucleotide; GZMB exon 3; Set C
agagcagagugaggauggggguggagucacaggguaua

SEQ ID NO: 11318 - RNA, 40 nt, Artificial Sequence
  Synthetic Oligonucleotide; GZMB exon 3; Set C
gagagcagagugaggauggggguggagucacaggguauac

SEQ ID NO: 11319 - RNA, 24 nt, Artificial Sequence
  Synthetic Oligonucleotide; GZMB exon 3; Set C
agugaggauggggguggagucaca

SEQ ID NO: 11320 - RNA, 16 nt, Artificial Sequence
  Synthetic Oligonucleotide; GZMB exon 3; Set C
aggauggggguggagu

SEQ ID NO: 11321 - RNA, 37 nt, Artificial Sequence
  Synthetic Oligonucleotide; GZMB exon 3; Set C
agagcagagugaggauggggguggagucacaggguau

SEQ ID NO: 11322 - RNA, 39 nt, Artificial Sequence
  Synthetic Oligonucleotide; GZMB exon 3; Set C
gagagcagagugaggauggggguggagucacaggguaua

SEQ ID NO: 11323 - RNA, 15 nt, Artificial Sequence
  Synthetic Oligonucleotide; GZMB exon 3; Set C
aggauggggguggag

SEQ ID NO: 11324 - RNA, 17 nt, Artificial Sequence
  Synthetic Oligonucleotide; GZMB exon 3; Set A
gaggauggggguggagu

SEQ ID NO: 11325 - RNA, 38 nt, Artificial Sequence
  Synthetic Oligonucleotide; GZMB exon 3; Set C
gagagcagagugaggauggggguggagucacaggguau

SEQ ID NO: 11326 - RNA, 40 nt, Artificial Sequence
  Synthetic Oligonucleotide; GZMB exon 3; Set C
agagagcagagugaggauggggguggagucacaggguaua

SEQ ID NO: 11327 - RNA, 16 nt, Artificial Sequence
  Synthetic Oligonucleotide; GZMB exon 3; Set C
gaggauggggguggag

SEQ ID NO: 11328 - RNA, 18 nt, Artificial Sequence
  Synthetic Oligonucleotide; GZMB exon 3; Set A
ugaggauggggguggagu

SEQ ID NO: 11329 - RNA, 39 nt, Artificial Sequence
  Synthetic Oligonucleotide; GZMB exon 3; Set C
agagagcagagugaggauggggguggagucacaggguau

SEQ ID NO: 11330 - RNA, 15 nt, Artificial Sequence
  Synthetic Oligonucleotide; GZMB exon 3; Set C
gaggaugggggugga

SEQ ID NO: 11331 - RNA, 17 nt, Artificial Sequence
  Synthetic Oligonucleotide; GZMB exon 3; Set C
ugaggauggggguggag

SEQ ID NO: 11332 - RNA, 19 nt, Artificial Sequence
  Synthetic Oligonucleotide; GZMB exon 3; Set A
gugaggauggggguggagu

SEQ ID NO: 11333 - RNA, 40 nt, Artificial Sequence
  Synthetic Oligonucleotide; GZMB exon 3; Set C
cagagagcagagugaggauggggguggagucacaggguau

SEQ ID NO: 11334 - RNA, 16 nt, Artificial Sequence
  Synthetic Oligonucleotide; GZMB exon 3; Set C
ugaggaugggggugga

SEQ ID NO: 11335 - RNA, 18 nt, Artificial Sequence
  Synthetic Oligonucleotide; GZMB exon 3; Set A
gugaggauggggguggag

SEQ ID NO: 11336 - RNA, 20 nt, Artificial Sequence
  Synthetic Oligonucleotide; GZMB exon 3; Set A
agugaggauggggguggagu

SEQ ID NO: 11337 - RNA, 15 nt, Artificial Sequence
  Synthetic Oligonucleotide; GZMB exon 3; Set C
ugaggaugggggugg

SEQ ID NO: 11338 - RNA, 17 nt, Artificial Sequence
  Synthetic Oligonucleotide; GZMB exon 3; Set A
gugaggaugggggugga

SEQ ID NO: 11339 - RNA, 19 nt, Artificial Sequence
  Synthetic Oligonucleotide; GZMB exon 3; Set A
agugaggauggggguggag

SEQ ID NO: 11340 - RNA, 16 nt, Artificial Sequence
  Synthetic Oligonucleotide; GZMB exon 3; Set C
gugaggaugggggugg

SEQ ID NO: 11341 - RNA, 18 nt, Artificial Sequence
  Synthetic Oligonucleotide; GZMB exon 3; Set A
agugaggaugggggugga

SEQ ID NO: 11342 - RNA, 17 nt, Artificial Sequence
  Synthetic Oligonucleotide; GZMB exon 3; Set C
agugaggaugggggugg

SEQ ID NO: 11343 - RNA, 15 nt, Artificial Sequence
  Synthetic Oligonucleotide; GZMB exon 3; Set C
gugaggaugggggug

SEQ ID NO: 11344 - RNA, 16 nt, Artificial Sequence
  Synthetic Oligonucleotide; GZMB exon 3; Set C
agugaggaugggggug

SEQ ID NO: 11345 - RNA, 15 nt, Artificial Sequence
  Synthetic Oligonucleotide; GZMB exon 3; Set C
agugaggaugggggu

SEQ ID NO: 11346 - RNA, 39 nt, Artificial Sequence
  Synthetic Oligonucleotide; GZMB exon 3; Set C
auggagcugcacagagagcagagugaggaugggggugga

SEQ ID NO: 11347 - RNA, 38 nt, Artificial Sequence
  Synthetic Oligonucleotide; GZMB exon 3; Set C
auggagcugcacagagagcagagugaggaugggggugg

SEQ ID NO: 11348 - RNA, 40 nt, Artificial Sequence
  Synthetic Oligonucleotide; GZMB exon 3; Set C
uauggagcugcacagagagcagagugaggaugggggugga

SEQ ID NO: 11349 - RNA, 39 nt, Artificial Sequence
  Synthetic Oligonucleotide; GZMB exon 3; Set C
uauggagcugcacagagagcagagugaggaugggggugg

SEQ ID NO: 11350 - RNA, 37 nt, Artificial Sequence
  Synthetic Oligonucleotide; GZMB exon 3; Set C
auggagcugcacagagagcagagugaggaugggggug

SEQ ID NO: 11351 - RNA, 40 nt, Artificial Sequence
  Synthetic Oligonucleotide; GZMB exon 3; Set C
uuauggagcugcacagagagcagagugaggaugggggugg

SEQ ID NO: 11352 - RNA, 36 nt, Artificial Sequence
  Synthetic Oligonucleotide; GZMB exon 3; Set C
auggagcugcacagagagcagagugaggaugggggu

SEQ ID NO: 11353 - RNA, 38 nt, Artificial Sequence
  Synthetic Oligonucleotide; GZMB exon 3; Set C
uauggagcugcacagagagcagagugaggaugggggug

SEQ ID NO: 11354 - RNA, 37 nt, Artificial Sequence
  Synthetic Oligonucleotide; GZMB exon 3; Set C
uauggagcugcacagagagcagagugaggaugggggu

SEQ ID NO: 11355 - RNA, 39 nt, Artificial Sequence
  Synthetic Oligonucleotide; GZMB exon 3; Set C
uuauggagcugcacagagagcagagugaggaugggggug

SEQ ID NO: 11356 - RNA, 38 nt, Artificial Sequence
  Synthetic Oligonucleotide; GZMB exon 3; Set C
uuauggagcugcacagagagcagagugaggaugggggu

SEQ ID NO: 11357 - RNA, 40 nt, Artificial Sequence
  Synthetic Oligonucleotide; GZMB exon 3; Set C
uuuauggagcugcacagagagcagagugaggaugggggug

SEQ ID NO: 11358 - RNA, 39 nt, Artificial Sequence
  Synthetic Oligonucleotide; GZMB exon 3; Set C
uuuauggagcugcacagagagcagagugaggaugggggu

SEQ ID NO: 11359 - RNA, 40 nt, Artificial Sequence
  Synthetic Oligonucleotide; GZMB exon 3; Set C
auuuauggagcugcacagagagcagagugaggaugggggu

SEQ ID NO: 11360 - RNA, 31 nt, Artificial Sequence
  Synthetic Oligonucleotide; GZMB exon 3; Set C
uuauggagcugcacagagagcagagugagga

SEQ ID NO: 11361 - RNA, 32 nt, Artificial Sequence
  Synthetic Oligonucleotide; GZMB exon 3; Set C
uuuauggagcugcacagagagcagagugagga

SEQ ID NO: 11362 - RNA, 33 nt, Artificial Sequence
  Synthetic Oligonucleotide; GZMB exon 3; Set C
auuuauggagcugcacagagagcagagugagga

SEQ ID NO: 11363 - RNA, 39 nt, Artificial Sequence
  Synthetic Oligonucleotide; GZMB exon 3; Set C
ggugacauuuauggagcugcacagagagcagagugagga

SEQ ID NO: 11364 - RNA, 40 nt, Artificial Sequence
  Synthetic Oligonucleotide; GZMB exon 3; Set C
aggugacauuuauggagcugcacagagagcagagugagga

SEQ ID NO: 11365 - RNA, 38 nt, Artificial Sequence
  Synthetic Oligonucleotide; GZMB exon 3; Set C
ggugacauuuauggagcugcacagagagcagagugagg

SEQ ID NO: 11366 - RNA, 37 nt, Artificial Sequence
  Synthetic Oligonucleotide; GZMB exon 3; Set C
ggugacauuuauggagcugcacagagagcagagugag

SEQ ID NO: 11367 - RNA, 17 nt, Artificial Sequence
  Synthetic Oligonucleotide; GZMB exon 3; Set C
auggagcugcacagaga

SEQ ID NO: 11368 - RNA, 36 nt, Artificial Sequence
  Synthetic Oligonucleotide; GZMB exon 3; Set C
ggugacauuuauggagcugcacagagagcagaguga

SEQ ID NO: 11369 - RNA, 18 nt, Artificial Sequence
  Synthetic Oligonucleotide; GZMB exon 3; Set C
uauggagcugcacagaga

SEQ ID NO: 11370 - RNA, 16 nt, Artificial Sequence
  Synthetic Oligonucleotide; GZMB exon 3; Set C
auggagcugcacagag

SEQ ID NO: 11371 - RNA, 35 nt, Artificial Sequence
  Synthetic Oligonucleotide; GZMB exon 3; Set C
ggugacauuuauggagcugcacagagagcagagug

SEQ ID NO: 11372 - RNA, 19 nt, Artificial Sequence
  Synthetic Oligonucleotide; GZMB exon 3; Set C
uuauggagcugcacagaga

SEQ ID NO: 11373 - RNA, 17 nt, Artificial Sequence
  Synthetic Oligonucleotide; GZMB exon 3; Set C
uauggagcugcacagag

SEQ ID NO: 11374 - RNA, 20 nt, Artificial Sequence
  Synthetic Oligonucleotide; GZMB exon 3; Set C
uuuauggagcugcacagaga

SEQ ID NO: 11375 - RNA, 18 nt, Artificial Sequence
  Synthetic Oligonucleotide; GZMB exon 3; Set C
uuauggagcugcacagag

SEQ ID NO: 11376 - RNA, 16 nt, Artificial Sequence
  Synthetic Oligonucleotide; GZMB exon 3; Set C
uauggagcugcacaga

SEQ ID NO: 11377 - RNA, 21 nt, Artificial Sequence
  Synthetic Oligonucleotide; GZMB exon 3; Set C
auuuauggagcugcacagaga

SEQ ID NO: 11378 - RNA, 19 nt, Artificial Sequence
  Synthetic Oligonucleotide; GZMB exon 3; Set C
uuuauggagcugcacagag

SEQ ID NO: 11379 - RNA, 17 nt, Artificial Sequence
  Synthetic Oligonucleotide; GZMB exon 3; Set C
uuauggagcugcacaga

SEQ ID NO: 11380 - RNA, 15 nt, Artificial Sequence
  Synthetic Oligonucleotide; GZMB exon 3; Set C
uauggagcugcacag

SEQ ID NO: 11381 - RNA, 22 nt, Artificial Sequence
  Synthetic Oligonucleotide; GZMB exon 3; Set A
cauuuauggagcugcacagaga

SEQ ID NO: 11382 - RNA, 20 nt, Artificial Sequence
  Synthetic Oligonucleotide; GZMB exon 3; Set C
auuuauggagcugcacagag

SEQ ID NO: 11383 - RNA, 18 nt, Artificial Sequence
  Synthetic Oligonucleotide; GZMB exon 3; Set C
uuuauggagcugcacaga

SEQ ID NO: 11384 - RNA, 16 nt, Artificial Sequence
  Synthetic Oligonucleotide; GZMB exon 3; Set C
uuauggagcugcacag

SEQ ID NO: 11385 - RNA, 21 nt, Artificial Sequence
  Synthetic Oligonucleotide; GZMB exon 3; Set C
cauuuauggagcugcacagag

SEQ ID NO: 11386 - RNA, 15 nt, Artificial Sequence
  Synthetic Oligonucleotide; GZMB exon 3; Set C
uuauggagcugcaca

SEQ ID NO: 11387 - RNA, 19 nt, Artificial Sequence
  Synthetic Oligonucleotide; GZMB exon 3; Set C
auuuauggagcugcacaga

SEQ ID NO: 11388 - RNA, 17 nt, Artificial Sequence
  Synthetic Oligonucleotide; GZMB exon 3; Set C
uuuauggagcugcacag

SEQ ID NO: 11389 - RNA, 16 nt, Artificial Sequence
  Synthetic Oligonucleotide; GZMB exon 3; Set C
uuuauggagcugcaca

SEQ ID NO: 11390 - RNA, 20 nt, Artificial Sequence
  Synthetic Oligonucleotide; GZMB exon 3; Set C
cauuuauggagcugcacaga

SEQ ID NO: 11391 - RNA, 18 nt, Artificial Sequence
  Synthetic Oligonucleotide; GZMB exon 3; Set C
auuuauggagcugcacag

SEQ ID NO: 11392 - RNA, 25 nt, Artificial Sequence
  Synthetic Oligonucleotide; GZMB exon 3; Set A
ugacauuuauggagcugcacagaga

SEQ ID NO: 11393 - RNA, 17 nt, Artificial Sequence
  Synthetic Oligonucleotide; GZMB exon 3; Set C
auuuauggagcugcaca

SEQ ID NO: 11394 - RNA, 26 nt, Artificial Sequence
  Synthetic Oligonucleotide; GZMB exon 3; Set A
gugacauuuauggagcugcacagaga

SEQ ID NO: 11395 - RNA, 24 nt, Artificial Sequence
  Synthetic Oligonucleotide; GZMB exon 3; Set A
ugacauuuauggagcugcacagag

SEQ ID NO: 11396 - RNA, 27 nt, Artificial Sequence
  Synthetic Oligonucleotide; GZMB exon 3; Set C
ggugacauuuauggagcugcacagaga

SEQ ID NO: 11397 - RNA, 25 nt, Artificial Sequence
  Synthetic Oligonucleotide; GZMB exon 3; Set A
gugacauuuauggagcugcacagag

SEQ ID NO: 11398 - RNA, 28 nt, Artificial Sequence
  Synthetic Oligonucleotide; GZMB exon 3; Set C
aggugacauuuauggagcugcacagaga

SEQ ID NO: 11399 - RNA, 26 nt, Artificial Sequence
  Synthetic Oligonucleotide; GZMB exon 3; Set A
ggugacauuuauggagcugcacagag

SEQ ID NO: 11400 - RNA, 27 nt, Artificial Sequence
  Synthetic Oligonucleotide; GZMB exon 3; Set A
aggugacauuuauggagcugcacagag

SEQ ID NO: 11401 - RNA, 25 nt, Artificial Sequence
  Synthetic Oligonucleotide; GZMB exon 3; Set A
ggugacauuuauggagcugcacaga

SEQ ID NO: 11402 - RNA, 26 nt, Artificial Sequence
  Synthetic Oligonucleotide; GZMB exon 3; Set A
aggugacauuuauggagcugcacaga

SEQ ID NO: 11403 - RNA, 24 nt, Artificial Sequence
  Synthetic Oligonucleotide; GZMB exon 3; Set A
ggugacauuuauggagcugcacag

SEQ ID NO: 11404 - RNA, 23 nt, Artificial Sequence
  Synthetic Oligonucleotide; GZMB exon 3; Set A
ggugacauuuauggagcugcaca

SEQ ID NO: 11405 - RNA, 25 nt, Artificial Sequence
  Synthetic Oligonucleotide; GZMB exon 3; Set A
aggugacauuuauggagcugcacag

SEQ ID NO: 11406 - RNA, 24 nt, Artificial Sequence
  Synthetic Oligonucleotide; GZMB exon 3; Set A
aggugacauuuauggagcugcaca

SEQ ID NO: 11407 - RNA, 15 nt, Artificial Sequence
  Synthetic Oligonucleotide; GZMB exon 3; Set C
gugacauuuauggag

SEQ ID NO: 11408 - RNA, 16 nt, Artificial Sequence
  Synthetic Oligonucleotide; GZMB exon 3; Set C
ggugacauuuauggag

SEQ ID NO: 11409 - RNA, 15 nt, Artificial Sequence
  Synthetic Oligonucleotide; GZMB exon 3; Set C
ggugacauuuaugga

SEQ ID NO: 11410 - RNA, 17 nt, Artificial Sequence
  Synthetic Oligonucleotide; GZMB exon 3; Set C
aggugacauuuauggag

SEQ ID NO: 11411 - RNA, 16 nt, Artificial Sequence
  Synthetic Oligonucleotide; GZMB exon 3; Set C
aggugacauuuaugga

SEQ ID NO: 11412 - RNA, 15 nt, Artificial Sequence
  Synthetic Oligonucleotide; GZMB exon 3; Set C
aggugacauuuaugg

SEQ ID NO: 11413 - RNA, 27 nt, Artificial Sequence
  Synthetic Oligonucleotide; GZMB exon 3; Set C
auugugggcccccaaggugacauuuau

SEQ ID NO: 11414 - RNA, 29 nt, Artificial Sequence
  Synthetic Oligonucleotide; GZMB exon 3; Set C
uauugugggcccccaaggugacauuuaug

SEQ ID NO: 11415 - RNA, 28 nt, Artificial Sequence
  Synthetic Oligonucleotide; GZMB exon 3; Set C
uauugugggcccccaaggugacauuuau

SEQ ID NO: 11416 - RNA, 30 nt, Artificial Sequence
  Synthetic Oligonucleotide; GZMB exon 3; Set C
auauugugggcccccaaggugacauuuaug

SEQ ID NO: 11417 - RNA, 29 nt, Artificial Sequence
  Synthetic Oligonucleotide; GZMB exon 3; Set C
auauugugggcccccaaggugacauuuau

SEQ ID NO: 11418 - RNA, 27 nt, Artificial Sequence
  Synthetic Oligonucleotide; GZMB exon 3; Set C
uauugugggcccccaaggugacauuua

SEQ ID NO: 11419 - RNA, 31 nt, Artificial Sequence
  Synthetic Oligonucleotide; GZMB exon 3; Set C
gauauugugggcccccaaggugacauuuaug

SEQ ID NO: 11420 - RNA, 28 nt, Artificial Sequence
  Synthetic Oligonucleotide; GZMB exon 3; Set C
auauugugggcccccaaggugacauuua

SEQ ID NO: 11421 - RNA, 30 nt, Artificial Sequence
  Synthetic Oligonucleotide; GZMB exon 3; Set C
gauauugugggcccccaaggugacauuuau

SEQ ID NO: 11422 - RNA, 32 nt, Artificial Sequence
  Synthetic Oligonucleotide; GZMB exon 3; Set C
ugauauugugggcccccaaggugacauuuaug

SEQ ID NO: 11423 - RNA, 27 nt, Artificial Sequence
  Synthetic Oligonucleotide; GZMB exon 3; Set C
auauugugggcccccaaggugacauuu

SEQ ID NO: 11424 - RNA, 31 nt, Artificial Sequence
  Synthetic Oligonucleotide; GZMB exon 3; Set C
ugauauugugggcccccaaggugacauuuau

SEQ ID NO: 11425 - RNA, 29 nt, Artificial Sequence
  Synthetic Oligonucleotide; GZMB exon 3; Set C
gauauugugggcccccaaggugacauuua

SEQ ID NO: 11426 - RNA, 33 nt, Artificial Sequence
  Synthetic Oligonucleotide; GZMB exon 3; Set C
uugauauugugggcccccaaggugacauuuaug

SEQ ID NO: 11427 - RNA, 32 nt, Artificial Sequence
  Synthetic Oligonucleotide; GZMB exon 3; Set C
uugauauugugggcccccaaggugacauuuau

SEQ ID NO: 11428 - RNA, 30 nt, Artificial Sequence
  Synthetic Oligonucleotide; GZMB exon 3; Set C
ugauauugugggcccccaaggugacauuua

SEQ ID NO: 11429 - RNA, 28 nt, Artificial Sequence
  Synthetic Oligonucleotide; GZMB exon 3; Set C
gauauugugggcccccaaggugacauuu

SEQ ID NO: 11430 - RNA, 34 nt, Artificial Sequence
  Synthetic Oligonucleotide; GZMB exon 3; Set C
uuugauauugugggcccccaaggugacauuuaug

SEQ ID NO: 11431 - RNA, 36 nt, Artificial Sequence
  Synthetic Oligonucleotide; GZMB exon 3; Set C
cuuugauauugugggcccccaaggugacauuuaugg

SEQ ID NO: 11432 - RNA, 33 nt, Artificial Sequence
  Synthetic Oligonucleotide; GZMB exon 3; Set C
uuugauauugugggcccccaaggugacauuuau

SEQ ID NO: 11433 - RNA, 31 nt, Artificial Sequence
  Synthetic Oligonucleotide; GZMB exon 3; Set C
uugauauugugggcccccaaggugacauuua

SEQ ID NO: 11434 - RNA, 29 nt, Artificial Sequence
  Synthetic Oligonucleotide; GZMB exon 3; Set C
ugauauugugggcccccaaggugacauuu

SEQ ID NO: 11435 - RNA, 27 nt, Artificial Sequence
  Synthetic Oligonucleotide; GZMB exon 3; Set C
gauauugugggcccccaaggugacauu

SEQ ID NO: 11436 - RNA, 35 nt, Artificial Sequence
  Synthetic Oligonucleotide; GZMB exon 3; Set C
cuuugauauugugggcccccaaggugacauuuaug

SEQ ID NO: 11437 - RNA, 37 nt, Artificial Sequence
  Synthetic Oligonucleotide; GZMB exon 3; Set C
ucuuugauauugugggcccccaaggugacauuuaugg

SEQ ID NO: 11438 - RNA, 34 nt, Artificial Sequence
  Synthetic Oligonucleotide; GZMB exon 3; Set C
cuuugauauugugggcccccaaggugacauuuau

SEQ ID NO: 11439 - RNA, 32 nt, Artificial Sequence
  Synthetic Oligonucleotide; GZMB exon 3; Set C
uuugauauugugggcccccaaggugacauuua

SEQ ID NO: 11440 - RNA, 30 nt, Artificial Sequence
  Synthetic Oligonucleotide; GZMB exon 3; Set C
uugauauugugggcccccaaggugacauuu

SEQ ID NO: 11441 - RNA, 28 nt, Artificial Sequence
  Synthetic Oligonucleotide; GZMB exon 3; Set C
ugauauugugggcccccaaggugacauu

SEQ ID NO: 11442 - RNA, 36 nt, Artificial Sequence
  Synthetic Oligonucleotide; GZMB exon 3; Set C
ucuuugauauugugggcccccaaggugacauuuaug

SEQ ID NO: 11443 - RNA, 38 nt, Artificial Sequence
  Synthetic Oligonucleotide; GZMB exon 3; Set C
uucuuugauauugugggcccccaaggugacauuuaugg

SEQ ID NO: 11444 - RNA, 35 nt, Artificial Sequence
  Synthetic Oligonucleotide; GZMB exon 3; Set C
ucuuugauauugugggcccccaaggugacauuuau

SEQ ID NO: 11445 - RNA, 33 nt, Artificial Sequence
  Synthetic Oligonucleotide; GZMB exon 3; Set C
cuuugauauugugggcccccaaggugacauuua

SEQ ID NO: 11446 - RNA, 31 nt, Artificial Sequence
  Synthetic Oligonucleotide; GZMB exon 3; Set C
uuugauauugugggcccccaaggugacauuu

SEQ ID NO: 11447 - RNA, 29 nt, Artificial Sequence
  Synthetic Oligonucleotide; GZMB exon 3; Set C
uugauauugugggcccccaaggugacauu

SEQ ID NO: 11448 - RNA, 37 nt, Artificial Sequence
  Synthetic Oligonucleotide; GZMB exon 3; Set C
uucuuugauauugugggcccccaaggugacauuuaug

SEQ ID NO: 11449 - RNA, 34 nt, Artificial Sequence
  Synthetic Oligonucleotide; GZMB exon 3; Set C
ucuuugauauugugggcccccaaggugacauuua

SEQ ID NO: 11450 - RNA, 32 nt, Artificial Sequence
  Synthetic Oligonucleotide; GZMB exon 3; Set C
cuuugauauugugggcccccaaggugacauuu

SEQ ID NO: 11451 - RNA, 30 nt, Artificial Sequence
  Synthetic Oligonucleotide; GZMB exon 3; Set C
uuugauauugugggcccccaaggugacauu

SEQ ID NO: 11452 - RNA, 36 nt, Artificial Sequence
  Synthetic Oligonucleotide; GZMB exon 3; Set C
uucuuugauauugugggcccccaaggugacauuuau

SEQ ID NO: 11453 - RNA, 33 nt, Artificial Sequence
  Synthetic Oligonucleotide; GZMB exon 3; Set C
ucuuugauauugugggcccccaaggugacauuu

SEQ ID NO: 11454 - RNA, 31 nt, Artificial Sequence
  Synthetic Oligonucleotide; GZMB exon 3; Set C
cuuugauauugugggcccccaaggugacauu

SEQ ID NO: 11455 - RNA, 35 nt, Artificial Sequence
  Synthetic Oligonucleotide; GZMB exon 3; Set C
uucuuugauauugugggcccccaaggugacauuua

SEQ ID NO: 11456 - RNA, 32 nt, Artificial Sequence
  Synthetic Oligonucleotide; GZMB exon 3; Set C
ucuuugauauugugggcccccaaggugacauu

SEQ ID NO: 11457 - RNA, 34 nt, Artificial Sequence
  Synthetic Oligonucleotide; GZMB exon 3; Set C
uucuuugauauugugggcccccaaggugacauuu

SEQ ID NO: 11458 - RNA, 33 nt, Artificial Sequence
  Synthetic Oligonucleotide; GZMB exon 3; Set C
uucuuugauauugugggcccccaaggugacauu

SEQ ID NO: 11459 - RNA, 15 nt, Artificial Sequence
  Synthetic Oligonucleotide; GZMB exon 3; Set C
cuuugauauuguggg

SEQ ID NO: 11460 - RNA, 16 nt, Artificial Sequence
  Synthetic Oligonucleotide; GZMB exon 3; Set C
ucuuugauauuguggg

SEQ ID NO: 11461 - RNA, 15 nt, Artificial Sequence
  Synthetic Oligonucleotide; GZMB exon 3; Set C
ucuuugauauugugg

SEQ ID NO: 11462 - RNA, 17 nt, Artificial Sequence
  Synthetic Oligonucleotide; GZMB exon 3; Set C
uucuuugauauuguggg

SEQ ID NO: 11463 - RNA, 16 nt, Artificial Sequence
  Synthetic Oligonucleotide; GZMB exon 3; Set C
uucuuugauauugugg

SEQ ID NO: 11464 - RNA, 18 nt, Artificial Sequence
  Synthetic Oligonucleotide; GZMB exon 3; Set C
guucuuugauauuguggg

SEQ ID NO: 11465 - RNA, 15 nt, Artificial Sequence
  Synthetic Oligonucleotide; GZMB exon 3; Set C
uucuuugauauugug

SEQ ID NO: 11466 - RNA, 17 nt, Artificial Sequence
  Synthetic Oligonucleotide; GZMB exon 3; Set C
guucuuugauauugugg

SEQ ID NO: 11467 - RNA, 19 nt, Artificial Sequence
  Synthetic Oligonucleotide; GZMB exon 3; Set C
uguucuuugauauuguggg

SEQ ID NO: 11468 - RNA, 16 nt, Artificial Sequence
  Synthetic Oligonucleotide; GZMB exon 3; Set C
guucuuugauauugug

SEQ ID NO: 11469 - RNA, 18 nt, Artificial Sequence
  Synthetic Oligonucleotide; GZMB exon 3; Set C
uguucuuugauauugugg

SEQ ID NO: 11470 - RNA, 15 nt, Artificial Sequence
  Synthetic Oligonucleotide; GZMB exon 3; Set C
guucuuugauauugu

SEQ ID NO: 11471 - RNA, 17 nt, Artificial Sequence
  Synthetic Oligonucleotide; GZMB exon 3; Set C
uguucuuugauauugug

SEQ ID NO: 11472 - RNA, 16 nt, Artificial Sequence
  Synthetic Oligonucleotide; GZMB exon 3; Set C
uguucuuugauauugu

SEQ ID NO: 11473 - RNA, 15 nt, Artificial Sequence
  Synthetic Oligonucleotide; GZMB exon 3; Set C
uguucuuugauauug

SEQ ID NO: 11474 - RNA, 30 nt, Artificial Sequence
  Synthetic Oligonucleotide; GZMB exon 3; Set C
ugggucggcuccuguucuuugauauugugg

SEQ ID NO: 11475 - RNA, 29 nt, Artificial Sequence
  Synthetic Oligonucleotide; GZMB exon 3; Set C
ugggucggcuccuguucuuugauauugug

SEQ ID NO: 11476 - RNA, 28 nt, Artificial Sequence
  Synthetic Oligonucleotide; GZMB exon 3; Set C
ugggucggcuccuguucuuugauauugu

SEQ ID NO: 11477 - RNA, 27 nt, Artificial Sequence
  Synthetic Oligonucleotide; GZMB exon 3; Set A
ugggucggcuccuguucuuugauauug

SEQ ID NO: 11478 - RNA, 26 nt, Artificial Sequence
  Synthetic Oligonucleotide; GZMB exon 3; Set A
ugggucggcuccuguucuuugauauu

SEQ ID NO: 11479 - RNA, 25 nt, Artificial Sequence
  Synthetic Oligonucleotide; GZMB exon 3; Set A
ugggucggcuccuguucuuugauau

SEQ ID NO: 11480 - RNA, 24 nt, Artificial Sequence
  Synthetic Oligonucleotide; GZMB exon 3; Set A
ugggucggcuccuguucuuugaua

SEQ ID NO: 11481 - RNA, 23 nt, Artificial Sequence
  Synthetic Oligonucleotide; GZMB exon 3; Set A
ugggucggcuccuguucuuugau

SEQ ID NO: 11482 - RNA, 22 nt, Artificial Sequence
  Synthetic Oligonucleotide; GZMB exon 3; Set A
ugggucggcuccuguucuuuga

SEQ ID NO: 11483 - RNA, 38 nt, Artificial Sequence
  Synthetic Oligonucleotide; GZMB exon 3; Set C
uaaacugcugggucggcuccuguucuuugauauugugg

SEQ ID NO: 11484 - RNA, 21 nt, Artificial Sequence
  Synthetic Oligonucleotide; GZMB exon 3; Set A
ugggucggcuccuguucuuug

SEQ ID NO: 11485 - RNA, 37 nt, Artificial Sequence
  Synthetic Oligonucleotide; GZMB exon 3; Set C
uaaacugcugggucggcuccuguucuuugauauugug

SEQ ID NO: 11486 - RNA, 39 nt, Artificial Sequence
  Synthetic Oligonucleotide; GZMB exon 3; Set C
auaaacugcugggucggcuccuguucuuugauauugugg

SEQ ID NO: 11487 - RNA, 20 nt, Artificial Sequence
  Synthetic Oligonucleotide; GZMB exon 3; Set A
ugggucggcuccuguucuuu

SEQ ID NO: 11488 - RNA, 36 nt, Artificial Sequence
  Synthetic Oligonucleotide; GZMB exon 3; Set C
uaaacugcugggucggcuccuguucuuugauauugu

SEQ ID NO: 11489 - RNA, 38 nt, Artificial Sequence
  Synthetic Oligonucleotide; GZMB exon 3; Set C
auaaacugcugggucggcuccuguucuuugauauugug

SEQ ID NO: 11490 - RNA, 40 nt, Artificial Sequence
  Synthetic Oligonucleotide; GZMB exon 3; Set C
gauaaacugcugggucggcuccuguucuuugauauugugg

SEQ ID NO: 11491 - RNA, 19 nt, Artificial Sequence
  Synthetic Oligonucleotide; GZMB exon 3; Set A
ugggucggcuccuguucuu

SEQ ID NO: 11492 - RNA, 35 nt, Artificial Sequence
  Synthetic Oligonucleotide; GZMB exon 3; Set C
uaaacugcugggucggcuccuguucuuugauauug

SEQ ID NO: 11493 - RNA, 37 nt, Artificial Sequence
  Synthetic Oligonucleotide; GZMB exon 3; Set C
auaaacugcugggucggcuccuguucuuugauauugu

SEQ ID NO: 11494 - RNA, 39 nt, Artificial Sequence
  Synthetic Oligonucleotide; GZMB exon 3; Set C
gauaaacugcugggucggcuccuguucuuugauauugug

SEQ ID NO: 11495 - RNA, 36 nt, Artificial Sequence
  Synthetic Oligonucleotide; GZMB exon 3; Set C
auaaacugcugggucggcuccuguucuuugauauug

SEQ ID NO: 11496 - RNA, 34 nt, Artificial Sequence
  Synthetic Oligonucleotide; GZMB exon 3; Set C
uaaacugcugggucggcuccuguucuuugauauu

SEQ ID NO: 11497 - RNA, 38 nt, Artificial Sequence
  Synthetic Oligonucleotide; GZMB exon 3; Set C
gauaaacugcugggucggcuccuguucuuugauauugu

SEQ ID NO: 11498 - RNA, 40 nt, Artificial Sequence
  Synthetic Oligonucleotide; GZMB exon 3; Set C
ggauaaacugcugggucggcuccuguucuuugauauugug

SEQ ID NO: 11499 - RNA, 33 nt, Artificial Sequence
  Synthetic Oligonucleotide; GZMB exon 3; Set C
uaaacugcugggucggcuccuguucuuugauau

SEQ ID NO: 11500 - RNA, 37 nt, Artificial Sequence
  Synthetic Oligonucleotide; GZMB exon 3; Set C
gauaaacugcugggucggcuccuguucuuugauauug

SEQ ID NO: 11501 - RNA, 35 nt, Artificial Sequence
  Synthetic Oligonucleotide; GZMB exon 3; Set C
auaaacugcugggucggcuccuguucuuugauauu

SEQ ID NO: 11502 - RNA, 39 nt, Artificial Sequence
  Synthetic Oligonucleotide; GZMB exon 3; Set C
ggauaaacugcugggucggcuccuguucuuugauauugu

SEQ ID NO: 11503 - RNA, 34 nt, Artificial Sequence
  Synthetic Oligonucleotide; GZMB exon 3; Set C
auaaacugcugggucggcuccuguucuuugauau

SEQ ID NO: 11504 - RNA, 32 nt, Artificial Sequence
  Synthetic Oligonucleotide; GZMB exon 3; Set C
uaaacugcugggucggcuccuguucuuugaua

SEQ ID NO: 11505 - RNA, 36 nt, Artificial Sequence
  Synthetic Oligonucleotide; GZMB exon 3; Set C
gauaaacugcugggucggcuccuguucuuugauauu

SEQ ID NO: 11506 - RNA, 38 nt, Artificial Sequence
  Synthetic Oligonucleotide; GZMB exon 3; Set C
ggauaaacugcugggucggcuccuguucuuugauauug

SEQ ID NO: 11507 - RNA, 35 nt, Artificial Sequence
  Synthetic Oligonucleotide; GZMB exon 3; Set C
gauaaacugcugggucggcuccuguucuuugauau

SEQ ID NO: 11508 - RNA, 33 nt, Artificial Sequence
  Synthetic Oligonucleotide; GZMB exon 3; Set C
auaaacugcugggucggcuccuguucuuugaua

SEQ ID NO: 11509 - RNA, 31 nt, Artificial Sequence
  Synthetic Oligonucleotide; GZMB exon 3; Set C
uaaacugcugggucggcuccuguucuuugau

SEQ ID NO: 11510 - RNA, 37 nt, Artificial Sequence
  Synthetic Oligonucleotide; GZMB exon 3; Set C
ggauaaacugcugggucggcuccuguucuuugauauu

SEQ ID NO: 11511 - RNA, 34 nt, Artificial Sequence
  Synthetic Oligonucleotide; GZMB exon 3; Set C
gauaaacugcugggucggcuccuguucuuugaua

SEQ ID NO: 11512 - RNA, 36 nt, Artificial Sequence
  Synthetic Oligonucleotide; GZMB exon 3; Set C
ggauaaacugcugggucggcuccuguucuuugauau

SEQ ID NO: 11513 - RNA, 32 nt, Artificial Sequence
  Synthetic Oligonucleotide; GZMB exon 3; Set C
auaaacugcugggucggcuccuguucuuugau

SEQ ID NO: 11514 - RNA, 30 nt, Artificial Sequence
  Synthetic Oligonucleotide; GZMB exon 3; Set C
uaaacugcugggucggcuccuguucuuuga

SEQ ID NO: 11515 - RNA, 35 nt, Artificial Sequence
  Synthetic Oligonucleotide; GZMB exon 3; Set C
ggauaaacugcugggucggcuccuguucuuugaua

SEQ ID NO: 11516 - RNA, 33 nt, Artificial Sequence
  Synthetic Oligonucleotide; GZMB exon 3; Set C
gauaaacugcugggucggcuccuguucuuugau

SEQ ID NO: 11517 - RNA, 31 nt, Artificial Sequence
  Synthetic Oligonucleotide; GZMB exon 3; Set C
auaaacugcugggucggcuccuguucuuuga

SEQ ID NO: 11518 - RNA, 29 nt, Artificial Sequence
  Synthetic Oligonucleotide; GZMB exon 3; Set C
uaaacugcugggucggcuccuguucuuug

SEQ ID NO: 11519 - RNA, 32 nt, Artificial Sequence
  Synthetic Oligonucleotide; GZMB exon 3; Set C
gauaaacugcugggucggcuccuguucuuuga

SEQ ID NO: 11520 - RNA, 30 nt, Artificial Sequence
  Synthetic Oligonucleotide; GZMB exon 3; Set C
auaaacugcugggucggcuccuguucuuug

SEQ ID NO: 11521 - RNA, 28 nt, Artificial Sequence
  Synthetic Oligonucleotide; GZMB exon 3; Set C
uaaacugcugggucggcuccuguucuuu

SEQ ID NO: 11522 - RNA, 34 nt, Artificial Sequence
  Synthetic Oligonucleotide; GZMB exon 3; Set C
ggauaaacugcugggucggcuccuguucuuugau

SEQ ID NO: 11523 - RNA, 31 nt, Artificial Sequence
  Synthetic Oligonucleotide; GZMB exon 3; Set C
gauaaacugcugggucggcuccuguucuuug

SEQ ID NO: 11524 - RNA, 29 nt, Artificial Sequence
  Synthetic Oligonucleotide; GZMB exon 3; Set C
auaaacugcugggucggcuccuguucuuu

SEQ ID NO: 11525 - RNA, 27 nt, Artificial Sequence
  Synthetic Oligonucleotide; GZMB exon 3; Set C
uaaacugcugggucggcuccuguucuu

SEQ ID NO: 11526 - RNA, 33 nt, Artificial Sequence
  Synthetic Oligonucleotide; GZMB exon 3; Set C
ggauaaacugcugggucggcuccuguucuuuga

SEQ ID NO: 11527 - RNA, 30 nt, Artificial Sequence
  Synthetic Oligonucleotide; GZMB exon 3; Set C
gauaaacugcugggucggcuccuguucuuu

SEQ ID NO: 11528 - RNA, 28 nt, Artificial Sequence
  Synthetic Oligonucleotide; GZMB exon 3; Set C
auaaacugcugggucggcuccuguucuu

SEQ ID NO: 11529 - RNA, 32 nt, Artificial Sequence
  Synthetic Oligonucleotide; GZMB exon 3; Set C
ggauaaacugcugggucggcuccuguucuuug

SEQ ID NO: 11530 - RNA, 29 nt, Artificial Sequence
  Synthetic Oligonucleotide; GZMB exon 3; Set C
gauaaacugcugggucggcuccuguucuu

SEQ ID NO: 11531 - RNA, 27 nt, Artificial Sequence
  Synthetic Oligonucleotide; GZMB exon 3; Set C
auaaacugcugggucggcuccuguucu

SEQ ID NO: 11532 - RNA, 31 nt, Artificial Sequence
  Synthetic Oligonucleotide; GZMB exon 3; Set C
ggauaaacugcugggucggcuccuguucuuu

SEQ ID NO: 11533 - RNA, 28 nt, Artificial Sequence
  Synthetic Oligonucleotide; GZMB exon 3; Set C
gauaaacugcugggucggcuccuguucu

SEQ ID NO: 11534 - RNA, 30 nt, Artificial Sequence
  Synthetic Oligonucleotide; GZMB exon 3; Set C
ggauaaacugcugggucggcuccuguucuu

SEQ ID NO: 11535 - RNA, 26 nt, Artificial Sequence
  Synthetic Oligonucleotide; GZMB exon 3; Set A
auaaacugcugggucggcuccuguuc

SEQ ID NO: 11536 - RNA, 29 nt, Artificial Sequence
  Synthetic Oligonucleotide; GZMB exon 3; Set C
ggauaaacugcugggucggcuccuguucu

SEQ ID NO: 11537 - RNA, 27 nt, Artificial Sequence
  Synthetic Oligonucleotide; GZMB exon 3; Set C
gauaaacugcugggucggcuccuguuc

SEQ ID NO: 11538 - RNA, 15 nt, Artificial Sequence
  Synthetic Oligonucleotide; GZMB exon 3; Set C
gggaugggucuuuuc

SEQ ID NO: 11539 - RNA, 16 nt, Artificial Sequence
  Synthetic Oligonucleotide; GZMB exon 3; Set C
ggggaugggucuuuuc

SEQ ID NO: 11540 - RNA, 15 nt, Artificial Sequence
  Synthetic Oligonucleotide; GZMB exon 3; Set C
ggggaugggucuuuu

SEQ ID NO: 11541 - RNA, 17 nt, Artificial Sequence
  Synthetic Oligonucleotide; GZMB exon 3; Set C
gggggaugggucuuuuc

SEQ ID NO: 11542 - RNA, 35 nt, Artificial Sequence
  Synthetic Oligonucleotide; GZMB exon 3; Set C
aggcuggaugggggaugggucuuuucacagggaua

SEQ ID NO: 11543 - RNA, 37 nt, Artificial Sequence
  Synthetic Oligonucleotide; GZMB exon 3; Set C
uaggcuggaugggggaugggucuuuucacagggauaa

SEQ ID NO: 11544 - RNA, 34 nt, Artificial Sequence
  Synthetic Oligonucleotide; GZMB exon 3; Set C
aggcuggaugggggaugggucuuuucacagggau

SEQ ID NO: 11545 - RNA, 18 nt, Artificial Sequence
  Synthetic Oligonucleotide; GZMB exon 3; Set C
ugggggaugggucuuuuc

SEQ ID NO: 11546 - RNA, 16 nt, Artificial Sequence
  Synthetic Oligonucleotide; GZMB exon 3; Set C
gggggaugggucuuuu

SEQ ID NO: 11547 - RNA, 36 nt, Artificial Sequence
  Synthetic Oligonucleotide; GZMB exon 3; Set C
uaggcuggaugggggaugggucuuuucacagggaua

SEQ ID NO: 11548 - RNA, 38 nt, Artificial Sequence
  Synthetic Oligonucleotide; GZMB exon 3; Set C
auaggcuggaugggggaugggucuuuucacagggauaa

SEQ ID NO: 11549 - RNA, 35 nt, Artificial Sequence
  Synthetic Oligonucleotide; GZMB exon 3; Set C
uaggcuggaugggggaugggucuuuucacagggau

SEQ ID NO: 11550 - RNA, 19 nt, Artificial Sequence
  Synthetic Oligonucleotide; GZMB exon 3; Set C
augggggaugggucuuuuc

SEQ ID NO: 11551 - RNA, 17 nt, Artificial Sequence
  Synthetic Oligonucleotide; GZMB exon 3; Set C
ugggggaugggucuuuu

SEQ ID NO: 11552 - RNA, 37 nt, Artificial Sequence
  Synthetic Oligonucleotide; GZMB exon 3; Set C
auaggcuggaugggggaugggucuuuucacagggaua

SEQ ID NO: 11553 - RNA, 39 nt, Artificial Sequence
  Synthetic Oligonucleotide; GZMB exon 3; Set C
uauaggcuggaugggggaugggucuuuucacagggauaa

SEQ ID NO: 11554 - RNA, 36 nt, Artificial Sequence
  Synthetic Oligonucleotide; GZMB exon 3; Set C
auaggcuggaugggggaugggucuuuucacagggau

SEQ ID NO: 11555 - RNA, 20 nt, Artificial Sequence
  Synthetic Oligonucleotide; GZMB exon 3; Set A
gaugggggaugggucuuuuc

SEQ ID NO: 11556 - RNA, 18 nt, Artificial Sequence
  Synthetic Oligonucleotide; GZMB exon 3; Set C
augggggaugggucuuuu

SEQ ID NO: 11557 - RNA, 16 nt, Artificial Sequence
  Synthetic Oligonucleotide; GZMB exon 3; Set C
ugggggaugggucuuu

SEQ ID NO: 11558 - RNA, 38 nt, Artificial Sequence
  Synthetic Oligonucleotide; GZMB exon 3; Set C
uauaggcuggaugggggaugggucuuuucacagggaua

SEQ ID NO: 11559 - RNA, 40 nt, Artificial Sequence
  Synthetic Oligonucleotide; GZMB exon 3; Set C
uuauaggcuggaugggggaugggucuuuucacagggauaa

SEQ ID NO: 11560 - RNA, 37 nt, Artificial Sequence
  Synthetic Oligonucleotide; GZMB exon 3; Set C
uauaggcuggaugggggaugggucuuuucacagggau

SEQ ID NO: 11561 - RNA, 21 nt, Artificial Sequence
  Synthetic Oligonucleotide; GZMB exon 3; Set A
ggaugggggaugggucuuuuc

SEQ ID NO: 11562 - RNA, 19 nt, Artificial Sequence
  Synthetic Oligonucleotide; GZMB exon 3; Set A
gaugggggaugggucuuuu

SEQ ID NO: 11563 - RNA, 17 nt, Artificial Sequence
  Synthetic Oligonucleotide; GZMB exon 3; Set C
augggggaugggucuuu

SEQ ID NO: 11564 - RNA, 39 nt, Artificial Sequence
  Synthetic Oligonucleotide; GZMB exon 3; Set C
uuauaggcuggaugggggaugggucuuuucacagggaua

SEQ ID NO: 11565 - RNA, 35 nt, Artificial Sequence
  Synthetic Oligonucleotide; GZMB exon 3; Set C
auaggcuggaugggggaugggucuuuucacaggga

SEQ ID NO: 11566 - RNA, 38 nt, Artificial Sequence
  Synthetic Oligonucleotide; GZMB exon 3; Set C
uuauaggcuggaugggggaugggucuuuucacagggau

SEQ ID NO: 11567 - RNA, 20 nt, Artificial Sequence
  Synthetic Oligonucleotide; GZMB exon 3; Set A
ggaugggggaugggucuuuu

SEQ ID NO: 11568 - RNA, 22 nt, Artificial Sequence
  Synthetic Oligonucleotide; GZMB exon 3; Set A
uggaugggggaugggucuuuuc

SEQ ID NO: 11569 - RNA, 18 nt, Artificial Sequence
  Synthetic Oligonucleotide; GZMB exon 3; Set C
gaugggggaugggucuuu

SEQ ID NO: 11570 - RNA, 40 nt, Artificial Sequence
  Synthetic Oligonucleotide; GZMB exon 3; Set C
auuauaggcuggaugggggaugggucuuuucacagggaua

SEQ ID NO: 11571 - RNA, 16 nt, Artificial Sequence
  Synthetic Oligonucleotide; GZMB exon 3; Set C
augggggaugggucuu

SEQ ID NO: 11572 - RNA, 36 nt, Artificial Sequence
  Synthetic Oligonucleotide; GZMB exon 3; Set C
uauaggcuggaugggggaugggucuuuucacaggga

SEQ ID NO: 11573 - RNA, 39 nt, Artificial Sequence
  Synthetic Oligonucleotide; GZMB exon 3; Set C
auuauaggcuggaugggggaugggucuuuucacagggau

SEQ ID NO: 11574 - RNA, 19 nt, Artificial Sequence
  Synthetic Oligonucleotide; GZMB exon 3; Set A
ggaugggggaugggucuuu

SEQ ID NO: 11575 - RNA, 21 nt, Artificial Sequence
  Synthetic Oligonucleotide; GZMB exon 3; Set A
uggaugggggaugggucuuuu

SEQ ID NO: 11576 - RNA, 23 nt, Artificial Sequence
  Synthetic Oligonucleotide; GZMB exon 3; Set A
cuggaugggggaugggucuuuuc

SEQ ID NO: 11577 - RNA, 17 nt, Artificial Sequence
  Synthetic Oligonucleotide; GZMB exon 3; Set C
gaugggggaugggucuu

SEQ ID NO: 11578 - RNA, 15 nt, Artificial Sequence
  Synthetic Oligonucleotide; GZMB exon 3; Set C
augggggaugggucu

SEQ ID NO: 11579 - RNA, 37 nt, Artificial Sequence
  Synthetic Oligonucleotide; GZMB exon 3; Set C
uuauaggcuggaugggggaugggucuuuucacaggga

SEQ ID NO: 11580 - RNA, 40 nt, Artificial Sequence
  Synthetic Oligonucleotide; GZMB exon 3; Set C
gauuauaggcuggaugggggaugggucuuuucacagggau

SEQ ID NO: 11581 - RNA, 20 nt, Artificial Sequence
  Synthetic Oligonucleotide; GZMB exon 3; Set A
uggaugggggaugggucuuu

SEQ ID NO: 11582 - RNA, 24 nt, Artificial Sequence
  Synthetic Oligonucleotide; GZMB exon 3; Set C
gcuggaugggggaugggucuuuuc

SEQ ID NO: 11583 - RNA, 22 nt, Artificial Sequence
  Synthetic Oligonucleotide; GZMB exon 3; Set A
cuggaugggggaugggucuuuu

SEQ ID NO: 11584 - RNA, 18 nt, Artificial Sequence
  Synthetic Oligonucleotide; GZMB exon 3; Set A
ggaugggggaugggucuu

SEQ ID NO: 11585 - RNA, 16 nt, Artificial Sequence
  Synthetic Oligonucleotide; GZMB exon 3; Set C
gaugggggaugggucu

SEQ ID NO: 11586 - RNA, 38 nt, Artificial Sequence
  Synthetic Oligonucleotide; GZMB exon 3; Set C
auuauaggcuggaugggggaugggucuuuucacaggga

SEQ ID NO: 11587 - RNA, 25 nt, Artificial Sequence
  Synthetic Oligonucleotide; GZMB exon 3; Set C
ggcuggaugggggaugggucuuuuc

SEQ ID NO: 11588 - RNA, 23 nt, Artificial Sequence
  Synthetic Oligonucleotide; GZMB exon 3; Set C
gcuggaugggggaugggucuuuu

SEQ ID NO: 11589 - RNA, 21 nt, Artificial Sequence
  Synthetic Oligonucleotide; GZMB exon 3; Set A
cuggaugggggaugggucuuu

SEQ ID NO: 11590 - RNA, 19 nt, Artificial Sequence
  Synthetic Oligonucleotide; GZMB exon 3; Set A
uggaugggggaugggucuu

SEQ ID NO: 11591 - RNA, 17 nt, Artificial Sequence
  Synthetic Oligonucleotide; GZMB exon 3; Set A
ggaugggggaugggucu

SEQ ID NO: 11592 - RNA, 39 nt, Artificial Sequence
  Synthetic Oligonucleotide; GZMB exon 3; Set C
gauuauaggcuggaugggggaugggucuuuucacaggga

SEQ ID NO: 11593 - RNA, 15 nt, Artificial Sequence
  Synthetic Oligonucleotide; GZMB exon 3; Set C
gaugggggauggguc

SEQ ID NO: 11594 - RNA, 26 nt, Artificial Sequence
  Synthetic Oligonucleotide; GZMB exon 3; Set C
aggcuggaugggggaugggucuuuuc

SEQ ID NO: 11595 - RNA, 24 nt, Artificial Sequence
  Synthetic Oligonucleotide; GZMB exon 3; Set C
ggcuggaugggggaugggucuuuu

SEQ ID NO: 11596 - RNA, 22 nt, Artificial Sequence
  Synthetic Oligonucleotide; GZMB exon 3; Set C
gcuggaugggggaugggucuuu

SEQ ID NO: 11597 - RNA, 18 nt, Artificial Sequence
  Synthetic Oligonucleotide; GZMB exon 3; Set A
uggaugggggaugggucu

SEQ ID NO: 11598 - RNA, 40 nt, Artificial Sequence
  Synthetic Oligonucleotide; GZMB exon 3; Set C
ggauuauaggcuggaugggggaugggucuuuucacaggga

SEQ ID NO: 11599 - RNA, 16 nt, Artificial Sequence
  Synthetic Oligonucleotide; GZMB exon 3; Set A
ggaugggggauggguc

SEQ ID NO: 11600 - RNA, 27 nt, Artificial Sequence
  Synthetic Oligonucleotide; GZMB exon 3; Set C
uaggcuggaugggggaugggucuuuuc

SEQ ID NO: 11601 - RNA, 25 nt, Artificial Sequence
  Synthetic Oligonucleotide; GZMB exon 3; Set C
aggcuggaugggggaugggucuuuu

SEQ ID NO: 11602 - RNA, 23 nt, Artificial Sequence
  Synthetic Oligonucleotide; GZMB exon 3; Set C
ggcuggaugggggaugggucuuu

SEQ ID NO: 11603 - RNA, 15 nt, Artificial Sequence
  Synthetic Oligonucleotide; GZMB exon 3; Set C
ggaugggggaugggu

SEQ ID NO: 11604 - RNA, 21 nt, Artificial Sequence
  Synthetic Oligonucleotide; GZMB exon 3; Set C
gcuggaugggggaugggucuu

SEQ ID NO: 11605 - RNA, 17 nt, Artificial Sequence
  Synthetic Oligonucleotide; GZMB exon 3; Set A
uggaugggggauggguc

SEQ ID NO: 11606 - RNA, 28 nt, Artificial Sequence
  Synthetic Oligonucleotide; GZMB exon 3; Set C
auaggcuggaugggggaugggucuuuuc

SEQ ID NO: 11607 - RNA, 26 nt, Artificial Sequence
  Synthetic Oligonucleotide; GZMB exon 3; Set C
uaggcuggaugggggaugggucuuuu

SEQ ID NO: 11608 - RNA, 24 nt, Artificial Sequence
  Synthetic Oligonucleotide; GZMB exon 3; Set C
aggcuggaugggggaugggucuuu

SEQ ID NO: 11609 - RNA, 16 nt, Artificial Sequence
  Synthetic Oligonucleotide; GZMB exon 3; Set C
uggaugggggaugggu

SEQ ID NO: 11610 - RNA, 22 nt, Artificial Sequence
  Synthetic Oligonucleotide; GZMB exon 3; Set C
ggcuggaugggggaugggucuu

SEQ ID NO: 11611 - RNA, 29 nt, Artificial Sequence
  Synthetic Oligonucleotide; GZMB exon 3; Set C
uauaggcuggaugggggaugggucuuuuc

SEQ ID NO: 11612 - RNA, 27 nt, Artificial Sequence
  Synthetic Oligonucleotide; GZMB exon 3; Set C
auaggcuggaugggggaugggucuuuu

SEQ ID NO: 11613 - RNA, 25 nt, Artificial Sequence
  Synthetic Oligonucleotide; GZMB exon 3; Set C
uaggcuggaugggggaugggucuuu

SEQ ID NO: 11614 - RNA, 15 nt, Artificial Sequence
  Synthetic Oligonucleotide; GZMB exon 3; Set C
uggaugggggauggg

SEQ ID NO: 11615 - RNA, 17 nt, Artificial Sequence
  Synthetic Oligonucleotide; GZMB exon 3; Set A
cuggaugggggaugggu

SEQ ID NO: 11616 - RNA, 23 nt, Artificial Sequence
  Synthetic Oligonucleotide; GZMB exon 3; Set C
aggcuggaugggggaugggucuu

SEQ ID NO: 11617 - RNA, 21 nt, Artificial Sequence
  Synthetic Oligonucleotide; GZMB exon 3; Set C
ggcuggaugggggaugggucu

SEQ ID NO: 11618 - RNA, 30 nt, Artificial Sequence
  Synthetic Oligonucleotide; GZMB exon 3; Set C
uuauaggcuggaugggggaugggucuuuuc

SEQ ID NO: 11619 - RNA, 28 nt, Artificial Sequence
  Synthetic Oligonucleotide; GZMB exon 3; Set C
uauaggcuggaugggggaugggucuuuu

SEQ ID NO: 11620 - RNA, 26 nt, Artificial Sequence
  Synthetic Oligonucleotide; GZMB exon 3; Set C
auaggcuggaugggggaugggucuuu

SEQ ID NO: 11621 - RNA, 18 nt, Artificial Sequence
  Synthetic Oligonucleotide; GZMB exon 3; Set A
gcuggaugggggaugggu

SEQ ID NO: 11622 - RNA, 24 nt, Artificial Sequence
  Synthetic Oligonucleotide; GZMB exon 3; Set C
uaggcuggaugggggaugggucuu

SEQ ID NO: 11623 - RNA, 22 nt, Artificial Sequence
  Synthetic Oligonucleotide; GZMB exon 3; Set C
aggcuggaugggggaugggucu

SEQ ID NO: 11624 - RNA, 20 nt, Artificial Sequence
  Synthetic Oligonucleotide; GZMB exon 3; Set C
ggcuggaugggggauggguc

SEQ ID NO: 11625 - RNA, 31 nt, Artificial Sequence
  Synthetic Oligonucleotide; GZMB exon 3; Set C
auuauaggcuggaugggggaugggucuuuuc

SEQ ID NO: 11626 - RNA, 29 nt, Artificial Sequence
  Synthetic Oligonucleotide; GZMB exon 3; Set C
uuauaggcuggaugggggaugggucuuuu

SEQ ID NO: 11627 - RNA, 27 nt, Artificial Sequence
  Synthetic Oligonucleotide; GZMB exon 3; Set C
uauaggcuggaugggggaugggucuuu

SEQ ID NO: 11628 - RNA, 15 nt, Artificial Sequence
  Synthetic Oligonucleotide; GZMB exon 3; Set C
cuggaugggggaugg

SEQ ID NO: 11629 - RNA, 19 nt, Artificial Sequence
  Synthetic Oligonucleotide; GZMB exon 3; Set C
ggcuggaugggggaugggu

SEQ ID NO: 11630 - RNA, 17 nt, Artificial Sequence
  Synthetic Oligonucleotide; GZMB exon 3; Set A
gcuggaugggggauggg

SEQ ID NO: 11631 - RNA, 25 nt, Artificial Sequence
  Synthetic Oligonucleotide; GZMB exon 3; Set C
auaggcuggaugggggaugggucuu

SEQ ID NO: 11632 - RNA, 23 nt, Artificial Sequence
  Synthetic Oligonucleotide; GZMB exon 3; Set C
uaggcuggaugggggaugggucu

SEQ ID NO: 11633 - RNA, 21 nt, Artificial Sequence
  Synthetic Oligonucleotide; GZMB exon 3; Set C
aggcuggaugggggauggguc

SEQ ID NO: 11634 - RNA, 32 nt, Artificial Sequence
  Synthetic Oligonucleotide; GZMB exon 3; Set C
gauuauaggcuggaugggggaugggucuuuuc

SEQ ID NO: 11635 - RNA, 30 nt, Artificial Sequence
  Synthetic Oligonucleotide; GZMB exon 3; Set C
auuauaggcuggaugggggaugggucuuuu

SEQ ID NO: 11636 - RNA, 28 nt, Artificial Sequence
  Synthetic Oligonucleotide; GZMB exon 3; Set C
uuauaggcuggaugggggaugggucuuu

SEQ ID NO: 11637 - RNA, 16 nt, Artificial Sequence
  Synthetic Oligonucleotide; GZMB exon 3; Set A
gcuggaugggggaugg

SEQ ID NO: 11638 - RNA, 20 nt, Artificial Sequence
  Synthetic Oligonucleotide; GZMB exon 3; Set C
aggcuggaugggggaugggu

SEQ ID NO: 11639 - RNA, 18 nt, Artificial Sequence
  Synthetic Oligonucleotide; GZMB exon 3; Set A
ggcuggaugggggauggg

SEQ ID NO: 11640 - RNA, 26 nt, Artificial Sequence
  Synthetic Oligonucleotide; GZMB exon 3; Set C
uauaggcuggaugggggaugggucuu

SEQ ID NO: 11641 - RNA, 24 nt, Artificial Sequence
  Synthetic Oligonucleotide; GZMB exon 3; Set C
auaggcuggaugggggaugggucu

SEQ ID NO: 11642 - RNA, 22 nt, Artificial Sequence
  Synthetic Oligonucleotide; GZMB exon 3; Set C
uaggcuggaugggggauggguc

SEQ ID NO: 11643 - RNA, 31 nt, Artificial Sequence
  Synthetic Oligonucleotide; GZMB exon 3; Set C
gauuauaggcuggaugggggaugggucuuuu

SEQ ID NO: 11644 - RNA, 29 nt, Artificial Sequence
  Synthetic Oligonucleotide; GZMB exon 3; Set C
auuauaggcuggaugggggaugggucuuu

SEQ ID NO: 11645 - RNA, 33 nt, Artificial Sequence
  Synthetic Oligonucleotide; GZMB exon 3; Set C
ggauuauaggcuggaugggggaugggucuuuuc

SEQ ID NO: 11646 - RNA, 17 nt, Artificial Sequence
  Synthetic Oligonucleotide; GZMB exon 3; Set A
ggcuggaugggggaugg

SEQ ID NO: 11647 - RNA, 21 nt, Artificial Sequence
  Synthetic Oligonucleotide; GZMB exon 3; Set C
uaggcuggaugggggaugggu

SEQ ID NO: 11648 - RNA, 19 nt, Artificial Sequence
  Synthetic Oligonucleotide; GZMB exon 3; Set A
aggcuggaugggggauggg

SEQ ID NO: 11649 - RNA, 27 nt, Artificial Sequence
  Synthetic Oligonucleotide; GZMB exon 3; Set C
uuauaggcuggaugggggaugggucuu

SEQ ID NO: 11650 - RNA, 25 nt, Artificial Sequence
  Synthetic Oligonucleotide; GZMB exon 3; Set C
uauaggcuggaugggggaugggucu

SEQ ID NO: 11651 - RNA, 23 nt, Artificial Sequence
  Synthetic Oligonucleotide; GZMB exon 3; Set C
auaggcuggaugggggauggguc

SEQ ID NO: 11652 - RNA, 30 nt, Artificial Sequence
  Synthetic Oligonucleotide; GZMB exon 3; Set C
gauuauaggcuggaugggggaugggucuuu

SEQ ID NO: 11653 - RNA, 34 nt, Artificial Sequence
  Synthetic Oligonucleotide; GZMB exon 3; Set C
aggauuauaggcuggaugggggaugggucuuuuc

SEQ ID NO: 11654 - RNA, 32 nt, Artificial Sequence
  Synthetic Oligonucleotide; GZMB exon 3; Set C
ggauuauaggcuggaugggggaugggucuuuu

SEQ ID NO: 11655 - RNA, 18 nt, Artificial Sequence
  Synthetic Oligonucleotide; GZMB exon 3; Set A
aggcuggaugggggaugg

SEQ ID NO: 11656 - RNA, 16 nt, Artificial Sequence
  Synthetic Oligonucleotide; GZMB exon 3; Set A
ggcuggaugggggaug

SEQ ID NO: 11657 - RNA, 22 nt, Artificial Sequence
  Synthetic Oligonucleotide; GZMB exon 3; Set C
auaggcuggaugggggaugggu

SEQ ID NO: 11658 - RNA, 20 nt, Artificial Sequence
  Synthetic Oligonucleotide; GZMB exon 3; Set A
uaggcuggaugggggauggg

SEQ ID NO: 11659 - RNA, 28 nt, Artificial Sequence
  Synthetic Oligonucleotide; GZMB exon 3; Set C
auuauaggcuggaugggggaugggucuu

SEQ ID NO: 11660 - RNA, 26 nt, Artificial Sequence
  Synthetic Oligonucleotide; GZMB exon 3; Set C
uuauaggcuggaugggggaugggucu

SEQ ID NO: 11661 - RNA, 24 nt, Artificial Sequence
  Synthetic Oligonucleotide; GZMB exon 3; Set C
uauaggcuggaugggggauggguc

SEQ ID NO: 11662 - RNA, 35 nt, Artificial Sequence
  Synthetic Oligonucleotide; GZMB exon 3; Set C
uaggauuauaggcuggaugggggaugggucuuuuc

SEQ ID NO: 11663 - RNA, 33 nt, Artificial Sequence
  Synthetic Oligonucleotide; GZMB exon 3; Set C
aggauuauaggcuggaugggggaugggucuuuu

SEQ ID NO: 11664 - RNA, 31 nt, Artificial Sequence
  Synthetic Oligonucleotide; GZMB exon 3; Set C
ggauuauaggcuggaugggggaugggucuuu

SEQ ID NO: 11665 - RNA, 19 nt, Artificial Sequence
  Synthetic Oligonucleotide; GZMB exon 3; Set A
uaggcuggaugggggaugg

SEQ ID NO: 11666 - RNA, 17 nt, Artificial Sequence
  Synthetic Oligonucleotide; GZMB exon 3; Set A
aggcuggaugggggaug

SEQ ID NO: 11667 - RNA, 23 nt, Artificial Sequence
  Synthetic Oligonucleotide; GZMB exon 3; Set C
uauaggcuggaugggggaugggu

SEQ ID NO: 11668 - RNA, 21 nt, Artificial Sequence
  Synthetic Oligonucleotide; GZMB exon 3; Set A
auaggcuggaugggggauggg

SEQ ID NO: 11669 - RNA, 29 nt, Artificial Sequence
  Synthetic Oligonucleotide; GZMB exon 3; Set C
gauuauaggcuggaugggggaugggucuu

SEQ ID NO: 11670 - RNA, 27 nt, Artificial Sequence
  Synthetic Oligonucleotide; GZMB exon 3; Set C
auuauaggcuggaugggggaugggucu

SEQ ID NO: 11671 - RNA, 25 nt, Artificial Sequence
  Synthetic Oligonucleotide; GZMB exon 3; Set C
uuauaggcuggaugggggauggguc

SEQ ID NO: 11672 - RNA, 15 nt, Artificial Sequence
  Synthetic Oligonucleotide; GZMB exon 3; Set C
ggcuggaugggggau

SEQ ID NO: 11673 - RNA, 20 nt, Artificial Sequence
  Synthetic Oligonucleotide; GZMB exon 3; Set A
auaggcuggaugggggaugg

SEQ ID NO: 11674 - RNA, 34 nt, Artificial Sequence
  Synthetic Oligonucleotide; GZMB exon 3; Set C
uaggauuauaggcuggaugggggaugggucuuuu

SEQ ID NO: 11675 - RNA, 32 nt, Artificial Sequence
  Synthetic Oligonucleotide; GZMB exon 3; Set C
aggauuauaggcuggaugggggaugggucuuu

SEQ ID NO: 11676 - RNA, 18 nt, Artificial Sequence
  Synthetic Oligonucleotide; GZMB exon 3; Set A
uaggcuggaugggggaug

SEQ ID NO: 11677 - RNA, 24 nt, Artificial Sequence
  Synthetic Oligonucleotide; GZMB exon 3; Set C
uuauaggcuggaugggggaugggu

SEQ ID NO: 11678 - RNA, 22 nt, Artificial Sequence
  Synthetic Oligonucleotide; GZMB exon 3; Set A
uauaggcuggaugggggauggg

SEQ ID NO: 11679 - RNA, 30 nt, Artificial Sequence
  Synthetic Oligonucleotide; GZMB exon 3; Set C
ggauuauaggcuggaugggggaugggucuu

SEQ ID NO: 11680 - RNA, 28 nt, Artificial Sequence
  Synthetic Oligonucleotide; GZMB exon 3; Set C
gauuauaggcuggaugggggaugggucu

SEQ ID NO: 11681 - RNA, 26 nt, Artificial Sequence
  Synthetic Oligonucleotide; GZMB exon 3; Set C
auuauaggcuggaugggggauggguc

SEQ ID NO: 11682 - RNA, 16 nt, Artificial Sequence
  Synthetic Oligonucleotide; GZMB exon 3; Set C
aggcuggaugggggau

SEQ ID NO: 11683 - RNA, 21 nt, Artificial Sequence
  Synthetic Oligonucleotide; GZMB exon 3; Set A
uauaggcuggaugggggaugg

SEQ ID NO: 11684 - RNA, 33 nt, Artificial Sequence
  Synthetic Oligonucleotide; GZMB exon 3; Set C
uaggauuauaggcuggaugggggaugggucuuu

SEQ ID NO: 11685 - RNA, 19 nt, Artificial Sequence
  Synthetic Oligonucleotide; GZMB exon 3; Set A
auaggcuggaugggggaug

SEQ ID NO: 11686 - RNA, 25 nt, Artificial Sequence
  Synthetic Oligonucleotide; GZMB exon 3; Set C
auuauaggcuggaugggggaugggu

SEQ ID NO: 11687 - RNA, 23 nt, Artificial Sequence
  Synthetic Oligonucleotide; GZMB exon 3; Set A
uuauaggcuggaugggggauggg

SEQ ID NO: 11688 - RNA, 31 nt, Artificial Sequence
  Synthetic Oligonucleotide; GZMB exon 3; Set C
aggauuauaggcuggaugggggaugggucuu

SEQ ID NO: 11689 - RNA, 29 nt, Artificial Sequence
  Synthetic Oligonucleotide; GZMB exon 3; Set C
ggauuauaggcuggaugggggaugggucu

SEQ ID NO: 11690 - RNA, 27 nt, Artificial Sequence
  Synthetic Oligonucleotide; GZMB exon 3; Set C
gauuauaggcuggaugggggauggguc

SEQ ID NO: 11691 - RNA, 17 nt, Artificial Sequence
  Synthetic Oligonucleotide; GZMB exon 3; Set A
uaggcuggaugggggau

SEQ ID NO: 11692 - RNA, 15 nt, Artificial Sequence
  Synthetic Oligonucleotide; GZMB exon 3; Set C
aggcuggauggggga

SEQ ID NO: 11693 - RNA, 22 nt, Artificial Sequence
  Synthetic Oligonucleotide; GZMB exon 3; Set A
uuauaggcuggaugggggaugg

SEQ ID NO: 11694 - RNA, 20 nt, Artificial Sequence
  Synthetic Oligonucleotide; GZMB exon 3; Set A
uauaggcuggaugggggaug

SEQ ID NO: 11695 - RNA, 26 nt, Artificial Sequence
  Synthetic Oligonucleotide; GZMB exon 3; Set C
gauuauaggcuggaugggggaugggu

SEQ ID NO: 11696 - RNA, 24 nt, Artificial Sequence
  Synthetic Oligonucleotide; GZMB exon 3; Set A
auuauaggcuggaugggggauggg

SEQ ID NO: 11697 - RNA, 32 nt, Artificial Sequence
  Synthetic Oligonucleotide; GZMB exon 3; Set C
uaggauuauaggcuggaugggggaugggucuu

SEQ ID NO: 11698 - RNA, 30 nt, Artificial Sequence
  Synthetic Oligonucleotide; GZMB exon 3; Set C
aggauuauaggcuggaugggggaugggucu

SEQ ID NO: 11699 - RNA, 28 nt, Artificial Sequence
  Synthetic Oligonucleotide; GZMB exon 3; Set C
ggauuauaggcuggaugggggauggguc

SEQ ID NO: 11700 - RNA, 18 nt, Artificial Sequence
  Synthetic Oligonucleotide; GZMB exon 3; Set A
auaggcuggaugggggau

SEQ ID NO: 11701 - RNA, 16 nt, Artificial Sequence
  Synthetic Oligonucleotide; GZMB exon 3; Set A
uaggcuggauggggga

SEQ ID NO: 11702 - RNA, 23 nt, Artificial Sequence
  Synthetic Oligonucleotide; GZMB exon 3; Set A
auuauaggcuggaugggggaugg

SEQ ID NO: 11703 - RNA, 21 nt, Artificial Sequence
  Synthetic Oligonucleotide; GZMB exon 3; Set A
uuauaggcuggaugggggaug

SEQ ID NO: 11704 - RNA, 25 nt, Artificial Sequence
  Synthetic Oligonucleotide; GZMB exon 3; Set C
gauuauaggcuggaugggggauggg

SEQ ID NO: 11705 - RNA, 27 nt, Artificial Sequence
  Synthetic Oligonucleotide; GZMB exon 3; Set C
ggauuauaggcuggaugggggaugggu

SEQ ID NO: 11706 - RNA, 31 nt, Artificial Sequence
  Synthetic Oligonucleotide; GZMB exon 3; Set C
uaggauuauaggcuggaugggggaugggucu

SEQ ID NO: 11707 - RNA, 29 nt, Artificial Sequence
  Synthetic Oligonucleotide; GZMB exon 3; Set C
aggauuauaggcuggaugggggauggguc

SEQ ID NO: 11708 - RNA, 19 nt, Artificial Sequence
  Synthetic Oligonucleotide; GZMB exon 3; Set A
uauaggcuggaugggggau

SEQ ID NO: 11709 - RNA, 17 nt, Artificial Sequence
  Synthetic Oligonucleotide; GZMB exon 3; Set A
auaggcuggauggggga

SEQ ID NO: 11710 - RNA, 24 nt, Artificial Sequence
  Synthetic Oligonucleotide; GZMB exon 3; Set A
gauuauaggcuggaugggggaugg

SEQ ID NO: 11711 - RNA, 40 nt, Artificial Sequence
  Synthetic Oligonucleotide; GZMB exon 3; Set C
guucuuaggauuauaggcuggaugggggaugggucuuuuc

SEQ ID NO: 11712 - RNA, 22 nt, Artificial Sequence
  Synthetic Oligonucleotide; GZMB exon 3; Set A
auuauaggcuggaugggggaug

SEQ ID NO: 11713 - RNA, 28 nt, Artificial Sequence
  Synthetic Oligonucleotide; GZMB exon 3; Set C
aggauuauaggcuggaugggggaugggu

SEQ ID NO: 11714 - RNA, 26 nt, Artificial Sequence
  Synthetic Oligonucleotide; GZMB exon 3; Set C
ggauuauaggcuggaugggggauggg

SEQ ID NO: 11715 - RNA, 30 nt, Artificial Sequence
  Synthetic Oligonucleotide; GZMB exon 3; Set C
uaggauuauaggcuggaugggggauggguc

SEQ ID NO: 11716 - RNA, 20 nt, Artificial Sequence
  Synthetic Oligonucleotide; GZMB exon 3; Set A
uuauaggcuggaugggggau

SEQ ID NO: 11717 - RNA, 18 nt, Artificial Sequence
  Synthetic Oligonucleotide; GZMB exon 3; Set A
uauaggcuggauggggga

SEQ ID NO: 11718 - RNA, 16 nt, Artificial Sequence
  Synthetic Oligonucleotide; GZMB exon 3; Set C
auaggcuggauggggg

SEQ ID NO: 11719 - RNA, 25 nt, Artificial Sequence
  Synthetic Oligonucleotide; GZMB exon 3; Set C
ggauuauaggcuggaugggggaugg

SEQ ID NO: 11720 - RNA, 39 nt, Artificial Sequence
  Synthetic Oligonucleotide; GZMB exon 3; Set C
guucuuaggauuauaggcuggaugggggaugggucuuuu

SEQ ID NO: 11721 - RNA, 23 nt, Artificial Sequence
  Synthetic Oligonucleotide; GZMB exon 3; Set A
gauuauaggcuggaugggggaug

SEQ ID NO: 11722 - RNA, 29 nt, Artificial Sequence
  Synthetic Oligonucleotide; GZMB exon 3; Set C
uaggauuauaggcuggaugggggaugggu

SEQ ID NO: 11723 - RNA, 27 nt, Artificial Sequence
  Synthetic Oligonucleotide; GZMB exon 3; Set C
aggauuauaggcuggaugggggauggg

SEQ ID NO: 11724 - RNA, 21 nt, Artificial Sequence
  Synthetic Oligonucleotide; GZMB exon 3; Set A
auuauaggcuggaugggggau

SEQ ID NO: 11725 - RNA, 19 nt, Artificial Sequence
  Synthetic Oligonucleotide; GZMB exon 3; Set A
uuauaggcuggauggggga

SEQ ID NO: 11726 - RNA, 17 nt, Artificial Sequence
  Synthetic Oligonucleotide; GZMB exon 3; Set C
uauaggcuggauggggg

SEQ ID NO: 11727 - RNA, 26 nt, Artificial Sequence
  Synthetic Oligonucleotide; GZMB exon 3; Set A
aggauuauaggcuggaugggggaugg

SEQ ID NO: 11728 - RNA, 38 nt, Artificial Sequence
  Synthetic Oligonucleotide; GZMB exon 3; Set C
guucuuaggauuauaggcuggaugggggaugggucuuu

SEQ ID NO: 11729 - RNA, 40 nt, Artificial Sequence
  Synthetic Oligonucleotide; GZMB exon 3; Set C
aguucuuaggauuauaggcuggaugggggaugggucuuuu

SEQ ID NO: 11730 - RNA, 24 nt, Artificial Sequence
  Synthetic Oligonucleotide; GZMB exon 3; Set A
ggauuauaggcuggaugggggaug

SEQ ID NO: 11731 - RNA, 28 nt, Artificial Sequence
  Synthetic Oligonucleotide; GZMB exon 3; Set C
uaggauuauaggcuggaugggggauggg

SEQ ID NO: 11732 - RNA, 22 nt, Artificial Sequence
  Synthetic Oligonucleotide; GZMB exon 3; Set A
gauuauaggcuggaugggggau

SEQ ID NO: 11733 - RNA, 20 nt, Artificial Sequence
  Synthetic Oligonucleotide; GZMB exon 3; Set A
auuauaggcuggauggggga

SEQ ID NO: 11734 - RNA, 18 nt, Artificial Sequence
  Synthetic Oligonucleotide; GZMB exon 3; Set C
uuauaggcuggauggggg

SEQ ID NO: 11735 - RNA, 27 nt, Artificial Sequence
  Synthetic Oligonucleotide; GZMB exon 3; Set C
uaggauuauaggcuggaugggggaugg

SEQ ID NO: 11736 - RNA, 39 nt, Artificial Sequence
  Synthetic Oligonucleotide; GZMB exon 3; Set C
aguucuuaggauuauaggcuggaugggggaugggucuuu

SEQ ID NO: 11737 - RNA, 25 nt, Artificial Sequence
  Synthetic Oligonucleotide; GZMB exon 3; Set A
aggauuauaggcuggaugggggaug

SEQ ID NO: 11738 - RNA, 37 nt, Artificial Sequence
  Synthetic Oligonucleotide; GZMB exon 3; Set C
guucuuaggauuauaggcuggaugggggaugggucuu

SEQ ID NO: 11739 - RNA, 23 nt, Artificial Sequence
  Synthetic Oligonucleotide; GZMB exon 3; Set A
ggauuauaggcuggaugggggau

SEQ ID NO: 11740 - RNA, 21 nt, Artificial Sequence
  Synthetic Oligonucleotide; GZMB exon 3; Set A
gauuauaggcuggauggggga

SEQ ID NO: 11741 - RNA, 19 nt, Artificial Sequence
  Synthetic Oligonucleotide; GZMB exon 3; Set C
auuauaggcuggauggggg

SEQ ID NO: 11742 - RNA, 40 nt, Artificial Sequence
  Synthetic Oligonucleotide; GZMB exon 3; Set C
aaguucuuaggauuauaggcuggaugggggaugggucuuu

SEQ ID NO: 11743 - RNA, 26 nt, Artificial Sequence
  Synthetic Oligonucleotide; GZMB exon 3; Set A
uaggauuauaggcuggaugggggaug

SEQ ID NO: 11744 - RNA, 38 nt, Artificial Sequence
  Synthetic Oligonucleotide; GZMB exon 3; Set C
aguucuuaggauuauaggcuggaugggggaugggucuu

SEQ ID NO: 11745 - RNA, 36 nt, Artificial Sequence
  Synthetic Oligonucleotide; GZMB exon 3; Set C
guucuuaggauuauaggcuggaugggggaugggucu

SEQ ID NO: 11746 - RNA, 24 nt, Artificial Sequence
  Synthetic Oligonucleotide; GZMB exon 3; Set A
aggauuauaggcuggaugggggau

SEQ ID NO: 11747 - RNA, 22 nt, Artificial Sequence
  Synthetic Oligonucleotide; GZMB exon 3; Set A
ggauuauaggcuggauggggga

SEQ ID NO: 11748 - RNA, 20 nt, Artificial Sequence
  Synthetic Oligonucleotide; GZMB exon 3; Set A
gauuauaggcuggauggggg

SEQ ID NO: 11749 - RNA, 39 nt, Artificial Sequence
  Synthetic Oligonucleotide; GZMB exon 3; Set C
aaguucuuaggauuauaggcuggaugggggaugggucuu

SEQ ID NO: 11750 - RNA, 37 nt, Artificial Sequence
  Synthetic Oligonucleotide; GZMB exon 3; Set C
aguucuuaggauuauaggcuggaugggggaugggucu

SEQ ID NO: 11751 - RNA, 35 nt, Artificial Sequence
  Synthetic Oligonucleotide; GZMB exon 3; Set C
guucuuaggauuauaggcuggaugggggauggguc

SEQ ID NO: 11752 - RNA, 25 nt, Artificial Sequence
  Synthetic Oligonucleotide; GZMB exon 3; Set A
uaggauuauaggcuggaugggggau

SEQ ID NO: 11753 - RNA, 23 nt, Artificial Sequence
  Synthetic Oligonucleotide; GZMB exon 3; Set A
aggauuauaggcuggauggggga

SEQ ID NO: 11754 - RNA, 21 nt, Artificial Sequence
  Synthetic Oligonucleotide; GZMB exon 3; Set A
ggauuauaggcuggauggggg

SEQ ID NO: 11755 - RNA, 34 nt, Artificial Sequence
  Synthetic Oligonucleotide; GZMB exon 3; Set C
guucuuaggauuauaggcuggaugggggaugggu

SEQ ID NO: 11756 - RNA, 40 nt, Artificial Sequence
  Synthetic Oligonucleotide; GZMB exon 3; Set C
gaaguucuuaggauuauaggcuggaugggggaugggucuu

SEQ ID NO: 11757 - RNA, 38 nt, Artificial Sequence
  Synthetic Oligonucleotide; GZMB exon 3; Set C
aaguucuuaggauuauaggcuggaugggggaugggucu

SEQ ID NO: 11758 - RNA, 36 nt, Artificial Sequence
  Synthetic Oligonucleotide; GZMB exon 3; Set C
aguucuuaggauuauaggcuggaugggggauggguc

SEQ ID NO: 11759 - RNA, 24 nt, Artificial Sequence
  Synthetic Oligonucleotide; GZMB exon 3; Set A
uaggauuauaggcuggauggggga

SEQ ID NO: 11760 - RNA, 22 nt, Artificial Sequence
  Synthetic Oligonucleotide; GZMB exon 3; Set A
aggauuauaggcuggauggggg

SEQ ID NO: 11761 - RNA, 33 nt, Artificial Sequence
  Synthetic Oligonucleotide; GZMB exon 3; Set C
guucuuaggauuauaggcuggaugggggauggg

SEQ ID NO: 11762 - RNA, 35 nt, Artificial Sequence
  Synthetic Oligonucleotide; GZMB exon 3; Set C
aguucuuaggauuauaggcuggaugggggaugggu

SEQ ID NO: 11763 - RNA, 39 nt, Artificial Sequence
  Synthetic Oligonucleotide; GZMB exon 3; Set C
gaaguucuuaggauuauaggcuggaugggggaugggucu

SEQ ID NO: 11764 - RNA, 37 nt, Artificial Sequence
  Synthetic Oligonucleotide; GZMB exon 3; Set C
aaguucuuaggauuauaggcuggaugggggauggguc

SEQ ID NO: 11765 - RNA, 15 nt, Artificial Sequence
  Synthetic Oligonucleotide; GZMB exon 3; Set C
auuauaggcuggaug

SEQ ID NO: 11766 - RNA, 23 nt, Artificial Sequence
  Synthetic Oligonucleotide; GZMB exon 3; Set A
uaggauuauaggcuggauggggg

SEQ ID NO: 11767 - RNA, 32 nt, Artificial Sequence
  Synthetic Oligonucleotide; GZMB exon 3; Set C
guucuuaggauuauaggcuggaugggggaugg

SEQ ID NO: 11768 - RNA, 36 nt, Artificial Sequence
  Synthetic Oligonucleotide; GZMB exon 3; Set C
aaguucuuaggauuauaggcuggaugggggaugggu

SEQ ID NO: 11769 - RNA, 34 nt, Artificial Sequence
  Synthetic Oligonucleotide; GZMB exon 3; Set C
aguucuuaggauuauaggcuggaugggggauggg

SEQ ID NO: 11770 - RNA, 40 nt, Artificial Sequence
  Synthetic Oligonucleotide; GZMB exon 3; Set C
agaaguucuuaggauuauaggcuggaugggggaugggucu

SEQ ID NO: 11771 - RNA, 38 nt, Artificial Sequence
  Synthetic Oligonucleotide; GZMB exon 3; Set C
gaaguucuuaggauuauaggcuggaugggggauggguc

SEQ ID NO: 11772 - RNA, 16 nt, Artificial Sequence
  Synthetic Oligonucleotide; GZMB exon 3; Set C
gauuauaggcuggaug

SEQ ID NO: 11773 - RNA, 33 nt, Artificial Sequence
  Synthetic Oligonucleotide; GZMB exon 3; Set C
aguucuuaggauuauaggcuggaugggggaugg

SEQ ID NO: 11774 - RNA, 31 nt, Artificial Sequence
  Synthetic Oligonucleotide; GZMB exon 3; Set C
guucuuaggauuauaggcuggaugggggaug

SEQ ID NO: 11775 - RNA, 35 nt, Artificial Sequence
  Synthetic Oligonucleotide; GZMB exon 3; Set C
aaguucuuaggauuauaggcuggaugggggauggg

SEQ ID NO: 11776 - RNA, 37 nt, Artificial Sequence
  Synthetic Oligonucleotide; GZMB exon 3; Set C
gaaguucuuaggauuauaggcuggaugggggaugggu

SEQ ID NO: 11777 - RNA, 39 nt, Artificial Sequence
  Synthetic Oligonucleotide; GZMB exon 3; Set C
agaaguucuuaggauuauaggcuggaugggggauggguc

SEQ ID NO: 11778 - RNA, 15 nt, Artificial Sequence
  Synthetic Oligonucleotide; GZMB exon 3; Set C
gauuauaggcuggau

SEQ ID NO: 11779 - RNA, 17 nt, Artificial Sequence
  Synthetic Oligonucleotide; GZMB exon 3; Set C
ggauuauaggcuggaug

SEQ ID NO: 11780 - RNA, 34 nt, Artificial Sequence
  Synthetic Oligonucleotide; GZMB exon 3; Set C
aaguucuuaggauuauaggcuggaugggggaugg

SEQ ID NO: 11781 - RNA, 32 nt, Artificial Sequence
  Synthetic Oligonucleotide; GZMB exon 3; Set C
aguucuuaggauuauaggcuggaugggggaug

SEQ ID NO: 11782 - RNA, 36 nt, Artificial Sequence
  Synthetic Oligonucleotide; GZMB exon 3; Set C
gaaguucuuaggauuauaggcuggaugggggauggg

SEQ ID NO: 11783 - RNA, 38 nt, Artificial Sequence
  Synthetic Oligonucleotide; GZMB exon 3; Set C
agaaguucuuaggauuauaggcuggaugggggaugggu

SEQ ID NO: 11784 - RNA, 30 nt, Artificial Sequence
  Synthetic Oligonucleotide; GZMB exon 3; Set C
guucuuaggauuauaggcuggaugggggau

SEQ ID NO: 11785 - RNA, 16 nt, Artificial Sequence
  Synthetic Oligonucleotide; GZMB exon 3; Set C
ggauuauaggcuggau

SEQ ID NO: 11786 - RNA, 18 nt, Artificial Sequence
  Synthetic Oligonucleotide; GZMB exon 3; Set C
aggauuauaggcuggaug

SEQ ID NO: 11787 - RNA, 35 nt, Artificial Sequence
  Synthetic Oligonucleotide; GZMB exon 3; Set C
gaaguucuuaggauuauaggcuggaugggggaugg

SEQ ID NO: 11788 - RNA, 33 nt, Artificial Sequence
  Synthetic Oligonucleotide; GZMB exon 3; Set C
aaguucuuaggauuauaggcuggaugggggaug

SEQ ID NO: 11789 - RNA, 37 nt, Artificial Sequence
  Synthetic Oligonucleotide; GZMB exon 3; Set C
agaaguucuuaggauuauaggcuggaugggggauggg

SEQ ID NO: 11790 - RNA, 39 nt, Artificial Sequence
  Synthetic Oligonucleotide; GZMB exon 3; Set C
gagaaguucuuaggauuauaggcuggaugggggaugggu

SEQ ID NO: 11791 - RNA, 31 nt, Artificial Sequence
  Synthetic Oligonucleotide; GZMB exon 3; Set C
aguucuuaggauuauaggcuggaugggggau

SEQ ID NO: 11792 - RNA, 15 nt, Artificial Sequence
  Synthetic Oligonucleotide; GZMB exon 3; Set C
ggauuauaggcugga

SEQ ID NO: 11793 - RNA, 29 nt, Artificial Sequence
  Synthetic Oligonucleotide; GZMB exon 3; Set C
guucuuaggauuauaggcuggauggggga

SEQ ID NO: 11794 - RNA, 17 nt, Artificial Sequence
  Synthetic Oligonucleotide; GZMB exon 3; Set C
aggauuauaggcuggau

SEQ ID NO: 11795 - RNA, 19 nt, Artificial Sequence
  Synthetic Oligonucleotide; GZMB exon 3; Set C
uaggauuauaggcuggaug

SEQ ID NO: 11796 - RNA, 36 nt, Artificial Sequence
  Synthetic Oligonucleotide; GZMB exon 3; Set C
agaaguucuuaggauuauaggcuggaugggggaugg

SEQ ID NO: 11797 - RNA, 34 nt, Artificial Sequence
  Synthetic Oligonucleotide; GZMB exon 3; Set C
gaaguucuuaggauuauaggcuggaugggggaug

SEQ ID NO: 11798 - RNA, 40 nt, Artificial Sequence
  Synthetic Oligonucleotide; GZMB exon 3; Set C
ggagaaguucuuaggauuauaggcuggaugggggaugggu

SEQ ID NO: 11799 - RNA, 38 nt, Artificial Sequence
  Synthetic Oligonucleotide; GZMB exon 3; Set C
gagaaguucuuaggauuauaggcuggaugggggauggg

SEQ ID NO: 11800 - RNA, 32 nt, Artificial Sequence
  Synthetic Oligonucleotide; GZMB exon 3; Set C
aaguucuuaggauuauaggcuggaugggggau

SEQ ID NO: 11801 - RNA, 16 nt, Artificial Sequence
  Synthetic Oligonucleotide; GZMB exon 3; Set C
aggauuauaggcugga

SEQ ID NO: 11802 - RNA, 30 nt, Artificial Sequence
  Synthetic Oligonucleotide; GZMB exon 3; Set C
aguucuuaggauuauaggcuggauggggga

SEQ ID NO: 11803 - RNA, 18 nt, Artificial Sequence
  Synthetic Oligonucleotide; GZMB exon 3; Set C
uaggauuauaggcuggau

SEQ ID NO: 11804 - RNA, 37 nt, Artificial Sequence
  Synthetic Oligonucleotide; GZMB exon 3; Set C
gagaaguucuuaggauuauaggcuggaugggggaugg

SEQ ID NO: 11805 - RNA, 35 nt, Artificial Sequence
  Synthetic Oligonucleotide; GZMB exon 3; Set C
agaaguucuuaggauuauaggcuggaugggggaug

SEQ ID NO: 11806 - RNA, 39 nt, Artificial Sequence
  Synthetic Oligonucleotide; GZMB exon 3; Set C
ggagaaguucuuaggauuauaggcuggaugggggauggg

SEQ ID NO: 11807 - RNA, 33 nt, Artificial Sequence
  Synthetic Oligonucleotide; GZMB exon 3; Set C
gaaguucuuaggauuauaggcuggaugggggau

SEQ ID NO: 11808 - RNA, 17 nt, Artificial Sequence
  Synthetic Oligonucleotide; GZMB exon 3; Set C
uaggauuauaggcugga

SEQ ID NO: 11809 - RNA, 31 nt, Artificial Sequence
  Synthetic Oligonucleotide; GZMB exon 3; Set C
aaguucuuaggauuauaggcuggauggggga

SEQ ID NO: 11810 - RNA, 15 nt, Artificial Sequence
  Synthetic Oligonucleotide; GZMB exon 3; Set C
aggauuauaggcugg

SEQ ID NO: 11811 - RNA, 38 nt, Artificial Sequence
  Synthetic Oligonucleotide; GZMB exon 3; Set C
ggagaaguucuuaggauuauaggcuggaugggggaugg

SEQ ID NO: 11812 - RNA, 36 nt, Artificial Sequence
  Synthetic Oligonucleotide; GZMB exon 3; Set C
gagaaguucuuaggauuauaggcuggaugggggaug

SEQ ID NO: 11813 - RNA, 40 nt, Artificial Sequence
  Synthetic Oligonucleotide; GZMB exon 3; Set C
uggagaaguucuuaggauuauaggcuggaugggggauggg

SEQ ID NO: 11814 - RNA, 32 nt, Artificial Sequence
  Synthetic Oligonucleotide; GZMB exon 3; Set C
gaaguucuuaggauuauaggcuggauggggga

SEQ ID NO: 11815 - RNA, 16 nt, Artificial Sequence
  Synthetic Oligonucleotide; GZMB exon 3; Set C
uaggauuauaggcugg

SEQ ID NO: 11816 - RNA, 30 nt, Artificial Sequence
  Synthetic Oligonucleotide; GZMB exon 3; Set A
aaguucuuaggauuauaggcuggauggggg

SEQ ID NO: 11817 - RNA, 39 nt, Artificial Sequence
  Synthetic Oligonucleotide; GZMB exon 3; Set C
uggagaaguucuuaggauuauaggcuggaugggggaugg

SEQ ID NO: 11818 - RNA, 37 nt, Artificial Sequence
  Synthetic Oligonucleotide; GZMB exon 3; Set C
ggagaaguucuuaggauuauaggcuggaugggggaug

SEQ ID NO: 11819 - RNA, 15 nt, Artificial Sequence
  Synthetic Oligonucleotide; GZMB exon 3; Set C
uaggauuauaggcug

SEQ ID NO: 11820 - RNA, 40 nt, Artificial Sequence
  Synthetic Oligonucleotide; GZMB exon 3; Set C
uuggagaaguucuuaggauuauaggcuggaugggggaugg

SEQ ID NO: 11821 - RNA, 38 nt, Artificial Sequence
  Synthetic Oligonucleotide; GZMB exon 3; Set C
uggagaaguucuuaggauuauaggcuggaugggggaug

SEQ ID NO: 11822 - RNA, 24 nt, Artificial Sequence
  Synthetic Oligonucleotide; GZMB exon 3; Set C
guucuuaggauuauaggcuggaug

SEQ ID NO: 11823 - RNA, 39 nt, Artificial Sequence
  Synthetic Oligonucleotide; GZMB exon 3; Set C
uuggagaaguucuuaggauuauaggcuggaugggggaug

SEQ ID NO: 11824 - RNA, 37 nt, Artificial Sequence
  Synthetic Oligonucleotide; GZMB exon 3; Set C
uggagaaguucuuaggauuauaggcuggaugggggau

SEQ ID NO: 11825 - RNA, 23 nt, Artificial Sequence
  Synthetic Oligonucleotide; GZMB exon 3; Set C
guucuuaggauuauaggcuggau

SEQ ID NO: 11826 - RNA, 40 nt, Artificial Sequence
  Synthetic Oligonucleotide; GZMB exon 3; Set C
guuggagaaguucuuaggauuauaggcuggaugggggaug

SEQ ID NO: 11827 - RNA, 38 nt, Artificial Sequence
  Synthetic Oligonucleotide; GZMB exon 3; Set C
uuggagaaguucuuaggauuauaggcuggaugggggau

SEQ ID NO: 11828 - RNA, 22 nt, Artificial Sequence
  Synthetic Oligonucleotide; GZMB exon 3; Set C
guucuuaggauuauaggcugga

SEQ ID NO: 11829 - RNA, 36 nt, Artificial Sequence
  Synthetic Oligonucleotide; GZMB exon 3; Set C
uggagaaguucuuaggauuauaggcuggauggggga

SEQ ID NO: 11830 - RNA, 26 nt, Artificial Sequence
  Synthetic Oligonucleotide; GZMB exon 3; Set C
aaguucuuaggauuauaggcuggaug

SEQ ID NO: 11831 - RNA, 39 nt, Artificial Sequence
  Synthetic Oligonucleotide; GZMB exon 3; Set C
guuggagaaguucuuaggauuauaggcuggaugggggau

SEQ ID NO: 11832 - RNA, 23 nt, Artificial Sequence
  Synthetic Oligonucleotide; GZMB exon 3; Set C
aguucuuaggauuauaggcugga

SEQ ID NO: 11833 - RNA, 37 nt, Artificial Sequence
  Synthetic Oligonucleotide; GZMB exon 3; Set C
uuggagaaguucuuaggauuauaggcuggauggggga

SEQ ID NO: 11834 - RNA, 21 nt, Artificial Sequence
  Synthetic Oligonucleotide; GZMB exon 3; Set C
guucuuaggauuauaggcugg

SEQ ID NO: 11835 - RNA, 25 nt, Artificial Sequence
  Synthetic Oligonucleotide; GZMB exon 3; Set C
aaguucuuaggauuauaggcuggau

SEQ ID NO: 11836 - RNA, 40 nt, Artificial Sequence
  Synthetic Oligonucleotide; GZMB exon 3; Set C
cguuggagaaguucuuaggauuauaggcuggaugggggau

SEQ ID NO: 11837 - RNA, 24 nt, Artificial Sequence
  Synthetic Oligonucleotide; GZMB exon 3; Set C
aaguucuuaggauuauaggcugga

SEQ ID NO: 11838 - RNA, 38 nt, Artificial Sequence
  Synthetic Oligonucleotide; GZMB exon 3; Set C
guuggagaaguucuuaggauuauaggcuggauggggga

SEQ ID NO: 11839 - RNA, 22 nt, Artificial Sequence
  Synthetic Oligonucleotide; GZMB exon 3; Set C
aguucuuaggauuauaggcugg

SEQ ID NO: 11840 - RNA, 25 nt, Artificial Sequence
  Synthetic Oligonucleotide; GZMB exon 3; Set A
gaaguucuuaggauuauaggcugga

SEQ ID NO: 11841 - RNA, 39 nt, Artificial Sequence
  Synthetic Oligonucleotide; GZMB exon 3; Set C
cguuggagaaguucuuaggauuauaggcuggauggggga

SEQ ID NO: 11842 - RNA, 23 nt, Artificial Sequence
  Synthetic Oligonucleotide; GZMB exon 3; Set C
aaguucuuaggauuauaggcugg

SEQ ID NO: 11843 - RNA, 37 nt, Artificial Sequence
  Synthetic Oligonucleotide; GZMB exon 3; Set C
guuggagaaguucuuaggauuauaggcuggauggggg

SEQ ID NO: 11844 - RNA, 18 nt, Artificial Sequence
  Synthetic Oligonucleotide; GZMB exon 3; Set C
guucuuaggauuauaggc

SEQ ID NO: 11845 - RNA, 40 nt, Artificial Sequence
  Synthetic Oligonucleotide; GZMB exon 3; Set C
ucguuggagaaguucuuaggauuauaggcuggauggggga

SEQ ID NO: 11846 - RNA, 24 nt, Artificial Sequence
  Synthetic Oligonucleotide; GZMB exon 3; Set C
gaaguucuuaggauuauaggcugg

SEQ ID NO: 11847 - RNA, 17 nt, Artificial Sequence
  Synthetic Oligonucleotide; GZMB exon 3; Set C
guucuuaggauuauagg

SEQ ID NO: 11848 - RNA, 19 nt, Artificial Sequence
  Synthetic Oligonucleotide; GZMB exon 3; Set C
aguucuuaggauuauaggc

SEQ ID NO: 11849 - RNA, 31 nt, Artificial Sequence
  Synthetic Oligonucleotide; GZMB exon 3; Set A
uggagaaguucuuaggauuauaggcuggaug

SEQ ID NO: 11850 - RNA, 21 nt, Artificial Sequence
  Synthetic Oligonucleotide; GZMB exon 3; Set C
aaguucuuaggauuauaggcu

SEQ ID NO: 11851 - RNA, 16 nt, Artificial Sequence
  Synthetic Oligonucleotide; GZMB exon 3; Set C
guucuuaggauuauag

SEQ ID NO: 11852 - RNA, 18 nt, Artificial Sequence
  Synthetic Oligonucleotide; GZMB exon 3; Set C
aguucuuaggauuauagg

SEQ ID NO: 11853 - RNA, 20 nt, Artificial Sequence
  Synthetic Oligonucleotide; GZMB exon 3; Set C
aaguucuuaggauuauaggc

SEQ ID NO: 11854 - RNA, 32 nt, Artificial Sequence
  Synthetic Oligonucleotide; GZMB exon 3; Set A
uuggagaaguucuuaggauuauaggcuggaug

SEQ ID NO: 11855 - RNA, 30 nt, Artificial Sequence
  Synthetic Oligonucleotide; GZMB exon 3; Set A
uggagaaguucuuaggauuauaggcuggau

SEQ ID NO: 11856 - RNA, 15 nt, Artificial Sequence
  Synthetic Oligonucleotide; GZMB exon 3; Set C
guucuuaggauuaua

SEQ ID NO: 11857 - RNA, 17 nt, Artificial Sequence
  Synthetic Oligonucleotide; GZMB exon 3; Set C
aguucuuaggauuauag

SEQ ID NO: 11858 - RNA, 19 nt, Artificial Sequence
  Synthetic Oligonucleotide; GZMB exon 3; Set C
aaguucuuaggauuauagg

SEQ ID NO: 11859 - RNA, 21 nt, Artificial Sequence
  Synthetic Oligonucleotide; GZMB exon 3; Set C
gaaguucuuaggauuauaggc

SEQ ID NO: 11860 - RNA, 29 nt, Artificial Sequence
  Synthetic Oligonucleotide; GZMB exon 3; Set A
uggagaaguucuuaggauuauaggcugga

SEQ ID NO: 11861 - RNA, 33 nt, Artificial Sequence
  Synthetic Oligonucleotide; GZMB exon 3; Set A
guuggagaaguucuuaggauuauaggcuggaug

SEQ ID NO: 11862 - RNA, 31 nt, Artificial Sequence
  Synthetic Oligonucleotide; GZMB exon 3; Set A
uuggagaaguucuuaggauuauaggcuggau

SEQ ID NO: 11863 - RNA, 16 nt, Artificial Sequence
  Synthetic Oligonucleotide; GZMB exon 3; Set C
aguucuuaggauuaua

SEQ ID NO: 11864 - RNA, 18 nt, Artificial Sequence
  Synthetic Oligonucleotide; GZMB exon 3; Set C
aaguucuuaggauuauag

SEQ ID NO: 11865 - RNA, 20 nt, Artificial Sequence
  Synthetic Oligonucleotide; GZMB exon 3; Set C
gaaguucuuaggauuauagg

SEQ ID NO: 11866 - RNA, 30 nt, Artificial Sequence
  Synthetic Oligonucleotide; GZMB exon 3; Set A
uuggagaaguucuuaggauuauaggcugga

SEQ ID NO: 11867 - RNA, 28 nt, Artificial Sequence
  Synthetic Oligonucleotide; GZMB exon 3; Set A
uggagaaguucuuaggauuauaggcugg

SEQ ID NO: 11868 - RNA, 32 nt, Artificial Sequence
  Synthetic Oligonucleotide; GZMB exon 3; Set A
guuggagaaguucuuaggauuauaggcuggau

SEQ ID NO: 11869 - RNA, 34 nt, Artificial Sequence
  Synthetic Oligonucleotide; GZMB exon 3; Set A
cguuggagaaguucuuaggauuauaggcuggaug

SEQ ID NO: 11870 - RNA, 15 nt, Artificial Sequence
  Synthetic Oligonucleotide; GZMB exon 3; Set C
aguucuuaggauuau

SEQ ID NO: 11871 - RNA, 17 nt, Artificial Sequence
  Synthetic Oligonucleotide; GZMB exon 3; Set C
aaguucuuaggauuaua

SEQ ID NO: 11872 - RNA, 19 nt, Artificial Sequence
  Synthetic Oligonucleotide; GZMB exon 3; Set C
gaaguucuuaggauuauag

SEQ ID NO: 11873 - RNA, 31 nt, Artificial Sequence
  Synthetic Oligonucleotide; GZMB exon 3; Set A
guuggagaaguucuuaggauuauaggcugga

SEQ ID NO: 11874 - RNA, 29 nt, Artificial Sequence
  Synthetic Oligonucleotide; GZMB exon 3; Set A
uuggagaaguucuuaggauuauaggcugg

SEQ ID NO: 11875 - RNA, 33 nt, Artificial Sequence
  Synthetic Oligonucleotide; GZMB exon 3; Set A
cguuggagaaguucuuaggauuauaggcuggau

SEQ ID NO: 11876 - RNA, 35 nt, Artificial Sequence
  Synthetic Oligonucleotide; GZMB exon 3; Set A
ucguuggagaaguucuuaggauuauaggcuggaug

SEQ ID NO: 11877 - RNA, 16 nt, Artificial Sequence
  Synthetic Oligonucleotide; GZMB exon 3; Set C
aaguucuuaggauuau

SEQ ID NO: 11878 - RNA, 18 nt, Artificial Sequence
  Synthetic Oligonucleotide; GZMB exon 3; Set C
gaaguucuuaggauuaua

SEQ ID NO: 11879 - RNA, 20 nt, Artificial Sequence
  Synthetic Oligonucleotide; GZMB exon 3; Set C
agaaguucuuaggauuauag

SEQ ID NO: 11880 - RNA, 32 nt, Artificial Sequence
  Synthetic Oligonucleotide; GZMB exon 3; Set A
cguuggagaaguucuuaggauuauaggcugga

SEQ ID NO: 11881 - RNA, 30 nt, Artificial Sequence
  Synthetic Oligonucleotide; GZMB exon 3; Set A
guuggagaaguucuuaggauuauaggcugg

SEQ ID NO: 11882 - RNA, 34 nt, Artificial Sequence
  Synthetic Oligonucleotide; GZMB exon 3; Set A
ucguuggagaaguucuuaggauuauaggcuggau

SEQ ID NO: 11883 - RNA, 15 nt, Artificial Sequence
  Synthetic Oligonucleotide; GZMB exon 3; Set C
aaguucuuaggauua

SEQ ID NO: 11884 - RNA, 17 nt, Artificial Sequence
  Synthetic Oligonucleotide; GZMB exon 3; Set C
gaaguucuuaggauuau

SEQ ID NO: 11885 - RNA, 19 nt, Artificial Sequence
  Synthetic Oligonucleotide; GZMB exon 3; Set C
agaaguucuuaggauuaua

SEQ ID NO: 11886 - RNA, 25 nt, Artificial Sequence
  Synthetic Oligonucleotide; GZMB exon 3; Set C
uggagaaguucuuaggauuauaggc

SEQ ID NO: 11887 - RNA, 33 nt, Artificial Sequence
  Synthetic Oligonucleotide; GZMB exon 3; Set C
ucguuggagaaguucuuaggauuauaggcugga

SEQ ID NO: 11888 - RNA, 31 nt, Artificial Sequence
  Synthetic Oligonucleotide; GZMB exon 3; Set A
cguuggagaaguucuuaggauuauaggcugg

SEQ ID NO: 11889 - RNA, 29 nt, Artificial Sequence
  Synthetic Oligonucleotide; GZMB exon 3; Set A
guuggagaaguucuuaggauuauaggcug

SEQ ID NO: 11890 - RNA, 16 nt, Artificial Sequence
  Synthetic Oligonucleotide; GZMB exon 3; Set C
gaaguucuuaggauua

SEQ ID NO: 11891 - RNA, 18 nt, Artificial Sequence
  Synthetic Oligonucleotide; GZMB exon 3; Set C
agaaguucuuaggauuau

SEQ ID NO: 11892 - RNA, 20 nt, Artificial Sequence
  Synthetic Oligonucleotide; GZMB exon 3; Set C
gagaaguucuuaggauuaua

SEQ ID NO: 11893 - RNA, 24 nt, Artificial Sequence
  Synthetic Oligonucleotide; GZMB exon 3; Set C
uggagaaguucuuaggauuauagg

SEQ ID NO: 11894 - RNA, 26 nt, Artificial Sequence
  Synthetic Oligonucleotide; GZMB exon 3; Set C
uuggagaaguucuuaggauuauaggc

SEQ ID NO: 11895 - RNA, 32 nt, Artificial Sequence
  Synthetic Oligonucleotide; GZMB exon 3; Set A
ucguuggagaaguucuuaggauuauaggcugg

SEQ ID NO: 11896 - RNA, 28 nt, Artificial Sequence
  Synthetic Oligonucleotide; GZMB exon 3; Set A
guuggagaaguucuuaggauuauaggcu

SEQ ID NO: 11897 - RNA, 15 nt, Artificial Sequence
  Synthetic Oligonucleotide; GZMB exon 3; Set C
gaaguucuuaggauu

SEQ ID NO: 11898 - RNA, 17 nt, Artificial Sequence
  Synthetic Oligonucleotide; GZMB exon 3; Set C
agaaguucuuaggauua

SEQ ID NO: 11899 - RNA, 19 nt, Artificial Sequence
  Synthetic Oligonucleotide; GZMB exon 3; Set C
gagaaguucuuaggauuau

SEQ ID NO: 11900 - RNA, 21 nt, Artificial Sequence
  Synthetic Oligonucleotide; GZMB exon 3; Set C
ggagaaguucuuaggauuaua

SEQ ID NO: 11901 - RNA, 23 nt, Artificial Sequence
  Synthetic Oligonucleotide; GZMB exon 3; Set C
uggagaaguucuuaggauuauag

SEQ ID NO: 11902 - RNA, 25 nt, Artificial Sequence
  Synthetic Oligonucleotide; GZMB exon 3; Set C
uuggagaaguucuuaggauuauagg

SEQ ID NO: 11903 - RNA, 27 nt, Artificial Sequence
  Synthetic Oligonucleotide; GZMB exon 3; Set A
guuggagaaguucuuaggauuauaggc

SEQ ID NO: 11904 - RNA, 16 nt, Artificial Sequence
  Synthetic Oligonucleotide; GZMB exon 3; Set C
agaaguucuuaggauu

SEQ ID NO: 11905 - RNA, 20 nt, Artificial Sequence
  Synthetic Oligonucleotide; GZMB exon 3; Set C
ggagaaguucuuaggauuau

SEQ ID NO: 11906 - RNA, 18 nt, Artificial Sequence
  Synthetic Oligonucleotide; GZMB exon 3; Set C
gagaaguucuuaggauua

SEQ ID NO: 11907 - RNA, 22 nt, Artificial Sequence
  Synthetic Oligonucleotide; GZMB exon 3; Set C
uggagaaguucuuaggauuaua

SEQ ID NO: 11908 - RNA, 24 nt, Artificial Sequence
  Synthetic Oligonucleotide; GZMB exon 3; Set C
uuggagaaguucuuaggauuauag

SEQ ID NO: 11909 - RNA, 26 nt, Artificial Sequence
  Synthetic Oligonucleotide; GZMB exon 3; Set C
guuggagaaguucuuaggauuauagg

SEQ ID NO: 11910 - RNA, 28 nt, Artificial Sequence
  Synthetic Oligonucleotide; GZMB exon 3; Set A
cguuggagaaguucuuaggauuauaggc

SEQ ID NO: 11911 - RNA, 15 nt, Artificial Sequence
  Synthetic Oligonucleotide; GZMB exon 3; Set C
agaaguucuuaggau

SEQ ID NO: 11912 - RNA, 21 nt, Artificial Sequence
  Synthetic Oligonucleotide; GZMB exon 3; Set C
uggagaaguucuuaggauuau

SEQ ID NO: 11913 - RNA, 19 nt, Artificial Sequence
  Synthetic Oligonucleotide; GZMB exon 3; Set C
ggagaaguucuuaggauua

SEQ ID NO: 11914 - RNA, 17 nt, Artificial Sequence
  Synthetic Oligonucleotide; GZMB exon 3; Set C
gagaaguucuuaggauu

SEQ ID NO: 11915 - RNA, 23 nt, Artificial Sequence
  Synthetic Oligonucleotide; GZMB exon 3; Set C
uuggagaaguucuuaggauuaua

SEQ ID NO: 11916 - RNA, 25 nt, Artificial Sequence
  Synthetic Oligonucleotide; GZMB exon 3; Set C
guuggagaaguucuuaggauuauag

SEQ ID NO: 11917 - RNA, 27 nt, Artificial Sequence
  Synthetic Oligonucleotide; GZMB exon 3; Set C
cguuggagaaguucuuaggauuauagg

SEQ ID NO: 11918 - RNA, 29 nt, Artificial Sequence
  Synthetic Oligonucleotide; GZMB exon 3; Set A
ucguuggagaaguucuuaggauuauaggc

SEQ ID NO: 11919 - RNA, 16 nt, Artificial Sequence
  Synthetic Oligonucleotide; GZMB exon 3; Set C
gagaaguucuuaggau

SEQ ID NO: 11920 - RNA, 22 nt, Artificial Sequence
  Synthetic Oligonucleotide; GZMB exon 3; Set C
uuggagaaguucuuaggauuau

SEQ ID NO: 11921 - RNA, 20 nt, Artificial Sequence
  Synthetic Oligonucleotide; GZMB exon 3; Set C
uggagaaguucuuaggauua

SEQ ID NO: 11922 - RNA, 18 nt, Artificial Sequence
  Synthetic Oligonucleotide; GZMB exon 3; Set C
ggagaaguucuuaggauu

SEQ ID NO: 11923 - RNA, 24 nt, Artificial Sequence
  Synthetic Oligonucleotide; GZMB exon 3; Set C
guuggagaaguucuuaggauuaua

SEQ ID NO: 11924 - RNA, 26 nt, Artificial Sequence
  Synthetic Oligonucleotide; GZMB exon 3; Set C
cguuggagaaguucuuaggauuauag

SEQ ID NO: 11925 - RNA, 28 nt, Artificial Sequence
  Synthetic Oligonucleotide; GZMB exon 3; Set A
ucguuggagaaguucuuaggauuauagg

SEQ ID NO: 11926 - RNA, 38 nt, Artificial Sequence
  Synthetic Oligonucleotide; GZMB exon 3; Set C
ugaugucguuggagaaguucuuaggauuauaggcugga

SEQ ID NO: 11927 - RNA, 17 nt, Artificial Sequence
  Synthetic Oligonucleotide; GZMB exon 3; Set C
ggagaaguucuuaggau

SEQ ID NO: 11928 - RNA, 23 nt, Artificial Sequence
  Synthetic Oligonucleotide; GZMB exon 3; Set C
guuggagaaguucuuaggauuau

SEQ ID NO: 11929 - RNA, 21 nt, Artificial Sequence
  Synthetic Oligonucleotide; GZMB exon 3; Set C
uuggagaaguucuuaggauua

SEQ ID NO: 11930 - RNA, 19 nt, Artificial Sequence
  Synthetic Oligonucleotide; GZMB exon 3; Set C
uggagaaguucuuaggauu

SEQ ID NO: 11931 - RNA, 25 nt, Artificial Sequence
  Synthetic Oligonucleotide; GZMB exon 3; Set C
cguuggagaaguucuuaggauuaua

SEQ ID NO: 11932 - RNA, 27 nt, Artificial Sequence
  Synthetic Oligonucleotide; GZMB exon 3; Set C
ucguuggagaaguucuuaggauuauag

SEQ ID NO: 11933 - RNA, 18 nt, Artificial Sequence
  Synthetic Oligonucleotide; GZMB exon 3; Set C
uggagaaguucuuaggau

SEQ ID NO: 11934 - RNA, 22 nt, Artificial Sequence
  Synthetic Oligonucleotide; GZMB exon 3; Set C
guuggagaaguucuuaggauua

SEQ ID NO: 11935 - RNA, 20 nt, Artificial Sequence
  Synthetic Oligonucleotide; GZMB exon 3; Set C
uuggagaaguucuuaggauu

SEQ ID NO: 11936 - RNA, 24 nt, Artificial Sequence
  Synthetic Oligonucleotide; GZMB exon 3; Set C
cguuggagaaguucuuaggauuau

SEQ ID NO: 11937 - RNA, 26 nt, Artificial Sequence
  Synthetic Oligonucleotide; GZMB exon 3; Set C
ucguuggagaaguucuuaggauuaua

SEQ ID NO: 11938 - RNA, 19 nt, Artificial Sequence
  Synthetic Oligonucleotide; GZMB exon 3; Set C
uuggagaaguucuuaggau

SEQ ID NO: 11939 - RNA, 21 nt, Artificial Sequence
  Synthetic Oligonucleotide; GZMB exon 3; Set C
guuggagaaguucuuaggauu

SEQ ID NO: 11940 - RNA, 25 nt, Artificial Sequence
  Synthetic Oligonucleotide; GZMB exon 3; Set C
ucguuggagaaguucuuaggauuau

SEQ ID NO: 11941 - RNA, 23 nt, Artificial Sequence
  Synthetic Oligonucleotide; GZMB exon 3; Set C
cguuggagaaguucuuaggauua

SEQ ID NO: 11942 - RNA, 17 nt, Artificial Sequence
  Synthetic Oligonucleotide; GZMB exon 3; Set C
uggagaaguucuuagga

SEQ ID NO: 11943 - RNA, 33 nt, Artificial Sequence
  Synthetic Oligonucleotide; GZMB exon 3; Set A
gaugucguuggagaaguucuuaggauuauaggc

SEQ ID NO: 11944 - RNA, 20 nt, Artificial Sequence
  Synthetic Oligonucleotide; GZMB exon 3; Set C
guuggagaaguucuuaggau

SEQ ID NO: 11945 - RNA, 24 nt, Artificial Sequence
  Synthetic Oligonucleotide; GZMB exon 3; Set C
ucguuggagaaguucuuaggauua

SEQ ID NO: 11946 - RNA, 22 nt, Artificial Sequence
  Synthetic Oligonucleotide; GZMB exon 3; Set C
cguuggagaaguucuuaggauu

SEQ ID NO: 11947 - RNA, 18 nt, Artificial Sequence
  Synthetic Oligonucleotide; GZMB exon 3; Set C
uuggagaaguucuuagga

SEQ ID NO: 11948 - RNA, 16 nt, Artificial Sequence
  Synthetic Oligonucleotide; GZMB exon 3; Set C
uggagaaguucuuagg

SEQ ID NO: 11949 - RNA, 32 nt, Artificial Sequence
  Synthetic Oligonucleotide; GZMB exon 3; Set A
gaugucguuggagaaguucuuaggauuauagg

SEQ ID NO: 11950 - RNA, 34 nt, Artificial Sequence
  Synthetic Oligonucleotide; GZMB exon 3; Set A
ugaugucguuggagaaguucuuaggauuauaggc

SEQ ID NO: 11951 - RNA, 21 nt, Artificial Sequence
  Synthetic Oligonucleotide; GZMB exon 3; Set C
cguuggagaaguucuuaggau

SEQ ID NO: 11952 - RNA, 23 nt, Artificial Sequence
  Synthetic Oligonucleotide; GZMB exon 3; Set C
ucguuggagaaguucuuaggauu

SEQ ID NO: 11953 - RNA, 19 nt, Artificial Sequence
  Synthetic Oligonucleotide; GZMB exon 3; Set C
guuggagaaguucuuagga

SEQ ID NO: 11954 - RNA, 17 nt, Artificial Sequence
  Synthetic Oligonucleotide; GZMB exon 3; Set C
uuggagaaguucuuagg

SEQ ID NO: 11955 - RNA, 15 nt, Artificial Sequence
  Synthetic Oligonucleotide; GZMB exon 3; Set C
uggagaaguucuuag

SEQ ID NO: 11956 - RNA, 31 nt, Artificial Sequence
  Synthetic Oligonucleotide; GZMB exon 3; Set A
gaugucguuggagaaguucuuaggauuauag

SEQ ID NO: 11957 - RNA, 33 nt, Artificial Sequence
  Synthetic Oligonucleotide; GZMB exon 3; Set A
ugaugucguuggagaaguucuuaggauuauagg

SEQ ID NO: 11958 - RNA, 22 nt, Artificial Sequence
  Synthetic Oligonucleotide; GZMB exon 3; Set C
ucguuggagaaguucuuaggau

SEQ ID NO: 11959 - RNA, 30 nt, Artificial Sequence
  Synthetic Oligonucleotide; GZMB exon 3; Set A
gaugucguuggagaaguucuuaggauuaua

SEQ ID NO: 11960 - RNA, 18 nt, Artificial Sequence
  Synthetic Oligonucleotide; GZMB exon 3; Set C
guuggagaaguucuuagg

SEQ ID NO: 11961 - RNA, 16 nt, Artificial Sequence
  Synthetic Oligonucleotide; GZMB exon 3; Set C
uuggagaaguucuuag

SEQ ID NO: 11962 - RNA, 20 nt, Artificial Sequence
  Synthetic Oligonucleotide; GZMB exon 3; Set C
cguuggagaaguucuuagga

SEQ ID NO: 11963 - RNA, 32 nt, Artificial Sequence
  Synthetic Oligonucleotide; GZMB exon 3; Set A
ugaugucguuggagaaguucuuaggauuauag

SEQ ID NO: 11964 - RNA, 34 nt, Artificial Sequence
  Synthetic Oligonucleotide; GZMB exon 3; Set A
augaugucguuggagaaguucuuaggauuauagg

SEQ ID NO: 11965 - RNA, 29 nt, Artificial Sequence
  Synthetic Oligonucleotide; GZMB exon 3; Set A
gaugucguuggagaaguucuuaggauuau

SEQ ID NO: 11966 - RNA, 31 nt, Artificial Sequence
  Synthetic Oligonucleotide; GZMB exon 3; Set A
ugaugucguuggagaaguucuuaggauuaua

SEQ ID NO: 11967 - RNA, 17 nt, Artificial Sequence
  Synthetic Oligonucleotide; GZMB exon 3; Set C
guuggagaaguucuuag

SEQ ID NO: 11968 - RNA, 21 nt, Artificial Sequence
  Synthetic Oligonucleotide; GZMB exon 3; Set C
ucguuggagaaguucuuagga

SEQ ID NO: 11969 - RNA, 19 nt, Artificial Sequence
  Synthetic Oligonucleotide; GZMB exon 3; Set C
cguuggagaaguucuuagg

SEQ ID NO: 11970 - RNA, 33 nt, Artificial Sequence
  Synthetic Oligonucleotide; GZMB exon 3; Set A
augaugucguuggagaaguucuuaggauuauag

SEQ ID NO: 11971 - RNA, 30 nt, Artificial Sequence
  Synthetic Oligonucleotide; GZMB exon 3; Set A
ugaugucguuggagaaguucuuaggauuau

SEQ ID NO: 11972 - RNA, 28 nt, Artificial Sequence
  Synthetic Oligonucleotide; GZMB exon 3; Set A
gaugucguuggagaaguucuuaggauua

SEQ ID NO: 11973 - RNA, 32 nt, Artificial Sequence
  Synthetic Oligonucleotide; GZMB exon 3; Set A
augaugucguuggagaaguucuuaggauuaua

SEQ ID NO: 11974 - RNA, 20 nt, Artificial Sequence
  Synthetic Oligonucleotide; GZMB exon 3; Set C
ucguuggagaaguucuuagg

SEQ ID NO: 11975 - RNA, 18 nt, Artificial Sequence
  Synthetic Oligonucleotide; GZMB exon 3; Set C
cguuggagaaguucuuag

SEQ ID NO: 11976 - RNA, 29 nt, Artificial Sequence
  Synthetic Oligonucleotide; GZMB exon 3; Set A
ugaugucguuggagaaguucuuaggauua

SEQ ID NO: 11977 - RNA, 27 nt, Artificial Sequence
  Synthetic Oligonucleotide; GZMB exon 3; Set A
gaugucguuggagaaguucuuaggauu

SEQ ID NO: 11978 - RNA, 31 nt, Artificial Sequence
  Synthetic Oligonucleotide; GZMB exon 3; Set A
augaugucguuggagaaguucuuaggauuau

SEQ ID NO: 11979 - RNA, 19 nt, Artificial Sequence
  Synthetic Oligonucleotide; GZMB exon 3; Set C
ucguuggagaaguucuuag

SEQ ID NO: 11980 - RNA, 39 nt, Artificial Sequence
  Synthetic Oligonucleotide; GZMB exon 3; Set C
uagcaugaugucguuggagaaguucuuaggauuauaggc

SEQ ID NO: 11981 - RNA, 26 nt, Artificial Sequence
  Synthetic Oligonucleotide; GZMB exon 3; Set A
gaugucguuggagaaguucuuaggau

SEQ ID NO: 11982 - RNA, 28 nt, Artificial Sequence
  Synthetic Oligonucleotide; GZMB exon 3; Set A
ugaugucguuggagaaguucuuaggauu

SEQ ID NO: 11983 - RNA, 30 nt, Artificial Sequence
  Synthetic Oligonucleotide; GZMB exon 3; Set A
augaugucguuggagaaguucuuaggauua

SEQ ID NO: 11984 - RNA, 38 nt, Artificial Sequence
  Synthetic Oligonucleotide; GZMB exon 3; Set A
uagcaugaugucguuggagaaguucuuaggauuauagg

SEQ ID NO: 11985 - RNA, 40 nt, Artificial Sequence
  Synthetic Oligonucleotide; GZMB exon 3; Set C
guagcaugaugucguuggagaaguucuuaggauuauaggc

SEQ ID NO: 11986 - RNA, 27 nt, Artificial Sequence
  Synthetic Oligonucleotide; GZMB exon 3; Set A
ugaugucguuggagaaguucuuaggau

SEQ ID NO: 11987 - RNA, 29 nt, Artificial Sequence
  Synthetic Oligonucleotide; GZMB exon 3; Set A
augaugucguuggagaaguucuuaggauu

SEQ ID NO: 11988 - RNA, 25 nt, Artificial Sequence
  Synthetic Oligonucleotide; GZMB exon 3; Set A
gaugucguuggagaaguucuuagga

SEQ ID NO: 11989 - RNA, 37 nt, Artificial Sequence
  Synthetic Oligonucleotide; GZMB exon 3; Set A
uagcaugaugucguuggagaaguucuuaggauuauag

SEQ ID NO: 11990 - RNA, 39 nt, Artificial Sequence
  Synthetic Oligonucleotide; GZMB exon 3; Set C
guagcaugaugucguuggagaaguucuuaggauuauagg

SEQ ID NO: 11991 - RNA, 28 nt, Artificial Sequence
  Synthetic Oligonucleotide; GZMB exon 3; Set A
augaugucguuggagaaguucuuaggau

SEQ ID NO: 11992 - RNA, 36 nt, Artificial Sequence
  Synthetic Oligonucleotide; GZMB exon 3; Set A
uagcaugaugucguuggagaaguucuuaggauuaua

SEQ ID NO: 11993 - RNA, 26 nt, Artificial Sequence
  Synthetic Oligonucleotide; GZMB exon 3; Set A
ugaugucguuggagaaguucuuagga

SEQ ID NO: 11994 - RNA, 24 nt, Artificial Sequence
  Synthetic Oligonucleotide; GZMB exon 3; Set C
gaugucguuggagaaguucuuagg

SEQ ID NO: 11995 - RNA, 38 nt, Artificial Sequence
  Synthetic Oligonucleotide; GZMB exon 3; Set A
guagcaugaugucguuggagaaguucuuaggauuauag

SEQ ID NO: 11996 - RNA, 40 nt, Artificial Sequence
  Synthetic Oligonucleotide; GZMB exon 3; Set C
aguagcaugaugucguuggagaaguucuuaggauuauagg

SEQ ID NO: 11997 - RNA, 35 nt, Artificial Sequence
  Synthetic Oligonucleotide; GZMB exon 3; Set A
uagcaugaugucguuggagaaguucuuaggauuau

SEQ ID NO: 11998 - RNA, 37 nt, Artificial Sequence
  Synthetic Oligonucleotide; GZMB exon 3; Set A
guagcaugaugucguuggagaaguucuuaggauuaua

SEQ ID NO: 11999 - RNA, 25 nt, Artificial Sequence
  Synthetic Oligonucleotide; GZMB exon 3; Set C
ugaugucguuggagaaguucuuagg

SEQ ID NO: 12000 - RNA, 23 nt, Artificial Sequence
  Synthetic Oligonucleotide; GZMB exon 3; Set C
gaugucguuggagaaguucuuag

SEQ ID NO: 12001 - RNA, 27 nt, Artificial Sequence
  Synthetic Oligonucleotide; GZMB exon 3; Set A
augaugucguuggagaaguucuuagga

SEQ ID NO: 12002 - RNA, 39 nt, Artificial Sequence
  Synthetic Oligonucleotide; GZMB exon 3; Set A
aguagcaugaugucguuggagaaguucuuaggauuauag

SEQ ID NO: 12003 - RNA, 36 nt, Artificial Sequence
  Synthetic Oligonucleotide; GZMB exon 3; Set A
guagcaugaugucguuggagaaguucuuaggauuau

SEQ ID NO: 12004 - RNA, 34 nt, Artificial Sequence
  Synthetic Oligonucleotide; GZMB exon 3; Set A
uagcaugaugucguuggagaaguucuuaggauua

SEQ ID NO: 12005 - RNA, 38 nt, Artificial Sequence
  Synthetic Oligonucleotide; GZMB exon 3; Set A
aguagcaugaugucguuggagaaguucuuaggauuaua

SEQ ID NO: 12006 - RNA, 24 nt, Artificial Sequence
  Synthetic Oligonucleotide; GZMB exon 3; Set C
ugaugucguuggagaaguucuuag

SEQ ID NO: 12007 - RNA, 26 nt, Artificial Sequence
  Synthetic Oligonucleotide; GZMB exon 3; Set C
augaugucguuggagaaguucuuagg

SEQ ID NO: 12008 - RNA, 37 nt, Artificial Sequence
  Synthetic Oligonucleotide; GZMB exon 3; Set A
aguagcaugaugucguuggagaaguucuuaggauuau

SEQ ID NO: 12009 - RNA, 35 nt, Artificial Sequence
  Synthetic Oligonucleotide; GZMB exon 3; Set A
guagcaugaugucguuggagaaguucuuaggauua

SEQ ID NO: 12010 - RNA, 33 nt, Artificial Sequence
  Synthetic Oligonucleotide; GZMB exon 3; Set A
uagcaugaugucguuggagaaguucuuaggauu

SEQ ID NO: 12011 - RNA, 25 nt, Artificial Sequence
  Synthetic Oligonucleotide; GZMB exon 3; Set C
augaugucguuggagaaguucuuag

SEQ ID NO: 12012 - RNA, 32 nt, Artificial Sequence
  Synthetic Oligonucleotide; GZMB exon 3; Set A
uagcaugaugucguuggagaaguucuuaggau

SEQ ID NO: 12013 - RNA, 36 nt, Artificial Sequence
  Synthetic Oligonucleotide; GZMB exon 3; Set A
aguagcaugaugucguuggagaaguucuuaggauua

SEQ ID NO: 12014 - RNA, 34 nt, Artificial Sequence
  Synthetic Oligonucleotide; GZMB exon 3; Set A
guagcaugaugucguuggagaaguucuuaggauu

SEQ ID NO: 12015 - RNA, 33 nt, Artificial Sequence
  Synthetic Oligonucleotide; GZMB exon 3; Set A
guagcaugaugucguuggagaaguucuuaggau

SEQ ID NO: 12016 - RNA, 35 nt, Artificial Sequence
  Synthetic Oligonucleotide; GZMB exon 3; Set A
aguagcaugaugucguuggagaaguucuuaggauu

SEQ ID NO: 12017 - RNA, 31 nt, Artificial Sequence
  Synthetic Oligonucleotide; GZMB exon 3; Set A
uagcaugaugucguuggagaaguucuuagga

SEQ ID NO: 12018 - RNA, 34 nt, Artificial Sequence
  Synthetic Oligonucleotide; GZMB exon 3; Set A
aguagcaugaugucguuggagaaguucuuaggau

SEQ ID NO: 12019 - RNA, 32 nt, Artificial Sequence
  Synthetic Oligonucleotide; GZMB exon 3; Set A
guagcaugaugucguuggagaaguucuuagga

SEQ ID NO: 12020 - RNA, 30 nt, Artificial Sequence
  Synthetic Oligonucleotide; GZMB exon 3; Set A
uagcaugaugucguuggagaaguucuuagg

SEQ ID NO: 12021 - RNA, 18 nt, Artificial Sequence
  Synthetic Oligonucleotide; GZMB exon 3; Set C
gaugucguuggagaaguu

SEQ ID NO: 12022 - RNA, 33 nt, Artificial Sequence
  Synthetic Oligonucleotide; GZMB exon 3; Set A
aguagcaugaugucguuggagaaguucuuagga

SEQ ID NO: 12023 - RNA, 31 nt, Artificial Sequence
  Synthetic Oligonucleotide; GZMB exon 3; Set A
guagcaugaugucguuggagaaguucuuagg

SEQ ID NO: 12024 - RNA, 29 nt, Artificial Sequence
  Synthetic Oligonucleotide; GZMB exon 3; Set A
uagcaugaugucguuggagaaguucuuag

SEQ ID NO: 12025 - RNA, 19 nt, Artificial Sequence
  Synthetic Oligonucleotide; GZMB exon 3; Set C
ugaugucguuggagaaguu

SEQ ID NO: 12026 - RNA, 17 nt, Artificial Sequence
  Synthetic Oligonucleotide; GZMB exon 3; Set C
gaugucguuggagaagu

SEQ ID NO: 12027 - RNA, 32 nt, Artificial Sequence
  Synthetic Oligonucleotide; GZMB exon 3; Set A
aguagcaugaugucguuggagaaguucuuagg

SEQ ID NO: 12028 - RNA, 30 nt, Artificial Sequence
  Synthetic Oligonucleotide; GZMB exon 3; Set A
guagcaugaugucguuggagaaguucuuag

SEQ ID NO: 12029 - RNA, 16 nt, Artificial Sequence
  Synthetic Oligonucleotide; GZMB exon 3; Set C
gaugucguuggagaag

SEQ ID NO: 12030 - RNA, 20 nt, Artificial Sequence
  Synthetic Oligonucleotide; GZMB exon 3; Set C
augaugucguuggagaaguu

SEQ ID NO: 12031 - RNA, 18 nt, Artificial Sequence
  Synthetic Oligonucleotide; GZMB exon 3; Set C
ugaugucguuggagaagu

SEQ ID NO: 12032 - RNA, 31 nt, Artificial Sequence
  Synthetic Oligonucleotide; GZMB exon 3; Set A
aguagcaugaugucguuggagaaguucuuag

SEQ ID NO: 12033 - RNA, 17 nt, Artificial Sequence
  Synthetic Oligonucleotide; GZMB exon 3; Set C
ugaugucguuggagaag

SEQ ID NO: 12034 - RNA, 19 nt, Artificial Sequence
  Synthetic Oligonucleotide; GZMB exon 3; Set C
augaugucguuggagaagu

SEQ ID NO: 12035 - RNA, 15 nt, Artificial Sequence
  Synthetic Oligonucleotide; GZMB exon 3; Set C
gaugucguuggagaa

SEQ ID NO: 12036 - RNA, 18 nt, Artificial Sequence
  Synthetic Oligonucleotide; GZMB exon 3; Set C
augaugucguuggagaag

SEQ ID NO: 12037 - RNA, 16 nt, Artificial Sequence
  Synthetic Oligonucleotide; GZMB exon 3; Set C
ugaugucguuggagaa

SEQ ID NO: 12038 - RNA, 24 nt, Artificial Sequence
  Synthetic Oligonucleotide; GZMB exon 3; Set A
uagcaugaugucguuggagaaguu

SEQ ID NO: 12039 - RNA, 25 nt, Artificial Sequence
  Synthetic Oligonucleotide; GZMB exon 3; Set A
guagcaugaugucguuggagaaguu

SEQ ID NO: 12040 - RNA, 23 nt, Artificial Sequence
  Synthetic Oligonucleotide; GZMB exon 3; Set C
uagcaugaugucguuggagaagu

SEQ ID NO: 12041 - RNA, 22 nt, Artificial Sequence
  Synthetic Oligonucleotide; GZMB exon 3; Set C
uagcaugaugucguuggagaag

SEQ ID NO: 12042 - RNA, 26 nt, Artificial Sequence
  Synthetic Oligonucleotide; GZMB exon 3; Set A
aguagcaugaugucguuggagaaguu

SEQ ID NO: 12043 - RNA, 24 nt, Artificial Sequence
  Synthetic Oligonucleotide; GZMB exon 3; Set B
guagcaugaugucguuggagaagu

SEQ ID NO: 12044 - RNA, 23 nt, Artificial Sequence
  Synthetic Oligonucleotide; GZMB exon 3; Set C
guagcaugaugucguuggagaag

SEQ ID NO: 12045 - RNA, 25 nt, Artificial Sequence
  Synthetic Oligonucleotide; GZMB exon 3; Set B
aguagcaugaugucguuggagaagu

SEQ ID NO: 12046 - RNA, 21 nt, Artificial Sequence
  Synthetic Oligonucleotide; GZMB exon 3; Set C
uagcaugaugucguuggagaa

SEQ ID NO: 12047 - RNA, 24 nt, Artificial Sequence
  Synthetic Oligonucleotide; GZMB exon 3; Set C
aguagcaugaugucguuggagaag

SEQ ID NO: 12048 - RNA, 22 nt, Artificial Sequence
  Synthetic Oligonucleotide; GZMB exon 3; Set C
guagcaugaugucguuggagaa

SEQ ID NO: 12049 - RNA, 23 nt, Artificial Sequence
  Synthetic Oligonucleotide; GZMB exon 3; Set C
aguagcaugaugucguuggagaa

SEQ ID NO: 12050 - RNA, 21 nt, Artificial Sequence
  Synthetic Oligonucleotide; GZMB exon 3; Set B
guagcaugaugucguuggaga

SEQ ID NO: 12051 - RNA, 22 nt, Artificial Sequence
  Synthetic Oligonucleotide; GZMB exon 3; Set B
aguagcaugaugucguuggaga

SEQ ID NO: 12052 - RNA, 17 nt, Artificial Sequence
  Synthetic Oligonucleotide; GZMB exon 3; Set C
uagcaugaugucguugg

SEQ ID NO: 12053 - RNA, 16 nt, Artificial Sequence
  Synthetic Oligonucleotide; GZMB exon 3; Set C
uagcaugaugucguug

SEQ ID NO: 12054 - RNA, 18 nt, Artificial Sequence
  Synthetic Oligonucleotide; GZMB exon 3; Set C
guagcaugaugucguugg

SEQ ID NO: 12055 - RNA, 15 nt, Artificial Sequence
  Synthetic Oligonucleotide; GZMB exon 3; Set C
uagcaugaugucguu

SEQ ID NO: 12056 - RNA, 17 nt, Artificial Sequence
  Synthetic Oligonucleotide; GZMB exon 3; Set C
guagcaugaugucguug

SEQ ID NO: 12057 - RNA, 19 nt, Artificial Sequence
  Synthetic Oligonucleotide; GZMB exon 3; Set C
aguagcaugaugucguugg

SEQ ID NO: 12058 - RNA, 16 nt, Artificial Sequence
  Synthetic Oligonucleotide; GZMB exon 3; Set C
guagcaugaugucguu

SEQ ID NO: 12059 - RNA, 18 nt, Artificial Sequence
  Synthetic Oligonucleotide; GZMB exon 3; Set C
aguagcaugaugucguug

SEQ ID NO: 12060 - RNA, 17 nt, Artificial Sequence
  Synthetic Oligonucleotide; GZMB exon 3; Set C
aguagcaugaugucguu

SEQ ID NO: 12061 - RNA, 15 nt, Artificial Sequence
  Synthetic Oligonucleotide; GZMB exon 3; Set C
guagcaugaugucgu

SEQ ID NO: 12062 - RNA, 16 nt, Artificial Sequence
  Synthetic Oligonucleotide; GZMB exon 3; Set C
aguagcaugaugucgu

SEQ ID NO: 12063 - RNA, 15 nt, Artificial Sequence
  Synthetic Oligonucleotide; GZMB exon 3; Set C
aguagcaugaugucg

SEQ ID NO: 12064 - RNA, 17 nt, Artificial Sequence
  Synthetic Oligonucleotide; GZMB exon 3; Set C
agucacaggguauacag

SEQ ID NO: 12065 - RNA, 16 nt, Artificial Sequence
  Synthetic Oligonucleotide; GZMB exon 3; Set C
agucacaggguauaca

SEQ ID NO: 12066 - RNA, 15 nt, Artificial Sequence
  Synthetic Oligonucleotide; GZMB exon 3; Set C
agucacaggguauac

SEQ ID NO: 12067 - RNA, 15 nt, Artificial Sequence
  Synthetic Oligonucleotide; GZMB exon 3; Set C
uggagucacagggua

SEQ ID NO: 12068 - RNA, 16 nt, Artificial Sequence
  Synthetic Oligonucleotide; GZMB exon 3; Set C
guggagucacagggua

SEQ ID NO: 12069 - RNA, 17 nt, Artificial Sequence
  Synthetic Oligonucleotide; GZMB exon 3; Set C
gguggagucacagggua

SEQ ID NO: 12070 - RNA, 15 nt, Artificial Sequence
  Synthetic Oligonucleotide; GZMB exon 3; Set C
guggagucacagggu

SEQ ID NO: 12071 - RNA, 18 nt, Artificial Sequence
  Synthetic Oligonucleotide; GZMB exon 3; Set A
ggguggagucacagggua

SEQ ID NO: 12072 - RNA, 16 nt, Artificial Sequence
  Synthetic Oligonucleotide; GZMB exon 3; Set C
gguggagucacagggu

SEQ ID NO: 12073 - RNA, 19 nt, Artificial Sequence
  Synthetic Oligonucleotide; GZMB exon 3; Set A
gggguggagucacagggua

SEQ ID NO: 12074 - RNA, 17 nt, Artificial Sequence
  Synthetic Oligonucleotide; GZMB exon 3; Set A
ggguggagucacagggu

SEQ ID NO: 12075 - RNA, 15 nt, Artificial Sequence
  Synthetic Oligonucleotide; GZMB exon 3; Set C
gguggagucacaggg

SEQ ID NO: 12076 - RNA, 20 nt, Artificial Sequence
  Synthetic Oligonucleotide; GZMB exon 3; Set C
ggggguggagucacagggua

SEQ ID NO: 12077 - RNA, 18 nt, Artificial Sequence
  Synthetic Oligonucleotide; GZMB exon 3; Set A
gggguggagucacagggu

SEQ ID NO: 12078 - RNA, 16 nt, Artificial Sequence
  Synthetic Oligonucleotide; GZMB exon 3; Set C
ggguggagucacaggg

SEQ ID NO: 12079 - RNA, 21 nt, Artificial Sequence
  Synthetic Oligonucleotide; GZMB exon 3; Set C
uggggguggagucacagggua

SEQ ID NO: 12080 - RNA, 19 nt, Artificial Sequence
  Synthetic Oligonucleotide; GZMB exon 3; Set C
ggggguggagucacagggu

SEQ ID NO: 12081 - RNA, 15 nt, Artificial Sequence
  Synthetic Oligonucleotide; GZMB exon 3; Set C
ggguggagucacagg

SEQ ID NO: 12082 - RNA, 17 nt, Artificial Sequence
  Synthetic Oligonucleotide; GZMB exon 3; Set A
gggguggagucacaggg

SEQ ID NO: 12083 - RNA, 22 nt, Artificial Sequence
  Synthetic Oligonucleotide; GZMB exon 3; Set C
auggggguggagucacagggua

SEQ ID NO: 12084 - RNA, 20 nt, Artificial Sequence
  Synthetic Oligonucleotide; GZMB exon 3; Set C
uggggguggagucacagggu

SEQ ID NO: 12085 - RNA, 16 nt, Artificial Sequence
  Synthetic Oligonucleotide; GZMB exon 3; Set C
gggguggagucacagg

SEQ ID NO: 12086 - RNA, 18 nt, Artificial Sequence
  Synthetic Oligonucleotide; GZMB exon 3; Set A
ggggguggagucacaggg

SEQ ID NO: 12087 - RNA, 23 nt, Artificial Sequence
  Synthetic Oligonucleotide; GZMB exon 3; Set C
gauggggguggagucacagggua

SEQ ID NO: 12088 - RNA, 21 nt, Artificial Sequence
  Synthetic Oligonucleotide; GZMB exon 3; Set C
auggggguggagucacagggu

SEQ ID NO: 12089 - RNA, 17 nt, Artificial Sequence
  Synthetic Oligonucleotide; GZMB exon 3; Set A
ggggguggagucacagg

SEQ ID NO: 12090 - RNA, 15 nt, Artificial Sequence
  Synthetic Oligonucleotide; GZMB exon 3; Set C
gggguggagucacag

SEQ ID NO: 12091 - RNA, 19 nt, Artificial Sequence
  Synthetic Oligonucleotide; GZMB exon 3; Set A
uggggguggagucacaggg

SEQ ID NO: 12092 - RNA, 24 nt, Artificial Sequence
  Synthetic Oligonucleotide; GZMB exon 3; Set C
ggauggggguggagucacagggua

SEQ ID NO: 12093 - RNA, 22 nt, Artificial Sequence
  Synthetic Oligonucleotide; GZMB exon 3; Set C
gauggggguggagucacagggu

SEQ ID NO: 12094 - RNA, 18 nt, Artificial Sequence
  Synthetic Oligonucleotide; GZMB exon 3; Set A
uggggguggagucacagg

SEQ ID NO: 12095 - RNA, 16 nt, Artificial Sequence
  Synthetic Oligonucleotide; GZMB exon 3; Set C
ggggguggagucacag

SEQ ID NO: 12096 - RNA, 20 nt, Artificial Sequence
  Synthetic Oligonucleotide; GZMB exon 3; Set A
auggggguggagucacaggg

SEQ ID NO: 12097 - RNA, 25 nt, Artificial Sequence
  Synthetic Oligonucleotide; GZMB exon 3; Set C
aggauggggguggagucacagggua

SEQ ID NO: 12098 - RNA, 23 nt, Artificial Sequence
  Synthetic Oligonucleotide; GZMB exon 3; Set C
ggauggggguggagucacagggu

SEQ ID NO: 12099 - RNA, 19 nt, Artificial Sequence
  Synthetic Oligonucleotide; GZMB exon 3; Set A
auggggguggagucacagg

SEQ ID NO: 12100 - RNA, 17 nt, Artificial Sequence
  Synthetic Oligonucleotide; GZMB exon 3; Set A
uggggguggagucacag

SEQ ID NO: 12101 - RNA, 21 nt, Artificial Sequence
  Synthetic Oligonucleotide; GZMB exon 3; Set A
gauggggguggagucacaggg

SEQ ID NO: 12102 - RNA, 26 nt, Artificial Sequence
  Synthetic Oligonucleotide; GZMB exon 3; Set C
gaggauggggguggagucacagggua

SEQ ID NO: 12103 - RNA, 24 nt, Artificial Sequence
  Synthetic Oligonucleotide; GZMB exon 3; Set C
aggauggggguggagucacagggu

SEQ ID NO: 12104 - RNA, 20 nt, Artificial Sequence
  Synthetic Oligonucleotide; GZMB exon 3; Set A
gauggggguggagucacagg

SEQ ID NO: 12105 - RNA, 18 nt, Artificial Sequence
  Synthetic Oligonucleotide; GZMB exon 3; Set A
auggggguggagucacag

SEQ ID NO: 12106 - RNA, 22 nt, Artificial Sequence
  Synthetic Oligonucleotide; GZMB exon 3; Set C
ggauggggguggagucacaggg

SEQ ID NO: 12107 - RNA, 27 nt, Artificial Sequence
  Synthetic Oligonucleotide; GZMB exon 3; Set C
ugaggauggggguggagucacagggua

SEQ ID NO: 12108 - RNA, 25 nt, Artificial Sequence
  Synthetic Oligonucleotide; GZMB exon 3; Set C
gaggauggggguggagucacagggu

SEQ ID NO: 12109 - RNA, 21 nt, Artificial Sequence
  Synthetic Oligonucleotide; GZMB exon 3; Set A
ggauggggguggagucacagg

SEQ ID NO: 12110 - RNA, 19 nt, Artificial Sequence
  Synthetic Oligonucleotide; GZMB exon 3; Set A
gauggggguggagucacag

SEQ ID NO: 12111 - RNA, 23 nt, Artificial Sequence
  Synthetic Oligonucleotide; GZMB exon 3; Set C
aggauggggguggagucacaggg

SEQ ID NO: 12112 - RNA, 28 nt, Artificial Sequence
  Synthetic Oligonucleotide; GZMB exon 3; Set C
gugaggauggggguggagucacagggua

SEQ ID NO: 12113 - RNA, 26 nt, Artificial Sequence
  Synthetic Oligonucleotide; GZMB exon 3; Set C
ugaggauggggguggagucacagggu

SEQ ID NO: 12114 - RNA, 22 nt, Artificial Sequence
  Synthetic Oligonucleotide; GZMB exon 3; Set A
aggauggggguggagucacagg

SEQ ID NO: 12115 - RNA, 20 nt, Artificial Sequence
  Synthetic Oligonucleotide; GZMB exon 3; Set A
ggauggggguggagucacag

SEQ ID NO: 12116 - RNA, 24 nt, Artificial Sequence
  Synthetic Oligonucleotide; GZMB exon 3; Set C
gaggauggggguggagucacaggg

SEQ ID NO: 12117 - RNA, 29 nt, Artificial Sequence
  Synthetic Oligonucleotide; GZMB exon 3; Set C
agugaggauggggguggagucacagggua

SEQ ID NO: 12118 - RNA, 27 nt, Artificial Sequence
  Synthetic Oligonucleotide; GZMB exon 3; Set C
gugaggauggggguggagucacagggu

SEQ ID NO: 12119 - RNA, 23 nt, Artificial Sequence
  Synthetic Oligonucleotide; GZMB exon 3; Set C
gaggauggggguggagucacagg

SEQ ID NO: 12120 - RNA, 21 nt, Artificial Sequence
  Synthetic Oligonucleotide; GZMB exon 3; Set A
aggauggggguggagucacag

SEQ ID NO: 12121 - RNA, 25 nt, Artificial Sequence
  Synthetic Oligonucleotide; GZMB exon 3; Set C
ugaggauggggguggagucacaggg

SEQ ID NO: 12122 - RNA, 28 nt, Artificial Sequence
  Synthetic Oligonucleotide; GZMB exon 3; Set C
agugaggauggggguggagucacagggu

SEQ ID NO: 12123 - RNA, 24 nt, Artificial Sequence
  Synthetic Oligonucleotide; GZMB exon 3; Set C
ugaggauggggguggagucacagg

SEQ ID NO: 12124 - RNA, 22 nt, Artificial Sequence
  Synthetic Oligonucleotide; GZMB exon 3; Set A
gaggauggggguggagucacag

SEQ ID NO: 12125 - RNA, 26 nt, Artificial Sequence
  Synthetic Oligonucleotide; GZMB exon 3; Set C
gugaggauggggguggagucacaggg

SEQ ID NO: 12126 - RNA, 25 nt, Artificial Sequence
  Synthetic Oligonucleotide; GZMB exon 3; Set C
gugaggauggggguggagucacagg

SEQ ID NO: 12127 - RNA, 23 nt, Artificial Sequence
  Synthetic Oligonucleotide; GZMB exon 3; Set A
ugaggauggggguggagucacag

SEQ ID NO: 12128 - RNA, 27 nt, Artificial Sequence
  Synthetic Oligonucleotide; GZMB exon 3; Set C
agugaggauggggguggagucacaggg

SEQ ID NO: 12129 - RNA, 26 nt, Artificial Sequence
  Synthetic Oligonucleotide; GZMB exon 3; Set C
agugaggauggggguggagucacagg

SEQ ID NO: 12130 - RNA, 24 nt, Artificial Sequence
  Synthetic Oligonucleotide; GZMB exon 3; Set C
gugaggauggggguggagucacag

SEQ ID NO: 12131 - RNA, 25 nt, Artificial Sequence
  Synthetic Oligonucleotide; GZMB exon 3; Set C
agugaggauggggguggagucacag

SEQ ID NO: 12132 - RNA, 36 nt, Artificial Sequence
  Synthetic Oligonucleotide; GZMB exon 3; Set C
agagcagagugaggauggggguggagucacagggua

SEQ ID NO: 12133 - RNA, 37 nt, Artificial Sequence
  Synthetic Oligonucleotide; GZMB exon 3; Set C
gagagcagagugaggauggggguggagucacagggua

SEQ ID NO: 12134 - RNA, 35 nt, Artificial Sequence
  Synthetic Oligonucleotide; GZMB exon 3; Set C
agagcagagugaggauggggguggagucacagggu

SEQ ID NO: 12135 - RNA, 38 nt, Artificial Sequence
  Synthetic Oligonucleotide; GZMB exon 3; Set C
agagagcagagugaggauggggguggagucacagggua

SEQ ID NO: 12136 - RNA, 36 nt, Artificial Sequence
  Synthetic Oligonucleotide; GZMB exon 3; Set C
gagagcagagugaggauggggguggagucacagggu

SEQ ID NO: 12137 - RNA, 39 nt, Artificial Sequence
  Synthetic Oligonucleotide; GZMB exon 3; Set C
cagagagcagagugaggauggggguggagucacagggua

SEQ ID NO: 12138 - RNA, 37 nt, Artificial Sequence
  Synthetic Oligonucleotide; GZMB exon 3; Set C
agagagcagagugaggauggggguggagucacagggu

SEQ ID NO: 12139 - RNA, 33 nt, Artificial Sequence
  Synthetic Oligonucleotide; GZMB exon 3; Set C
agagcagagugaggauggggguggagucacagg

SEQ ID NO: 12140 - RNA, 40 nt, Artificial Sequence
  Synthetic Oligonucleotide; GZMB exon 3; Set C
acagagagcagagugaggauggggguggagucacagggua

SEQ ID NO: 12141 - RNA, 38 nt, Artificial Sequence
  Synthetic Oligonucleotide; GZMB exon 3; Set C
cagagagcagagugaggauggggguggagucacagggu

SEQ ID NO: 12142 - RNA, 34 nt, Artificial Sequence
  Synthetic Oligonucleotide; GZMB exon 3; Set C
gagagcagagugaggauggggguggagucacagg

SEQ ID NO: 12143 - RNA, 31 nt, Artificial Sequence
  Synthetic Oligonucleotide; GZMB exon 3; Set C
agagcagagugaggauggggguggagucaca

SEQ ID NO: 12144 - RNA, 39 nt, Artificial Sequence
  Synthetic Oligonucleotide; GZMB exon 3; Set C
acagagagcagagugaggauggggguggagucacagggu

SEQ ID NO: 12145 - RNA, 32 nt, Artificial Sequence
  Synthetic Oligonucleotide; GZMB exon 3; Set C
gagagcagagugaggauggggguggagucaca

SEQ ID NO: 12146 - RNA, 33 nt, Artificial Sequence
  Synthetic Oligonucleotide; GZMB exon 3; Set C
agagagcagagugaggauggggguggagucaca

SEQ ID NO: 12147 - RNA, 34 nt, Artificial Sequence
  Synthetic Oligonucleotide; GZMB exon 3; Set C
cagagagcagagugaggauggggguggagucaca

SEQ ID NO: 12148 - RNA, 35 nt, Artificial Sequence
  Synthetic Oligonucleotide; GZMB exon 3; Set C
acagagagcagagugaggauggggguggagucaca

SEQ ID NO: 12149 - RNA, 27 nt, Artificial Sequence
  Synthetic Oligonucleotide; GZMB exon 3; Set C
agagcagagugaggauggggguggagu

SEQ ID NO: 12150 - RNA, 36 nt, Artificial Sequence
  Synthetic Oligonucleotide; GZMB exon 3; Set C
cacagagagcagagugaggauggggguggagucaca

SEQ ID NO: 12151 - RNA, 26 nt, Artificial Sequence
  Synthetic Oligonucleotide; GZMB exon 3; Set C
agagcagagugaggauggggguggag

SEQ ID NO: 12152 - RNA, 28 nt, Artificial Sequence
  Synthetic Oligonucleotide; GZMB exon 3; Set C
gagagcagagugaggauggggguggagu

SEQ ID NO: 12153 - RNA, 25 nt, Artificial Sequence
  Synthetic Oligonucleotide; GZMB exon 3; Set C
agagcagagugaggaugggggugga

SEQ ID NO: 12154 - RNA, 37 nt, Artificial Sequence
  Synthetic Oligonucleotide; GZMB exon 3; Set C
gcacagagagcagagugaggauggggguggagucaca

SEQ ID NO: 12155 - RNA, 27 nt, Artificial Sequence
  Synthetic Oligonucleotide; GZMB exon 3; Set C
gagagcagagugaggauggggguggag

SEQ ID NO: 12156 - RNA, 29 nt, Artificial Sequence
  Synthetic Oligonucleotide; GZMB exon 3; Set C
agagagcagagugaggauggggguggagu

SEQ ID NO: 12157 - RNA, 24 nt, Artificial Sequence
  Synthetic Oligonucleotide; GZMB exon 3; Set C
agagcagagugaggaugggggugg

SEQ ID NO: 12158 - RNA, 26 nt, Artificial Sequence
  Synthetic Oligonucleotide; GZMB exon 3; Set C
gagagcagagugaggaugggggugga

SEQ ID NO: 12159 - RNA, 38 nt, Artificial Sequence
  Synthetic Oligonucleotide; GZMB exon 3; Set C
ugcacagagagcagagugaggauggggguggagucaca

SEQ ID NO: 12160 - RNA, 28 nt, Artificial Sequence
  Synthetic Oligonucleotide; GZMB exon 3; Set C
agagagcagagugaggauggggguggag

SEQ ID NO: 12161 - RNA, 30 nt, Artificial Sequence
  Synthetic Oligonucleotide; GZMB exon 3; Set C
cagagagcagagugaggauggggguggagu

SEQ ID NO: 12162 - RNA, 25 nt, Artificial Sequence
  Synthetic Oligonucleotide; GZMB exon 3; Set C
gagagcagagugaggaugggggugg

SEQ ID NO: 12163 - RNA, 23 nt, Artificial Sequence
  Synthetic Oligonucleotide; GZMB exon 3; Set A
agagcagagugaggaugggggug

SEQ ID NO: 12164 - RNA, 27 nt, Artificial Sequence
  Synthetic Oligonucleotide; GZMB exon 3; Set C
agagagcagagugaggaugggggugga

SEQ ID NO: 12165 - RNA, 29 nt, Artificial Sequence
  Synthetic Oligonucleotide; GZMB exon 3; Set C
cagagagcagagugaggauggggguggag

SEQ ID NO: 12166 - RNA, 31 nt, Artificial Sequence
  Synthetic Oligonucleotide; GZMB exon 3; Set C
acagagagcagagugaggauggggguggagu

SEQ ID NO: 12167 - RNA, 22 nt, Artificial Sequence
  Synthetic Oligonucleotide; GZMB exon 3; Set A
agagcagagugaggaugggggu

SEQ ID NO: 12168 - RNA, 26 nt, Artificial Sequence
  Synthetic Oligonucleotide; GZMB exon 3; Set C
agagagcagagugaggaugggggugg

SEQ ID NO: 12169 - RNA, 24 nt, Artificial Sequence
  Synthetic Oligonucleotide; GZMB exon 3; Set A
gagagcagagugaggaugggggug

SEQ ID NO: 12170 - RNA, 28 nt, Artificial Sequence
  Synthetic Oligonucleotide; GZMB exon 3; Set C
cagagagcagagugaggaugggggugga

SEQ ID NO: 12171 - RNA, 30 nt, Artificial Sequence
  Synthetic Oligonucleotide; GZMB exon 3; Set C
acagagagcagagugaggauggggguggag

SEQ ID NO: 12172 - RNA, 23 nt, Artificial Sequence
  Synthetic Oligonucleotide; GZMB exon 3; Set A
gagagcagagugaggaugggggu

SEQ ID NO: 12173 - RNA, 27 nt, Artificial Sequence
  Synthetic Oligonucleotide; GZMB exon 3; Set C
cagagagcagagugaggaugggggugg

SEQ ID NO: 12174 - RNA, 29 nt, Artificial Sequence
  Synthetic Oligonucleotide; GZMB exon 3; Set C
acagagagcagagugaggaugggggugga

SEQ ID NO: 12175 - RNA, 25 nt, Artificial Sequence
  Synthetic Oligonucleotide; GZMB exon 3; Set A
agagagcagagugaggaugggggug

SEQ ID NO: 12176 - RNA, 21 nt, Artificial Sequence
  Synthetic Oligonucleotide; GZMB exon 3; Set A
agagcagagugaggauggggg

SEQ ID NO: 12177 - RNA, 28 nt, Artificial Sequence
  Synthetic Oligonucleotide; GZMB exon 3; Set C
acagagagcagagugaggaugggggugg

SEQ ID NO: 12178 - RNA, 24 nt, Artificial Sequence
  Synthetic Oligonucleotide; GZMB exon 3; Set A
agagagcagagugaggaugggggu

SEQ ID NO: 12179 - RNA, 26 nt, Artificial Sequence
  Synthetic Oligonucleotide; GZMB exon 3; Set C
cagagagcagagugaggaugggggug

SEQ ID NO: 12180 - RNA, 30 nt, Artificial Sequence
  Synthetic Oligonucleotide; GZMB exon 3; Set C
cacagagagcagagugaggaugggggugga

SEQ ID NO: 12181 - RNA, 22 nt, Artificial Sequence
  Synthetic Oligonucleotide; GZMB exon 3; Set A
gagagcagagugaggauggggg

SEQ ID NO: 12182 - RNA, 20 nt, Artificial Sequence
  Synthetic Oligonucleotide; GZMB exon 3; Set A
agagcagagugaggaugggg

SEQ ID NO: 12183 - RNA, 25 nt, Artificial Sequence
  Synthetic Oligonucleotide; GZMB exon 3; Set C
cagagagcagagugaggaugggggu

SEQ ID NO: 12184 - RNA, 29 nt, Artificial Sequence
  Synthetic Oligonucleotide; GZMB exon 3; Set C
cacagagagcagagugaggaugggggugg

SEQ ID NO: 12185 - RNA, 27 nt, Artificial Sequence
  Synthetic Oligonucleotide; GZMB exon 3; Set C
acagagagcagagugaggaugggggug

SEQ ID NO: 12186 - RNA, 31 nt, Artificial Sequence
  Synthetic Oligonucleotide; GZMB exon 3; Set C
gcacagagagcagagugaggaugggggugga

SEQ ID NO: 12187 - RNA, 23 nt, Artificial Sequence
  Synthetic Oligonucleotide; GZMB exon 3; Set A
agagagcagagugaggauggggg

SEQ ID NO: 12188 - RNA, 21 nt, Artificial Sequence
  Synthetic Oligonucleotide; GZMB exon 3; Set A
gagagcagagugaggaugggg

SEQ ID NO: 12189 - RNA, 19 nt, Artificial Sequence
  Synthetic Oligonucleotide; GZMB exon 3; Set C
agagcagagugaggauggg

SEQ ID NO: 12190 - RNA, 26 nt, Artificial Sequence
  Synthetic Oligonucleotide; GZMB exon 3; Set C
acagagagcagagugaggaugggggu

SEQ ID NO: 12191 - RNA, 30 nt, Artificial Sequence
  Synthetic Oligonucleotide; GZMB exon 3; Set C
gcacagagagcagagugaggaugggggugg

SEQ ID NO: 12192 - RNA, 28 nt, Artificial Sequence
  Synthetic Oligonucleotide; GZMB exon 3; Set C
cacagagagcagagugaggaugggggug

SEQ ID NO: 12193 - RNA, 32 nt, Artificial Sequence
  Synthetic Oligonucleotide; GZMB exon 3; Set C
ugcacagagagcagagugaggaugggggugga

SEQ ID NO: 12194 - RNA, 24 nt, Artificial Sequence
  Synthetic Oligonucleotide; GZMB exon 3; Set A
cagagagcagagugaggauggggg

SEQ ID NO: 12195 - RNA, 22 nt, Artificial Sequence
  Synthetic Oligonucleotide; GZMB exon 3; Set A
agagagcagagugaggaugggg

SEQ ID NO: 12196 - RNA, 18 nt, Artificial Sequence
  Synthetic Oligonucleotide; GZMB exon 3; Set C
agagcagagugaggaugg

SEQ ID NO: 12197 - RNA, 20 nt, Artificial Sequence
  Synthetic Oligonucleotide; GZMB exon 3; Set A
gagagcagagugaggauggg

SEQ ID NO: 12198 - RNA, 27 nt, Artificial Sequence
  Synthetic Oligonucleotide; GZMB exon 3; Set C
cacagagagcagagugaggaugggggu

SEQ ID NO: 12199 - RNA, 31 nt, Artificial Sequence
  Synthetic Oligonucleotide; GZMB exon 3; Set C
ugcacagagagcagagugaggaugggggugg

SEQ ID NO: 12200 - RNA, 29 nt, Artificial Sequence
  Synthetic Oligonucleotide; GZMB exon 3; Set C
gcacagagagcagagugaggaugggggug

SEQ ID NO: 12201 - RNA, 25 nt, Artificial Sequence
  Synthetic Oligonucleotide; GZMB exon 3; Set C
acagagagcagagugaggauggggg

SEQ ID NO: 12202 - RNA, 23 nt, Artificial Sequence
  Synthetic Oligonucleotide; GZMB exon 3; Set A
cagagagcagagugaggaugggg

SEQ ID NO: 12203 - RNA, 17 nt, Artificial Sequence
  Synthetic Oligonucleotide; GZMB exon 3; Set C
agagcagagugaggaug

SEQ ID NO: 12204 - RNA, 19 nt, Artificial Sequence
  Synthetic Oligonucleotide; GZMB exon 3; Set C
gagagcagagugaggaugg

SEQ ID NO: 12205 - RNA, 21 nt, Artificial Sequence
  Synthetic Oligonucleotide; GZMB exon 3; Set A
agagagcagagugaggauggg

SEQ ID NO: 12206 - RNA, 28 nt, Artificial Sequence
  Synthetic Oligonucleotide; GZMB exon 3; Set C
gcacagagagcagagugaggaugggggu

SEQ ID NO: 12207 - RNA, 30 nt, Artificial Sequence
  Synthetic Oligonucleotide; GZMB exon 3; Set C
ugcacagagagcagagugaggaugggggug

SEQ ID NO: 12208 - RNA, 24 nt, Artificial Sequence
  Synthetic Oligonucleotide; GZMB exon 3; Set A
acagagagcagagugaggaugggg

SEQ ID NO: 12209 - RNA, 16 nt, Artificial Sequence
  Synthetic Oligonucleotide; GZMB exon 3; Set C
agagcagagugaggau

SEQ ID NO: 12210 - RNA, 18 nt, Artificial Sequence
  Synthetic Oligonucleotide; GZMB exon 3; Set C
gagagcagagugaggaug

SEQ ID NO: 12211 - RNA, 20 nt, Artificial Sequence
  Synthetic Oligonucleotide; GZMB exon 3; Set C
agagagcagagugaggaugg

SEQ ID NO: 12212 - RNA, 22 nt, Artificial Sequence
  Synthetic Oligonucleotide; GZMB exon 3; Set A
cagagagcagagugaggauggg

SEQ ID NO: 12213 - RNA, 38 nt, Artificial Sequence
  Synthetic Oligonucleotide; GZMB exon 3; Set C
gagcugcacagagagcagagugaggauggggguggagu

SEQ ID NO: 12214 - RNA, 29 nt, Artificial Sequence
  Synthetic Oligonucleotide; GZMB exon 3; Set C
ugcacagagagcagagugaggaugggggu

SEQ ID NO: 12215 - RNA, 15 nt, Artificial Sequence
  Synthetic Oligonucleotide; GZMB exon 3; Set C
agagcagagugagga

SEQ ID NO: 12216 - RNA, 17 nt, Artificial Sequence
  Synthetic Oligonucleotide; GZMB exon 3; Set C
gagagcagagugaggau

SEQ ID NO: 12217 - RNA, 19 nt, Artificial Sequence
  Synthetic Oligonucleotide; GZMB exon 3; Set C
agagagcagagugaggaug

SEQ ID NO: 12218 - RNA, 21 nt, Artificial Sequence
  Synthetic Oligonucleotide; GZMB exon 3; Set A
cagagagcagagugaggaugg

SEQ ID NO: 12219 - RNA, 23 nt, Artificial Sequence
  Synthetic Oligonucleotide; GZMB exon 3; Set A
acagagagcagagugaggauggg

SEQ ID NO: 12220 - RNA, 37 nt, Artificial Sequence
  Synthetic Oligonucleotide; GZMB exon 3; Set C
gagcugcacagagagcagagugaggauggggguggag

SEQ ID NO: 12221 - RNA, 39 nt, Artificial Sequence
  Synthetic Oligonucleotide; GZMB exon 3; Set C
ggagcugcacagagagcagagugaggauggggguggagu

SEQ ID NO: 12222 - RNA, 36 nt, Artificial Sequence
  Synthetic Oligonucleotide; GZMB exon 3; Set C
gagcugcacagagagcagagugaggaugggggugga

SEQ ID NO: 12223 - RNA, 16 nt, Artificial Sequence
  Synthetic Oligonucleotide; GZMB exon 3; Set C
gagagcagagugagga

SEQ ID NO: 12224 - RNA, 18 nt, Artificial Sequence
  Synthetic Oligonucleotide; GZMB exon 3; Set C
agagagcagagugaggau

SEQ ID NO: 12225 - RNA, 22 nt, Artificial Sequence
  Synthetic Oligonucleotide; GZMB exon 3; Set A
acagagagcagagugaggaugg

SEQ ID NO: 12226 - RNA, 20 nt, Artificial Sequence
  Synthetic Oligonucleotide; GZMB exon 3; Set C
cagagagcagagugaggaug

SEQ ID NO: 12227 - RNA, 38 nt, Artificial Sequence
  Synthetic Oligonucleotide; GZMB exon 3; Set C
ggagcugcacagagagcagagugaggauggggguggag

SEQ ID NO: 12228 - RNA, 40 nt, Artificial Sequence
  Synthetic Oligonucleotide; GZMB exon 3; Set C
uggagcugcacagagagcagagugaggauggggguggagu

SEQ ID NO: 12229 - RNA, 35 nt, Artificial Sequence
  Synthetic Oligonucleotide; GZMB exon 3; Set C
gagcugcacagagagcagagugaggaugggggugg

SEQ ID NO: 12230 - RNA, 37 nt, Artificial Sequence
  Synthetic Oligonucleotide; GZMB exon 3; Set C
ggagcugcacagagagcagagugaggaugggggugga

SEQ ID NO: 12231 - RNA, 17 nt, Artificial Sequence
  Synthetic Oligonucleotide; GZMB exon 3; Set C
agagagcagagugagga

SEQ ID NO: 12232 - RNA, 15 nt, Artificial Sequence
  Synthetic Oligonucleotide; GZMB exon 3; Set C
gagagcagagugagg

SEQ ID NO: 12233 - RNA, 19 nt, Artificial Sequence
  Synthetic Oligonucleotide; GZMB exon 3; Set C
cagagagcagagugaggau

SEQ ID NO: 12234 - RNA, 21 nt, Artificial Sequence
  Synthetic Oligonucleotide; GZMB exon 3; Set C
acagagagcagagugaggaug

SEQ ID NO: 12235 - RNA, 39 nt, Artificial Sequence
  Synthetic Oligonucleotide; GZMB exon 3; Set C
uggagcugcacagagagcagagugaggauggggguggag

SEQ ID NO: 12236 - RNA, 36 nt, Artificial Sequence
  Synthetic Oligonucleotide; GZMB exon 3; Set C
ggagcugcacagagagcagagugaggaugggggugg

SEQ ID NO: 12237 - RNA, 38 nt, Artificial Sequence
  Synthetic Oligonucleotide; GZMB exon 3; Set C
uggagcugcacagagagcagagugaggaugggggugga

SEQ ID NO: 12238 - RNA, 34 nt, Artificial Sequence
  Synthetic Oligonucleotide; GZMB exon 3; Set C
gagcugcacagagagcagagugaggaugggggug

SEQ ID NO: 12239 - RNA, 18 nt, Artificial Sequence
  Synthetic Oligonucleotide; GZMB exon 3; Set C
cagagagcagagugagga

SEQ ID NO: 12240 - RNA, 16 nt, Artificial Sequence
  Synthetic Oligonucleotide; GZMB exon 3; Set C
agagagcagagugagg

SEQ ID NO: 12241 - RNA, 20 nt, Artificial Sequence
  Synthetic Oligonucleotide; GZMB exon 3; Set C
acagagagcagagugaggau

SEQ ID NO: 12242 - RNA, 40 nt, Artificial Sequence
  Synthetic Oligonucleotide; GZMB exon 3; Set C
auggagcugcacagagagcagagugaggauggggguggag

SEQ ID NO: 12243 - RNA, 37 nt, Artificial Sequence
  Synthetic Oligonucleotide; GZMB exon 3; Set C
uggagcugcacagagagcagagugaggaugggggugg

SEQ ID NO: 12244 - RNA, 33 nt, Artificial Sequence
  Synthetic Oligonucleotide; GZMB exon 3; Set C
gagcugcacagagagcagagugaggaugggggu

SEQ ID NO: 12245 - RNA, 35 nt, Artificial Sequence
  Synthetic Oligonucleotide; GZMB exon 3; Set C
ggagcugcacagagagcagagugaggaugggggug

SEQ ID NO: 12246 - RNA, 19 nt, Artificial Sequence
  Synthetic Oligonucleotide; GZMB exon 3; Set C
acagagagcagagugagga

SEQ ID NO: 12247 - RNA, 15 nt, Artificial Sequence
  Synthetic Oligonucleotide; GZMB exon 3; Set C
agagagcagagugag

SEQ ID NO: 12248 - RNA, 17 nt, Artificial Sequence
  Synthetic Oligonucleotide; GZMB exon 3; Set C
cagagagcagagugagg

SEQ ID NO: 12249 - RNA, 34 nt, Artificial Sequence
  Synthetic Oligonucleotide; GZMB exon 3; Set C
ggagcugcacagagagcagagugaggaugggggu

SEQ ID NO: 12250 - RNA, 36 nt, Artificial Sequence
  Synthetic Oligonucleotide; GZMB exon 3; Set C
uggagcugcacagagagcagagugaggaugggggug

SEQ ID NO: 12251 - RNA, 18 nt, Artificial Sequence
  Synthetic Oligonucleotide; GZMB exon 3; Set C
acagagagcagagugagg

SEQ ID NO: 12252 - RNA, 16 nt, Artificial Sequence
  Synthetic Oligonucleotide; GZMB exon 3; Set C
cagagagcagagugag

SEQ ID NO: 12253 - RNA, 32 nt, Artificial Sequence
  Synthetic Oligonucleotide; GZMB exon 3; Set C
gagcugcacagagagcagagugaggauggggg

SEQ ID NO: 12254 - RNA, 35 nt, Artificial Sequence
  Synthetic Oligonucleotide; GZMB exon 3; Set C
uggagcugcacagagagcagagugaggaugggggu

SEQ ID NO: 12255 - RNA, 15 nt, Artificial Sequence
  Synthetic Oligonucleotide; GZMB exon 3; Set C
cagagagcagaguga

SEQ ID NO: 12256 - RNA, 17 nt, Artificial Sequence
  Synthetic Oligonucleotide; GZMB exon 3; Set C
acagagagcagagugag

SEQ ID NO: 12257 - RNA, 33 nt, Artificial Sequence
  Synthetic Oligonucleotide; GZMB exon 3; Set C
ggagcugcacagagagcagagugaggauggggg

SEQ ID NO: 12258 - RNA, 31 nt, Artificial Sequence
  Synthetic Oligonucleotide; GZMB exon 3; Set C
gagcugcacagagagcagagugaggaugggg

SEQ ID NO: 12259 - RNA, 16 nt, Artificial Sequence
  Synthetic Oligonucleotide; GZMB exon 3; Set C
acagagagcagaguga

SEQ ID NO: 12260 - RNA, 34 nt, Artificial Sequence
  Synthetic Oligonucleotide; GZMB exon 3; Set C
uggagcugcacagagagcagagugaggauggggg

SEQ ID NO: 12261 - RNA, 32 nt, Artificial Sequence
  Synthetic Oligonucleotide; GZMB exon 3; Set C
ggagcugcacagagagcagagugaggaugggg

SEQ ID NO: 12262 - RNA, 30 nt, Artificial Sequence
  Synthetic Oligonucleotide; GZMB exon 3; Set C
gagcugcacagagagcagagugaggauggg

SEQ ID NO: 12263 - RNA, 15 nt, Artificial Sequence
  Synthetic Oligonucleotide; GZMB exon 3; Set C
acagagagcagagug

SEQ ID NO: 12264 - RNA, 35 nt, Artificial Sequence
  Synthetic Oligonucleotide; GZMB exon 3; Set C
auggagcugcacagagagcagagugaggauggggg

SEQ ID NO: 12265 - RNA, 33 nt, Artificial Sequence
  Synthetic Oligonucleotide; GZMB exon 3; Set C
uggagcugcacagagagcagagugaggaugggg

SEQ ID NO: 12266 - RNA, 29 nt, Artificial Sequence
  Synthetic Oligonucleotide; GZMB exon 3; Set C
gagcugcacagagagcagagugaggaugg

SEQ ID NO: 12267 - RNA, 31 nt, Artificial Sequence
  Synthetic Oligonucleotide; GZMB exon 3; Set C
ggagcugcacagagagcagagugaggauggg

SEQ ID NO: 12268 - RNA, 36 nt, Artificial Sequence
  Synthetic Oligonucleotide; GZMB exon 3; Set C
uauggagcugcacagagagcagagugaggauggggg

SEQ ID NO: 12269 - RNA, 34 nt, Artificial Sequence
  Synthetic Oligonucleotide; GZMB exon 3; Set C
auggagcugcacagagagcagagugaggaugggg

SEQ ID NO: 12270 - RNA, 30 nt, Artificial Sequence
  Synthetic Oligonucleotide; GZMB exon 3; Set C
ggagcugcacagagagcagagugaggaugg

SEQ ID NO: 12271 - RNA, 28 nt, Artificial Sequence
  Synthetic Oligonucleotide; GZMB exon 3; Set C
gagcugcacagagagcagagugaggaug

SEQ ID NO: 12272 - RNA, 32 nt, Artificial Sequence
  Synthetic Oligonucleotide; GZMB exon 3; Set C
uggagcugcacagagagcagagugaggauggg

SEQ ID NO: 12273 - RNA, 37 nt, Artificial Sequence
  Synthetic Oligonucleotide; GZMB exon 3; Set C
uuauggagcugcacagagagcagagugaggauggggg

SEQ ID NO: 12274 - RNA, 35 nt, Artificial Sequence
  Synthetic Oligonucleotide; GZMB exon 3; Set C
uauggagcugcacagagagcagagugaggaugggg

SEQ ID NO: 12275 - RNA, 27 nt, Artificial Sequence
  Synthetic Oligonucleotide; GZMB exon 3; Set C
gagcugcacagagagcagagugaggau

SEQ ID NO: 12276 - RNA, 31 nt, Artificial Sequence
  Synthetic Oligonucleotide; GZMB exon 3; Set C
uggagcugcacagagagcagagugaggaugg

SEQ ID NO: 12277 - RNA, 29 nt, Artificial Sequence
  Synthetic Oligonucleotide; GZMB exon 3; Set C
ggagcugcacagagagcagagugaggaug

SEQ ID NO: 12278 - RNA, 33 nt, Artificial Sequence
  Synthetic Oligonucleotide; GZMB exon 3; Set C
auggagcugcacagagagcagagugaggauggg

SEQ ID NO: 12279 - RNA, 26 nt, Artificial Sequence
  Synthetic Oligonucleotide; GZMB exon 3; Set C
gagcugcacagagagcagagugagga

SEQ ID NO: 12280 - RNA, 38 nt, Artificial Sequence
  Synthetic Oligonucleotide; GZMB exon 3; Set C
uuuauggagcugcacagagagcagagugaggauggggg

SEQ ID NO: 12281 - RNA, 36 nt, Artificial Sequence
  Synthetic Oligonucleotide; GZMB exon 3; Set C
uuauggagcugcacagagagcagagugaggaugggg

SEQ ID NO: 12282 - RNA, 28 nt, Artificial Sequence
  Synthetic Oligonucleotide; GZMB exon 3; Set C
ggagcugcacagagagcagagugaggau

SEQ ID NO: 12283 - RNA, 32 nt, Artificial Sequence
  Synthetic Oligonucleotide; GZMB exon 3; Set C
auggagcugcacagagagcagagugaggaugg

SEQ ID NO: 12284 - RNA, 30 nt, Artificial Sequence
  Synthetic Oligonucleotide; GZMB exon 3; Set C
uggagcugcacagagagcagagugaggaug

SEQ ID NO: 12285 - RNA, 34 nt, Artificial Sequence
  Synthetic Oligonucleotide; GZMB exon 3; Set C
uauggagcugcacagagagcagagugaggauggg

SEQ ID NO: 12286 - RNA, 27 nt, Artificial Sequence
  Synthetic Oligonucleotide; GZMB exon 3; Set C
ggagcugcacagagagcagagugagga

SEQ ID NO: 12287 - RNA, 25 nt, Artificial Sequence
  Synthetic Oligonucleotide; GZMB exon 3; Set C
gagcugcacagagagcagagugagg

SEQ ID NO: 12288 - RNA, 39 nt, Artificial Sequence
  Synthetic Oligonucleotide; GZMB exon 3; Set C
auuuauggagcugcacagagagcagagugaggauggggg

SEQ ID NO: 12289 - RNA, 37 nt, Artificial Sequence
  Synthetic Oligonucleotide; GZMB exon 3; Set C
uuuauggagcugcacagagagcagagugaggaugggg

SEQ ID NO: 12290 - RNA, 29 nt, Artificial Sequence
  Synthetic Oligonucleotide; GZMB exon 3; Set C
uggagcugcacagagagcagagugaggau

SEQ ID NO: 12291 - RNA, 33 nt, Artificial Sequence
  Synthetic Oligonucleotide; GZMB exon 3; Set C
uauggagcugcacagagagcagagugaggaugg

SEQ ID NO: 12292 - RNA, 31 nt, Artificial Sequence
  Synthetic Oligonucleotide; GZMB exon 3; Set C
auggagcugcacagagagcagagugaggaug

SEQ ID NO: 12293 - RNA, 35 nt, Artificial Sequence
  Synthetic Oligonucleotide; GZMB exon 3; Set C
uuauggagcugcacagagagcagagugaggauggg

SEQ ID NO: 12294 - RNA, 28 nt, Artificial Sequence
  Synthetic Oligonucleotide; GZMB exon 3; Set C
uggagcugcacagagagcagagugagga

SEQ ID NO: 12295 - RNA, 26 nt, Artificial Sequence
  Synthetic Oligonucleotide; GZMB exon 3; Set C
ggagcugcacagagagcagagugagg

SEQ ID NO: 12296 - RNA, 24 nt, Artificial Sequence
  Synthetic Oligonucleotide; GZMB exon 3; Set A
gagcugcacagagagcagagugag

SEQ ID NO: 12297 - RNA, 40 nt, Artificial Sequence
  Synthetic Oligonucleotide; GZMB exon 3; Set C
cauuuauggagcugcacagagagcagagugaggauggggg

SEQ ID NO: 12298 - RNA, 38 nt, Artificial Sequence
  Synthetic Oligonucleotide; GZMB exon 3; Set C
auuuauggagcugcacagagagcagagugaggaugggg

SEQ ID NO: 12299 - RNA, 30 nt, Artificial Sequence
  Synthetic Oligonucleotide; GZMB exon 3; Set C
auggagcugcacagagagcagagugaggau

SEQ ID NO: 12300 - RNA, 34 nt, Artificial Sequence
  Synthetic Oligonucleotide; GZMB exon 3; Set C
uuauggagcugcacagagagcagagugaggaugg

SEQ ID NO: 12301 - RNA, 32 nt, Artificial Sequence
  Synthetic Oligonucleotide; GZMB exon 3; Set C
uauggagcugcacagagagcagagugaggaug

SEQ ID NO: 12302 - RNA, 36 nt, Artificial Sequence
  Synthetic Oligonucleotide; GZMB exon 3; Set C
uuuauggagcugcacagagagcagagugaggauggg

SEQ ID NO: 12303 - RNA, 29 nt, Artificial Sequence
  Synthetic Oligonucleotide; GZMB exon 3; Set C
auggagcugcacagagagcagagugagga

SEQ ID NO: 12304 - RNA, 23 nt, Artificial Sequence
  Synthetic Oligonucleotide; GZMB exon 3; Set A
gagcugcacagagagcagaguga

SEQ ID NO: 12305 - RNA, 27 nt, Artificial Sequence
  Synthetic Oligonucleotide; GZMB exon 3; Set C
uggagcugcacagagagcagagugagg

SEQ ID NO: 12306 - RNA, 25 nt, Artificial Sequence
  Synthetic Oligonucleotide; GZMB exon 3; Set C
ggagcugcacagagagcagagugag

SEQ ID NO: 12307 - RNA, 39 nt, Artificial Sequence
  Synthetic Oligonucleotide; GZMB exon 3; Set C
cauuuauggagcugcacagagagcagagugaggaugggg

SEQ ID NO: 12308 - RNA, 31 nt, Artificial Sequence
  Synthetic Oligonucleotide; GZMB exon 3; Set C
uauggagcugcacagagagcagagugaggau

SEQ ID NO: 12309 - RNA, 35 nt, Artificial Sequence
  Synthetic Oligonucleotide; GZMB exon 3; Set C
uuuauggagcugcacagagagcagagugaggaugg

SEQ ID NO: 12310 - RNA, 33 nt, Artificial Sequence
  Synthetic Oligonucleotide; GZMB exon 3; Set C
uuauggagcugcacagagagcagagugaggaug

SEQ ID NO: 12311 - RNA, 37 nt, Artificial Sequence
  Synthetic Oligonucleotide; GZMB exon 3; Set C
auuuauggagcugcacagagagcagagugaggauggg

SEQ ID NO: 12312 - RNA, 22 nt, Artificial Sequence
  Synthetic Oligonucleotide; GZMB exon 3; Set A
gagcugcacagagagcagagug

SEQ ID NO: 12313 - RNA, 30 nt, Artificial Sequence
  Synthetic Oligonucleotide; GZMB exon 3; Set C
uauggagcugcacagagagcagagugagga

SEQ ID NO: 12314 - RNA, 24 nt, Artificial Sequence
  Synthetic Oligonucleotide; GZMB exon 3; Set C
ggagcugcacagagagcagaguga

SEQ ID NO: 12315 - RNA, 28 nt, Artificial Sequence
  Synthetic Oligonucleotide; GZMB exon 3; Set C
auggagcugcacagagagcagagugagg

SEQ ID NO: 12316 - RNA, 26 nt, Artificial Sequence
  Synthetic Oligonucleotide; GZMB exon 3; Set C
uggagcugcacagagagcagagugag

SEQ ID NO: 12317 - RNA, 40 nt, Artificial Sequence
  Synthetic Oligonucleotide; GZMB exon 3; Set C
acauuuauggagcugcacagagagcagagugaggaugggg

SEQ ID NO: 12318 - RNA, 32 nt, Artificial Sequence
  Synthetic Oligonucleotide; GZMB exon 3; Set C
uuauggagcugcacagagagcagagugaggau

SEQ ID NO: 12319 - RNA, 36 nt, Artificial Sequence
  Synthetic Oligonucleotide; GZMB exon 3; Set C
auuuauggagcugcacagagagcagagugaggaugg

SEQ ID NO: 12320 - RNA, 34 nt, Artificial Sequence
  Synthetic Oligonucleotide; GZMB exon 3; Set C
uuuauggagcugcacagagagcagagugaggaug

SEQ ID NO: 12321 - RNA, 38 nt, Artificial Sequence
  Synthetic Oligonucleotide; GZMB exon 3; Set C
cauuuauggagcugcacagagagcagagugaggauggg

SEQ ID NO: 12322 - RNA, 23 nt, Artificial Sequence
  Synthetic Oligonucleotide; GZMB exon 3; Set A
ggagcugcacagagagcagagug

SEQ ID NO: 12323 - RNA, 25 nt, Artificial Sequence
  Synthetic Oligonucleotide; GZMB exon 3; Set C
uggagcugcacagagagcagaguga

SEQ ID NO: 12324 - RNA, 29 nt, Artificial Sequence
  Synthetic Oligonucleotide; GZMB exon 3; Set C
uauggagcugcacagagagcagagugagg

SEQ ID NO: 12325 - RNA, 27 nt, Artificial Sequence
  Synthetic Oligonucleotide; GZMB exon 3; Set C
auggagcugcacagagagcagagugag

SEQ ID NO: 12326 - RNA, 21 nt, Artificial Sequence
  Synthetic Oligonucleotide; GZMB exon 3; Set A
gagcugcacagagagcagagu

SEQ ID NO: 12327 - RNA, 33 nt, Artificial Sequence
  Synthetic Oligonucleotide; GZMB exon 3; Set C
uuuauggagcugcacagagagcagagugaggau

SEQ ID NO: 12328 - RNA, 35 nt, Artificial Sequence
  Synthetic Oligonucleotide; GZMB exon 3; Set C
auuuauggagcugcacagagagcagagugaggaug

SEQ ID NO: 12329 - RNA, 37 nt, Artificial Sequence
  Synthetic Oligonucleotide; GZMB exon 3; Set C
cauuuauggagcugcacagagagcagagugaggaugg

SEQ ID NO: 12330 - RNA, 39 nt, Artificial Sequence
  Synthetic Oligonucleotide; GZMB exon 3; Set C
acauuuauggagcugcacagagagcagagugaggauggg

SEQ ID NO: 12331 - RNA, 24 nt, Artificial Sequence
  Synthetic Oligonucleotide; GZMB exon 3; Set A
uggagcugcacagagagcagagug

SEQ ID NO: 12332 - RNA, 26 nt, Artificial Sequence
  Synthetic Oligonucleotide; GZMB exon 3; Set C
auggagcugcacagagagcagaguga

SEQ ID NO: 12333 - RNA, 30 nt, Artificial Sequence
  Synthetic Oligonucleotide; GZMB exon 3; Set C
uuauggagcugcacagagagcagagugagg

SEQ ID NO: 12334 - RNA, 28 nt, Artificial Sequence
  Synthetic Oligonucleotide; GZMB exon 3; Set C
uauggagcugcacagagagcagagugag

SEQ ID NO: 12335 - RNA, 22 nt, Artificial Sequence
  Synthetic Oligonucleotide; GZMB exon 3; Set A
ggagcugcacagagagcagagu

SEQ ID NO: 12336 - RNA, 34 nt, Artificial Sequence
  Synthetic Oligonucleotide; GZMB exon 3; Set C
auuuauggagcugcacagagagcagagugaggau

SEQ ID NO: 12337 - RNA, 36 nt, Artificial Sequence
  Synthetic Oligonucleotide; GZMB exon 3; Set C
cauuuauggagcugcacagagagcagagugaggaug

SEQ ID NO: 12338 - RNA, 38 nt, Artificial Sequence
  Synthetic Oligonucleotide; GZMB exon 3; Set C
acauuuauggagcugcacagagagcagagugaggaugg

SEQ ID NO: 12339 - RNA, 40 nt, Artificial Sequence
  Synthetic Oligonucleotide; GZMB exon 3; Set C
gacauuuauggagcugcacagagagcagagugaggauggg

SEQ ID NO: 12340 - RNA, 25 nt, Artificial Sequence
  Synthetic Oligonucleotide; GZMB exon 3; Set A
auggagcugcacagagagcagagug

SEQ ID NO: 12341 - RNA, 27 nt, Artificial Sequence
  Synthetic Oligonucleotide; GZMB exon 3; Set C
uauggagcugcacagagagcagaguga

SEQ ID NO: 12342 - RNA, 31 nt, Artificial Sequence
  Synthetic Oligonucleotide; GZMB exon 3; Set C
uuuauggagcugcacagagagcagagugagg

SEQ ID NO: 12343 - RNA, 29 nt, Artificial Sequence
  Synthetic Oligonucleotide; GZMB exon 3; Set C
uuauggagcugcacagagagcagagugag

SEQ ID NO: 12344 - RNA, 23 nt, Artificial Sequence
  Synthetic Oligonucleotide; GZMB exon 3; Set A
uggagcugcacagagagcagagu

SEQ ID NO: 12345 - RNA, 35 nt, Artificial Sequence
  Synthetic Oligonucleotide; GZMB exon 3; Set C
cauuuauggagcugcacagagagcagagugaggau

SEQ ID NO: 12346 - RNA, 37 nt, Artificial Sequence
  Synthetic Oligonucleotide; GZMB exon 3; Set C
acauuuauggagcugcacagagagcagagugaggaug

SEQ ID NO: 12347 - RNA, 39 nt, Artificial Sequence
  Synthetic Oligonucleotide; GZMB exon 3; Set C
gacauuuauggagcugcacagagagcagagugaggaugg

SEQ ID NO: 12348 - RNA, 26 nt, Artificial Sequence
  Synthetic Oligonucleotide; GZMB exon 3; Set A
uauggagcugcacagagagcagagug

SEQ ID NO: 12349 - RNA, 34 nt, Artificial Sequence
  Synthetic Oligonucleotide; GZMB exon 3; Set C
cauuuauggagcugcacagagagcagagugagga

SEQ ID NO: 12350 - RNA, 28 nt, Artificial Sequence
  Synthetic Oligonucleotide; GZMB exon 3; Set C
uuauggagcugcacagagagcagaguga

SEQ ID NO: 12351 - RNA, 32 nt, Artificial Sequence
  Synthetic Oligonucleotide; GZMB exon 3; Set C
auuuauggagcugcacagagagcagagugagg

SEQ ID NO: 12352 - RNA, 30 nt, Artificial Sequence
  Synthetic Oligonucleotide; GZMB exon 3; Set C
uuuauggagcugcacagagagcagagugag

SEQ ID NO: 12353 - RNA, 24 nt, Artificial Sequence
  Synthetic Oligonucleotide; GZMB exon 3; Set A
auggagcugcacagagagcagagu

SEQ ID NO: 12354 - RNA, 36 nt, Artificial Sequence
  Synthetic Oligonucleotide; GZMB exon 3; Set C
acauuuauggagcugcacagagagcagagugaggau

SEQ ID NO: 12355 - RNA, 40 nt, Artificial Sequence
  Synthetic Oligonucleotide; GZMB exon 3; Set C
ugacauuuauggagcugcacagagagcagagugaggaugg

SEQ ID NO: 12356 - RNA, 38 nt, Artificial Sequence
  Synthetic Oligonucleotide; GZMB exon 3; Set C
gacauuuauggagcugcacagagagcagagugaggaug

SEQ ID NO: 12357 - RNA, 27 nt, Artificial Sequence
  Synthetic Oligonucleotide; GZMB exon 3; Set A
uuauggagcugcacagagagcagagug

SEQ ID NO: 12358 - RNA, 35 nt, Artificial Sequence
  Synthetic Oligonucleotide; GZMB exon 3; Set C
acauuuauggagcugcacagagagcagagugagga

SEQ ID NO: 12359 - RNA, 29 nt, Artificial Sequence
  Synthetic Oligonucleotide; GZMB exon 3; Set C
uuuauggagcugcacagagagcagaguga

SEQ ID NO: 12360 - RNA, 31 nt, Artificial Sequence
  Synthetic Oligonucleotide; GZMB exon 3; Set C
auuuauggagcugcacagagagcagagugag

SEQ ID NO: 12361 - RNA, 33 nt, Artificial Sequence
  Synthetic Oligonucleotide; GZMB exon 3; Set C
cauuuauggagcugcacagagagcagagugagg

SEQ ID NO: 12362 - RNA, 25 nt, Artificial Sequence
  Synthetic Oligonucleotide; GZMB exon 3; Set A
uauggagcugcacagagagcagagu

SEQ ID NO: 12363 - RNA, 37 nt, Artificial Sequence
  Synthetic Oligonucleotide; GZMB exon 3; Set C
gacauuuauggagcugcacagagagcagagugaggau

SEQ ID NO: 12364 - RNA, 39 nt, Artificial Sequence
  Synthetic Oligonucleotide; GZMB exon 3; Set C
ugacauuuauggagcugcacagagagcagagugaggaug

SEQ ID NO: 12365 - RNA, 28 nt, Artificial Sequence
  Synthetic Oligonucleotide; GZMB exon 3; Set A
uuuauggagcugcacagagagcagagug

SEQ ID NO: 12366 - RNA, 36 nt, Artificial Sequence
  Synthetic Oligonucleotide; GZMB exon 3; Set C
gacauuuauggagcugcacagagagcagagugagga

SEQ ID NO: 12367 - RNA, 30 nt, Artificial Sequence
  Synthetic Oligonucleotide; GZMB exon 3; Set C
auuuauggagcugcacagagagcagaguga

SEQ ID NO: 12368 - RNA, 32 nt, Artificial Sequence
  Synthetic Oligonucleotide; GZMB exon 3; Set C
cauuuauggagcugcacagagagcagagugag

SEQ ID NO: 12369 - RNA, 34 nt, Artificial Sequence
  Synthetic Oligonucleotide; GZMB exon 3; Set C
acauuuauggagcugcacagagagcagagugagg

SEQ ID NO: 12370 - RNA, 26 nt, Artificial Sequence
  Synthetic Oligonucleotide; GZMB exon 3; Set A
uuauggagcugcacagagagcagagu

SEQ ID NO: 12371 - RNA, 38 nt, Artificial Sequence
  Synthetic Oligonucleotide; GZMB exon 3; Set C
ugacauuuauggagcugcacagagagcagagugaggau

SEQ ID NO: 12372 - RNA, 40 nt, Artificial Sequence
  Synthetic Oligonucleotide; GZMB exon 3; Set C
gugacauuuauggagcugcacagagagcagagugaggaug

SEQ ID NO: 12373 - RNA, 29 nt, Artificial Sequence
  Synthetic Oligonucleotide; GZMB exon 3; Set A
auuuauggagcugcacagagagcagagug

SEQ ID NO: 12374 - RNA, 37 nt, Artificial Sequence
  Synthetic Oligonucleotide; GZMB exon 3; Set C
ugacauuuauggagcugcacagagagcagagugagga

SEQ ID NO: 12375 - RNA, 31 nt, Artificial Sequence
  Synthetic Oligonucleotide; GZMB exon 3; Set C
cauuuauggagcugcacagagagcagaguga

SEQ ID NO: 12376 - RNA, 33 nt, Artificial Sequence
  Synthetic Oligonucleotide; GZMB exon 3; Set C
acauuuauggagcugcacagagagcagagugag

SEQ ID NO: 12377 - RNA, 35 nt, Artificial Sequence
  Synthetic Oligonucleotide; GZMB exon 3; Set C
gacauuuauggagcugcacagagagcagagugagg

SEQ ID NO: 12378 - RNA, 27 nt, Artificial Sequence
  Synthetic Oligonucleotide; GZMB exon 3; Set A
uuuauggagcugcacagagagcagagu

SEQ ID NO: 12379 - RNA, 39 nt, Artificial Sequence
  Synthetic Oligonucleotide; GZMB exon 3; Set C
gugacauuuauggagcugcacagagagcagagugaggau

SEQ ID NO: 12380 - RNA, 30 nt, Artificial Sequence
  Synthetic Oligonucleotide; GZMB exon 3; Set C
cauuuauggagcugcacagagagcagagug

SEQ ID NO: 12381 - RNA, 38 nt, Artificial Sequence
  Synthetic Oligonucleotide; GZMB exon 3; Set C
gugacauuuauggagcugcacagagagcagagugagga

SEQ ID NO: 12382 - RNA, 32 nt, Artificial Sequence
  Synthetic Oligonucleotide; GZMB exon 3; Set C
acauuuauggagcugcacagagagcagaguga

SEQ ID NO: 12383 - RNA, 36 nt, Artificial Sequence
  Synthetic Oligonucleotide; GZMB exon 3; Set C
ugacauuuauggagcugcacagagagcagagugagg

SEQ ID NO: 12384 - RNA, 34 nt, Artificial Sequence
  Synthetic Oligonucleotide; GZMB exon 3; Set C
gacauuuauggagcugcacagagagcagagugag

SEQ ID NO: 12385 - RNA, 28 nt, Artificial Sequence
  Synthetic Oligonucleotide; GZMB exon 3; Set A
auuuauggagcugcacagagagcagagu

SEQ ID NO: 12386 - RNA, 40 nt, Artificial Sequence
  Synthetic Oligonucleotide; GZMB exon 3; Set C
ggugacauuuauggagcugcacagagagcagagugaggau

SEQ ID NO: 12387 - RNA, 31 nt, Artificial Sequence
  Synthetic Oligonucleotide; GZMB exon 3; Set C
acauuuauggagcugcacagagagcagagug

SEQ ID NO: 12388 - RNA, 33 nt, Artificial Sequence
  Synthetic Oligonucleotide; GZMB exon 3; Set C
gacauuuauggagcugcacagagagcagaguga

SEQ ID NO: 12389 - RNA, 37 nt, Artificial Sequence
  Synthetic Oligonucleotide; GZMB exon 3; Set C
gugacauuuauggagcugcacagagagcagagugagg

SEQ ID NO: 12390 - RNA, 35 nt, Artificial Sequence
  Synthetic Oligonucleotide; GZMB exon 3; Set C
ugacauuuauggagcugcacagagagcagagugag

SEQ ID NO: 12391 - RNA, 29 nt, Artificial Sequence
  Synthetic Oligonucleotide; GZMB exon 3; Set C
cauuuauggagcugcacagagagcagagu

SEQ ID NO: 12392 - RNA, 15 nt, Artificial Sequence
  Synthetic Oligonucleotide; GZMB exon 3; Set C
ggagcugcacagaga

SEQ ID NO: 12393 - RNA, 32 nt, Artificial Sequence
  Synthetic Oligonucleotide; GZMB exon 3; Set C
gacauuuauggagcugcacagagagcagagug

SEQ ID NO: 12394 - RNA, 34 nt, Artificial Sequence
  Synthetic Oligonucleotide; GZMB exon 3; Set C
ugacauuuauggagcugcacagagagcagaguga

SEQ ID NO: 12395 - RNA, 36 nt, Artificial Sequence
  Synthetic Oligonucleotide; GZMB exon 3; Set C
gugacauuuauggagcugcacagagagcagagugag

SEQ ID NO: 12396 - RNA, 30 nt, Artificial Sequence
  Synthetic Oligonucleotide; GZMB exon 3; Set C
acauuuauggagcugcacagagagcagagu

SEQ ID NO: 12397 - RNA, 16 nt, Artificial Sequence
  Synthetic Oligonucleotide; GZMB exon 3; Set C
uggagcugcacagaga

SEQ ID NO: 12398 - RNA, 33 nt, Artificial Sequence
  Synthetic Oligonucleotide; GZMB exon 3; Set C
ugacauuuauggagcugcacagagagcagagug

SEQ ID NO: 12399 - RNA, 35 nt, Artificial Sequence
  Synthetic Oligonucleotide; GZMB exon 3; Set C
gugacauuuauggagcugcacagagagcagaguga

SEQ ID NO: 12400 - RNA, 39 nt, Artificial Sequence
  Synthetic Oligonucleotide; GZMB exon 3; Set C
aggugacauuuauggagcugcacagagagcagagugagg

SEQ ID NO: 12401 - RNA, 31 nt, Artificial Sequence
  Synthetic Oligonucleotide; GZMB exon 3; Set C
gacauuuauggagcugcacagagagcagagu

SEQ ID NO: 12402 - RNA, 15 nt, Artificial Sequence
  Synthetic Oligonucleotide; GZMB exon 3; Set C
uggagcugcacagag

SEQ ID NO: 12403 - RNA, 34 nt, Artificial Sequence
  Synthetic Oligonucleotide; GZMB exon 3; Set C
gugacauuuauggagcugcacagagagcagagug

SEQ ID NO: 12404 - RNA, 38 nt, Artificial Sequence
  Synthetic Oligonucleotide; GZMB exon 3; Set C
aggugacauuuauggagcugcacagagagcagagugag

SEQ ID NO: 12405 - RNA, 32 nt, Artificial Sequence
  Synthetic Oligonucleotide; GZMB exon 3; Set C
ugacauuuauggagcugcacagagagcagagu

SEQ ID NO: 12406 - RNA, 37 nt, Artificial Sequence
  Synthetic Oligonucleotide; GZMB exon 3; Set C
aggugacauuuauggagcugcacagagagcagaguga

SEQ ID NO: 12407 - RNA, 33 nt, Artificial Sequence
  Synthetic Oligonucleotide; GZMB exon 3; Set C
gugacauuuauggagcugcacagagagcagagu

SEQ ID NO: 12408 - RNA, 15 nt, Artificial Sequence
  Synthetic Oligonucleotide; GZMB exon 3; Set C
auggagcugcacaga

SEQ ID NO: 12409 - RNA, 36 nt, Artificial Sequence
  Synthetic Oligonucleotide; GZMB exon 3; Set C
aggugacauuuauggagcugcacagagagcagagug

SEQ ID NO: 12410 - RNA, 34 nt, Artificial Sequence
  Synthetic Oligonucleotide; GZMB exon 3; Set C
ggugacauuuauggagcugcacagagagcagagu

SEQ ID NO: 12411 - RNA, 35 nt, Artificial Sequence
  Synthetic Oligonucleotide; GZMB exon 3; Set C
aggugacauuuauggagcugcacagagagcagagu

SEQ ID NO: 12412 - RNA, 23 nt, Artificial Sequence
  Synthetic Oligonucleotide; GZMB exon 3; Set A
acauuuauggagcugcacagaga

SEQ ID NO: 12413 - RNA, 24 nt, Artificial Sequence
  Synthetic Oligonucleotide; GZMB exon 3; Set A
gacauuuauggagcugcacagaga

SEQ ID NO: 12414 - RNA, 22 nt, Artificial Sequence
  Synthetic Oligonucleotide; GZMB exon 3; Set A
acauuuauggagcugcacagag

SEQ ID NO: 12415 - RNA, 23 nt, Artificial Sequence
  Synthetic Oligonucleotide; GZMB exon 3; Set A
gacauuuauggagcugcacagag

SEQ ID NO: 12416 - RNA, 21 nt, Artificial Sequence
  Synthetic Oligonucleotide; GZMB exon 3; Set A
acauuuauggagcugcacaga

SEQ ID NO: 12417 - RNA, 19 nt, Artificial Sequence
  Synthetic Oligonucleotide; GZMB exon 3; Set C
cauuuauggagcugcacag

SEQ ID NO: 12418 - RNA, 15 nt, Artificial Sequence
  Synthetic Oligonucleotide; GZMB exon 3; Set C
uuuauggagcugcac

SEQ ID NO: 12419 - RNA, 18 nt, Artificial Sequence
  Synthetic Oligonucleotide; GZMB exon 3; Set C
cauuuauggagcugcaca

SEQ ID NO: 12420 - RNA, 22 nt, Artificial Sequence
  Synthetic Oligonucleotide; GZMB exon 3; Set A
gacauuuauggagcugcacaga

SEQ ID NO: 12421 - RNA, 20 nt, Artificial Sequence
  Synthetic Oligonucleotide; GZMB exon 3; Set C
acauuuauggagcugcacag

SEQ ID NO: 12422 - RNA, 16 nt, Artificial Sequence
  Synthetic Oligonucleotide; GZMB exon 3; Set C
auuuauggagcugcac

SEQ ID NO: 12423 - RNA, 19 nt, Artificial Sequence
  Synthetic Oligonucleotide; GZMB exon 3; Set C
acauuuauggagcugcaca

SEQ ID NO: 12424 - RNA, 23 nt, Artificial Sequence
  Synthetic Oligonucleotide; GZMB exon 3; Set A
ugacauuuauggagcugcacaga

SEQ ID NO: 12425 - RNA, 21 nt, Artificial Sequence
  Synthetic Oligonucleotide; GZMB exon 3; Set A
gacauuuauggagcugcacag

SEQ ID NO: 12426 - RNA, 17 nt, Artificial Sequence
  Synthetic Oligonucleotide; GZMB exon 3; Set C
cauuuauggagcugcac

SEQ ID NO: 12427 - RNA, 15 nt, Artificial Sequence
  Synthetic Oligonucleotide; GZMB exon 3; Set C
auuuauggagcugca

SEQ ID NO: 12428 - RNA, 20 nt, Artificial Sequence
  Synthetic Oligonucleotide; GZMB exon 3; Set A
gacauuuauggagcugcaca

SEQ ID NO: 12429 - RNA, 24 nt, Artificial Sequence
  Synthetic Oligonucleotide; GZMB exon 3; Set A
gugacauuuauggagcugcacaga

SEQ ID NO: 12430 - RNA, 22 nt, Artificial Sequence
  Synthetic Oligonucleotide; GZMB exon 3; Set A
ugacauuuauggagcugcacag

SEQ ID NO: 12431 - RNA, 18 nt, Artificial Sequence
  Synthetic Oligonucleotide; GZMB exon 3; Set C
acauuuauggagcugcac

SEQ ID NO: 12432 - RNA, 16 nt, Artificial Sequence
  Synthetic Oligonucleotide; GZMB exon 3; Set C
cauuuauggagcugca

SEQ ID NO: 12433 - RNA, 21 nt, Artificial Sequence
  Synthetic Oligonucleotide; GZMB exon 3; Set A
ugacauuuauggagcugcaca

SEQ ID NO: 12434 - RNA, 23 nt, Artificial Sequence
  Synthetic Oligonucleotide; GZMB exon 3; Set A
gugacauuuauggagcugcacag

SEQ ID NO: 12435 - RNA, 19 nt, Artificial Sequence
  Synthetic Oligonucleotide; GZMB exon 3; Set C
gacauuuauggagcugcac

SEQ ID NO: 12436 - RNA, 15 nt, Artificial Sequence
  Synthetic Oligonucleotide; GZMB exon 3; Set C
cauuuauggagcugc

SEQ ID NO: 12437 - RNA, 22 nt, Artificial Sequence
  Synthetic Oligonucleotide; GZMB exon 3; Set A
gugacauuuauggagcugcaca

SEQ ID NO: 12438 - RNA, 20 nt, Artificial Sequence
  Synthetic Oligonucleotide; GZMB exon 3; Set C
ugacauuuauggagcugcac

SEQ ID NO: 12439 - RNA, 21 nt, Artificial Sequence
  Synthetic Oligonucleotide; GZMB exon 3; Set A
gugacauuuauggagcugcac

SEQ ID NO: 12440 - RNA, 19 nt, Artificial Sequence
  Synthetic Oligonucleotide; GZMB exon 3; Set C
ugacauuuauggagcugca

SEQ ID NO: 12441 - RNA, 22 nt, Artificial Sequence
  Synthetic Oligonucleotide; GZMB exon 3; Set A
ggugacauuuauggagcugcac

SEQ ID NO: 12442 - RNA, 20 nt, Artificial Sequence
  Synthetic Oligonucleotide; GZMB exon 3; Set C
gugacauuuauggagcugca

SEQ ID NO: 12443 - RNA, 18 nt, Artificial Sequence
  Synthetic Oligonucleotide; GZMB exon 3; Set C
ugacauuuauggagcugc

SEQ ID NO: 12444 - RNA, 23 nt, Artificial Sequence
  Synthetic Oligonucleotide; GZMB exon 3; Set A
aggugacauuuauggagcugcac

SEQ ID NO: 12445 - RNA, 21 nt, Artificial Sequence
  Synthetic Oligonucleotide; GZMB exon 3; Set A
ggugacauuuauggagcugca

SEQ ID NO: 12446 - RNA, 19 nt, Artificial Sequence
  Synthetic Oligonucleotide; GZMB exon 3; Set C
gugacauuuauggagcugc

SEQ ID NO: 12447 - RNA, 22 nt, Artificial Sequence
  Synthetic Oligonucleotide; GZMB exon 3; Set A
aggugacauuuauggagcugca

SEQ ID NO: 12448 - RNA, 20 nt, Artificial Sequence
  Synthetic Oligonucleotide; GZMB exon 3; Set A
ggugacauuuauggagcugc

SEQ ID NO: 12449 - RNA, 21 nt, Artificial Sequence
  Synthetic Oligonucleotide; GZMB exon 3; Set A
aggugacauuuauggagcugc

SEQ ID NO: 12450 - RNA, 37 nt, Artificial Sequence
  Synthetic Oligonucleotide; GZMB exon 3; Set C
gggcccccaaggugacauuuauggagcugcacagaga

SEQ ID NO: 12451 - RNA, 38 nt, Artificial Sequence
  Synthetic Oligonucleotide; GZMB exon 3; Set C
ugggcccccaaggugacauuuauggagcugcacagaga

SEQ ID NO: 12452 - RNA, 36 nt, Artificial Sequence
  Synthetic Oligonucleotide; GZMB exon 3; Set C
gggcccccaaggugacauuuauggagcugcacagag

SEQ ID NO: 12453 - RNA, 39 nt, Artificial Sequence
  Synthetic Oligonucleotide; GZMB exon 3; Set C
gugggcccccaaggugacauuuauggagcugcacagaga

SEQ ID NO: 12454 - RNA, 37 nt, Artificial Sequence
  Synthetic Oligonucleotide; GZMB exon 3; Set C
ugggcccccaaggugacauuuauggagcugcacagag

SEQ ID NO: 12455 - RNA, 35 nt, Artificial Sequence
  Synthetic Oligonucleotide; GZMB exon 3; Set C
gggcccccaaggugacauuuauggagcugcacaga

SEQ ID NO: 12456 - RNA, 40 nt, Artificial Sequence
  Synthetic Oligonucleotide; GZMB exon 3; Set C
ugugggcccccaaggugacauuuauggagcugcacagaga

SEQ ID NO: 12457 - RNA, 38 nt, Artificial Sequence
  Synthetic Oligonucleotide; GZMB exon 3; Set C
gugggcccccaaggugacauuuauggagcugcacagag

SEQ ID NO: 12458 - RNA, 36 nt, Artificial Sequence
  Synthetic Oligonucleotide; GZMB exon 3; Set C
ugggcccccaaggugacauuuauggagcugcacaga

SEQ ID NO: 12459 - RNA, 34 nt, Artificial Sequence
  Synthetic Oligonucleotide; GZMB exon 3; Set C
gggcccccaaggugacauuuauggagcugcacag

SEQ ID NO: 12460 - RNA, 39 nt, Artificial Sequence
  Synthetic Oligonucleotide; GZMB exon 3; Set C
ugugggcccccaaggugacauuuauggagcugcacagag

SEQ ID NO: 12461 - RNA, 33 nt, Artificial Sequence
  Synthetic Oligonucleotide; GZMB exon 3; Set C
gggcccccaaggugacauuuauggagcugcaca

SEQ ID NO: 12462 - RNA, 37 nt, Artificial Sequence
  Synthetic Oligonucleotide; GZMB exon 3; Set C
gugggcccccaaggugacauuuauggagcugcacaga

SEQ ID NO: 12463 - RNA, 35 nt, Artificial Sequence
  Synthetic Oligonucleotide; GZMB exon 3; Set C
ugggcccccaaggugacauuuauggagcugcacag

SEQ ID NO: 12464 - RNA, 40 nt, Artificial Sequence
  Synthetic Oligonucleotide; GZMB exon 3; Set C
uugugggcccccaaggugacauuuauggagcugcacagag

SEQ ID NO: 12465 - RNA, 34 nt, Artificial Sequence
  Synthetic Oligonucleotide; GZMB exon 3; Set C
ugggcccccaaggugacauuuauggagcugcaca

SEQ ID NO: 12466 - RNA, 38 nt, Artificial Sequence
  Synthetic Oligonucleotide; GZMB exon 3; Set C
ugugggcccccaaggugacauuuauggagcugcacaga

SEQ ID NO: 12467 - RNA, 36 nt, Artificial Sequence
  Synthetic Oligonucleotide; GZMB exon 3; Set C
gugggcccccaaggugacauuuauggagcugcacag

SEQ ID NO: 12468 - RNA, 35 nt, Artificial Sequence
  Synthetic Oligonucleotide; GZMB exon 3; Set C
gugggcccccaaggugacauuuauggagcugcaca

SEQ ID NO: 12469 - RNA, 39 nt, Artificial Sequence
  Synthetic Oligonucleotide; GZMB exon 3; Set C
uugugggcccccaaggugacauuuauggagcugcacaga

SEQ ID NO: 12470 - RNA, 37 nt, Artificial Sequence
  Synthetic Oligonucleotide; GZMB exon 3; Set C
ugugggcccccaaggugacauuuauggagcugcacag

SEQ ID NO: 12471 - RNA, 36 nt, Artificial Sequence
  Synthetic Oligonucleotide; GZMB exon 3; Set C
ugugggcccccaaggugacauuuauggagcugcaca

SEQ ID NO: 12472 - RNA, 40 nt, Artificial Sequence
  Synthetic Oligonucleotide; GZMB exon 3; Set C
auugugggcccccaaggugacauuuauggagcugcacaga

SEQ ID NO: 12473 - RNA, 38 nt, Artificial Sequence
  Synthetic Oligonucleotide; GZMB exon 3; Set C
uugugggcccccaaggugacauuuauggagcugcacag

SEQ ID NO: 12474 - RNA, 37 nt, Artificial Sequence
  Synthetic Oligonucleotide; GZMB exon 3; Set C
uugugggcccccaaggugacauuuauggagcugcaca

SEQ ID NO: 12475 - RNA, 39 nt, Artificial Sequence
  Synthetic Oligonucleotide; GZMB exon 3; Set C
auugugggcccccaaggugacauuuauggagcugcacag

SEQ ID NO: 12476 - RNA, 38 nt, Artificial Sequence
  Synthetic Oligonucleotide; GZMB exon 3; Set C
auugugggcccccaaggugacauuuauggagcugcaca

SEQ ID NO: 12477 - RNA, 40 nt, Artificial Sequence
  Synthetic Oligonucleotide; GZMB exon 3; Set C
uauugugggcccccaaggugacauuuauggagcugcacag

SEQ ID NO: 12478 - RNA, 36 nt, Artificial Sequence
  Synthetic Oligonucleotide; GZMB exon 3; Set C
uugugggcccccaaggugacauuuauggagcugcac

SEQ ID NO: 12479 - RNA, 39 nt, Artificial Sequence
  Synthetic Oligonucleotide; GZMB exon 3; Set C
uauugugggcccccaaggugacauuuauggagcugcaca

SEQ ID NO: 12480 - RNA, 37 nt, Artificial Sequence
  Synthetic Oligonucleotide; GZMB exon 3; Set C
auugugggcccccaaggugacauuuauggagcugcac

SEQ ID NO: 12481 - RNA, 40 nt, Artificial Sequence
  Synthetic Oligonucleotide; GZMB exon 3; Set C
auauugugggcccccaaggugacauuuauggagcugcaca

SEQ ID NO: 12482 - RNA, 26 nt, Artificial Sequence
  Synthetic Oligonucleotide; GZMB exon 3; Set C
gggcccccaaggugacauuuauggag

SEQ ID NO: 12483 - RNA, 38 nt, Artificial Sequence
  Synthetic Oligonucleotide; GZMB exon 3; Set C
uauugugggcccccaaggugacauuuauggagcugcac

SEQ ID NO: 12484 - RNA, 25 nt, Artificial Sequence
  Synthetic Oligonucleotide; GZMB exon 3; Set C
gggcccccaaggugacauuuaugga

SEQ ID NO: 12485 - RNA, 27 nt, Artificial Sequence
  Synthetic Oligonucleotide; GZMB exon 3; Set C
ugggcccccaaggugacauuuauggag

SEQ ID NO: 12486 - RNA, 39 nt, Artificial Sequence
  Synthetic Oligonucleotide; GZMB exon 3; Set C
auauugugggcccccaaggugacauuuauggagcugcac

SEQ ID NO: 12487 - RNA, 37 nt, Artificial Sequence
  Synthetic Oligonucleotide; GZMB exon 3; Set C
uauugugggcccccaaggugacauuuauggagcugca

SEQ ID NO: 12488 - RNA, 24 nt, Artificial Sequence
  Synthetic Oligonucleotide; GZMB exon 3; Set C
gggcccccaaggugacauuuaugg

SEQ ID NO: 12489 - RNA, 26 nt, Artificial Sequence
  Synthetic Oligonucleotide; GZMB exon 3; Set C
ugggcccccaaggugacauuuaugga

SEQ ID NO: 12490 - RNA, 28 nt, Artificial Sequence
  Synthetic Oligonucleotide; GZMB exon 3; Set C
gugggcccccaaggugacauuuauggag

SEQ ID NO: 12491 - RNA, 40 nt, Artificial Sequence
  Synthetic Oligonucleotide; GZMB exon 3; Set C
gauauugugggcccccaaggugacauuuauggagcugcac

SEQ ID NO: 12492 - RNA, 38 nt, Artificial Sequence
  Synthetic Oligonucleotide; GZMB exon 3; Set C
auauugugggcccccaaggugacauuuauggagcugca

SEQ ID NO: 12493 - RNA, 23 nt, Artificial Sequence
  Synthetic Oligonucleotide; GZMB exon 3; Set A
gggcccccaaggugacauuuaug

SEQ ID NO: 12494 - RNA, 25 nt, Artificial Sequence
  Synthetic Oligonucleotide; GZMB exon 3; Set C
ugggcccccaaggugacauuuaugg

SEQ ID NO: 12495 - RNA, 27 nt, Artificial Sequence
  Synthetic Oligonucleotide; GZMB exon 3; Set C
gugggcccccaaggugacauuuaugga

SEQ ID NO: 12496 - RNA, 29 nt, Artificial Sequence
  Synthetic Oligonucleotide; GZMB exon 3; Set C
ugugggcccccaaggugacauuuauggag

SEQ ID NO: 12497 - RNA, 39 nt, Artificial Sequence
  Synthetic Oligonucleotide; GZMB exon 3; Set C
gauauugugggcccccaaggugacauuuauggagcugca

SEQ ID NO: 12498 - RNA, 22 nt, Artificial Sequence
  Synthetic Oligonucleotide; GZMB exon 3; Set A
gggcccccaaggugacauuuau

SEQ ID NO: 12499 - RNA, 24 nt, Artificial Sequence
  Synthetic Oligonucleotide; GZMB exon 3; Set A
ugggcccccaaggugacauuuaug

SEQ ID NO: 12500 - RNA, 26 nt, Artificial Sequence
  Synthetic Oligonucleotide; GZMB exon 3; Set C
gugggcccccaaggugacauuuaugg

SEQ ID NO: 12501 - RNA, 28 nt, Artificial Sequence
  Synthetic Oligonucleotide; GZMB exon 3; Set C
ugugggcccccaaggugacauuuaugga

SEQ ID NO: 12502 - RNA, 30 nt, Artificial Sequence
  Synthetic Oligonucleotide; GZMB exon 3; Set C
uugugggcccccaaggugacauuuauggag

SEQ ID NO: 12503 - RNA, 40 nt, Artificial Sequence
  Synthetic Oligonucleotide; GZMB exon 3; Set C
ugauauugugggcccccaaggugacauuuauggagcugca

SEQ ID NO: 12504 - RNA, 38 nt, Artificial Sequence
  Synthetic Oligonucleotide; GZMB exon 3; Set C
gauauugugggcccccaaggugacauuuauggagcugc

SEQ ID NO: 12505 - RNA, 23 nt, Artificial Sequence
  Synthetic Oligonucleotide; GZMB exon 3; Set A
ugggcccccaaggugacauuuau

SEQ ID NO: 12506 - RNA, 21 nt, Artificial Sequence
  Synthetic Oligonucleotide; GZMB exon 3; Set A
gggcccccaaggugacauuua

SEQ ID NO: 12507 - RNA, 25 nt, Artificial Sequence
  Synthetic Oligonucleotide; GZMB exon 3; Set C
gugggcccccaaggugacauuuaug

SEQ ID NO: 12508 - RNA, 27 nt, Artificial Sequence
  Synthetic Oligonucleotide; GZMB exon 3; Set C
ugugggcccccaaggugacauuuaugg

SEQ ID NO: 12509 - RNA, 29 nt, Artificial Sequence
  Synthetic Oligonucleotide; GZMB exon 3; Set C
uugugggcccccaaggugacauuuaugga

SEQ ID NO: 12510 - RNA, 31 nt, Artificial Sequence
  Synthetic Oligonucleotide; GZMB exon 3; Set C
auugugggcccccaaggugacauuuauggag

SEQ ID NO: 12511 - RNA, 39 nt, Artificial Sequence
  Synthetic Oligonucleotide; GZMB exon 3; Set C
ugauauugugggcccccaaggugacauuuauggagcugc

SEQ ID NO: 12512 - RNA, 24 nt, Artificial Sequence
  Synthetic Oligonucleotide; GZMB exon 3; Set C
gugggcccccaaggugacauuuau

SEQ ID NO: 12513 - RNA, 22 nt, Artificial Sequence
  Synthetic Oligonucleotide; GZMB exon 3; Set A
ugggcccccaaggugacauuua

SEQ ID NO: 12514 - RNA, 20 nt, Artificial Sequence
  Synthetic Oligonucleotide; GZMB exon 3; Set A
gggcccccaaggugacauuu

SEQ ID NO: 12515 - RNA, 26 nt, Artificial Sequence
  Synthetic Oligonucleotide; GZMB exon 3; Set C
ugugggcccccaaggugacauuuaug

SEQ ID NO: 12516 - RNA, 28 nt, Artificial Sequence
  Synthetic Oligonucleotide; GZMB exon 3; Set C
uugugggcccccaaggugacauuuaugg

SEQ ID NO: 12517 - RNA, 30 nt, Artificial Sequence
  Synthetic Oligonucleotide; GZMB exon 3; Set C
auugugggcccccaaggugacauuuaugga

SEQ ID NO: 12518 - RNA, 32 nt, Artificial Sequence
  Synthetic Oligonucleotide; GZMB exon 3; Set C
uauugugggcccccaaggugacauuuauggag

SEQ ID NO: 12519 - RNA, 40 nt, Artificial Sequence
  Synthetic Oligonucleotide; GZMB exon 3; Set C
uugauauugugggcccccaaggugacauuuauggagcugc

SEQ ID NO: 12520 - RNA, 25 nt, Artificial Sequence
  Synthetic Oligonucleotide; GZMB exon 3; Set C
ugugggcccccaaggugacauuuau

SEQ ID NO: 12521 - RNA, 23 nt, Artificial Sequence
  Synthetic Oligonucleotide; GZMB exon 3; Set C
gugggcccccaaggugacauuua

SEQ ID NO: 12522 - RNA, 21 nt, Artificial Sequence
  Synthetic Oligonucleotide; GZMB exon 3; Set A
ugggcccccaaggugacauuu

SEQ ID NO: 12523 - RNA, 19 nt, Artificial Sequence
  Synthetic Oligonucleotide; GZMB exon 3; Set A
gggcccccaaggugacauu

SEQ ID NO: 12524 - RNA, 27 nt, Artificial Sequence
  Synthetic Oligonucleotide; GZMB exon 3; Set C
uugugggcccccaaggugacauuuaug

SEQ ID NO: 12525 - RNA, 29 nt, Artificial Sequence
  Synthetic Oligonucleotide; GZMB exon 3; Set C
auugugggcccccaaggugacauuuaugg

SEQ ID NO: 12526 - RNA, 31 nt, Artificial Sequence
  Synthetic Oligonucleotide; GZMB exon 3; Set C
uauugugggcccccaaggugacauuuaugga

SEQ ID NO: 12527 - RNA, 33 nt, Artificial Sequence
  Synthetic Oligonucleotide; GZMB exon 3; Set C
auauugugggcccccaaggugacauuuauggag

SEQ ID NO: 12528 - RNA, 26 nt, Artificial Sequence
  Synthetic Oligonucleotide; GZMB exon 3; Set C
uugugggcccccaaggugacauuuau

SEQ ID NO: 12529 - RNA, 24 nt, Artificial Sequence
  Synthetic Oligonucleotide; GZMB exon 3; Set C
ugugggcccccaaggugacauuua

SEQ ID NO: 12530 - RNA, 22 nt, Artificial Sequence
  Synthetic Oligonucleotide; GZMB exon 3; Set C
gugggcccccaaggugacauuu

SEQ ID NO: 12531 - RNA, 20 nt, Artificial Sequence
  Synthetic Oligonucleotide; GZMB exon 3; Set A
ugggcccccaaggugacauu

SEQ ID NO: 12532 - RNA, 28 nt, Artificial Sequence
  Synthetic Oligonucleotide; GZMB exon 3; Set C
auugugggcccccaaggugacauuuaug

SEQ ID NO: 12533 - RNA, 30 nt, Artificial Sequence
  Synthetic Oligonucleotide; GZMB exon 3; Set C
uauugugggcccccaaggugacauuuaugg

SEQ ID NO: 12534 - RNA, 32 nt, Artificial Sequence
  Synthetic Oligonucleotide; GZMB exon 3; Set C
auauugugggcccccaaggugacauuuaugga

SEQ ID NO: 12535 - RNA, 34 nt, Artificial Sequence
  Synthetic Oligonucleotide; GZMB exon 3; Set C
gauauugugggcccccaaggugacauuuauggag

SEQ ID NO: 12536 - RNA, 25 nt, Artificial Sequence
  Synthetic Oligonucleotide; GZMB exon 3; Set C
uugugggcccccaaggugacauuua

SEQ ID NO: 12537 - RNA, 23 nt, Artificial Sequence
  Synthetic Oligonucleotide; GZMB exon 3; Set C
ugugggcccccaaggugacauuu

SEQ ID NO: 12538 - RNA, 21 nt, Artificial Sequence
  Synthetic Oligonucleotide; GZMB exon 3; Set C
gugggcccccaaggugacauu

SEQ ID NO: 12539 - RNA, 19 nt, Artificial Sequence
  Synthetic Oligonucleotide; GZMB exon 3; Set A
ugggcccccaaggugacau

SEQ ID NO: 12540 - RNA, 31 nt, Artificial Sequence
  Synthetic Oligonucleotide; GZMB exon 3; Set C
auauugugggcccccaaggugacauuuaugg

SEQ ID NO: 12541 - RNA, 33 nt, Artificial Sequence
  Synthetic Oligonucleotide; GZMB exon 3; Set C
gauauugugggcccccaaggugacauuuaugga

SEQ ID NO: 12542 - RNA, 35 nt, Artificial Sequence
  Synthetic Oligonucleotide; GZMB exon 3; Set C
ugauauugugggcccccaaggugacauuuauggag

SEQ ID NO: 12543 - RNA, 26 nt, Artificial Sequence
  Synthetic Oligonucleotide; GZMB exon 3; Set C
auugugggcccccaaggugacauuua

SEQ ID NO: 12544 - RNA, 24 nt, Artificial Sequence
  Synthetic Oligonucleotide; GZMB exon 3; Set C
uugugggcccccaaggugacauuu

SEQ ID NO: 12545 - RNA, 22 nt, Artificial Sequence
  Synthetic Oligonucleotide; GZMB exon 3; Set C
ugugggcccccaaggugacauu

SEQ ID NO: 12546 - RNA, 20 nt, Artificial Sequence
  Synthetic Oligonucleotide; GZMB exon 3; Set C
gugggcccccaaggugacau

SEQ ID NO: 12547 - RNA, 32 nt, Artificial Sequence
  Synthetic Oligonucleotide; GZMB exon 3; Set C
gauauugugggcccccaaggugacauuuaugg

SEQ ID NO: 12548 - RNA, 34 nt, Artificial Sequence
  Synthetic Oligonucleotide; GZMB exon 3; Set C
ugauauugugggcccccaaggugacauuuaugga

SEQ ID NO: 12549 - RNA, 36 nt, Artificial Sequence
  Synthetic Oligonucleotide; GZMB exon 3; Set C
uugauauugugggcccccaaggugacauuuauggag

SEQ ID NO: 12550 - RNA, 25 nt, Artificial Sequence
  Synthetic Oligonucleotide; GZMB exon 3; Set C
auugugggcccccaaggugacauuu

SEQ ID NO: 12551 - RNA, 23 nt, Artificial Sequence
  Synthetic Oligonucleotide; GZMB exon 3; Set C
uugugggcccccaaggugacauu

SEQ ID NO: 12552 - RNA, 21 nt, Artificial Sequence
  Synthetic Oligonucleotide; GZMB exon 3; Set C
ugugggcccccaaggugacau

SEQ ID NO: 12553 - RNA, 33 nt, Artificial Sequence
  Synthetic Oligonucleotide; GZMB exon 3; Set C
ugauauugugggcccccaaggugacauuuaugg

SEQ ID NO: 12554 - RNA, 35 nt, Artificial Sequence
  Synthetic Oligonucleotide; GZMB exon 3; Set C
uugauauugugggcccccaaggugacauuuaugga

SEQ ID NO: 12555 - RNA, 19 nt, Artificial Sequence
  Synthetic Oligonucleotide; GZMB exon 3; Set C
gugggcccccaaggugaca

SEQ ID NO: 12556 - RNA, 37 nt, Artificial Sequence
  Synthetic Oligonucleotide; GZMB exon 3; Set C
uuugauauugugggcccccaaggugacauuuauggag

SEQ ID NO: 12557 - RNA, 26 nt, Artificial Sequence
  Synthetic Oligonucleotide; GZMB exon 3; Set C
uauugugggcccccaaggugacauuu

SEQ ID NO: 12558 - RNA, 24 nt, Artificial Sequence
  Synthetic Oligonucleotide; GZMB exon 3; Set C
auugugggcccccaaggugacauu

SEQ ID NO: 12559 - RNA, 22 nt, Artificial Sequence
  Synthetic Oligonucleotide; GZMB exon 3; Set C
uugugggcccccaaggugacau

SEQ ID NO: 12560 - RNA, 34 nt, Artificial Sequence
  Synthetic Oligonucleotide; GZMB exon 3; Set C
uugauauugugggcccccaaggugacauuuaugg

SEQ ID NO: 12561 - RNA, 36 nt, Artificial Sequence
  Synthetic Oligonucleotide; GZMB exon 3; Set C
uuugauauugugggcccccaaggugacauuuaugga

SEQ ID NO: 12562 - RNA, 20 nt, Artificial Sequence
  Synthetic Oligonucleotide; GZMB exon 3; Set C
ugugggcccccaaggugaca

SEQ ID NO: 12563 - RNA, 38 nt, Artificial Sequence
  Synthetic Oligonucleotide; GZMB exon 3; Set C
cuuugauauugugggcccccaaggugacauuuauggag

SEQ ID NO: 12564 - RNA, 25 nt, Artificial Sequence
  Synthetic Oligonucleotide; GZMB exon 3; Set C
uauugugggcccccaaggugacauu

SEQ ID NO: 12565 - RNA, 23 nt, Artificial Sequence
  Synthetic Oligonucleotide; GZMB exon 3; Set C
auugugggcccccaaggugacau

SEQ ID NO: 12566 - RNA, 35 nt, Artificial Sequence
  Synthetic Oligonucleotide; GZMB exon 3; Set C
uuugauauugugggcccccaaggugacauuuaugg

SEQ ID NO: 12567 - RNA, 17 nt, Artificial Sequence
  Synthetic Oligonucleotide; GZMB exon 3; Set A
gugggcccccaagguga

SEQ ID NO: 12568 - RNA, 37 nt, Artificial Sequence
  Synthetic Oligonucleotide; GZMB exon 3; Set C
cuuugauauugugggcccccaaggugacauuuaugga

SEQ ID NO: 12569 - RNA, 21 nt, Artificial Sequence
  Synthetic Oligonucleotide; GZMB exon 3; Set C
uugugggcccccaaggugaca

SEQ ID NO: 12570 - RNA, 19 nt, Artificial Sequence
  Synthetic Oligonucleotide; GZMB exon 3; Set A
ugugggcccccaaggugac

SEQ ID NO: 12571 - RNA, 39 nt, Artificial Sequence
  Synthetic Oligonucleotide; GZMB exon 3; Set C
ucuuugauauugugggcccccaaggugacauuuauggag

SEQ ID NO: 12572 - RNA, 26 nt, Artificial Sequence
  Synthetic Oligonucleotide; GZMB exon 3; Set C
auauugugggcccccaaggugacauu

SEQ ID NO: 12573 - RNA, 24 nt, Artificial Sequence
  Synthetic Oligonucleotide; GZMB exon 3; Set C
uauugugggcccccaaggugacau

SEQ ID NO: 12574 - RNA, 18 nt, Artificial Sequence
  Synthetic Oligonucleotide; GZMB exon 3; Set A
ugugggcccccaagguga

SEQ ID NO: 12575 - RNA, 38 nt, Artificial Sequence
  Synthetic Oligonucleotide; GZMB exon 3; Set C
ucuuugauauugugggcccccaaggugacauuuaugga

SEQ ID NO: 12576 - RNA, 22 nt, Artificial Sequence
  Synthetic Oligonucleotide; GZMB exon 3; Set C
auugugggcccccaaggugaca

SEQ ID NO: 12577 - RNA, 20 nt, Artificial Sequence
  Synthetic Oligonucleotide; GZMB exon 3; Set A
uugugggcccccaaggugac

SEQ ID NO: 12578 - RNA, 40 nt, Artificial Sequence
  Synthetic Oligonucleotide; GZMB exon 3; Set C
uucuuugauauugugggcccccaaggugacauuuauggag

SEQ ID NO: 12579 - RNA, 15 nt, Artificial Sequence
  Synthetic Oligonucleotide; GZMB exon 3; Set A
gugggcccccaaggu

SEQ ID NO: 12580 - RNA, 25 nt, Artificial Sequence
  Synthetic Oligonucleotide; GZMB exon 3; Set C
auauugugggcccccaaggugacau

SEQ ID NO: 12581 - RNA, 19 nt, Artificial Sequence
  Synthetic Oligonucleotide; GZMB exon 3; Set A
uugugggcccccaagguga

SEQ ID NO: 12582 - RNA, 17 nt, Artificial Sequence
  Synthetic Oligonucleotide; GZMB exon 3; Set A
ugugggcccccaaggug

SEQ ID NO: 12583 - RNA, 39 nt, Artificial Sequence
  Synthetic Oligonucleotide; GZMB exon 3; Set C
uucuuugauauugugggcccccaaggugacauuuaugga

SEQ ID NO: 12584 - RNA, 23 nt, Artificial Sequence
  Synthetic Oligonucleotide; GZMB exon 3; Set C
uauugugggcccccaaggugaca

SEQ ID NO: 12585 - RNA, 21 nt, Artificial Sequence
  Synthetic Oligonucleotide; GZMB exon 3; Set A
auugugggcccccaaggugac

SEQ ID NO: 12586 - RNA, 16 nt, Artificial Sequence
  Synthetic Oligonucleotide; GZMB exon 3; Set A
ugugggcccccaaggu

SEQ ID NO: 12587 - RNA, 26 nt, Artificial Sequence
  Synthetic Oligonucleotide; GZMB exon 3; Set C
gauauugugggcccccaaggugacau

SEQ ID NO: 12588 - RNA, 20 nt, Artificial Sequence
  Synthetic Oligonucleotide; GZMB exon 3; Set A
auugugggcccccaagguga

SEQ ID NO: 12589 - RNA, 18 nt, Artificial Sequence
  Synthetic Oligonucleotide; GZMB exon 3; Set A
uugugggcccccaaggug

SEQ ID NO: 12590 - RNA, 40 nt, Artificial Sequence
  Synthetic Oligonucleotide; GZMB exon 3; Set C
guucuuugauauugugggcccccaaggugacauuuaugga

SEQ ID NO: 12591 - RNA, 24 nt, Artificial Sequence
  Synthetic Oligonucleotide; GZMB exon 3; Set C
auauugugggcccccaaggugaca

SEQ ID NO: 12592 - RNA, 22 nt, Artificial Sequence
  Synthetic Oligonucleotide; GZMB exon 3; Set A
uauugugggcccccaaggugac

SEQ ID NO: 12593 - RNA, 17 nt, Artificial Sequence
  Synthetic Oligonucleotide; GZMB exon 3; Set A
uugugggcccccaaggu

SEQ ID NO: 12594 - RNA, 15 nt, Artificial Sequence
  Synthetic Oligonucleotide; GZMB exon 3; Set A
ugugggcccccaagg

SEQ ID NO: 12595 - RNA, 27 nt, Artificial Sequence
  Synthetic Oligonucleotide; GZMB exon 3; Set C
ugauauugugggcccccaaggugacau

SEQ ID NO: 12596 - RNA, 39 nt, Artificial Sequence
  Synthetic Oligonucleotide; GZMB exon 3; Set C
guucuuugauauugugggcccccaaggugacauuuaugg

SEQ ID NO: 12597 - RNA, 21 nt, Artificial Sequence
  Synthetic Oligonucleotide; GZMB exon 3; Set A
uauugugggcccccaagguga

SEQ ID NO: 12598 - RNA, 19 nt, Artificial Sequence
  Synthetic Oligonucleotide; GZMB exon 3; Set A
auugugggcccccaaggug

SEQ ID NO: 12599 - RNA, 25 nt, Artificial Sequence
  Synthetic Oligonucleotide; GZMB exon 3; Set C
gauauugugggcccccaaggugaca

SEQ ID NO: 12600 - RNA, 23 nt, Artificial Sequence
  Synthetic Oligonucleotide; GZMB exon 3; Set A
auauugugggcccccaaggugac

SEQ ID NO: 12601 - RNA, 38 nt, Artificial Sequence
  Synthetic Oligonucleotide; GZMB exon 3; Set C
guucuuugauauugugggcccccaaggugacauuuaug

SEQ ID NO: 12602 - RNA, 18 nt, Artificial Sequence
  Synthetic Oligonucleotide; GZMB exon 3; Set A
auugugggcccccaaggu

SEQ ID NO: 12603 - RNA, 16 nt, Artificial Sequence
  Synthetic Oligonucleotide; GZMB exon 3; Set A
uugugggcccccaagg

SEQ ID NO: 12604 - RNA, 28 nt, Artificial Sequence
  Synthetic Oligonucleotide; GZMB exon 3; Set C
uugauauugugggcccccaaggugacau

SEQ ID NO: 12605 - RNA, 40 nt, Artificial Sequence
  Synthetic Oligonucleotide; GZMB exon 3; Set C
uguucuuugauauugugggcccccaaggugacauuuaugg

SEQ ID NO: 12606 - RNA, 22 nt, Artificial Sequence
  Synthetic Oligonucleotide; GZMB exon 3; Set A
auauugugggcccccaagguga

SEQ ID NO: 12607 - RNA, 20 nt, Artificial Sequence
  Synthetic Oligonucleotide; GZMB exon 3; Set A
uauugugggcccccaaggug

SEQ ID NO: 12608 - RNA, 26 nt, Artificial Sequence
  Synthetic Oligonucleotide; GZMB exon 3; Set C
ugauauugugggcccccaaggugaca

SEQ ID NO: 12609 - RNA, 24 nt, Artificial Sequence
  Synthetic Oligonucleotide; GZMB exon 3; Set C
gauauugugggcccccaaggugac

SEQ ID NO: 12610 - RNA, 37 nt, Artificial Sequence
  Synthetic Oligonucleotide; GZMB exon 3; Set C
guucuuugauauugugggcccccaaggugacauuuau

SEQ ID NO: 12611 - RNA, 39 nt, Artificial Sequence
  Synthetic Oligonucleotide; GZMB exon 3; Set C
uguucuuugauauugugggcccccaaggugacauuuaug

SEQ ID NO: 12612 - RNA, 19 nt, Artificial Sequence
  Synthetic Oligonucleotide; GZMB exon 3; Set A
uauugugggcccccaaggu

SEQ ID NO: 12613 - RNA, 17 nt, Artificial Sequence
  Synthetic Oligonucleotide; GZMB exon 3; Set A
auugugggcccccaagg

SEQ ID NO: 12614 - RNA, 29 nt, Artificial Sequence
  Synthetic Oligonucleotide; GZMB exon 3; Set C
uuugauauugugggcccccaaggugacau

SEQ ID NO: 12615 - RNA, 21 nt, Artificial Sequence
  Synthetic Oligonucleotide; GZMB exon 3; Set A
auauugugggcccccaaggug

SEQ ID NO: 12616 - RNA, 23 nt, Artificial Sequence
  Synthetic Oligonucleotide; GZMB exon 3; Set C
gauauugugggcccccaagguga

SEQ ID NO: 12617 - RNA, 27 nt, Artificial Sequence
  Synthetic Oligonucleotide; GZMB exon 3; Set C
uugauauugugggcccccaaggugaca

SEQ ID NO: 12618 - RNA, 25 nt, Artificial Sequence
  Synthetic Oligonucleotide; GZMB exon 3; Set C
ugauauugugggcccccaaggugac

SEQ ID NO: 12619 - RNA, 38 nt, Artificial Sequence
  Synthetic Oligonucleotide; GZMB exon 3; Set C
uguucuuugauauugugggcccccaaggugacauuuau

SEQ ID NO: 12620 - RNA, 36 nt, Artificial Sequence
  Synthetic Oligonucleotide; GZMB exon 3; Set C
guucuuugauauugugggcccccaaggugacauuua

SEQ ID NO: 12621 - RNA, 20 nt, Artificial Sequence
  Synthetic Oligonucleotide; GZMB exon 3; Set A
auauugugggcccccaaggu

SEQ ID NO: 12622 - RNA, 18 nt, Artificial Sequence
  Synthetic Oligonucleotide; GZMB exon 3; Set A
uauugugggcccccaagg

SEQ ID NO: 12623 - RNA, 30 nt, Artificial Sequence
  Synthetic Oligonucleotide; GZMB exon 3; Set C
cuuugauauugugggcccccaaggugacau

SEQ ID NO: 12624 - RNA, 24 nt, Artificial Sequence
  Synthetic Oligonucleotide; GZMB exon 3; Set C
ugauauugugggcccccaagguga

SEQ ID NO: 12625 - RNA, 22 nt, Artificial Sequence
  Synthetic Oligonucleotide; GZMB exon 3; Set A
gauauugugggcccccaaggug

SEQ ID NO: 12626 - RNA, 28 nt, Artificial Sequence
  Synthetic Oligonucleotide; GZMB exon 3; Set C
uuugauauugugggcccccaaggugaca

SEQ ID NO: 12627 - RNA, 26 nt, Artificial Sequence
  Synthetic Oligonucleotide; GZMB exon 3; Set C
uugauauugugggcccccaaggugac

SEQ ID NO: 12628 - RNA, 37 nt, Artificial Sequence
  Synthetic Oligonucleotide; GZMB exon 3; Set C
uguucuuugauauugugggcccccaaggugacauuua

SEQ ID NO: 12629 - RNA, 35 nt, Artificial Sequence
  Synthetic Oligonucleotide; GZMB exon 3; Set C
guucuuugauauugugggcccccaaggugacauuu

SEQ ID NO: 12630 - RNA, 21 nt, Artificial Sequence
  Synthetic Oligonucleotide; GZMB exon 3; Set A
gauauugugggcccccaaggu

SEQ ID NO: 12631 - RNA, 19 nt, Artificial Sequence
  Synthetic Oligonucleotide; GZMB exon 3; Set A
auauugugggcccccaagg

SEQ ID NO: 12632 - RNA, 31 nt, Artificial Sequence
  Synthetic Oligonucleotide; GZMB exon 3; Set C
ucuuugauauugugggcccccaaggugacau

SEQ ID NO: 12633 - RNA, 25 nt, Artificial Sequence
  Synthetic Oligonucleotide; GZMB exon 3; Set C
uugauauugugggcccccaagguga

SEQ ID NO: 12634 - RNA, 23 nt, Artificial Sequence
  Synthetic Oligonucleotide; GZMB exon 3; Set A
ugauauugugggcccccaaggug

SEQ ID NO: 12635 - RNA, 29 nt, Artificial Sequence
  Synthetic Oligonucleotide; GZMB exon 3; Set C
cuuugauauugugggcccccaaggugaca

SEQ ID NO: 12636 - RNA, 27 nt, Artificial Sequence
  Synthetic Oligonucleotide; GZMB exon 3; Set C
uuugauauugugggcccccaaggugac

SEQ ID NO: 12637 - RNA, 36 nt, Artificial Sequence
  Synthetic Oligonucleotide; GZMB exon 3; Set C
uguucuuugauauugugggcccccaaggugacauuu

SEQ ID NO: 12638 - RNA, 34 nt, Artificial Sequence
  Synthetic Oligonucleotide; GZMB exon 3; Set C
guucuuugauauugugggcccccaaggugacauu

SEQ ID NO: 12639 - RNA, 22 nt, Artificial Sequence
  Synthetic Oligonucleotide; GZMB exon 3; Set A
ugauauugugggcccccaaggu

SEQ ID NO: 12640 - RNA, 20 nt, Artificial Sequence
  Synthetic Oligonucleotide; GZMB exon 3; Set A
gauauugugggcccccaagg

SEQ ID NO: 12641 - RNA, 32 nt, Artificial Sequence
  Synthetic Oligonucleotide; GZMB exon 3; Set C
uucuuugauauugugggcccccaaggugacau

SEQ ID NO: 12642 - RNA, 26 nt, Artificial Sequence
  Synthetic Oligonucleotide; GZMB exon 3; Set C
uuugauauugugggcccccaagguga

SEQ ID NO: 12643 - RNA, 24 nt, Artificial Sequence
  Synthetic Oligonucleotide; GZMB exon 3; Set A
uugauauugugggcccccaaggug

SEQ ID NO: 12644 - RNA, 30 nt, Artificial Sequence
  Synthetic Oligonucleotide; GZMB exon 3; Set C
ucuuugauauugugggcccccaaggugaca

SEQ ID NO: 12645 - RNA, 28 nt, Artificial Sequence
  Synthetic Oligonucleotide; GZMB exon 3; Set C
cuuugauauugugggcccccaaggugac

SEQ ID NO: 12646 - RNA, 35 nt, Artificial Sequence
  Synthetic Oligonucleotide; GZMB exon 3; Set C
uguucuuugauauugugggcccccaaggugacauu

SEQ ID NO: 12647 - RNA, 23 nt, Artificial Sequence
  Synthetic Oligonucleotide; GZMB exon 3; Set A
uugauauugugggcccccaaggu

SEQ ID NO: 12648 - RNA, 21 nt, Artificial Sequence
  Synthetic Oligonucleotide; GZMB exon 3; Set A
ugauauugugggcccccaagg

SEQ ID NO: 12649 - RNA, 33 nt, Artificial Sequence
  Synthetic Oligonucleotide; GZMB exon 3; Set C
guucuuugauauugugggcccccaaggugacau

SEQ ID NO: 12650 - RNA, 27 nt, Artificial Sequence
  Synthetic Oligonucleotide; GZMB exon 3; Set C
cuuugauauugugggcccccaagguga

SEQ ID NO: 12651 - RNA, 25 nt, Artificial Sequence
  Synthetic Oligonucleotide; GZMB exon 3; Set A
uuugauauugugggcccccaaggug

SEQ ID NO: 12652 - RNA, 31 nt, Artificial Sequence
  Synthetic Oligonucleotide; GZMB exon 3; Set C
uucuuugauauugugggcccccaaggugaca

SEQ ID NO: 12653 - RNA, 29 nt, Artificial Sequence
  Synthetic Oligonucleotide; GZMB exon 3; Set C
ucuuugauauugugggcccccaaggugac

SEQ ID NO: 12654 - RNA, 24 nt, Artificial Sequence
  Synthetic Oligonucleotide; GZMB exon 3; Set A
uuugauauugugggcccccaaggu

SEQ ID NO: 12655 - RNA, 22 nt, Artificial Sequence
  Synthetic Oligonucleotide; GZMB exon 3; Set A
uugauauugugggcccccaagg

SEQ ID NO: 12656 - RNA, 34 nt, Artificial Sequence
  Synthetic Oligonucleotide; GZMB exon 3; Set C
uguucuuugauauugugggcccccaaggugacau

SEQ ID NO: 12657 - RNA, 28 nt, Artificial Sequence
  Synthetic Oligonucleotide; GZMB exon 3; Set C
ucuuugauauugugggcccccaagguga

SEQ ID NO: 12658 - RNA, 26 nt, Artificial Sequence
  Synthetic Oligonucleotide; GZMB exon 3; Set A
cuuugauauugugggcccccaaggug

SEQ ID NO: 12659 - RNA, 32 nt, Artificial Sequence
  Synthetic Oligonucleotide; GZMB exon 3; Set C
guucuuugauauugugggcccccaaggugaca

SEQ ID NO: 12660 - RNA, 30 nt, Artificial Sequence
  Synthetic Oligonucleotide; GZMB exon 3; Set C
uucuuugauauugugggcccccaaggugac

SEQ ID NO: 12661 - RNA, 25 nt, Artificial Sequence
  Synthetic Oligonucleotide; GZMB exon 3; Set A
cuuugauauugugggcccccaaggu

SEQ ID NO: 12662 - RNA, 23 nt, Artificial Sequence
  Synthetic Oligonucleotide; GZMB exon 3; Set A
uuugauauugugggcccccaagg

SEQ ID NO: 12663 - RNA, 27 nt, Artificial Sequence
  Synthetic Oligonucleotide; GZMB exon 3; Set C
ucuuugauauugugggcccccaaggug

SEQ ID NO: 12664 - RNA, 29 nt, Artificial Sequence
  Synthetic Oligonucleotide; GZMB exon 3; Set C
uucuuugauauugugggcccccaagguga

SEQ ID NO: 12665 - RNA, 33 nt, Artificial Sequence
  Synthetic Oligonucleotide; GZMB exon 3; Set C
uguucuuugauauugugggcccccaaggugaca

SEQ ID NO: 12666 - RNA, 31 nt, Artificial Sequence
  Synthetic Oligonucleotide; GZMB exon 3; Set C
guucuuugauauugugggcccccaaggugac

SEQ ID NO: 12667 - RNA, 26 nt, Artificial Sequence
  Synthetic Oligonucleotide; GZMB exon 3; Set C
ucuuugauauugugggcccccaaggu

SEQ ID NO: 12668 - RNA, 24 nt, Artificial Sequence
  Synthetic Oligonucleotide; GZMB exon 3; Set A
cuuugauauugugggcccccaagg

SEQ ID NO: 12669 - RNA, 28 nt, Artificial Sequence
  Synthetic Oligonucleotide; GZMB exon 3; Set C
uucuuugauauugugggcccccaaggug

SEQ ID NO: 12670 - RNA, 30 nt, Artificial Sequence
  Synthetic Oligonucleotide; GZMB exon 3; Set C
guucuuugauauugugggcccccaagguga

SEQ ID NO: 12671 - RNA, 32 nt, Artificial Sequence
  Synthetic Oligonucleotide; GZMB exon 3; Set C
uguucuuugauauugugggcccccaaggugac

SEQ ID NO: 12672 - RNA, 27 nt, Artificial Sequence
  Synthetic Oligonucleotide; GZMB exon 3; Set C
uucuuugauauugugggcccccaaggu

SEQ ID NO: 12673 - RNA, 25 nt, Artificial Sequence
  Synthetic Oligonucleotide; GZMB exon 3; Set A
ucuuugauauugugggcccccaagg

SEQ ID NO: 12674 - RNA, 31 nt, Artificial Sequence
  Synthetic Oligonucleotide; GZMB exon 3; Set C
uguucuuugauauugugggcccccaagguga

SEQ ID NO: 12675 - RNA, 29 nt, Artificial Sequence
  Synthetic Oligonucleotide; GZMB exon 3; Set C
guucuuugauauugugggcccccaaggug

SEQ ID NO: 12676 - RNA, 40 nt, Artificial Sequence
  Synthetic Oligonucleotide; GZMB exon 3; Set C
gcuccuguucuuugauauugugggcccccaaggugacauu

SEQ ID NO: 12677 - RNA, 28 nt, Artificial Sequence
  Synthetic Oligonucleotide; GZMB exon 3; Set C
guucuuugauauugugggcccccaaggu

SEQ ID NO: 12678 - RNA, 26 nt, Artificial Sequence
  Synthetic Oligonucleotide; GZMB exon 3; Set A
uucuuugauauugugggcccccaagg

SEQ ID NO: 12679 - RNA, 30 nt, Artificial Sequence
  Synthetic Oligonucleotide; GZMB exon 3; Set C
uguucuuugauauugugggcccccaaggug

SEQ ID NO: 12680 - RNA, 29 nt, Artificial Sequence
  Synthetic Oligonucleotide; GZMB exon 3; Set C
uguucuuugauauugugggcccccaaggu

SEQ ID NO: 12681 - RNA, 27 nt, Artificial Sequence
  Synthetic Oligonucleotide; GZMB exon 3; Set C
guucuuugauauugugggcccccaagg

SEQ ID NO: 12682 - RNA, 28 nt, Artificial Sequence
  Synthetic Oligonucleotide; GZMB exon 3; Set C
uguucuuugauauugugggcccccaagg

SEQ ID NO: 12683 - RNA, 40 nt, Artificial Sequence
  Synthetic Oligonucleotide; GZMB exon 3; Set C
ggcuccuguucuuugauauugugggcccccaaggugacau

SEQ ID NO: 12684 - RNA, 35 nt, Artificial Sequence
  Synthetic Oligonucleotide; GZMB exon 3; Set C
ggcuccuguucuuugauauugugggcccccaaggu

SEQ ID NO: 12685 - RNA, 39 nt, Artificial Sequence
  Synthetic Oligonucleotide; GZMB exon 3; Set C
ggucggcuccuguucuuugauauugugggcccccaaggu

SEQ ID NO: 12686 - RNA, 40 nt, Artificial Sequence
  Synthetic Oligonucleotide; GZMB exon 3; Set C
gggucggcuccuguucuuugauauugugggcccccaaggu

SEQ ID NO: 12687 - RNA, 39 nt, Artificial Sequence
  Synthetic Oligonucleotide; GZMB exon 3; Set C
gggucggcuccuguucuuugauauugugggcccccaagg

SEQ ID NO: 12688 - RNA, 40 nt, Artificial Sequence
  Synthetic Oligonucleotide; GZMB exon 3; Set C
ugggucggcuccuguucuuugauauugugggcccccaagg

SEQ ID NO: 12689 - RNA, 24 nt, Artificial Sequence
  Synthetic Oligonucleotide; GZMB exon 3; Set A
gcuccuguucuuugauauuguggg

SEQ ID NO: 12690 - RNA, 23 nt, Artificial Sequence
  Synthetic Oligonucleotide; GZMB exon 3; Set C
gcuccuguucuuugauauugugg

SEQ ID NO: 12691 - RNA, 25 nt, Artificial Sequence
  Synthetic Oligonucleotide; GZMB exon 3; Set A
ggcuccuguucuuugauauuguggg

SEQ ID NO: 12692 - RNA, 22 nt, Artificial Sequence
  Synthetic Oligonucleotide; GZMB exon 3; Set C
gcuccuguucuuugauauugug

SEQ ID NO: 12693 - RNA, 24 nt, Artificial Sequence
  Synthetic Oligonucleotide; GZMB exon 3; Set A
ggcuccuguucuuugauauugugg

SEQ ID NO: 12694 - RNA, 21 nt, Artificial Sequence
  Synthetic Oligonucleotide; GZMB exon 3; Set C
gcuccuguucuuugauauugu

SEQ ID NO: 12695 - RNA, 23 nt, Artificial Sequence
  Synthetic Oligonucleotide; GZMB exon 3; Set C
ggcuccuguucuuugauauugug

SEQ ID NO: 12696 - RNA, 20 nt, Artificial Sequence
  Synthetic Oligonucleotide; GZMB exon 3; Set C
gcuccuguucuuugauauug

SEQ ID NO: 12697 - RNA, 22 nt, Artificial Sequence
  Synthetic Oligonucleotide; GZMB exon 3; Set C
ggcuccuguucuuugauauugu

SEQ ID NO: 12698 - RNA, 26 nt, Artificial Sequence
  Synthetic Oligonucleotide; GZMB exon 3; Set A
ucggcuccuguucuuugauauugugg

SEQ ID NO: 12699 - RNA, 21 nt, Artificial Sequence
  Synthetic Oligonucleotide; GZMB exon 3; Set C
ggcuccuguucuuugauauug

SEQ ID NO: 12700 - RNA, 19 nt, Artificial Sequence
  Synthetic Oligonucleotide; GZMB exon 3; Set C
gcuccuguucuuugauauu

SEQ ID NO: 12701 - RNA, 25 nt, Artificial Sequence
  Synthetic Oligonucleotide; GZMB exon 3; Set A
ucggcuccuguucuuugauauugug

SEQ ID NO: 12702 - RNA, 27 nt, Artificial Sequence
  Synthetic Oligonucleotide; GZMB exon 3; Set A
gucggcuccuguucuuugauauugugg

SEQ ID NO: 12703 - RNA, 29 nt, Artificial Sequence
  Synthetic Oligonucleotide; GZMB exon 3; Set C
ggucggcuccuguucuuugauauuguggg

SEQ ID NO: 12704 - RNA, 18 nt, Artificial Sequence
  Synthetic Oligonucleotide; GZMB exon 3; Set C
gcuccuguucuuugauau

SEQ ID NO: 12705 - RNA, 20 nt, Artificial Sequence
  Synthetic Oligonucleotide; GZMB exon 3; Set C
ggcuccuguucuuugauauu

SEQ ID NO: 12706 - RNA, 24 nt, Artificial Sequence
  Synthetic Oligonucleotide; GZMB exon 3; Set A
ucggcuccuguucuuugauauugu

SEQ ID NO: 12707 - RNA, 26 nt, Artificial Sequence
  Synthetic Oligonucleotide; GZMB exon 3; Set A
gucggcuccuguucuuugauauugug

SEQ ID NO: 12708 - RNA, 28 nt, Artificial Sequence
  Synthetic Oligonucleotide; GZMB exon 3; Set C
ggucggcuccuguucuuugauauugugg

SEQ ID NO: 12709 - RNA, 30 nt, Artificial Sequence
  Synthetic Oligonucleotide; GZMB exon 3; Set C
gggucggcuccuguucuuugauauuguggg

SEQ ID NO: 12710 - RNA, 19 nt, Artificial Sequence
  Synthetic Oligonucleotide; GZMB exon 3; Set C
ggcuccuguucuuugauau

SEQ ID NO: 12711 - RNA, 17 nt, Artificial Sequence
  Synthetic Oligonucleotide; GZMB exon 3; Set C
gcuccuguucuuugaua

SEQ ID NO: 12712 - RNA, 23 nt, Artificial Sequence
  Synthetic Oligonucleotide; GZMB exon 3; Set A
ucggcuccuguucuuugauauug

SEQ ID NO: 12713 - RNA, 25 nt, Artificial Sequence
  Synthetic Oligonucleotide; GZMB exon 3; Set A
gucggcuccuguucuuugauauugu

SEQ ID NO: 12714 - RNA, 27 nt, Artificial Sequence
  Synthetic Oligonucleotide; GZMB exon 3; Set A
ggucggcuccuguucuuugauauugug

SEQ ID NO: 12715 - RNA, 29 nt, Artificial Sequence
  Synthetic Oligonucleotide; GZMB exon 3; Set C
gggucggcuccuguucuuugauauugugg

SEQ ID NO: 12716 - RNA, 31 nt, Artificial Sequence
  Synthetic Oligonucleotide; GZMB exon 3; Set C
ugggucggcuccuguucuuugauauuguggg

SEQ ID NO: 12717 - RNA, 18 nt, Artificial Sequence
  Synthetic Oligonucleotide; GZMB exon 3; Set C
ggcuccuguucuuugaua

SEQ ID NO: 12718 - RNA, 16 nt, Artificial Sequence
  Synthetic Oligonucleotide; GZMB exon 3; Set C
gcuccuguucuuugau

SEQ ID NO: 12719 - RNA, 22 nt, Artificial Sequence
  Synthetic Oligonucleotide; GZMB exon 3; Set C
ucggcuccuguucuuugauauu

SEQ ID NO: 12720 - RNA, 24 nt, Artificial Sequence
  Synthetic Oligonucleotide; GZMB exon 3; Set A
gucggcuccuguucuuugauauug

SEQ ID NO: 12721 - RNA, 26 nt, Artificial Sequence
  Synthetic Oligonucleotide; GZMB exon 3; Set A
ggucggcuccuguucuuugauauugu

SEQ ID NO: 12722 - RNA, 28 nt, Artificial Sequence
  Synthetic Oligonucleotide; GZMB exon 3; Set C
gggucggcuccuguucuuugauauugug

SEQ ID NO: 12723 - RNA, 32 nt, Artificial Sequence
  Synthetic Oligonucleotide; GZMB exon 3; Set C
cugggucggcuccuguucuuugauauuguggg

SEQ ID NO: 12724 - RNA, 21 nt, Artificial Sequence
  Synthetic Oligonucleotide; GZMB exon 3; Set C
ucggcuccuguucuuugauau

SEQ ID NO: 12725 - RNA, 17 nt, Artificial Sequence
  Synthetic Oligonucleotide; GZMB exon 3; Set C
ggcuccuguucuuugau

SEQ ID NO: 12726 - RNA, 15 nt, Artificial Sequence
  Synthetic Oligonucleotide; GZMB exon 3; Set C
gcuccuguucuuuga

SEQ ID NO: 12727 - RNA, 25 nt, Artificial Sequence
  Synthetic Oligonucleotide; GZMB exon 3; Set A
ggucggcuccuguucuuugauauug

SEQ ID NO: 12728 - RNA, 23 nt, Artificial Sequence
  Synthetic Oligonucleotide; GZMB exon 3; Set A
gucggcuccuguucuuugauauu

SEQ ID NO: 12729 - RNA, 27 nt, Artificial Sequence
  Synthetic Oligonucleotide; GZMB exon 3; Set C
gggucggcuccuguucuuugauauugu

SEQ ID NO: 12730 - RNA, 31 nt, Artificial Sequence
  Synthetic Oligonucleotide; GZMB exon 3; Set C
cugggucggcuccuguucuuugauauugugg

SEQ ID NO: 12731 - RNA, 33 nt, Artificial Sequence
  Synthetic Oligonucleotide; GZMB exon 3; Set C
gcugggucggcuccuguucuuugauauuguggg

SEQ ID NO: 12732 - RNA, 20 nt, Artificial Sequence
  Synthetic Oligonucleotide; GZMB exon 3; Set C
ucggcuccuguucuuugaua

SEQ ID NO: 12733 - RNA, 22 nt, Artificial Sequence
  Synthetic Oligonucleotide; GZMB exon 3; Set A
gucggcuccuguucuuugauau

SEQ ID NO: 12734 - RNA, 16 nt, Artificial Sequence
  Synthetic Oligonucleotide; GZMB exon 3; Set C
ggcuccuguucuuuga

SEQ ID NO: 12735 - RNA, 26 nt, Artificial Sequence
  Synthetic Oligonucleotide; GZMB exon 3; Set A
gggucggcuccuguucuuugauauug

SEQ ID NO: 12736 - RNA, 24 nt, Artificial Sequence
  Synthetic Oligonucleotide; GZMB exon 3; Set A
ggucggcuccuguucuuugauauu

SEQ ID NO: 12737 - RNA, 30 nt, Artificial Sequence
  Synthetic Oligonucleotide; GZMB exon 3; Set C
cugggucggcuccuguucuuugauauugug

SEQ ID NO: 12738 - RNA, 32 nt, Artificial Sequence
  Synthetic Oligonucleotide; GZMB exon 3; Set C
gcugggucggcuccuguucuuugauauugugg

SEQ ID NO: 12739 - RNA, 34 nt, Artificial Sequence
  Synthetic Oligonucleotide; GZMB exon 3; Set C
ugcugggucggcuccuguucuuugauauuguggg

SEQ ID NO: 12740 - RNA, 23 nt, Artificial Sequence
  Synthetic Oligonucleotide; GZMB exon 3; Set A
ggucggcuccuguucuuugauau

SEQ ID NO: 12741 - RNA, 21 nt, Artificial Sequence
  Synthetic Oligonucleotide; GZMB exon 3; Set A
gucggcuccuguucuuugaua

SEQ ID NO: 12742 - RNA, 15 nt, Artificial Sequence
  Synthetic Oligonucleotide; GZMB exon 3; Set C
ggcuccuguucuuug

SEQ ID NO: 12743 - RNA, 19 nt, Artificial Sequence
  Synthetic Oligonucleotide; GZMB exon 3; Set C
ucggcuccuguucuuugau

SEQ ID NO: 12744 - RNA, 25 nt, Artificial Sequence
  Synthetic Oligonucleotide; GZMB exon 3; Set A
gggucggcuccuguucuuugauauu

SEQ ID NO: 12745 - RNA, 29 nt, Artificial Sequence
  Synthetic Oligonucleotide; GZMB exon 3; Set C
cugggucggcuccuguucuuugauauugu

SEQ ID NO: 12746 - RNA, 31 nt, Artificial Sequence
  Synthetic Oligonucleotide; GZMB exon 3; Set C
gcugggucggcuccuguucuuugauauugug

SEQ ID NO: 12747 - RNA, 33 nt, Artificial Sequence
  Synthetic Oligonucleotide; GZMB exon 3; Set C
ugcugggucggcuccuguucuuugauauugugg

SEQ ID NO: 12748 - RNA, 24 nt, Artificial Sequence
  Synthetic Oligonucleotide; GZMB exon 3; Set A
gggucggcuccuguucuuugauau

SEQ ID NO: 12749 - RNA, 22 nt, Artificial Sequence
  Synthetic Oligonucleotide; GZMB exon 3; Set A
ggucggcuccuguucuuugaua

SEQ ID NO: 12750 - RNA, 18 nt, Artificial Sequence
  Synthetic Oligonucleotide; GZMB exon 3; Set C
ucggcuccuguucuuuga

SEQ ID NO: 12751 - RNA, 20 nt, Artificial Sequence
  Synthetic Oligonucleotide; GZMB exon 3; Set A
gucggcuccuguucuuugau

SEQ ID NO: 12752 - RNA, 28 nt, Artificial Sequence
  Synthetic Oligonucleotide; GZMB exon 3; Set A
cugggucggcuccuguucuuugauauug

SEQ ID NO: 12753 - RNA, 30 nt, Artificial Sequence
  Synthetic Oligonucleotide; GZMB exon 3; Set C
gcugggucggcuccuguucuuugauauugu

SEQ ID NO: 12754 - RNA, 32 nt, Artificial Sequence
  Synthetic Oligonucleotide; GZMB exon 3; Set C
ugcugggucggcuccuguucuuugauauugug

SEQ ID NO: 12755 - RNA, 23 nt, Artificial Sequence
  Synthetic Oligonucleotide; GZMB exon 3; Set A
gggucggcuccuguucuuugaua

SEQ ID NO: 12756 - RNA, 21 nt, Artificial Sequence
  Synthetic Oligonucleotide; GZMB exon 3; Set A
ggucggcuccuguucuuugau

SEQ ID NO: 12757 - RNA, 17 nt, Artificial Sequence
  Synthetic Oligonucleotide; GZMB exon 3; Set C
ucggcuccuguucuuug

SEQ ID NO: 12758 - RNA, 19 nt, Artificial Sequence
  Synthetic Oligonucleotide; GZMB exon 3; Set A
gucggcuccuguucuuuga

SEQ ID NO: 12759 - RNA, 27 nt, Artificial Sequence
  Synthetic Oligonucleotide; GZMB exon 3; Set A
cugggucggcuccuguucuuugauauu

SEQ ID NO: 12760 - RNA, 29 nt, Artificial Sequence
  Synthetic Oligonucleotide; GZMB exon 3; Set C
gcugggucggcuccuguucuuugauauug

SEQ ID NO: 12761 - RNA, 31 nt, Artificial Sequence
  Synthetic Oligonucleotide; GZMB exon 3; Set C
ugcugggucggcuccuguucuuugauauugu

SEQ ID NO: 12762 - RNA, 26 nt, Artificial Sequence
  Synthetic Oligonucleotide; GZMB exon 3; Set A
cugggucggcuccuguucuuugauau

SEQ ID NO: 12763 - RNA, 22 nt, Artificial Sequence
  Synthetic Oligonucleotide; GZMB exon 3; Set A
gggucggcuccuguucuuugau

SEQ ID NO: 12764 - RNA, 20 nt, Artificial Sequence
  Synthetic Oligonucleotide; GZMB exon 3; Set A
ggucggcuccuguucuuuga

SEQ ID NO: 12765 - RNA, 16 nt, Artificial Sequence
  Synthetic Oligonucleotide; GZMB exon 3; Set C
ucggcuccuguucuuu

SEQ ID NO: 12766 - RNA, 18 nt, Artificial Sequence
  Synthetic Oligonucleotide; GZMB exon 3; Set C
gucggcuccuguucuuug

SEQ ID NO: 12767 - RNA, 28 nt, Artificial Sequence
  Synthetic Oligonucleotide; GZMB exon 3; Set C
gcugggucggcuccuguucuuugauauu

SEQ ID NO: 12768 - RNA, 30 nt, Artificial Sequence
  Synthetic Oligonucleotide; GZMB exon 3; Set C
ugcugggucggcuccuguucuuugauauug

SEQ ID NO: 12769 - RNA, 38 nt, Artificial Sequence
  Synthetic Oligonucleotide; GZMB exon 3; Set C
aaacugcugggucggcuccuguucuuugauauuguggg

SEQ ID NO: 12770 - RNA, 25 nt, Artificial Sequence
  Synthetic Oligonucleotide; GZMB exon 3; Set A
cugggucggcuccuguucuuugaua

SEQ ID NO: 12771 - RNA, 27 nt, Artificial Sequence
  Synthetic Oligonucleotide; GZMB exon 3; Set C
gcugggucggcuccuguucuuugauau

SEQ ID NO: 12772 - RNA, 21 nt, Artificial Sequence
  Synthetic Oligonucleotide; GZMB exon 3; Set A
gggucggcuccuguucuuuga

SEQ ID NO: 12773 - RNA, 19 nt, Artificial Sequence
  Synthetic Oligonucleotide; GZMB exon 3; Set A
ggucggcuccuguucuuug

SEQ ID NO: 12774 - RNA, 29 nt, Artificial Sequence
  Synthetic Oligonucleotide; GZMB exon 3; Set C
ugcugggucggcuccuguucuuugauauu

SEQ ID NO: 12775 - RNA, 37 nt, Artificial Sequence
  Synthetic Oligonucleotide; GZMB exon 3; Set C
aaacugcugggucggcuccuguucuuugauauugugg

SEQ ID NO: 12776 - RNA, 39 nt, Artificial Sequence
  Synthetic Oligonucleotide; GZMB exon 3; Set C
uaaacugcugggucggcuccuguucuuugauauuguggg

SEQ ID NO: 12777 - RNA, 26 nt, Artificial Sequence
  Synthetic Oligonucleotide; GZMB exon 3; Set C
gcugggucggcuccuguucuuugaua

SEQ ID NO: 12778 - RNA, 28 nt, Artificial Sequence
  Synthetic Oligonucleotide; GZMB exon 3; Set C
ugcugggucggcuccuguucuuugauau

SEQ ID NO: 12779 - RNA, 20 nt, Artificial Sequence
  Synthetic Oligonucleotide; GZMB exon 3; Set A
gggucggcuccuguucuuug

SEQ ID NO: 12780 - RNA, 24 nt, Artificial Sequence
  Synthetic Oligonucleotide; GZMB exon 3; Set A
cugggucggcuccuguucuuugau

SEQ ID NO: 12781 - RNA, 18 nt, Artificial Sequence
  Synthetic Oligonucleotide; GZMB exon 3; Set A
ggucggcuccuguucuuu

SEQ ID NO: 12782 - RNA, 36 nt, Artificial Sequence
  Synthetic Oligonucleotide; GZMB exon 3; Set C
aaacugcugggucggcuccuguucuuugauauugug

SEQ ID NO: 12783 - RNA, 40 nt, Artificial Sequence
  Synthetic Oligonucleotide; GZMB exon 3; Set C
auaaacugcugggucggcuccuguucuuugauauuguggg

SEQ ID NO: 12784 - RNA, 27 nt, Artificial Sequence
  Synthetic Oligonucleotide; GZMB exon 3; Set C
ugcugggucggcuccuguucuuugaua

SEQ ID NO: 12785 - RNA, 19 nt, Artificial Sequence
  Synthetic Oligonucleotide; GZMB exon 3; Set A
gggucggcuccuguucuuu

SEQ ID NO: 12786 - RNA, 23 nt, Artificial Sequence
  Synthetic Oligonucleotide; GZMB exon 3; Set A
cugggucggcuccuguucuuuga

SEQ ID NO: 12787 - RNA, 25 nt, Artificial Sequence
  Synthetic Oligonucleotide; GZMB exon 3; Set C
gcugggucggcuccuguucuuugau

SEQ ID NO: 12788 - RNA, 17 nt, Artificial Sequence
  Synthetic Oligonucleotide; GZMB exon 3; Set A
ggucggcuccuguucuu

SEQ ID NO: 12789 - RNA, 35 nt, Artificial Sequence
  Synthetic Oligonucleotide; GZMB exon 3; Set C
aaacugcugggucggcuccuguucuuugauauugu

SEQ ID NO: 12790 - RNA, 18 nt, Artificial Sequence
  Synthetic Oligonucleotide; GZMB exon 3; Set A
gggucggcuccuguucuu

SEQ ID NO: 12791 - RNA, 22 nt, Artificial Sequence
  Synthetic Oligonucleotide; GZMB exon 3; Set A
cugggucggcuccuguucuuug

SEQ ID NO: 12792 - RNA, 24 nt, Artificial Sequence
  Synthetic Oligonucleotide; GZMB exon 3; Set C
gcugggucggcuccuguucuuuga

SEQ ID NO: 12793 - RNA, 26 nt, Artificial Sequence
  Synthetic Oligonucleotide; GZMB exon 3; Set C
ugcugggucggcuccuguucuuugau

SEQ ID NO: 12794 - RNA, 16 nt, Artificial Sequence
  Synthetic Oligonucleotide; GZMB exon 3; Set C
ggucggcuccuguucu

SEQ ID NO: 12795 - RNA, 34 nt, Artificial Sequence
  Synthetic Oligonucleotide; GZMB exon 3; Set C
aaacugcugggucggcuccuguucuuugauauug

SEQ ID NO: 12796 - RNA, 17 nt, Artificial Sequence
  Synthetic Oligonucleotide; GZMB exon 3; Set A
gggucggcuccuguucu

SEQ ID NO: 12797 - RNA, 21 nt, Artificial Sequence
  Synthetic Oligonucleotide; GZMB exon 3; Set A
cugggucggcuccuguucuuu

SEQ ID NO: 12798 - RNA, 23 nt, Artificial Sequence
  Synthetic Oligonucleotide; GZMB exon 3; Set C
gcugggucggcuccuguucuuug

SEQ ID NO: 12799 - RNA, 25 nt, Artificial Sequence
  Synthetic Oligonucleotide; GZMB exon 3; Set C
ugcugggucggcuccuguucuuuga

SEQ ID NO: 12800 - RNA, 33 nt, Artificial Sequence
  Synthetic Oligonucleotide; GZMB exon 3; Set C
aaacugcugggucggcuccuguucuuugauauu

SEQ ID NO: 12801 - RNA, 15 nt, Artificial Sequence
  Synthetic Oligonucleotide; GZMB exon 3; Set C
ggucggcuccuguuc

SEQ ID NO: 12802 - RNA, 32 nt, Artificial Sequence
  Synthetic Oligonucleotide; GZMB exon 3; Set C
aaacugcugggucggcuccuguucuuugauau

SEQ ID NO: 12803 - RNA, 18 nt, Artificial Sequence
  Synthetic Oligonucleotide; GZMB exon 3; Set A
ugggucggcuccuguucu

SEQ ID NO: 12804 - RNA, 20 nt, Artificial Sequence
  Synthetic Oligonucleotide; GZMB exon 3; Set A
cugggucggcuccuguucuu

SEQ ID NO: 12805 - RNA, 22 nt, Artificial Sequence
  Synthetic Oligonucleotide; GZMB exon 3; Set C
gcugggucggcuccuguucuuu

SEQ ID NO: 12806 - RNA, 24 nt, Artificial Sequence
  Synthetic Oligonucleotide; GZMB exon 3; Set C
ugcugggucggcuccuguucuuug

SEQ ID NO: 12807 - RNA, 16 nt, Artificial Sequence
  Synthetic Oligonucleotide; GZMB exon 3; Set A
gggucggcuccuguuc

SEQ ID NO: 12808 - RNA, 31 nt, Artificial Sequence
  Synthetic Oligonucleotide; GZMB exon 3; Set C
aaacugcugggucggcuccuguucuuugaua

SEQ ID NO: 12809 - RNA, 19 nt, Artificial Sequence
  Synthetic Oligonucleotide; GZMB exon 3; Set A
cugggucggcuccuguucu

SEQ ID NO: 12810 - RNA, 21 nt, Artificial Sequence
  Synthetic Oligonucleotide; GZMB exon 3; Set C
gcugggucggcuccuguucuu

SEQ ID NO: 12811 - RNA, 23 nt, Artificial Sequence
  Synthetic Oligonucleotide; GZMB exon 3; Set C
ugcugggucggcuccuguucuuu

SEQ ID NO: 12812 - RNA, 17 nt, Artificial Sequence
  Synthetic Oligonucleotide; GZMB exon 3; Set A
ugggucggcuccuguuc

SEQ ID NO: 12813 - RNA, 30 nt, Artificial Sequence
  Synthetic Oligonucleotide; GZMB exon 3; Set C
aaacugcugggucggcuccuguucuuugau

SEQ ID NO: 12814 - RNA, 20 nt, Artificial Sequence
  Synthetic Oligonucleotide; GZMB exon 3; Set C
gcugggucggcuccuguucu

SEQ ID NO: 12815 - RNA, 22 nt, Artificial Sequence
  Synthetic Oligonucleotide; GZMB exon 3; Set C
ugcugggucggcuccuguucuu

SEQ ID NO: 12816 - RNA, 18 nt, Artificial Sequence
  Synthetic Oligonucleotide; GZMB exon 3; Set A
cugggucggcuccuguuc

SEQ ID NO: 12817 - RNA, 16 nt, Artificial Sequence
  Synthetic Oligonucleotide; GZMB exon 3; Set A
ugggucggcuccuguu

SEQ ID NO: 12818 - RNA, 29 nt, Artificial Sequence
  Synthetic Oligonucleotide; GZMB exon 3; Set C
aaacugcugggucggcuccuguucuuuga

SEQ ID NO: 12819 - RNA, 21 nt, Artificial Sequence
  Synthetic Oligonucleotide; GZMB exon 3; Set C
ugcugggucggcuccuguucu

SEQ ID NO: 12820 - RNA, 19 nt, Artificial Sequence
  Synthetic Oligonucleotide; GZMB exon 3; Set A
gcugggucggcuccuguuc

SEQ ID NO: 12821 - RNA, 15 nt, Artificial Sequence
  Synthetic Oligonucleotide; GZMB exon 3; Set A
ugggucggcuccugu

SEQ ID NO: 12822 - RNA, 28 nt, Artificial Sequence
  Synthetic Oligonucleotide; GZMB exon 3; Set C
aaacugcugggucggcuccuguucuuug

SEQ ID NO: 12823 - RNA, 20 nt, Artificial Sequence
  Synthetic Oligonucleotide; GZMB exon 3; Set A
ugcugggucggcuccuguuc

SEQ ID NO: 12824 - RNA, 27 nt, Artificial Sequence
  Synthetic Oligonucleotide; GZMB exon 3; Set C
aaacugcugggucggcuccuguucuuu

SEQ ID NO: 12825 - RNA, 26 nt, Artificial Sequence
  Synthetic Oligonucleotide; GZMB exon 3; Set C
aaacugcugggucggcuccuguucuu

SEQ ID NO: 12826 - RNA, 25 nt, Artificial Sequence
  Synthetic Oligonucleotide; GZMB exon 3; Set C
aaacugcugggucggcuccuguucu

SEQ ID NO: 12827 - RNA, 26 nt, Artificial Sequence
  Synthetic Oligonucleotide; GZMB exon 3; Set C
uaaacugcugggucggcuccuguucu

SEQ ID NO: 12828 - RNA, 24 nt, Artificial Sequence
  Synthetic Oligonucleotide; GZMB exon 3; Set A
aaacugcugggucggcuccuguuc

SEQ ID NO: 12829 - RNA, 25 nt, Artificial Sequence
  Synthetic Oligonucleotide; GZMB exon 3; Set C
uaaacugcugggucggcuccuguuc

SEQ ID NO: 12830 - RNA, 23 nt, Artificial Sequence
  Synthetic Oligonucleotide; GZMB exon 3; Set A
aaacugcugggucggcuccuguu

SEQ ID NO: 12831 - RNA, 24 nt, Artificial Sequence
  Synthetic Oligonucleotide; GZMB exon 3; Set A
uaaacugcugggucggcuccuguu

SEQ ID NO: 12832 - RNA, 22 nt, Artificial Sequence
  Synthetic Oligonucleotide; GZMB exon 3; Set A
aaacugcugggucggcuccugu

SEQ ID NO: 12833 - RNA, 25 nt, Artificial Sequence
  Synthetic Oligonucleotide; GZMB exon 3; Set A
auaaacugcugggucggcuccuguu

SEQ ID NO: 12834 - RNA, 23 nt, Artificial Sequence
  Synthetic Oligonucleotide; GZMB exon 3; Set A
uaaacugcugggucggcuccugu

SEQ ID NO: 12835 - RNA, 28 nt, Artificial Sequence
  Synthetic Oligonucleotide; GZMB exon 3; Set C
ggauaaacugcugggucggcuccuguuc

SEQ ID NO: 12836 - RNA, 26 nt, Artificial Sequence
  Synthetic Oligonucleotide; GZMB exon 3; Set C
gauaaacugcugggucggcuccuguu

SEQ ID NO: 12837 - RNA, 24 nt, Artificial Sequence
  Synthetic Oligonucleotide; GZMB exon 3; Set A
auaaacugcugggucggcuccugu

SEQ ID NO: 12838 - RNA, 25 nt, Artificial Sequence
  Synthetic Oligonucleotide; GZMB exon 3; Set C
gauaaacugcugggucggcuccugu

SEQ ID NO: 12839 - RNA, 27 nt, Artificial Sequence
  Synthetic Oligonucleotide; GZMB exon 3; Set C
ggauaaacugcugggucggcuccuguu

SEQ ID NO: 12840 - RNA, 40 nt, Artificial Sequence
  Synthetic Oligonucleotide; GZMB exon 3; Set C
uucacagggauaaacugcugggucggcuccuguucuuuga

SEQ ID NO: 12841 - RNA, 26 nt, Artificial Sequence
  Synthetic Oligonucleotide; GZMB exon 3; Set C
ggauaaacugcugggucggcuccugu

SEQ ID NO: 12842 - RNA, 39 nt, Artificial Sequence
  Synthetic Oligonucleotide; GZMB exon 3; Set C
uucacagggauaaacugcugggucggcuccuguucuuug

SEQ ID NO: 12843 - RNA, 17 nt, Artificial Sequence
  Synthetic Oligonucleotide; GZMB exon 3; Set C
aaacugcugggucggcu

SEQ ID NO: 12844 - RNA, 40 nt, Artificial Sequence
  Synthetic Oligonucleotide; GZMB exon 3; Set C
uuucacagggauaaacugcugggucggcuccuguucuuug

SEQ ID NO: 12845 - RNA, 38 nt, Artificial Sequence
  Synthetic Oligonucleotide; GZMB exon 3; Set C
uucacagggauaaacugcugggucggcuccuguucuuu

SEQ ID NO: 12846 - RNA, 16 nt, Artificial Sequence
  Synthetic Oligonucleotide; GZMB exon 3; Set C
aaacugcugggucggc

SEQ ID NO: 12847 - RNA, 18 nt, Artificial Sequence
  Synthetic Oligonucleotide; GZMB exon 3; Set C
uaaacugcugggucggcu

SEQ ID NO: 12848 - RNA, 39 nt, Artificial Sequence
  Synthetic Oligonucleotide; GZMB exon 3; Set C
uuucacagggauaaacugcugggucggcuccuguucuuu

SEQ ID NO: 12849 - RNA, 37 nt, Artificial Sequence
  Synthetic Oligonucleotide; GZMB exon 3; Set C
uucacagggauaaacugcugggucggcuccuguucuu

SEQ ID NO: 12850 - RNA, 17 nt, Artificial Sequence
  Synthetic Oligonucleotide; GZMB exon 3; Set C
uaaacugcugggucggc

SEQ ID NO: 12851 - RNA, 19 nt, Artificial Sequence
  Synthetic Oligonucleotide; GZMB exon 3; Set C
auaaacugcugggucggcu

SEQ ID NO: 12852 - RNA, 40 nt, Artificial Sequence
  Synthetic Oligonucleotide; GZMB exon 3; Set C
uuuucacagggauaaacugcugggucggcuccuguucuuu

SEQ ID NO: 12853 - RNA, 38 nt, Artificial Sequence
  Synthetic Oligonucleotide; GZMB exon 3; Set C
uuucacagggauaaacugcugggucggcuccuguucuu

SEQ ID NO: 12854 - RNA, 36 nt, Artificial Sequence
  Synthetic Oligonucleotide; GZMB exon 3; Set C
uucacagggauaaacugcugggucggcuccuguucu

SEQ ID NO: 12855 - RNA, 18 nt, Artificial Sequence
  Synthetic Oligonucleotide; GZMB exon 3; Set C
auaaacugcugggucggc

SEQ ID NO: 12856 - RNA, 20 nt, Artificial Sequence
  Synthetic Oligonucleotide; GZMB exon 3; Set A
gauaaacugcugggucggcu

SEQ ID NO: 12857 - RNA, 39 nt, Artificial Sequence
  Synthetic Oligonucleotide; GZMB exon 3; Set C
uuuucacagggauaaacugcugggucggcuccuguucuu

SEQ ID NO: 12858 - RNA, 37 nt, Artificial Sequence
  Synthetic Oligonucleotide; GZMB exon 3; Set C
uuucacagggauaaacugcugggucggcuccuguucu

SEQ ID NO: 12859 - RNA, 35 nt, Artificial Sequence
  Synthetic Oligonucleotide; GZMB exon 3; Set C
uucacagggauaaacugcugggucggcuccuguuc

SEQ ID NO: 12860 - RNA, 19 nt, Artificial Sequence
  Synthetic Oligonucleotide; GZMB exon 3; Set A
gauaaacugcugggucggc

SEQ ID NO: 12861 - RNA, 21 nt, Artificial Sequence
  Synthetic Oligonucleotide; GZMB exon 3; Set A
ggauaaacugcugggucggcu

SEQ ID NO: 12862 - RNA, 15 nt, Artificial Sequence
  Synthetic Oligonucleotide; GZMB exon 3; Set C
uaaacugcugggucg

SEQ ID NO: 12863 - RNA, 38 nt, Artificial Sequence
  Synthetic Oligonucleotide; GZMB exon 3; Set C
uuuucacagggauaaacugcugggucggcuccuguucu

SEQ ID NO: 12864 - RNA, 40 nt, Artificial Sequence
  Synthetic Oligonucleotide; GZMB exon 3; Set C
cuuuucacagggauaaacugcugggucggcuccuguucuu

SEQ ID NO: 12865 - RNA, 36 nt, Artificial Sequence
  Synthetic Oligonucleotide; GZMB exon 3; Set C
uuucacagggauaaacugcugggucggcuccuguuc

SEQ ID NO: 12866 - RNA, 34 nt, Artificial Sequence
  Synthetic Oligonucleotide; GZMB exon 3; Set C
uucacagggauaaacugcugggucggcuccuguu

SEQ ID NO: 12867 - RNA, 20 nt, Artificial Sequence
  Synthetic Oligonucleotide; GZMB exon 3; Set A
ggauaaacugcugggucggc

SEQ ID NO: 12868 - RNA, 16 nt, Artificial Sequence
  Synthetic Oligonucleotide; GZMB exon 3; Set C
auaaacugcugggucg

SEQ ID NO: 12869 - RNA, 39 nt, Artificial Sequence
  Synthetic Oligonucleotide; GZMB exon 3; Set C
cuuuucacagggauaaacugcugggucggcuccuguucu

SEQ ID NO: 12870 - RNA, 37 nt, Artificial Sequence
  Synthetic Oligonucleotide; GZMB exon 3; Set C
uuuucacagggauaaacugcugggucggcuccuguuc

SEQ ID NO: 12871 - RNA, 35 nt, Artificial Sequence
  Synthetic Oligonucleotide; GZMB exon 3; Set C
uuucacagggauaaacugcugggucggcuccuguu

SEQ ID NO: 12872 - RNA, 33 nt, Artificial Sequence
  Synthetic Oligonucleotide; GZMB exon 3; Set C
uucacagggauaaacugcugggucggcuccugu

SEQ ID NO: 12873 - RNA, 17 nt, Artificial Sequence
  Synthetic Oligonucleotide; GZMB exon 3; Set C
gauaaacugcugggucg

SEQ ID NO: 12874 - RNA, 15 nt, Artificial Sequence
  Synthetic Oligonucleotide; GZMB exon 3; Set C
auaaacugcuggguc

SEQ ID NO: 12875 - RNA, 40 nt, Artificial Sequence
  Synthetic Oligonucleotide; GZMB exon 3; Set C
ucuuuucacagggauaaacugcugggucggcuccuguucu

SEQ ID NO: 12876 - RNA, 38 nt, Artificial Sequence
  Synthetic Oligonucleotide; GZMB exon 3; Set C
cuuuucacagggauaaacugcugggucggcuccuguuc

SEQ ID NO: 12877 - RNA, 36 nt, Artificial Sequence
  Synthetic Oligonucleotide; GZMB exon 3; Set C
uuuucacagggauaaacugcugggucggcuccuguu

SEQ ID NO: 12878 - RNA, 34 nt, Artificial Sequence
  Synthetic Oligonucleotide; GZMB exon 3; Set C
uuucacagggauaaacugcugggucggcuccugu

SEQ ID NO: 12879 - RNA, 18 nt, Artificial Sequence
  Synthetic Oligonucleotide; GZMB exon 3; Set C
ggauaaacugcugggucg

SEQ ID NO: 12880 - RNA, 16 nt, Artificial Sequence
  Synthetic Oligonucleotide; GZMB exon 3; Set C
gauaaacugcuggguc

SEQ ID NO: 12881 - RNA, 39 nt, Artificial Sequence
  Synthetic Oligonucleotide; GZMB exon 3; Set C
ucuuuucacagggauaaacugcugggucggcuccuguuc

SEQ ID NO: 12882 - RNA, 35 nt, Artificial Sequence
  Synthetic Oligonucleotide; GZMB exon 3; Set C
uuuucacagggauaaacugcugggucggcuccugu

SEQ ID NO: 12883 - RNA, 37 nt, Artificial Sequence
  Synthetic Oligonucleotide; GZMB exon 3; Set C
cuuuucacagggauaaacugcugggucggcuccuguu

SEQ ID NO: 12884 - RNA, 15 nt, Artificial Sequence
  Synthetic Oligonucleotide; GZMB exon 3; Set C
gauaaacugcugggu

SEQ ID NO: 12885 - RNA, 17 nt, Artificial Sequence
  Synthetic Oligonucleotide; GZMB exon 3; Set C
ggauaaacugcuggguc

SEQ ID NO: 12886 - RNA, 40 nt, Artificial Sequence
  Synthetic Oligonucleotide; GZMB exon 3; Set C
gucuuuucacagggauaaacugcugggucggcuccuguuc

SEQ ID NO: 12887 - RNA, 36 nt, Artificial Sequence
  Synthetic Oligonucleotide; GZMB exon 3; Set C
cuuuucacagggauaaacugcugggucggcuccugu

SEQ ID NO: 12888 - RNA, 38 nt, Artificial Sequence
  Synthetic Oligonucleotide; GZMB exon 3; Set C
ucuuuucacagggauaaacugcugggucggcuccuguu

SEQ ID NO: 12889 - RNA, 16 nt, Artificial Sequence
  Synthetic Oligonucleotide; GZMB exon 3; Set C
ggauaaacugcugggu

SEQ ID NO: 12890 - RNA, 37 nt, Artificial Sequence
  Synthetic Oligonucleotide; GZMB exon 3; Set C
ucuuuucacagggauaaacugcugggucggcuccugu

SEQ ID NO: 12891 - RNA, 39 nt, Artificial Sequence
  Synthetic Oligonucleotide; GZMB exon 3; Set C
gucuuuucacagggauaaacugcugggucggcuccuguu

SEQ ID NO: 12892 - RNA, 15 nt, Artificial Sequence
  Synthetic Oligonucleotide; GZMB exon 3; Set C
ggauaaacugcuggg

SEQ ID NO: 12893 - RNA, 40 nt, Artificial Sequence
  Synthetic Oligonucleotide; GZMB exon 3; Set C
ggucuuuucacagggauaaacugcugggucggcuccuguu

SEQ ID NO: 12894 - RNA, 38 nt, Artificial Sequence
  Synthetic Oligonucleotide; GZMB exon 3; Set C
gucuuuucacagggauaaacugcugggucggcuccugu

SEQ ID NO: 12895 - RNA, 28 nt, Artificial Sequence
  Synthetic Oligonucleotide; GZMB exon 3; Set C
uucacagggauaaacugcugggucggcu

SEQ ID NO: 12896 - RNA, 39 nt, Artificial Sequence
  Synthetic Oligonucleotide; GZMB exon 3; Set C
ggucuuuucacagggauaaacugcugggucggcuccugu

SEQ ID NO: 12897 - RNA, 27 nt, Artificial Sequence
  Synthetic Oligonucleotide; GZMB exon 3; Set C
uucacagggauaaacugcugggucggc

SEQ ID NO: 12898 - RNA, 29 nt, Artificial Sequence
  Synthetic Oligonucleotide; GZMB exon 3; Set C
uuucacagggauaaacugcugggucggcu

SEQ ID NO: 12899 - RNA, 40 nt, Artificial Sequence
  Synthetic Oligonucleotide; GZMB exon 3; Set C
gggucuuuucacagggauaaacugcugggucggcuccugu

SEQ ID NO: 12900 - RNA, 28 nt, Artificial Sequence
  Synthetic Oligonucleotide; GZMB exon 3; Set C
uuucacagggauaaacugcugggucggc

SEQ ID NO: 12901 - RNA, 30 nt, Artificial Sequence
  Synthetic Oligonucleotide; GZMB exon 3; Set C
uuuucacagggauaaacugcugggucggcu

SEQ ID NO: 12902 - RNA, 29 nt, Artificial Sequence
  Synthetic Oligonucleotide; GZMB exon 3; Set C
uuuucacagggauaaacugcugggucggc

SEQ ID NO: 12903 - RNA, 31 nt, Artificial Sequence
  Synthetic Oligonucleotide; GZMB exon 3; Set C
cuuuucacagggauaaacugcugggucggcu

SEQ ID NO: 12904 - RNA, 30 nt, Artificial Sequence
  Synthetic Oligonucleotide; GZMB exon 3; Set C
cuuuucacagggauaaacugcugggucggc

SEQ ID NO: 12905 - RNA, 32 nt, Artificial Sequence
  Synthetic Oligonucleotide; GZMB exon 3; Set C
ucuuuucacagggauaaacugcugggucggcu

SEQ ID NO: 12906 - RNA, 31 nt, Artificial Sequence
  Synthetic Oligonucleotide; GZMB exon 3; Set C
ucuuuucacagggauaaacugcugggucggc

SEQ ID NO: 12907 - RNA, 33 nt, Artificial Sequence
  Synthetic Oligonucleotide; GZMB exon 3; Set C
gucuuuucacagggauaaacugcugggucggcu

SEQ ID NO: 12908 - RNA, 32 nt, Artificial Sequence
  Synthetic Oligonucleotide; GZMB exon 3; Set C
gucuuuucacagggauaaacugcugggucggc

SEQ ID NO: 12909 - RNA, 34 nt, Artificial Sequence
  Synthetic Oligonucleotide; GZMB exon 3; Set C
ggucuuuucacagggauaaacugcugggucggcu

SEQ ID NO: 12910 - RNA, 21 nt, Artificial Sequence
  Synthetic Oligonucleotide; GZMB exon 3; Set C
uucacagggauaaacugcugg

SEQ ID NO: 12911 - RNA, 23 nt, Artificial Sequence
  Synthetic Oligonucleotide; GZMB exon 3; Set A
uuucacagggauaaacugcuggg

SEQ ID NO: 12912 - RNA, 33 nt, Artificial Sequence
  Synthetic Oligonucleotide; GZMB exon 3; Set C
ggucuuuucacagggauaaacugcugggucggc

SEQ ID NO: 12913 - RNA, 35 nt, Artificial Sequence
  Synthetic Oligonucleotide; GZMB exon 3; Set C
gggucuuuucacagggauaaacugcugggucggcu

SEQ ID NO: 12914 - RNA, 22 nt, Artificial Sequence
  Synthetic Oligonucleotide; GZMB exon 3; Set C
uuucacagggauaaacugcugg

SEQ ID NO: 12915 - RNA, 24 nt, Artificial Sequence
  Synthetic Oligonucleotide; GZMB exon 3; Set A
uuuucacagggauaaacugcuggg

SEQ ID NO: 12916 - RNA, 34 nt, Artificial Sequence
  Synthetic Oligonucleotide; GZMB exon 3; Set C
gggucuuuucacagggauaaacugcugggucggc

SEQ ID NO: 12917 - RNA, 36 nt, Artificial Sequence
  Synthetic Oligonucleotide; GZMB exon 3; Set C
ugggucuuuucacagggauaaacugcugggucggcu

SEQ ID NO: 12918 - RNA, 23 nt, Artificial Sequence
  Synthetic Oligonucleotide; GZMB exon 3; Set C
uuuucacagggauaaacugcugg

SEQ ID NO: 12919 - RNA, 25 nt, Artificial Sequence
  Synthetic Oligonucleotide; GZMB exon 3; Set A
cuuuucacagggauaaacugcuggg

SEQ ID NO: 12920 - RNA, 35 nt, Artificial Sequence
  Synthetic Oligonucleotide; GZMB exon 3; Set C
ugggucuuuucacagggauaaacugcugggucggc

SEQ ID NO: 12921 - RNA, 37 nt, Artificial Sequence
  Synthetic Oligonucleotide; GZMB exon 3; Set C
augggucuuuucacagggauaaacugcugggucggcu

SEQ ID NO: 12922 - RNA, 31 nt, Artificial Sequence
  Synthetic Oligonucleotide; GZMB exon 3; Set C
ggucuuuucacagggauaaacugcugggucg

SEQ ID NO: 12923 - RNA, 24 nt, Artificial Sequence
  Synthetic Oligonucleotide; GZMB exon 3; Set A
cuuuucacagggauaaacugcugg

SEQ ID NO: 12924 - RNA, 26 nt, Artificial Sequence
  Synthetic Oligonucleotide; GZMB exon 3; Set A
ucuuuucacagggauaaacugcuggg

SEQ ID NO: 12925 - RNA, 36 nt, Artificial Sequence
  Synthetic Oligonucleotide; GZMB exon 3; Set C
augggucuuuucacagggauaaacugcugggucggc

SEQ ID NO: 12926 - RNA, 38 nt, Artificial Sequence
  Synthetic Oligonucleotide; GZMB exon 3; Set C
gaugggucuuuucacagggauaaacugcugggucggcu

SEQ ID NO: 12927 - RNA, 32 nt, Artificial Sequence
  Synthetic Oligonucleotide; GZMB exon 3; Set C
gggucuuuucacagggauaaacugcugggucg

SEQ ID NO: 12928 - RNA, 25 nt, Artificial Sequence
  Synthetic Oligonucleotide; GZMB exon 3; Set A
ucuuuucacagggauaaacugcugg

SEQ ID NO: 12929 - RNA, 27 nt, Artificial Sequence
  Synthetic Oligonucleotide; GZMB exon 3; Set A
gucuuuucacagggauaaacugcuggg

SEQ ID NO: 12930 - RNA, 37 nt, Artificial Sequence
  Synthetic Oligonucleotide; GZMB exon 3; Set C
gaugggucuuuucacagggauaaacugcugggucggc

SEQ ID NO: 12931 - RNA, 29 nt, Artificial Sequence
  Synthetic Oligonucleotide; GZMB exon 3; Set C
ggucuuuucacagggauaaacugcugggu

SEQ ID NO: 12932 - RNA, 33 nt, Artificial Sequence
  Synthetic Oligonucleotide; GZMB exon 3; Set C
ugggucuuuucacagggauaaacugcugggucg

SEQ ID NO: 12933 - RNA, 26 nt, Artificial Sequence
  Synthetic Oligonucleotide; GZMB exon 3; Set A
gucuuuucacagggauaaacugcugg

SEQ ID NO: 12934 - RNA, 28 nt, Artificial Sequence
  Synthetic Oligonucleotide; GZMB exon 3; Set A
ggucuuuucacagggauaaacugcuggg

SEQ ID NO: 12935 - RNA, 30 nt, Artificial Sequence
  Synthetic Oligonucleotide; GZMB exon 3; Set C
gggucuuuucacagggauaaacugcugggu

SEQ ID NO: 12936 - RNA, 34 nt, Artificial Sequence
  Synthetic Oligonucleotide; GZMB exon 3; Set C
augggucuuuucacagggauaaacugcugggucg

SEQ ID NO: 12937 - RNA, 27 nt, Artificial Sequence
  Synthetic Oligonucleotide; GZMB exon 3; Set A
ggucuuuucacagggauaaacugcugg

SEQ ID NO: 12938 - RNA, 29 nt, Artificial Sequence
  Synthetic Oligonucleotide; GZMB exon 3; Set C
gggucuuuucacagggauaaacugcuggg

SEQ ID NO: 12939 - RNA, 31 nt, Artificial Sequence
  Synthetic Oligonucleotide; GZMB exon 3; Set C
ugggucuuuucacagggauaaacugcugggu

SEQ ID NO: 12940 - RNA, 33 nt, Artificial Sequence
  Synthetic Oligonucleotide; GZMB exon 3; Set C
augggucuuuucacagggauaaacugcuggguc

SEQ ID NO: 12941 - RNA, 28 nt, Artificial Sequence
  Synthetic Oligonucleotide; GZMB exon 3; Set A
gggucuuuucacagggauaaacugcugg

SEQ ID NO: 12942 - RNA, 30 nt, Artificial Sequence
  Synthetic Oligonucleotide; GZMB exon 3; Set C
ugggucuuuucacagggauaaacugcuggg

SEQ ID NO: 12943 - RNA, 26 nt, Artificial Sequence
  Synthetic Oligonucleotide; GZMB exon 3; Set A
ggucuuuucacagggauaaacugcug

SEQ ID NO: 12944 - RNA, 32 nt, Artificial Sequence
  Synthetic Oligonucleotide; GZMB exon 3; Set C
augggucuuuucacagggauaaacugcugggu

SEQ ID NO: 12945 - RNA, 29 nt, Artificial Sequence
  Synthetic Oligonucleotide; GZMB exon 3; Set A
ugggucuuuucacagggauaaacugcugg

SEQ ID NO: 12946 - RNA, 15 nt, Artificial Sequence
  Synthetic Oligonucleotide; GZMB exon 3; Set C
uuucacagggauaaa

SEQ ID NO: 12947 - RNA, 31 nt, Artificial Sequence
  Synthetic Oligonucleotide; GZMB exon 3; Set C
augggucuuuucacagggauaaacugcuggg

SEQ ID NO: 12948 - RNA, 27 nt, Artificial Sequence
  Synthetic Oligonucleotide; GZMB exon 3; Set A
gggucuuuucacagggauaaacugcug

SEQ ID NO: 12949 - RNA, 30 nt, Artificial Sequence
  Synthetic Oligonucleotide; GZMB exon 3; Set A
augggucuuuucacagggauaaacugcugg

SEQ ID NO: 12950 - RNA, 16 nt, Artificial Sequence
  Synthetic Oligonucleotide; GZMB exon 3; Set C
uuuucacagggauaaa

SEQ ID NO: 12951 - RNA, 32 nt, Artificial Sequence
  Synthetic Oligonucleotide; GZMB exon 3; Set C
gaugggucuuuucacagggauaaacugcuggg

SEQ ID NO: 12952 - RNA, 28 nt, Artificial Sequence
  Synthetic Oligonucleotide; GZMB exon 3; Set A
ugggucuuuucacagggauaaacugcug

SEQ ID NO: 12953 - RNA, 26 nt, Artificial Sequence
  Synthetic Oligonucleotide; GZMB exon 3; Set A
gggucuuuucacagggauaaacugcu

SEQ ID NO: 12954 - RNA, 15 nt, Artificial Sequence
  Synthetic Oligonucleotide; GZMB exon 3; Set C
uuuucacagggauaa

SEQ ID NO: 12955 - RNA, 31 nt, Artificial Sequence
  Synthetic Oligonucleotide; GZMB exon 3; Set C
gaugggucuuuucacagggauaaacugcugg

SEQ ID NO: 12956 - RNA, 17 nt, Artificial Sequence
  Synthetic Oligonucleotide; GZMB exon 3; Set C
cuuuucacagggauaaa

SEQ ID NO: 12957 - RNA, 29 nt, Artificial Sequence
  Synthetic Oligonucleotide; GZMB exon 3; Set A
augggucuuuucacagggauaaacugcug

SEQ ID NO: 12958 - RNA, 27 nt, Artificial Sequence
  Synthetic Oligonucleotide; GZMB exon 3; Set A
ugggucuuuucacagggauaaacugcu

SEQ ID NO: 12959 - RNA, 16 nt, Artificial Sequence
  Synthetic Oligonucleotide; GZMB exon 3; Set C
cuuuucacagggauaa

SEQ ID NO: 12960 - RNA, 32 nt, Artificial Sequence
  Synthetic Oligonucleotide; GZMB exon 3; Set C
ggaugggucuuuucacagggauaaacugcugg

SEQ ID NO: 12961 - RNA, 18 nt, Artificial Sequence
  Synthetic Oligonucleotide; GZMB exon 3; Set C
ucuuuucacagggauaaa

SEQ ID NO: 12962 - RNA, 28 nt, Artificial Sequence
  Synthetic Oligonucleotide; GZMB exon 3; Set A
augggucuuuucacagggauaaacugcu

SEQ ID NO: 12963 - RNA, 26 nt, Artificial Sequence
  Synthetic Oligonucleotide; GZMB exon 3; Set A
ugggucuuuucacagggauaaacugc

SEQ ID NO: 12964 - RNA, 15 nt, Artificial Sequence
  Synthetic Oligonucleotide; GZMB exon 3; Set C
cuuuucacagggaua

SEQ ID NO: 12965 - RNA, 17 nt, Artificial Sequence
  Synthetic Oligonucleotide; GZMB exon 3; Set C
ucuuuucacagggauaa

SEQ ID NO: 12966 - RNA, 33 nt, Artificial Sequence
  Synthetic Oligonucleotide; GZMB exon 3; Set C
gggaugggucuuuucacagggauaaacugcugg

SEQ ID NO: 12967 - RNA, 19 nt, Artificial Sequence
  Synthetic Oligonucleotide; GZMB exon 3; Set C
gucuuuucacagggauaaa

SEQ ID NO: 12968 - RNA, 27 nt, Artificial Sequence
  Synthetic Oligonucleotide; GZMB exon 3; Set A
augggucuuuucacagggauaaacugc

SEQ ID NO: 12969 - RNA, 16 nt, Artificial Sequence
  Synthetic Oligonucleotide; GZMB exon 3; Set C
ucuuuucacagggaua

SEQ ID NO: 12970 - RNA, 18 nt, Artificial Sequence
  Synthetic Oligonucleotide; GZMB exon 3; Set C
gucuuuucacagggauaa

SEQ ID NO: 12971 - RNA, 34 nt, Artificial Sequence
  Synthetic Oligonucleotide; GZMB exon 3; Set C
ggggaugggucuuuucacagggauaaacugcugg

SEQ ID NO: 12972 - RNA, 20 nt, Artificial Sequence
  Synthetic Oligonucleotide; GZMB exon 3; Set C
ggucuuuucacagggauaaa

SEQ ID NO: 12973 - RNA, 15 nt, Artificial Sequence
  Synthetic Oligonucleotide; GZMB exon 3; Set C
ucuuuucacagggau

SEQ ID NO: 12974 - RNA, 17 nt, Artificial Sequence
  Synthetic Oligonucleotide; GZMB exon 3; Set C
gucuuuucacagggaua

SEQ ID NO: 12975 - RNA, 19 nt, Artificial Sequence
  Synthetic Oligonucleotide; GZMB exon 3; Set C
ggucuuuucacagggauaa

SEQ ID NO: 12976 - RNA, 35 nt, Artificial Sequence
  Synthetic Oligonucleotide; GZMB exon 3; Set C
gggggaugggucuuuucacagggauaaacugcugg

SEQ ID NO: 12977 - RNA, 21 nt, Artificial Sequence
  Synthetic Oligonucleotide; GZMB exon 3; Set C
gggucuuuucacagggauaaa

SEQ ID NO: 12978 - RNA, 16 nt, Artificial Sequence
  Synthetic Oligonucleotide; GZMB exon 3; Set C
gucuuuucacagggau

SEQ ID NO: 12979 - RNA, 18 nt, Artificial Sequence
  Synthetic Oligonucleotide; GZMB exon 3; Set C
ggucuuuucacagggaua

SEQ ID NO: 12980 - RNA, 20 nt, Artificial Sequence
  Synthetic Oligonucleotide; GZMB exon 3; Set C
gggucuuuucacagggauaa

SEQ ID NO: 12981 - RNA, 36 nt, Artificial Sequence
  Synthetic Oligonucleotide; GZMB exon 3; Set C
ugggggaugggucuuuucacagggauaaacugcugg

SEQ ID NO: 12982 - RNA, 22 nt, Artificial Sequence
  Synthetic Oligonucleotide; GZMB exon 3; Set C
ugggucuuuucacagggauaaa

SEQ ID NO: 12983 - RNA, 17 nt, Artificial Sequence
  Synthetic Oligonucleotide; GZMB exon 3; Set C
ggucuuuucacagggau

SEQ ID NO: 12984 - RNA, 19 nt, Artificial Sequence
  Synthetic Oligonucleotide; GZMB exon 3; Set C
gggucuuuucacagggaua

SEQ ID NO: 12985 - RNA, 21 nt, Artificial Sequence
  Synthetic Oligonucleotide; GZMB exon 3; Set C
ugggucuuuucacagggauaa

SEQ ID NO: 12986 - RNA, 37 nt, Artificial Sequence
  Synthetic Oligonucleotide; GZMB exon 3; Set C
augggggaugggucuuuucacagggauaaacugcugg

SEQ ID NO: 12987 - RNA, 15 nt, Artificial Sequence
  Synthetic Oligonucleotide; GZMB exon 3; Set C
gucuuuucacaggga

SEQ ID NO: 12988 - RNA, 23 nt, Artificial Sequence
  Synthetic Oligonucleotide; GZMB exon 3; Set C
augggucuuuucacagggauaaa

SEQ ID NO: 12989 - RNA, 18 nt, Artificial Sequence
  Synthetic Oligonucleotide; GZMB exon 3; Set C
gggucuuuucacagggau

SEQ ID NO: 12990 - RNA, 20 nt, Artificial Sequence
  Synthetic Oligonucleotide; GZMB exon 3; Set C
ugggucuuuucacagggaua

SEQ ID NO: 12991 - RNA, 22 nt, Artificial Sequence
  Synthetic Oligonucleotide; GZMB exon 3; Set C
augggucuuuucacagggauaa

SEQ ID NO: 12992 - RNA, 38 nt, Artificial Sequence
  Synthetic Oligonucleotide; GZMB exon 3; Set C
gaugggggaugggucuuuucacagggauaaacugcugg

SEQ ID NO: 12993 - RNA, 16 nt, Artificial Sequence
  Synthetic Oligonucleotide; GZMB exon 3; Set C
ggucuuuucacaggga

SEQ ID NO: 12994 - RNA, 24 nt, Artificial Sequence
  Synthetic Oligonucleotide; GZMB exon 3; Set C
gaugggucuuuucacagggauaaa

SEQ ID NO: 12995 - RNA, 40 nt, Artificial Sequence
  Synthetic Oligonucleotide; GZMB exon 3; Set C
ggaugggggaugggucuuuucacagggauaaacugcuggg

SEQ ID NO: 12996 - RNA, 19 nt, Artificial Sequence
  Synthetic Oligonucleotide; GZMB exon 3; Set C
ugggucuuuucacagggau

SEQ ID NO: 12997 - RNA, 21 nt, Artificial Sequence
  Synthetic Oligonucleotide; GZMB exon 3; Set C
augggucuuuucacagggaua

SEQ ID NO: 12998 - RNA, 23 nt, Artificial Sequence
  Synthetic Oligonucleotide; GZMB exon 3; Set A
gaugggucuuuucacagggauaa

SEQ ID NO: 12999 - RNA, 39 nt, Artificial Sequence
  Synthetic Oligonucleotide; GZMB exon 3; Set C
ggaugggggaugggucuuuucacagggauaaacugcugg

SEQ ID NO: 13000 - RNA, 17 nt, Artificial Sequence
  Synthetic Oligonucleotide; GZMB exon 3; Set C
gggucuuuucacaggga

SEQ ID NO: 13001 - RNA, 25 nt, Artificial Sequence
  Synthetic Oligonucleotide; GZMB exon 3; Set A
ggaugggucuuuucacagggauaaa

SEQ ID NO: 13002 - RNA, 20 nt, Artificial Sequence
  Synthetic Oligonucleotide; GZMB exon 3; Set C
augggucuuuucacagggau

SEQ ID NO: 13003 - RNA, 22 nt, Artificial Sequence
  Synthetic Oligonucleotide; GZMB exon 3; Set A
gaugggucuuuucacagggaua

SEQ ID NO: 13004 - RNA, 24 nt, Artificial Sequence
  Synthetic Oligonucleotide; GZMB exon 3; Set A
ggaugggucuuuucacagggauaa

SEQ ID NO: 13005 - RNA, 40 nt, Artificial Sequence
  Synthetic Oligonucleotide; GZMB exon 3; Set C
uggaugggggaugggucuuuucacagggauaaacugcugg

SEQ ID NO: 13006 - RNA, 18 nt, Artificial Sequence
  Synthetic Oligonucleotide; GZMB exon 3; Set C
ugggucuuuucacaggga

SEQ ID NO: 13007 - RNA, 26 nt, Artificial Sequence
  Synthetic Oligonucleotide; GZMB exon 3; Set A
gggaugggucuuuucacagggauaaa

SEQ ID NO: 13008 - RNA, 21 nt, Artificial Sequence
  Synthetic Oligonucleotide; GZMB exon 3; Set A
gaugggucuuuucacagggau

SEQ ID NO: 13009 - RNA, 23 nt, Artificial Sequence
  Synthetic Oligonucleotide; GZMB exon 3; Set A
ggaugggucuuuucacagggaua

SEQ ID NO: 13010 - RNA, 25 nt, Artificial Sequence
  Synthetic Oligonucleotide; GZMB exon 3; Set A
gggaugggucuuuucacagggauaa

SEQ ID NO: 13011 - RNA, 19 nt, Artificial Sequence
  Synthetic Oligonucleotide; GZMB exon 3; Set C
augggucuuuucacaggga

SEQ ID NO: 13012 - RNA, 22 nt, Artificial Sequence
  Synthetic Oligonucleotide; GZMB exon 3; Set A
ggaugggucuuuucacagggau

SEQ ID NO: 13013 - RNA, 24 nt, Artificial Sequence
  Synthetic Oligonucleotide; GZMB exon 3; Set A
gggaugggucuuuucacagggaua

SEQ ID NO: 13014 - RNA, 26 nt, Artificial Sequence
  Synthetic Oligonucleotide; GZMB exon 3; Set A
ggggaugggucuuuucacagggauaa

SEQ ID NO: 13015 - RNA, 20 nt, Artificial Sequence
  Synthetic Oligonucleotide; GZMB exon 3; Set A
gaugggucuuuucacaggga

SEQ ID NO: 13016 - RNA, 23 nt, Artificial Sequence
  Synthetic Oligonucleotide; GZMB exon 3; Set A
gggaugggucuuuucacagggau

SEQ ID NO: 13017 - RNA, 25 nt, Artificial Sequence
  Synthetic Oligonucleotide; GZMB exon 3; Set C
ggggaugggucuuuucacagggaua

SEQ ID NO: 13018 - RNA, 27 nt, Artificial Sequence
  Synthetic Oligonucleotide; GZMB exon 3; Set C
gggggaugggucuuuucacagggauaa

SEQ ID NO: 13019 - RNA, 21 nt, Artificial Sequence
  Synthetic Oligonucleotide; GZMB exon 3; Set A
ggaugggucuuuucacaggga

SEQ ID NO: 13020 - RNA, 29 nt, Artificial Sequence
  Synthetic Oligonucleotide; GZMB exon 3; Set C
ugggggaugggucuuuucacagggauaaa

SEQ ID NO: 13021 - RNA, 24 nt, Artificial Sequence
  Synthetic Oligonucleotide; GZMB exon 3; Set C
ggggaugggucuuuucacagggau

SEQ ID NO: 13022 - RNA, 26 nt, Artificial Sequence
  Synthetic Oligonucleotide; GZMB exon 3; Set C
gggggaugggucuuuucacagggaua

SEQ ID NO: 13023 - RNA, 28 nt, Artificial Sequence
  Synthetic Oligonucleotide; GZMB exon 3; Set C
ugggggaugggucuuuucacagggauaa

SEQ ID NO: 13024 - RNA, 22 nt, Artificial Sequence
  Synthetic Oligonucleotide; GZMB exon 3; Set A
gggaugggucuuuucacaggga

SEQ ID NO: 13025 - RNA, 30 nt, Artificial Sequence
  Synthetic Oligonucleotide; GZMB exon 3; Set C
augggggaugggucuuuucacagggauaaa

SEQ ID NO: 13026 - RNA, 25 nt, Artificial Sequence
  Synthetic Oligonucleotide; GZMB exon 3; Set C
gggggaugggucuuuucacagggau

SEQ ID NO: 13027 - RNA, 27 nt, Artificial Sequence
  Synthetic Oligonucleotide; GZMB exon 3; Set C
ugggggaugggucuuuucacagggaua

SEQ ID NO: 13028 - RNA, 29 nt, Artificial Sequence
  Synthetic Oligonucleotide; GZMB exon 3; Set C
augggggaugggucuuuucacagggauaa

SEQ ID NO: 13029 - RNA, 23 nt, Artificial Sequence
  Synthetic Oligonucleotide; GZMB exon 3; Set C
ggggaugggucuuuucacaggga

SEQ ID NO: 13030 - RNA, 31 nt, Artificial Sequence
  Synthetic Oligonucleotide; GZMB exon 3; Set C
gaugggggaugggucuuuucacagggauaaa

SEQ ID NO: 13031 - RNA, 26 nt, Artificial Sequence
  Synthetic Oligonucleotide; GZMB exon 3; Set C
ugggggaugggucuuuucacagggau

SEQ ID NO: 13032 - RNA, 28 nt, Artificial Sequence
  Synthetic Oligonucleotide; GZMB exon 3; Set C
augggggaugggucuuuucacagggaua

SEQ ID NO: 13033 - RNA, 30 nt, Artificial Sequence
  Synthetic Oligonucleotide; GZMB exon 3; Set C
gaugggggaugggucuuuucacagggauaa

SEQ ID NO: 13034 - RNA, 24 nt, Artificial Sequence
  Synthetic Oligonucleotide; GZMB exon 3; Set C
gggggaugggucuuuucacaggga

SEQ ID NO: 13035 - RNA, 32 nt, Artificial Sequence
  Synthetic Oligonucleotide; GZMB exon 3; Set C
ggaugggggaugggucuuuucacagggauaaa

SEQ ID NO: 13036 - RNA, 40 nt, Artificial Sequence
  Synthetic Oligonucleotide; GZMB exon 3; Set C
ggcuggaugggggaugggucuuuucacagggauaaacugc

SEQ ID NO: 13037 - RNA, 27 nt, Artificial Sequence
  Synthetic Oligonucleotide; GZMB exon 3; Set C
augggggaugggucuuuucacagggau

SEQ ID NO: 13038 - RNA, 29 nt, Artificial Sequence
  Synthetic Oligonucleotide; GZMB exon 3; Set C
gaugggggaugggucuuuucacagggaua

SEQ ID NO: 13039 - RNA, 31 nt, Artificial Sequence
  Synthetic Oligonucleotide; GZMB exon 3; Set C
ggaugggggaugggucuuuucacagggauaa

SEQ ID NO: 13040 - RNA, 25 nt, Artificial Sequence
  Synthetic Oligonucleotide; GZMB exon 3; Set C
ugggggaugggucuuuucacaggga

SEQ ID NO: 13041 - RNA, 33 nt, Artificial Sequence
  Synthetic Oligonucleotide; GZMB exon 3; Set C
uggaugggggaugggucuuuucacagggauaaa

SEQ ID NO: 13042 - RNA, 28 nt, Artificial Sequence
  Synthetic Oligonucleotide; GZMB exon 3; Set C
gaugggggaugggucuuuucacagggau

SEQ ID NO: 13043 - RNA, 30 nt, Artificial Sequence
  Synthetic Oligonucleotide; GZMB exon 3; Set C
ggaugggggaugggucuuuucacagggaua

SEQ ID NO: 13044 - RNA, 32 nt, Artificial Sequence
  Synthetic Oligonucleotide; GZMB exon 3; Set C
uggaugggggaugggucuuuucacagggauaa

SEQ ID NO: 13045 - RNA, 26 nt, Artificial Sequence
  Synthetic Oligonucleotide; GZMB exon 3; Set C
augggggaugggucuuuucacaggga

SEQ ID NO: 13046 - RNA, 34 nt, Artificial Sequence
  Synthetic Oligonucleotide; GZMB exon 3; Set C
cuggaugggggaugggucuuuucacagggauaaa

SEQ ID NO: 13047 - RNA, 29 nt, Artificial Sequence
  Synthetic Oligonucleotide; GZMB exon 3; Set C
ggaugggggaugggucuuuucacagggau

SEQ ID NO: 13048 - RNA, 31 nt, Artificial Sequence
  Synthetic Oligonucleotide; GZMB exon 3; Set C
uggaugggggaugggucuuuucacagggaua

SEQ ID NO: 13049 - RNA, 33 nt, Artificial Sequence
  Synthetic Oligonucleotide; GZMB exon 3; Set C
cuggaugggggaugggucuuuucacagggauaa

SEQ ID NO: 13050 - RNA, 27 nt, Artificial Sequence
  Synthetic Oligonucleotide; GZMB exon 3; Set C
gaugggggaugggucuuuucacaggga

SEQ ID NO: 13051 - RNA, 35 nt, Artificial Sequence
  Synthetic Oligonucleotide; GZMB exon 3; Set C
gcuggaugggggaugggucuuuucacagggauaaa

SEQ ID NO: 13052 - RNA, 15 nt, Artificial Sequence
  Synthetic Oligonucleotide; GZMB exon 3; Set C
ggaugggucuuuuca

SEQ ID NO: 13053 - RNA, 30 nt, Artificial Sequence
  Synthetic Oligonucleotide; GZMB exon 3; Set C
uggaugggggaugggucuuuucacagggau

SEQ ID NO: 13054 - RNA, 32 nt, Artificial Sequence
  Synthetic Oligonucleotide; GZMB exon 3; Set C
cuggaugggggaugggucuuuucacagggaua

SEQ ID NO: 13055 - RNA, 34 nt, Artificial Sequence
  Synthetic Oligonucleotide; GZMB exon 3; Set C
gcuggaugggggaugggucuuuucacagggauaa

SEQ ID NO: 13056 - RNA, 28 nt, Artificial Sequence
  Synthetic Oligonucleotide; GZMB exon 3; Set C
ggaugggggaugggucuuuucacaggga

SEQ ID NO: 13057 - RNA, 36 nt, Artificial Sequence
  Synthetic Oligonucleotide; GZMB exon 3; Set C
ggcuggaugggggaugggucuuuucacagggauaaa

SEQ ID NO: 13058 - RNA, 16 nt, Artificial Sequence
  Synthetic Oligonucleotide; GZMB exon 3; Set C
gggaugggucuuuuca

SEQ ID NO: 13059 - RNA, 31 nt, Artificial Sequence
  Synthetic Oligonucleotide; GZMB exon 3; Set C
cuggaugggggaugggucuuuucacagggau

SEQ ID NO: 13060 - RNA, 33 nt, Artificial Sequence
  Synthetic Oligonucleotide; GZMB exon 3; Set C
gcuggaugggggaugggucuuuucacagggaua

SEQ ID NO: 13061 - RNA, 35 nt, Artificial Sequence
  Synthetic Oligonucleotide; GZMB exon 3; Set C
ggcuggaugggggaugggucuuuucacagggauaa

SEQ ID NO: 13062 - RNA, 29 nt, Artificial Sequence
  Synthetic Oligonucleotide; GZMB exon 3; Set C
uggaugggggaugggucuuuucacaggga

SEQ ID NO: 13063 - RNA, 37 nt, Artificial Sequence
  Synthetic Oligonucleotide; GZMB exon 3; Set C
aggcuggaugggggaugggucuuuucacagggauaaa

SEQ ID NO: 13064 - RNA, 32 nt, Artificial Sequence
  Synthetic Oligonucleotide; GZMB exon 3; Set C
gcuggaugggggaugggucuuuucacagggau

SEQ ID NO: 13065 - RNA, 34 nt, Artificial Sequence
  Synthetic Oligonucleotide; GZMB exon 3; Set C
ggcuggaugggggaugggucuuuucacagggaua

SEQ ID NO: 13066 - RNA, 36 nt, Artificial Sequence
  Synthetic Oligonucleotide; GZMB exon 3; Set C
aggcuggaugggggaugggucuuuucacagggauaa

SEQ ID NO: 13067 - RNA, 30 nt, Artificial Sequence
  Synthetic Oligonucleotide; GZMB exon 3; Set C
cuggaugggggaugggucuuuucacaggga

SEQ ID NO: 13068 - RNA, 38 nt, Artificial Sequence
  Synthetic Oligonucleotide; GZMB exon 3; Set C
uaggcuggaugggggaugggucuuuucacagggauaaa

SEQ ID NO: 13069 - RNA, 33 nt, Artificial Sequence
  Synthetic Oligonucleotide; GZMB exon 3; Set C
ggcuggaugggggaugggucuuuucacagggau

SEQ ID NO: 13070 - RNA, 31 nt, Artificial Sequence
  Synthetic Oligonucleotide; GZMB exon 3; Set C
gcuggaugggggaugggucuuuucacaggga

SEQ ID NO: 13071 - RNA, 39 nt, Artificial Sequence
  Synthetic Oligonucleotide; GZMB exon 3; Set C
auaggcuggaugggggaugggucuuuucacagggauaaa

SEQ ID NO: 13072 - RNA, 32 nt, Artificial Sequence
  Synthetic Oligonucleotide; GZMB exon 3; Set C
ggcuggaugggggaugggucuuuucacaggga

SEQ ID NO: 13073 - RNA, 40 nt, Artificial Sequence
  Synthetic Oligonucleotide; GZMB exon 3; Set C
uauaggcuggaugggggaugggucuuuucacagggauaaa

SEQ ID NO: 13074 - RNA, 20 nt, Artificial Sequence
  Synthetic Oligonucleotide; GZMB exon 3; Set A
augggggaugggucuuuuca

SEQ ID NO: 13075 - RNA, 15 nt, Artificial Sequence
  Synthetic Oligonucleotide; GZMB exon 3; Set C
gggggaugggucuuu

SEQ ID NO: 13076 - RNA, 33 nt, Artificial Sequence
  Synthetic Oligonucleotide; GZMB exon 3; Set C
aggcuggaugggggaugggucuuuucacaggga

SEQ ID NO: 13077 - RNA, 21 nt, Artificial Sequence
  Synthetic Oligonucleotide; GZMB exon 3; Set A
gaugggggaugggucuuuuca

SEQ ID NO: 13078 - RNA, 34 nt, Artificial Sequence
  Synthetic Oligonucleotide; GZMB exon 3; Set C
uaggcuggaugggggaugggucuuuucacaggga

SEQ ID NO: 13079 - RNA, 22 nt, Artificial Sequence
  Synthetic Oligonucleotide; GZMB exon 3; Set A
ggaugggggaugggucuuuuca

SEQ ID NO: 13080 - RNA, 15 nt, Artificial Sequence
  Synthetic Oligonucleotide; GZMB exon 3; Set C
ugggggaugggucuu

SEQ ID NO: 13081 - RNA, 23 nt, Artificial Sequence
  Synthetic Oligonucleotide; GZMB exon 3; Set A
uggaugggggaugggucuuuuca

SEQ ID NO: 13082 - RNA, 24 nt, Artificial Sequence
  Synthetic Oligonucleotide; GZMB exon 3; Set A
cuggaugggggaugggucuuuuca

SEQ ID NO: 13083 - RNA, 25 nt, Artificial Sequence
  Synthetic Oligonucleotide; GZMB exon 3; Set C
gcuggaugggggaugggucuuuuca

SEQ ID NO: 13084 - RNA, 26 nt, Artificial Sequence
  Synthetic Oligonucleotide; GZMB exon 3; Set C
ggcuggaugggggaugggucuuuuca

SEQ ID NO: 13085 - RNA, 27 nt, Artificial Sequence
  Synthetic Oligonucleotide; GZMB exon 3; Set C
aggcuggaugggggaugggucuuuuca

SEQ ID NO: 13086 - RNA, 20 nt, Artificial Sequence
  Synthetic Oligonucleotide; GZMB exon 3; Set A
cuggaugggggaugggucuu

SEQ ID NO: 13087 - RNA, 28 nt, Artificial Sequence
  Synthetic Oligonucleotide; GZMB exon 3; Set C
uaggcuggaugggggaugggucuuuuca

SEQ ID NO: 13088 - RNA, 19 nt, Artificial Sequence
  Synthetic Oligonucleotide; GZMB exon 3; Set A
cuggaugggggaugggucu

SEQ ID NO: 13089 - RNA, 29 nt, Artificial Sequence
  Synthetic Oligonucleotide; GZMB exon 3; Set C
auaggcuggaugggggaugggucuuuuca

SEQ ID NO: 13090 - RNA, 20 nt, Artificial Sequence
  Synthetic Oligonucleotide; GZMB exon 3; Set C
gcuggaugggggaugggucu

SEQ ID NO: 13091 - RNA, 18 nt, Artificial Sequence
  Synthetic Oligonucleotide; GZMB exon 3; Set A
cuggaugggggauggguc

SEQ ID NO: 13092 - RNA, 30 nt, Artificial Sequence
  Synthetic Oligonucleotide; GZMB exon 3; Set C
uauaggcuggaugggggaugggucuuuuca

SEQ ID NO: 13093 - RNA, 19 nt, Artificial Sequence
  Synthetic Oligonucleotide; GZMB exon 3; Set A
gcuggaugggggauggguc

SEQ ID NO: 13094 - RNA, 31 nt, Artificial Sequence
  Synthetic Oligonucleotide; GZMB exon 3; Set C
uuauaggcuggaugggggaugggucuuuuca

SEQ ID NO: 13095 - RNA, 16 nt, Artificial Sequence
  Synthetic Oligonucleotide; GZMB exon 3; Set C
cuggaugggggauggg

SEQ ID NO: 13096 - RNA, 32 nt, Artificial Sequence
  Synthetic Oligonucleotide; GZMB exon 3; Set C
auuauaggcuggaugggggaugggucuuuuca

SEQ ID NO: 13097 - RNA, 33 nt, Artificial Sequence
  Synthetic Oligonucleotide; GZMB exon 3; Set C
gauuauaggcuggaugggggaugggucuuuuca

SEQ ID NO: 13098 - RNA, 34 nt, Artificial Sequence
  Synthetic Oligonucleotide; GZMB exon 3; Set C
ggauuauaggcuggaugggggaugggucuuuuca

SEQ ID NO: 13099 - RNA, 15 nt, Artificial Sequence
  Synthetic Oligonucleotide; GZMB exon 3; Set C
gcuggaugggggaug

SEQ ID NO: 13100 - RNA, 35 nt, Artificial Sequence
  Synthetic Oligonucleotide; GZMB exon 3; Set C
aggauuauaggcuggaugggggaugggucuuuuca

SEQ ID NO: 13101 - RNA, 36 nt, Artificial Sequence
  Synthetic Oligonucleotide; GZMB exon 3; Set C
uaggauuauaggcuggaugggggaugggucuuuuca

SEQ ID NO: 13102 - RNA, 36 nt, Artificial Sequence
  Synthetic Oligonucleotide; GZMB exon 3; Set C
uuaggauuauaggcuggaugggggaugggucuuuuc

SEQ ID NO: 13103 - RNA, 35 nt, Artificial Sequence
  Synthetic Oligonucleotide; GZMB exon 3; Set C
uuaggauuauaggcuggaugggggaugggucuuuu

SEQ ID NO: 13104 - RNA, 34 nt, Artificial Sequence
  Synthetic Oligonucleotide; GZMB exon 3; Set C
uuaggauuauaggcuggaugggggaugggucuuu

SEQ ID NO: 13105 - RNA, 15 nt, Artificial Sequence
  Synthetic Oligonucleotide; GZMB exon 3; Set C
uaggcuggauggggg

SEQ ID NO: 13106 - RNA, 15 nt, Artificial Sequence
  Synthetic Oligonucleotide; GZMB exon 3; Set C
auaggcuggaugggg

SEQ ID NO: 13107 - RNA, 30 nt, Artificial Sequence
  Synthetic Oligonucleotide; GZMB exon 3; Set C
uuaggauuauaggcuggaugggggaugggu

SEQ ID NO: 13108 - RNA, 16 nt, Artificial Sequence
  Synthetic Oligonucleotide; GZMB exon 3; Set C
uauaggcuggaugggg

SEQ ID NO: 13109 - RNA, 29 nt, Artificial Sequence
  Synthetic Oligonucleotide; GZMB exon 3; Set C
uuaggauuauaggcuggaugggggauggg

SEQ ID NO: 13110 - RNA, 17 nt, Artificial Sequence
  Synthetic Oligonucleotide; GZMB exon 3; Set C
uuauaggcuggaugggg

SEQ ID NO: 13111 - RNA, 15 nt, Artificial Sequence
  Synthetic Oligonucleotide; GZMB exon 3; Set C
uauaggcuggauggg

SEQ ID NO: 13112 - RNA, 28 nt, Artificial Sequence
  Synthetic Oligonucleotide; GZMB exon 3; Set C
uuaggauuauaggcuggaugggggaugg

SEQ ID NO: 13113 - RNA, 18 nt, Artificial Sequence
  Synthetic Oligonucleotide; GZMB exon 3; Set C
auuauaggcuggaugggg

SEQ ID NO: 13114 - RNA, 16 nt, Artificial Sequence
  Synthetic Oligonucleotide; GZMB exon 3; Set C
uuauaggcuggauggg

SEQ ID NO: 13115 - RNA, 27 nt, Artificial Sequence
  Synthetic Oligonucleotide; GZMB exon 3; Set A
uuaggauuauaggcuggaugggggaug

SEQ ID NO: 13116 - RNA, 15 nt, Artificial Sequence
  Synthetic Oligonucleotide; GZMB exon 3; Set C
uuauaggcuggaugg

SEQ ID NO: 13117 - RNA, 19 nt, Artificial Sequence
  Synthetic Oligonucleotide; GZMB exon 3; Set C
gauuauaggcuggaugggg

SEQ ID NO: 13118 - RNA, 17 nt, Artificial Sequence
  Synthetic Oligonucleotide; GZMB exon 3; Set C
auuauaggcuggauggg

SEQ ID NO: 13119 - RNA, 16 nt, Artificial Sequence
  Synthetic Oligonucleotide; GZMB exon 3; Set C
auuauaggcuggaugg

SEQ ID NO: 13120 - RNA, 18 nt, Artificial Sequence
  Synthetic Oligonucleotide; GZMB exon 3; Set C
gauuauaggcuggauggg

SEQ ID NO: 13121 - RNA, 20 nt, Artificial Sequence
  Synthetic Oligonucleotide; GZMB exon 3; Set A
ggauuauaggcuggaugggg

SEQ ID NO: 13122 - RNA, 17 nt, Artificial Sequence
  Synthetic Oligonucleotide; GZMB exon 3; Set C
gauuauaggcuggaugg

SEQ ID NO: 13123 - RNA, 19 nt, Artificial Sequence
  Synthetic Oligonucleotide; GZMB exon 3; Set C
ggauuauaggcuggauggg

SEQ ID NO: 13124 - RNA, 21 nt, Artificial Sequence
  Synthetic Oligonucleotide; GZMB exon 3; Set A
aggauuauaggcuggaugggg

SEQ ID NO: 13125 - RNA, 18 nt, Artificial Sequence
  Synthetic Oligonucleotide; GZMB exon 3; Set C
ggauuauaggcuggaugg

SEQ ID NO: 13126 - RNA, 20 nt, Artificial Sequence
  Synthetic Oligonucleotide; GZMB exon 3; Set C
aggauuauaggcuggauggg

SEQ ID NO: 13127 - RNA, 22 nt, Artificial Sequence
  Synthetic Oligonucleotide; GZMB exon 3; Set A
uaggauuauaggcuggaugggg

SEQ ID NO: 13128 - RNA, 19 nt, Artificial Sequence
  Synthetic Oligonucleotide; GZMB exon 3; Set C
aggauuauaggcuggaugg

SEQ ID NO: 13129 - RNA, 21 nt, Artificial Sequence
  Synthetic Oligonucleotide; GZMB exon 3; Set C
uaggauuauaggcuggauggg

SEQ ID NO: 13130 - RNA, 40 nt, Artificial Sequence
  Synthetic Oligonucleotide; GZMB exon 3; Set C
gagaaguucuuaggauuauaggcuggaugggggauggguc

SEQ ID NO: 13131 - RNA, 20 nt, Artificial Sequence
  Synthetic Oligonucleotide; GZMB exon 3; Set C
uaggauuauaggcuggaugg

SEQ ID NO: 13132 - RNA, 28 nt, Artificial Sequence
  Synthetic Oligonucleotide; GZMB exon 3; Set A
guucuuaggauuauaggcuggauggggg

SEQ ID NO: 13133 - RNA, 29 nt, Artificial Sequence
  Synthetic Oligonucleotide; GZMB exon 3; Set A
aguucuuaggauuauaggcuggauggggg

SEQ ID NO: 13134 - RNA, 27 nt, Artificial Sequence
  Synthetic Oligonucleotide; GZMB exon 3; Set A
guucuuaggauuauaggcuggaugggg

SEQ ID NO: 13135 - RNA, 34 nt, Artificial Sequence
  Synthetic Oligonucleotide; GZMB exon 3; Set C
agaaguucuuaggauuauaggcuggaugggggau

SEQ ID NO: 13136 - RNA, 26 nt, Artificial Sequence
  Synthetic Oligonucleotide; GZMB exon 3; Set A
guucuuaggauuauaggcuggauggg

SEQ ID NO: 13137 - RNA, 28 nt, Artificial Sequence
  Synthetic Oligonucleotide; GZMB exon 3; Set A
aguucuuaggauuauaggcuggaugggg

SEQ ID NO: 13138 - RNA, 35 nt, Artificial Sequence
  Synthetic Oligonucleotide; GZMB exon 3; Set C
gagaaguucuuaggauuauaggcuggaugggggau

SEQ ID NO: 13139 - RNA, 33 nt, Artificial Sequence
  Synthetic Oligonucleotide; GZMB exon 3; Set C
agaaguucuuaggauuauaggcuggauggggga

SEQ ID NO: 13140 - RNA, 31 nt, Artificial Sequence
  Synthetic Oligonucleotide; GZMB exon 3; Set C
gaaguucuuaggauuauaggcuggauggggg

SEQ ID NO: 13141 - RNA, 25 nt, Artificial Sequence
  Synthetic Oligonucleotide; GZMB exon 3; Set A
guucuuaggauuauaggcuggaugg

SEQ ID NO: 13142 - RNA, 29 nt, Artificial Sequence
  Synthetic Oligonucleotide; GZMB exon 3; Set A
aaguucuuaggauuauaggcuggaugggg

SEQ ID NO: 13143 - RNA, 27 nt, Artificial Sequence
  Synthetic Oligonucleotide; GZMB exon 3; Set A
aguucuuaggauuauaggcuggauggg

SEQ ID NO: 13144 - RNA, 36 nt, Artificial Sequence
  Synthetic Oligonucleotide; GZMB exon 3; Set C
ggagaaguucuuaggauuauaggcuggaugggggau

SEQ ID NO: 13145 - RNA, 34 nt, Artificial Sequence
  Synthetic Oligonucleotide; GZMB exon 3; Set C
gagaaguucuuaggauuauaggcuggauggggga

SEQ ID NO: 13146 - RNA, 32 nt, Artificial Sequence
  Synthetic Oligonucleotide; GZMB exon 3; Set C
agaaguucuuaggauuauaggcuggauggggg

SEQ ID NO: 13147 - RNA, 26 nt, Artificial Sequence
  Synthetic Oligonucleotide; GZMB exon 3; Set A
aguucuuaggauuauaggcuggaugg

SEQ ID NO: 13148 - RNA, 28 nt, Artificial Sequence
  Synthetic Oligonucleotide; GZMB exon 3; Set A
aaguucuuaggauuauaggcuggauggg

SEQ ID NO: 13149 - RNA, 30 nt, Artificial Sequence
  Synthetic Oligonucleotide; GZMB exon 3; Set A
gaaguucuuaggauuauaggcuggaugggg

SEQ ID NO: 13150 - RNA, 35 nt, Artificial Sequence
  Synthetic Oligonucleotide; GZMB exon 3; Set C
ggagaaguucuuaggauuauaggcuggauggggga

SEQ ID NO: 13151 - RNA, 25 nt, Artificial Sequence
  Synthetic Oligonucleotide; GZMB exon 3; Set C
aguucuuaggauuauaggcuggaug

SEQ ID NO: 13152 - RNA, 33 nt, Artificial Sequence
  Synthetic Oligonucleotide; GZMB exon 3; Set C
gagaaguucuuaggauuauaggcuggauggggg

SEQ ID NO: 13153 - RNA, 27 nt, Artificial Sequence
  Synthetic Oligonucleotide; GZMB exon 3; Set A
aaguucuuaggauuauaggcuggaugg

SEQ ID NO: 13154 - RNA, 29 nt, Artificial Sequence
  Synthetic Oligonucleotide; GZMB exon 3; Set A
gaaguucuuaggauuauaggcuggauggg

SEQ ID NO: 13155 - RNA, 31 nt, Artificial Sequence
  Synthetic Oligonucleotide; GZMB exon 3; Set A
agaaguucuuaggauuauaggcuggaugggg

SEQ ID NO: 13156 - RNA, 24 nt, Artificial Sequence
  Synthetic Oligonucleotide; GZMB exon 3; Set C
aguucuuaggauuauaggcuggau

SEQ ID NO: 13157 - RNA, 34 nt, Artificial Sequence
  Synthetic Oligonucleotide; GZMB exon 3; Set C
ggagaaguucuuaggauuauaggcuggauggggg

SEQ ID NO: 13158 - RNA, 28 nt, Artificial Sequence
  Synthetic Oligonucleotide; GZMB exon 3; Set A
gaaguucuuaggauuauaggcuggaugg

SEQ ID NO: 13159 - RNA, 30 nt, Artificial Sequence
  Synthetic Oligonucleotide; GZMB exon 3; Set A
agaaguucuuaggauuauaggcuggauggg

SEQ ID NO: 13160 - RNA, 32 nt, Artificial Sequence
  Synthetic Oligonucleotide; GZMB exon 3; Set A
gagaaguucuuaggauuauaggcuggaugggg

SEQ ID NO: 13161 - RNA, 27 nt, Artificial Sequence
  Synthetic Oligonucleotide; GZMB exon 3; Set A
gaaguucuuaggauuauaggcuggaug

SEQ ID NO: 13162 - RNA, 35 nt, Artificial Sequence
  Synthetic Oligonucleotide; GZMB exon 3; Set C
uggagaaguucuuaggauuauaggcuggauggggg

SEQ ID NO: 13163 - RNA, 29 nt, Artificial Sequence
  Synthetic Oligonucleotide; GZMB exon 3; Set A
agaaguucuuaggauuauaggcuggaugg

SEQ ID NO: 13164 - RNA, 33 nt, Artificial Sequence
  Synthetic Oligonucleotide; GZMB exon 3; Set C
ggagaaguucuuaggauuauaggcuggaugggg

SEQ ID NO: 13165 - RNA, 31 nt, Artificial Sequence
  Synthetic Oligonucleotide; GZMB exon 3; Set A
gagaaguucuuaggauuauaggcuggauggg

SEQ ID NO: 13166 - RNA, 26 nt, Artificial Sequence
  Synthetic Oligonucleotide; GZMB exon 3; Set A
gaaguucuuaggauuauaggcuggau

SEQ ID NO: 13167 - RNA, 28 nt, Artificial Sequence
  Synthetic Oligonucleotide; GZMB exon 3; Set A
agaaguucuuaggauuauaggcuggaug

SEQ ID NO: 13168 - RNA, 36 nt, Artificial Sequence
  Synthetic Oligonucleotide; GZMB exon 3; Set C
uuggagaaguucuuaggauuauaggcuggauggggg

SEQ ID NO: 13169 - RNA, 20 nt, Artificial Sequence
  Synthetic Oligonucleotide; GZMB exon 3; Set C
guucuuaggauuauaggcug

SEQ ID NO: 13170 - RNA, 30 nt, Artificial Sequence
  Synthetic Oligonucleotide; GZMB exon 3; Set A
gagaaguucuuaggauuauaggcuggaugg

SEQ ID NO: 13171 - RNA, 34 nt, Artificial Sequence
  Synthetic Oligonucleotide; GZMB exon 3; Set C
uggagaaguucuuaggauuauaggcuggaugggg

SEQ ID NO: 13172 - RNA, 32 nt, Artificial Sequence
  Synthetic Oligonucleotide; GZMB exon 3; Set A
ggagaaguucuuaggauuauaggcuggauggg

SEQ ID NO: 13173 - RNA, 27 nt, Artificial Sequence
  Synthetic Oligonucleotide; GZMB exon 3; Set A
agaaguucuuaggauuauaggcuggau

SEQ ID NO: 13174 - RNA, 29 nt, Artificial Sequence
  Synthetic Oligonucleotide; GZMB exon 3; Set A
gagaaguucuuaggauuauaggcuggaug

SEQ ID NO: 13175 - RNA, 19 nt, Artificial Sequence
  Synthetic Oligonucleotide; GZMB exon 3; Set C
guucuuaggauuauaggcu

SEQ ID NO: 13176 - RNA, 21 nt, Artificial Sequence
  Synthetic Oligonucleotide; GZMB exon 3; Set C
aguucuuaggauuauaggcug

SEQ ID NO: 13177 - RNA, 31 nt, Artificial Sequence
  Synthetic Oligonucleotide; GZMB exon 3; Set A
ggagaaguucuuaggauuauaggcuggaugg

SEQ ID NO: 13178 - RNA, 35 nt, Artificial Sequence
  Synthetic Oligonucleotide; GZMB exon 3; Set C
uuggagaaguucuuaggauuauaggcuggaugggg

SEQ ID NO: 13179 - RNA, 33 nt, Artificial Sequence
  Synthetic Oligonucleotide; GZMB exon 3; Set A
uggagaaguucuuaggauuauaggcuggauggg

SEQ ID NO: 13180 - RNA, 26 nt, Artificial Sequence
  Synthetic Oligonucleotide; GZMB exon 3; Set A
agaaguucuuaggauuauaggcugga

SEQ ID NO: 13181 - RNA, 30 nt, Artificial Sequence
  Synthetic Oligonucleotide; GZMB exon 3; Set A
ggagaaguucuuaggauuauaggcuggaug

SEQ ID NO: 13182 - RNA, 28 nt, Artificial Sequence
  Synthetic Oligonucleotide; GZMB exon 3; Set A
gagaaguucuuaggauuauaggcuggau

SEQ ID NO: 13183 - RNA, 38 nt, Artificial Sequence
  Synthetic Oligonucleotide; GZMB exon 3; Set C
cguuggagaaguucuuaggauuauaggcuggauggggg

SEQ ID NO: 13184 - RNA, 20 nt, Artificial Sequence
  Synthetic Oligonucleotide; GZMB exon 3; Set C
aguucuuaggauuauaggcu

SEQ ID NO: 13185 - RNA, 22 nt, Artificial Sequence
  Synthetic Oligonucleotide; GZMB exon 3; Set C
aaguucuuaggauuauaggcug

SEQ ID NO: 13186 - RNA, 32 nt, Artificial Sequence
  Synthetic Oligonucleotide; GZMB exon 3; Set A
uggagaaguucuuaggauuauaggcuggaugg

SEQ ID NO: 13187 - RNA, 36 nt, Artificial Sequence
  Synthetic Oligonucleotide; GZMB exon 3; Set C
guuggagaaguucuuaggauuauaggcuggaugggg

SEQ ID NO: 13188 - RNA, 34 nt, Artificial Sequence
  Synthetic Oligonucleotide; GZMB exon 3; Set C
uuggagaaguucuuaggauuauaggcuggauggg

SEQ ID NO: 13189 - RNA, 27 nt, Artificial Sequence
  Synthetic Oligonucleotide; GZMB exon 3; Set A
gagaaguucuuaggauuauaggcugga

SEQ ID NO: 13190 - RNA, 25 nt, Artificial Sequence
  Synthetic Oligonucleotide; GZMB exon 3; Set C
agaaguucuuaggauuauaggcugg

SEQ ID NO: 13191 - RNA, 29 nt, Artificial Sequence
  Synthetic Oligonucleotide; GZMB exon 3; Set A
ggagaaguucuuaggauuauaggcuggau

SEQ ID NO: 13192 - RNA, 39 nt, Artificial Sequence
  Synthetic Oligonucleotide; GZMB exon 3; Set C
ucguuggagaaguucuuaggauuauaggcuggauggggg

SEQ ID NO: 13193 - RNA, 23 nt, Artificial Sequence
  Synthetic Oligonucleotide; GZMB exon 3; Set C
gaaguucuuaggauuauaggcug

SEQ ID NO: 13194 - RNA, 33 nt, Artificial Sequence
  Synthetic Oligonucleotide; GZMB exon 3; Set A
uuggagaaguucuuaggauuauaggcuggaugg

SEQ ID NO: 13195 - RNA, 35 nt, Artificial Sequence
  Synthetic Oligonucleotide; GZMB exon 3; Set C
guuggagaaguucuuaggauuauaggcuggauggg

SEQ ID NO: 13196 - RNA, 37 nt, Artificial Sequence
  Synthetic Oligonucleotide; GZMB exon 3; Set C
cguuggagaaguucuuaggauuauaggcuggaugggg

SEQ ID NO: 13197 - RNA, 28 nt, Artificial Sequence
  Synthetic Oligonucleotide; GZMB exon 3; Set A
ggagaaguucuuaggauuauaggcugga

SEQ ID NO: 13198 - RNA, 26 nt, Artificial Sequence
  Synthetic Oligonucleotide; GZMB exon 3; Set A
gagaaguucuuaggauuauaggcugg

SEQ ID NO: 13199 - RNA, 22 nt, Artificial Sequence
  Synthetic Oligonucleotide; GZMB exon 3; Set C
gaaguucuuaggauuauaggcu

SEQ ID NO: 13200 - RNA, 24 nt, Artificial Sequence
  Synthetic Oligonucleotide; GZMB exon 3; Set C
agaaguucuuaggauuauaggcug

SEQ ID NO: 13201 - RNA, 34 nt, Artificial Sequence
  Synthetic Oligonucleotide; GZMB exon 3; Set A
guuggagaaguucuuaggauuauaggcuggaugg

SEQ ID NO: 13202 - RNA, 38 nt, Artificial Sequence
  Synthetic Oligonucleotide; GZMB exon 3; Set C
ucguuggagaaguucuuaggauuauaggcuggaugggg

SEQ ID NO: 13203 - RNA, 36 nt, Artificial Sequence
  Synthetic Oligonucleotide; GZMB exon 3; Set C
cguuggagaaguucuuaggauuauaggcuggauggg

SEQ ID NO: 13204 - RNA, 27 nt, Artificial Sequence
  Synthetic Oligonucleotide; GZMB exon 3; Set A
ggagaaguucuuaggauuauaggcugg

SEQ ID NO: 13205 - RNA, 23 nt, Artificial Sequence
  Synthetic Oligonucleotide; GZMB exon 3; Set C
agaaguucuuaggauuauaggcu

SEQ ID NO: 13206 - RNA, 25 nt, Artificial Sequence
  Synthetic Oligonucleotide; GZMB exon 3; Set C
gagaaguucuuaggauuauaggcug

SEQ ID NO: 13207 - RNA, 35 nt, Artificial Sequence
  Synthetic Oligonucleotide; GZMB exon 3; Set C
cguuggagaaguucuuaggauuauaggcuggaugg

SEQ ID NO: 13208 - RNA, 37 nt, Artificial Sequence
  Synthetic Oligonucleotide; GZMB exon 3; Set C
ucguuggagaaguucuuaggauuauaggcuggauggg

SEQ ID NO: 13209 - RNA, 22 nt, Artificial Sequence
  Synthetic Oligonucleotide; GZMB exon 3; Set C
agaaguucuuaggauuauaggc

SEQ ID NO: 13210 - RNA, 24 nt, Artificial Sequence
  Synthetic Oligonucleotide; GZMB exon 3; Set C
gagaaguucuuaggauuauaggcu

SEQ ID NO: 13211 - RNA, 26 nt, Artificial Sequence
  Synthetic Oligonucleotide; GZMB exon 3; Set A
ggagaaguucuuaggauuauaggcug

SEQ ID NO: 13212 - RNA, 36 nt, Artificial Sequence
  Synthetic Oligonucleotide; GZMB exon 3; Set C
ucguuggagaaguucuuaggauuauaggcuggaugg

SEQ ID NO: 13213 - RNA, 21 nt, Artificial Sequence
  Synthetic Oligonucleotide; GZMB exon 3; Set C
agaaguucuuaggauuauagg

SEQ ID NO: 13214 - RNA, 23 nt, Artificial Sequence
  Synthetic Oligonucleotide; GZMB exon 3; Set C
gagaaguucuuaggauuauaggc

SEQ ID NO: 13215 - RNA, 25 nt, Artificial Sequence
  Synthetic Oligonucleotide; GZMB exon 3; Set C
ggagaaguucuuaggauuauaggcu

SEQ ID NO: 13216 - RNA, 27 nt, Artificial Sequence
  Synthetic Oligonucleotide; GZMB exon 3; Set A
uggagaaguucuuaggauuauaggcug

SEQ ID NO: 13217 - RNA, 22 nt, Artificial Sequence
  Synthetic Oligonucleotide; GZMB exon 3; Set C
gagaaguucuuaggauuauagg

SEQ ID NO: 13218 - RNA, 24 nt, Artificial Sequence
  Synthetic Oligonucleotide; GZMB exon 3; Set C
ggagaaguucuuaggauuauaggc

SEQ ID NO: 13219 - RNA, 26 nt, Artificial Sequence
  Synthetic Oligonucleotide; GZMB exon 3; Set A
uggagaaguucuuaggauuauaggcu

SEQ ID NO: 13220 - RNA, 28 nt, Artificial Sequence
  Synthetic Oligonucleotide; GZMB exon 3; Set A
uuggagaaguucuuaggauuauaggcug

SEQ ID NO: 13221 - RNA, 21 nt, Artificial Sequence
  Synthetic Oligonucleotide; GZMB exon 3; Set C
gagaaguucuuaggauuauag

SEQ ID NO: 13222 - RNA, 23 nt, Artificial Sequence
  Synthetic Oligonucleotide; GZMB exon 3; Set C
ggagaaguucuuaggauuauagg

SEQ ID NO: 13223 - RNA, 27 nt, Artificial Sequence
  Synthetic Oligonucleotide; GZMB exon 3; Set A
uuggagaaguucuuaggauuauaggcu

SEQ ID NO: 13224 - RNA, 22 nt, Artificial Sequence
  Synthetic Oligonucleotide; GZMB exon 3; Set C
ggagaaguucuuaggauuauag

SEQ ID NO: 13225 - RNA, 30 nt, Artificial Sequence
  Synthetic Oligonucleotide; GZMB exon 3; Set A
cguuggagaaguucuuaggauuauaggcug

SEQ ID NO: 13226 - RNA, 40 nt, Artificial Sequence
  Synthetic Oligonucleotide; GZMB exon 3; Set C
gaugucguuggagaaguucuuaggauuauaggcuggaugg

SEQ ID NO: 13227 - RNA, 39 nt, Artificial Sequence
  Synthetic Oligonucleotide; GZMB exon 3; Set C
gaugucguuggagaaguucuuaggauuauaggcuggaug

SEQ ID NO: 13228 - RNA, 29 nt, Artificial Sequence
  Synthetic Oligonucleotide; GZMB exon 3; Set A
cguuggagaaguucuuaggauuauaggcu

SEQ ID NO: 13229 - RNA, 31 nt, Artificial Sequence
  Synthetic Oligonucleotide; GZMB exon 3; Set A
ucguuggagaaguucuuaggauuauaggcug

SEQ ID NO: 13230 - RNA, 40 nt, Artificial Sequence
  Synthetic Oligonucleotide; GZMB exon 3; Set C
ugaugucguuggagaaguucuuaggauuauaggcuggaug

SEQ ID NO: 13231 - RNA, 38 nt, Artificial Sequence
  Synthetic Oligonucleotide; GZMB exon 3; Set C
gaugucguuggagaaguucuuaggauuauaggcuggau

SEQ ID NO: 13232 - RNA, 30 nt, Artificial Sequence
  Synthetic Oligonucleotide; GZMB exon 3; Set A
ucguuggagaaguucuuaggauuauaggcu

SEQ ID NO: 13233 - RNA, 37 nt, Artificial Sequence
  Synthetic Oligonucleotide; GZMB exon 3; Set C
gaugucguuggagaaguucuuaggauuauaggcugga

SEQ ID NO: 13234 - RNA, 39 nt, Artificial Sequence
  Synthetic Oligonucleotide; GZMB exon 3; Set C
ugaugucguuggagaaguucuuaggauuauaggcuggau

SEQ ID NO: 13235 - RNA, 36 nt, Artificial Sequence
  Synthetic Oligonucleotide; GZMB exon 3; Set C
gaugucguuggagaaguucuuaggauuauaggcugg

SEQ ID NO: 13236 - RNA, 40 nt, Artificial Sequence
  Synthetic Oligonucleotide; GZMB exon 3; Set C
augaugucguuggagaaguucuuaggauuauaggcuggau

SEQ ID NO: 13237 - RNA, 15 nt, Artificial Sequence
  Synthetic Oligonucleotide; GZMB exon 3; Set C
gagaaguucuuagga

SEQ ID NO: 13238 - RNA, 39 nt, Artificial Sequence
  Synthetic Oligonucleotide; GZMB exon 3; Set C
augaugucguuggagaaguucuuaggauuauaggcugga

SEQ ID NO: 13239 - RNA, 37 nt, Artificial Sequence
  Synthetic Oligonucleotide; GZMB exon 3; Set C
ugaugucguuggagaaguucuuaggauuauaggcugg

SEQ ID NO: 13240 - RNA, 35 nt, Artificial Sequence
  Synthetic Oligonucleotide; GZMB exon 3; Set A
gaugucguuggagaaguucuuaggauuauaggcug

SEQ ID NO: 13241 - RNA, 16 nt, Artificial Sequence
  Synthetic Oligonucleotide; GZMB exon 3; Set C
ggagaaguucuuagga

SEQ ID NO: 13242 - RNA, 38 nt, Artificial Sequence
  Synthetic Oligonucleotide; GZMB exon 3; Set C
augaugucguuggagaaguucuuaggauuauaggcugg

SEQ ID NO: 13243 - RNA, 34 nt, Artificial Sequence
  Synthetic Oligonucleotide; GZMB exon 3; Set A
gaugucguuggagaaguucuuaggauuauaggcu

SEQ ID NO: 13244 - RNA, 36 nt, Artificial Sequence
  Synthetic Oligonucleotide; GZMB exon 3; Set A
ugaugucguuggagaaguucuuaggauuauaggcug

SEQ ID NO: 13245 - RNA, 15 nt, Artificial Sequence
  Synthetic Oligonucleotide; GZMB exon 3; Set C
ggagaaguucuuagg

SEQ ID NO: 13246 - RNA, 35 nt, Artificial Sequence
  Synthetic Oligonucleotide; GZMB exon 3; Set A
ugaugucguuggagaaguucuuaggauuauaggcu

SEQ ID NO: 13247 - RNA, 37 nt, Artificial Sequence
  Synthetic Oligonucleotide; GZMB exon 3; Set A
augaugucguuggagaaguucuuaggauuauaggcug

SEQ ID NO: 13248 - RNA, 36 nt, Artificial Sequence
  Synthetic Oligonucleotide; GZMB exon 3; Set A
augaugucguuggagaaguucuuaggauuauaggcu

SEQ ID NO: 13249 - RNA, 35 nt, Artificial Sequence
  Synthetic Oligonucleotide; GZMB exon 3; Set A
augaugucguuggagaaguucuuaggauuauaggc

SEQ ID NO: 13250 - RNA, 40 nt, Artificial Sequence
  Synthetic Oligonucleotide; GZMB exon 3; Set C
uagcaugaugucguuggagaaguucuuaggauuauaggcu

SEQ ID NO: 13251 - RNA, 17 nt, Artificial Sequence
  Synthetic Oligonucleotide; GZMB exon 3; Set C
augaugucguuggagaa

SEQ ID NO: 13252 - RNA, 15 nt, Artificial Sequence
  Synthetic Oligonucleotide; GZMB exon 3; Set C
ugaugucguuggaga

SEQ ID NO: 13253 - RNA, 16 nt, Artificial Sequence
  Synthetic Oligonucleotide; GZMB exon 3; Set C
augaugucguuggaga

SEQ ID NO: 13254 - RNA, 15 nt, Artificial Sequence
  Synthetic Oligonucleotide; GZMB exon 3; Set C
augaugucguuggag

SEQ ID NO: 13255 - RNA, 20 nt, Artificial Sequence
  Synthetic Oligonucleotide; GZMB exon 3; Set C
uagcaugaugucguuggaga

SEQ ID NO: 13256 - RNA, 19 nt, Artificial Sequence
  Synthetic Oligonucleotide; GZMB exon 3; Set C
uagcaugaugucguuggag

SEQ ID NO: 13257 - RNA, 18 nt, Artificial Sequence
  Synthetic Oligonucleotide; GZMB exon 3; Set C
uagcaugaugucguugga

SEQ ID NO: 13258 - RNA, 20 nt, Artificial Sequence
  Synthetic Oligonucleotide; GZMB exon 3; Set C
guagcaugaugucguuggag

SEQ ID NO: 13259 - RNA, 19 nt, Artificial Sequence
  Synthetic Oligonucleotide; GZMB exon 3; Set C
guagcaugaugucguugga

SEQ ID NO: 13260 - RNA, 21 nt, Artificial Sequence
  Synthetic Oligonucleotide; GZMB exon 3; Set C
aguagcaugaugucguuggag

SEQ ID NO: 13261 - RNA, 20 nt, Artificial Sequence
  Synthetic Oligonucleotide; GZMB exon 3; Set C
aguagcaugaugucguugga

SEQ ID NO: 13262 - RNA, 40 nt, Artificial Sequence
  Synthetic Oligonucleotide; GZMB exon 3; Set C
gugugccucaccugcaguagcaugaugucguuggagaagu

SEQ ID NO: 13263 - RNA, 39 nt, Artificial Sequence
  Synthetic Oligonucleotide; GZMB exon 3; Set C
gugugccucaccugcaguagcaugaugucguuggagaag

SEQ ID NO: 13264 - RNA, 40 nt, Artificial Sequence
  Synthetic Oligonucleotide; GZMB exon 3; Set C
agugugccucaccugcaguagcaugaugucguuggagaag

SEQ ID NO: 13265 - RNA, 15 nt, Artificial Sequence
  Synthetic Oligonucleotide; GZMB exon 3; Set C
agaguggcaggagug

SEQ ID NO: 13266 - RNA, 16 nt, Artificial Sequence
  Synthetic Oligonucleotide; GZMB exon 3; Set C
aagaguggcaggagug

SEQ ID NO: 13267 - RNA, 15 nt, Artificial Sequence
  Synthetic Oligonucleotide; GZMB exon 3; Set C
aagaguggcaggagu

SEQ ID NO: 13268 - RNA, 17 nt, Artificial Sequence
  Synthetic Oligonucleotide; GZMB exon 3; Set C
caagaguggcaggagug

SEQ ID NO: 13269 - RNA, 16 nt, Artificial Sequence
  Synthetic Oligonucleotide; GZMB exon 3; Set C
caagaguggcaggagu

SEQ ID NO: 13270 - RNA, 18 nt, Artificial Sequence
  Synthetic Oligonucleotide; GZMB exon 3; Set C
gcaagaguggcaggagug

SEQ ID NO: 13271 - RNA, 19 nt, Artificial Sequence
  Synthetic Oligonucleotide; GZMB exon 3; Set C
agcaagaguggcaggagug

SEQ ID NO: 13272 - RNA, 17 nt, Artificial Sequence
  Synthetic Oligonucleotide; GZMB exon 3; Set C
gcaagaguggcaggagu

SEQ ID NO: 13273 - RNA, 15 nt, Artificial Sequence
  Synthetic Oligonucleotide; GZMB exon 3; Set C
caagaguggcaggag

SEQ ID NO: 13274 - RNA, 20 nt, Artificial Sequence
  Synthetic Oligonucleotide; GZMB exon 3; Set B
gagcaagaguggcaggagug

SEQ ID NO: 13275 - RNA, 18 nt, Artificial Sequence
  Synthetic Oligonucleotide; GZMB exon 3; Set C
agcaagaguggcaggagu

SEQ ID NO: 13276 - RNA, 16 nt, Artificial Sequence
  Synthetic Oligonucleotide; GZMB exon 3; Set C
gcaagaguggcaggag

SEQ ID NO: 13277 - RNA, 19 nt, Artificial Sequence
  Synthetic Oligonucleotide; GZMB exon 3; Set B
gagcaagaguggcaggagu

SEQ ID NO: 13278 - RNA, 17 nt, Artificial Sequence
  Synthetic Oligonucleotide; GZMB exon 3; Set C
agcaagaguggcaggag

SEQ ID NO: 13279 - RNA, 16 nt, Artificial Sequence
  Synthetic Oligonucleotide; GZMB exon 3; Set C
agcaagaguggcagga

SEQ ID NO: 13280 - RNA, 18 nt, Artificial Sequence
  Synthetic Oligonucleotide; GZMB exon 3; Set C
gagcaagaguggcaggag

SEQ ID NO: 13281 - RNA, 17 nt, Artificial Sequence
  Synthetic Oligonucleotide; GZMB exon 3; Set C
gagcaagaguggcagga

SEQ ID NO: 13282 - RNA, 15 nt, Artificial Sequence
  Synthetic Oligonucleotide; GZMB exon 3; Set C
ucacaggguauacag

SEQ ID NO: 13283 - RNA, 16 nt, Artificial Sequence
  Synthetic Oligonucleotide; GZMB exon 3; Set C
gucacaggguauacag

SEQ ID NO: 13284 - RNA, 15 nt, Artificial Sequence
  Synthetic Oligonucleotide; GZMB exon 3; Set C
gucacaggguauaca

SEQ ID NO: 13285 - RNA, 15 nt, Artificial Sequence
  Synthetic Oligonucleotide; GZMB exon 3; Set C
uggggguggagucac

SEQ ID NO: 13286 - RNA, 16 nt, Artificial Sequence
  Synthetic Oligonucleotide; GZMB exon 3; Set C
auggggguggagucac

SEQ ID NO: 13287 - RNA, 15 nt, Artificial Sequence
  Synthetic Oligonucleotide; GZMB exon 3; Set C
auggggguggaguca

SEQ ID NO: 13288 - RNA, 17 nt, Artificial Sequence
  Synthetic Oligonucleotide; GZMB exon 3; Set A
gauggggguggagucac

SEQ ID NO: 13289 - RNA, 16 nt, Artificial Sequence
  Synthetic Oligonucleotide; GZMB exon 3; Set C
gauggggguggaguca

SEQ ID NO: 13290 - RNA, 18 nt, Artificial Sequence
  Synthetic Oligonucleotide; GZMB exon 3; Set A
ggauggggguggagucac

SEQ ID NO: 13291 - RNA, 17 nt, Artificial Sequence
  Synthetic Oligonucleotide; GZMB exon 3; Set A
ggauggggguggaguca

SEQ ID NO: 13292 - RNA, 15 nt, Artificial Sequence
  Synthetic Oligonucleotide; GZMB exon 3; Set C
gauggggguggaguc

SEQ ID NO: 13293 - RNA, 19 nt, Artificial Sequence
  Synthetic Oligonucleotide; GZMB exon 3; Set A
aggauggggguggagucac

SEQ ID NO: 13294 - RNA, 18 nt, Artificial Sequence
  Synthetic Oligonucleotide; GZMB exon 3; Set A
aggauggggguggaguca

SEQ ID NO: 13295 - RNA, 16 nt, Artificial Sequence
  Synthetic Oligonucleotide; GZMB exon 3; Set C
ggauggggguggaguc

SEQ ID NO: 13296 - RNA, 20 nt, Artificial Sequence
  Synthetic Oligonucleotide; GZMB exon 3; Set A
gaggauggggguggagucac

SEQ ID NO: 13297 - RNA, 19 nt, Artificial Sequence
  Synthetic Oligonucleotide; GZMB exon 3; Set A
gaggauggggguggaguca

SEQ ID NO: 13298 - RNA, 17 nt, Artificial Sequence
  Synthetic Oligonucleotide; GZMB exon 3; Set C
aggauggggguggaguc

SEQ ID NO: 13299 - RNA, 21 nt, Artificial Sequence
  Synthetic Oligonucleotide; GZMB exon 3; Set A
ugaggauggggguggagucac

SEQ ID NO: 13300 - RNA, 20 nt, Artificial Sequence
  Synthetic Oligonucleotide; GZMB exon 3; Set A
ugaggauggggguggaguca

SEQ ID NO: 13301 - RNA, 18 nt, Artificial Sequence
  Synthetic Oligonucleotide; GZMB exon 3; Set A
gaggauggggguggaguc

SEQ ID NO: 13302 - RNA, 22 nt, Artificial Sequence
  Synthetic Oligonucleotide; GZMB exon 3; Set A
gugaggauggggguggagucac

SEQ ID NO: 13303 - RNA, 21 nt, Artificial Sequence
  Synthetic Oligonucleotide; GZMB exon 3; Set A
gugaggauggggguggaguca

SEQ ID NO: 13304 - RNA, 19 nt, Artificial Sequence
  Synthetic Oligonucleotide; GZMB exon 3; Set A
ugaggauggggguggaguc

SEQ ID NO: 13305 - RNA, 23 nt, Artificial Sequence
  Synthetic Oligonucleotide; GZMB exon 3; Set A
agugaggauggggguggagucac

SEQ ID NO: 13306 - RNA, 22 nt, Artificial Sequence
  Synthetic Oligonucleotide; GZMB exon 3; Set A
agugaggauggggguggaguca

SEQ ID NO: 13307 - RNA, 20 nt, Artificial Sequence
  Synthetic Oligonucleotide; GZMB exon 3; Set A
gugaggauggggguggaguc

SEQ ID NO: 13308 - RNA, 21 nt, Artificial Sequence
  Synthetic Oligonucleotide; GZMB exon 3; Set A
agugaggauggggguggaguc

SEQ ID NO: 13309 - RNA, 34 nt, Artificial Sequence
  Synthetic Oligonucleotide; GZMB exon 3; Set C
agagcagagugaggauggggguggagucacaggg

SEQ ID NO: 13310 - RNA, 35 nt, Artificial Sequence
  Synthetic Oligonucleotide; GZMB exon 3; Set C
gagagcagagugaggauggggguggagucacaggg

SEQ ID NO: 13311 - RNA, 32 nt, Artificial Sequence
  Synthetic Oligonucleotide; GZMB exon 3; Set C
agagcagagugaggauggggguggagucacag

SEQ ID NO: 13312 - RNA, 36 nt, Artificial Sequence
  Synthetic Oligonucleotide; GZMB exon 3; Set C
agagagcagagugaggauggggguggagucacaggg

SEQ ID NO: 13313 - RNA, 35 nt, Artificial Sequence
  Synthetic Oligonucleotide; GZMB exon 3; Set C
agagagcagagugaggauggggguggagucacagg

SEQ ID NO: 13314 - RNA, 33 nt, Artificial Sequence
  Synthetic Oligonucleotide; GZMB exon 3; Set C
gagagcagagugaggauggggguggagucacag

SEQ ID NO: 13315 - RNA, 37 nt, Artificial Sequence
  Synthetic Oligonucleotide; GZMB exon 3; Set C
cagagagcagagugaggauggggguggagucacaggg

SEQ ID NO: 13316 - RNA, 40 nt, Artificial Sequence
  Synthetic Oligonucleotide; GZMB exon 3; Set C
cacagagagcagagugaggauggggguggagucacagggu

SEQ ID NO: 13317 - RNA, 36 nt, Artificial Sequence
  Synthetic Oligonucleotide; GZMB exon 3; Set C
cagagagcagagugaggauggggguggagucacagg

SEQ ID NO: 13318 - RNA, 34 nt, Artificial Sequence
  Synthetic Oligonucleotide; GZMB exon 3; Set C
agagagcagagugaggauggggguggagucacag

SEQ ID NO: 13319 - RNA, 38 nt, Artificial Sequence
  Synthetic Oligonucleotide; GZMB exon 3; Set C
acagagagcagagugaggauggggguggagucacaggg

SEQ ID NO: 13320 - RNA, 37 nt, Artificial Sequence
  Synthetic Oligonucleotide; GZMB exon 3; Set C
acagagagcagagugaggauggggguggagucacagg

SEQ ID NO: 13321 - RNA, 35 nt, Artificial Sequence
  Synthetic Oligonucleotide; GZMB exon 3; Set C
cagagagcagagugaggauggggguggagucacag

SEQ ID NO: 13322 - RNA, 39 nt, Artificial Sequence
  Synthetic Oligonucleotide; GZMB exon 3; Set C
cacagagagcagagugaggauggggguggagucacaggg

SEQ ID NO: 13323 - RNA, 38 nt, Artificial Sequence
  Synthetic Oligonucleotide; GZMB exon 3; Set C
cacagagagcagagugaggauggggguggagucacagg

SEQ ID NO: 13324 - RNA, 36 nt, Artificial Sequence
  Synthetic Oligonucleotide; GZMB exon 3; Set C
acagagagcagagugaggauggggguggagucacag

SEQ ID NO: 13325 - RNA, 40 nt, Artificial Sequence
  Synthetic Oligonucleotide; GZMB exon 3; Set C
gcacagagagcagagugaggauggggguggagucacaggg

SEQ ID NO: 13326 - RNA, 39 nt, Artificial Sequence
  Synthetic Oligonucleotide; GZMB exon 3; Set C
gcacagagagcagagugaggauggggguggagucacagg

SEQ ID NO: 13327 - RNA, 37 nt, Artificial Sequence
  Synthetic Oligonucleotide; GZMB exon 3; Set C
cacagagagcagagugaggauggggguggagucacag

SEQ ID NO: 13328 - RNA, 40 nt, Artificial Sequence
  Synthetic Oligonucleotide; GZMB exon 3; Set C
ugcacagagagcagagugaggauggggguggagucacagg

SEQ ID NO: 13329 - RNA, 38 nt, Artificial Sequence
  Synthetic Oligonucleotide; GZMB exon 3; Set C
gcacagagagcagagugaggauggggguggagucacag

SEQ ID NO: 13330 - RNA, 39 nt, Artificial Sequence
  Synthetic Oligonucleotide; GZMB exon 3; Set C
ugcacagagagcagagugaggauggggguggagucacag

SEQ ID NO: 13331 - RNA, 32 nt, Artificial Sequence
  Synthetic Oligonucleotide; GZMB exon 3; Set C
cacagagagcagagugaggauggggguggagu

SEQ ID NO: 13332 - RNA, 31 nt, Artificial Sequence
  Synthetic Oligonucleotide; GZMB exon 3; Set C
cacagagagcagagugaggauggggguggag

SEQ ID NO: 13333 - RNA, 33 nt, Artificial Sequence
  Synthetic Oligonucleotide; GZMB exon 3; Set C
gcacagagagcagagugaggauggggguggagu

SEQ ID NO: 13334 - RNA, 32 nt, Artificial Sequence
  Synthetic Oligonucleotide; GZMB exon 3; Set C
gcacagagagcagagugaggauggggguggag

SEQ ID NO: 13335 - RNA, 34 nt, Artificial Sequence
  Synthetic Oligonucleotide; GZMB exon 3; Set C
ugcacagagagcagagugaggauggggguggagu

SEQ ID NO: 13336 - RNA, 33 nt, Artificial Sequence
  Synthetic Oligonucleotide; GZMB exon 3; Set C
ugcacagagagcagagugaggauggggguggag

SEQ ID NO: 13337 - RNA, 26 nt, Artificial Sequence
  Synthetic Oligonucleotide; GZMB exon 3; Set C
cacagagagcagagugaggauggggg

SEQ ID NO: 13338 - RNA, 27 nt, Artificial Sequence
  Synthetic Oligonucleotide; GZMB exon 3; Set C
gcacagagagcagagugaggauggggg

SEQ ID NO: 13339 - RNA, 25 nt, Artificial Sequence
  Synthetic Oligonucleotide; GZMB exon 3; Set A
cacagagagcagagugaggaugggg

SEQ ID NO: 13340 - RNA, 28 nt, Artificial Sequence
  Synthetic Oligonucleotide; GZMB exon 3; Set C
ugcacagagagcagagugaggauggggg

SEQ ID NO: 13341 - RNA, 26 nt, Artificial Sequence
  Synthetic Oligonucleotide; GZMB exon 3; Set C
gcacagagagcagagugaggaugggg

SEQ ID NO: 13342 - RNA, 24 nt, Artificial Sequence
  Synthetic Oligonucleotide; GZMB exon 3; Set A
cacagagagcagagugaggauggg

SEQ ID NO: 13343 - RNA, 27 nt, Artificial Sequence
  Synthetic Oligonucleotide; GZMB exon 3; Set C
ugcacagagagcagagugaggaugggg

SEQ ID NO: 13344 - RNA, 23 nt, Artificial Sequence
  Synthetic Oligonucleotide; GZMB exon 3; Set A
cacagagagcagagugaggaugg

SEQ ID NO: 13345 - RNA, 25 nt, Artificial Sequence
  Synthetic Oligonucleotide; GZMB exon 3; Set C
gcacagagagcagagugaggauggg

SEQ ID NO: 13346 - RNA, 22 nt, Artificial Sequence
  Synthetic Oligonucleotide; GZMB exon 3; Set A
cacagagagcagagugaggaug

SEQ ID NO: 13347 - RNA, 24 nt, Artificial Sequence
  Synthetic Oligonucleotide; GZMB exon 3; Set A
gcacagagagcagagugaggaugg

SEQ ID NO: 13348 - RNA, 26 nt, Artificial Sequence
  Synthetic Oligonucleotide; GZMB exon 3; Set C
ugcacagagagcagagugaggauggg

SEQ ID NO: 13349 - RNA, 21 nt, Artificial Sequence
  Synthetic Oligonucleotide; GZMB exon 3; Set A
cacagagagcagagugaggau

SEQ ID NO: 13350 - RNA, 23 nt, Artificial Sequence
  Synthetic Oligonucleotide; GZMB exon 3; Set A
gcacagagagcagagugaggaug

SEQ ID NO: 13351 - RNA, 25 nt, Artificial Sequence
  Synthetic Oligonucleotide; GZMB exon 3; Set A
ugcacagagagcagagugaggaugg

SEQ ID NO: 13352 - RNA, 20 nt, Artificial Sequence
  Synthetic Oligonucleotide; GZMB exon 3; Set A
cacagagagcagagugagga

SEQ ID NO: 13353 - RNA, 22 nt, Artificial Sequence
  Synthetic Oligonucleotide; GZMB exon 3; Set A
gcacagagagcagagugaggau

SEQ ID NO: 13354 - RNA, 24 nt, Artificial Sequence
  Synthetic Oligonucleotide; GZMB exon 3; Set A
ugcacagagagcagagugaggaug

SEQ ID NO: 13355 - RNA, 21 nt, Artificial Sequence
  Synthetic Oligonucleotide; GZMB exon 3; Set A
gcacagagagcagagugagga

SEQ ID NO: 13356 - RNA, 19 nt, Artificial Sequence
  Synthetic Oligonucleotide; GZMB exon 3; Set C
cacagagagcagagugagg

SEQ ID NO: 13357 - RNA, 23 nt, Artificial Sequence
  Synthetic Oligonucleotide; GZMB exon 3; Set A
ugcacagagagcagagugaggau

SEQ ID NO: 13358 - RNA, 22 nt, Artificial Sequence
  Synthetic Oligonucleotide; GZMB exon 3; Set A
ugcacagagagcagagugagga

SEQ ID NO: 13359 - RNA, 18 nt, Artificial Sequence
  Synthetic Oligonucleotide; GZMB exon 3; Set C
cacagagagcagagugag

SEQ ID NO: 13360 - RNA, 20 nt, Artificial Sequence
  Synthetic Oligonucleotide; GZMB exon 3; Set A
gcacagagagcagagugagg

SEQ ID NO: 13361 - RNA, 17 nt, Artificial Sequence
  Synthetic Oligonucleotide; GZMB exon 3; Set C
cacagagagcagaguga

SEQ ID NO: 13362 - RNA, 19 nt, Artificial Sequence
  Synthetic Oligonucleotide; GZMB exon 3; Set C
gcacagagagcagagugag

SEQ ID NO: 13363 - RNA, 21 nt, Artificial Sequence
  Synthetic Oligonucleotide; GZMB exon 3; Set A
ugcacagagagcagagugagg

SEQ ID NO: 13364 - RNA, 16 nt, Artificial Sequence
  Synthetic Oligonucleotide; GZMB exon 3; Set C
cacagagagcagagug

SEQ ID NO: 13365 - RNA, 18 nt, Artificial Sequence
  Synthetic Oligonucleotide; GZMB exon 3; Set C
gcacagagagcagaguga

SEQ ID NO: 13366 - RNA, 20 nt, Artificial Sequence
  Synthetic Oligonucleotide; GZMB exon 3; Set A
ugcacagagagcagagugag

SEQ ID NO: 13367 - RNA, 17 nt, Artificial Sequence
  Synthetic Oligonucleotide; GZMB exon 3; Set C
gcacagagagcagagug

SEQ ID NO: 13368 - RNA, 19 nt, Artificial Sequence
  Synthetic Oligonucleotide; GZMB exon 3; Set A
ugcacagagagcagaguga

SEQ ID NO: 13369 - RNA, 15 nt, Artificial Sequence
  Synthetic Oligonucleotide; GZMB exon 3; Set C
cacagagagcagagu

SEQ ID NO: 13370 - RNA, 18 nt, Artificial Sequence
  Synthetic Oligonucleotide; GZMB exon 3; Set C
ugcacagagagcagagug

SEQ ID NO: 13371 - RNA, 16 nt, Artificial Sequence
  Synthetic Oligonucleotide; GZMB exon 3; Set C
gcacagagagcagagu

SEQ ID NO: 13372 - RNA, 17 nt, Artificial Sequence
  Synthetic Oligonucleotide; GZMB exon 3; Set C
ugcacagagagcagagu

SEQ ID NO: 13373 - RNA, 17 nt, Artificial Sequence
  Synthetic Oligonucleotide; GZMB exon 3; Set C
acauuuauggagcugca

SEQ ID NO: 13374 - RNA, 18 nt, Artificial Sequence
  Synthetic Oligonucleotide; GZMB exon 3; Set C
gacauuuauggagcugca

SEQ ID NO: 13375 - RNA, 16 nt, Artificial Sequence
  Synthetic Oligonucleotide; GZMB exon 3; Set C
acauuuauggagcugc

SEQ ID NO: 13376 - RNA, 17 nt, Artificial Sequence
  Synthetic Oligonucleotide; GZMB exon 3; Set C
gacauuuauggagcugc

SEQ ID NO: 13377 - RNA, 32 nt, Artificial Sequence
  Synthetic Oligonucleotide; GZMB exon 3; Set C
gggcccccaaggugacauuuauggagcugcac

SEQ ID NO: 13378 - RNA, 15 nt, Artificial Sequence
  Synthetic Oligonucleotide; GZMB exon 3; Set C
aaggugacauuuaug

SEQ ID NO: 13379 - RNA, 33 nt, Artificial Sequence
  Synthetic Oligonucleotide; GZMB exon 3; Set C
ugggcccccaaggugacauuuauggagcugcac

SEQ ID NO: 13380 - RNA, 31 nt, Artificial Sequence
  Synthetic Oligonucleotide; GZMB exon 3; Set C
gggcccccaaggugacauuuauggagcugca

SEQ ID NO: 13381 - RNA, 34 nt, Artificial Sequence
  Synthetic Oligonucleotide; GZMB exon 3; Set C
gugggcccccaaggugacauuuauggagcugcac

SEQ ID NO: 13382 - RNA, 32 nt, Artificial Sequence
  Synthetic Oligonucleotide; GZMB exon 3; Set C
ugggcccccaaggugacauuuauggagcugca

SEQ ID NO: 13383 - RNA, 30 nt, Artificial Sequence
  Synthetic Oligonucleotide; GZMB exon 3; Set C
gggcccccaaggugacauuuauggagcugc

SEQ ID NO: 13384 - RNA, 35 nt, Artificial Sequence
  Synthetic Oligonucleotide; GZMB exon 3; Set C
ugugggcccccaaggugacauuuauggagcugcac

SEQ ID NO: 13385 - RNA, 33 nt, Artificial Sequence
  Synthetic Oligonucleotide; GZMB exon 3; Set C
gugggcccccaaggugacauuuauggagcugca

SEQ ID NO: 13386 - RNA, 31 nt, Artificial Sequence
  Synthetic Oligonucleotide; GZMB exon 3; Set C
ugggcccccaaggugacauuuauggagcugc

SEQ ID NO: 13387 - RNA, 34 nt, Artificial Sequence
  Synthetic Oligonucleotide; GZMB exon 3; Set C
ugugggcccccaaggugacauuuauggagcugca

SEQ ID NO: 13388 - RNA, 32 nt, Artificial Sequence
  Synthetic Oligonucleotide; GZMB exon 3; Set C
gugggcccccaaggugacauuuauggagcugc

SEQ ID NO: 13389 - RNA, 35 nt, Artificial Sequence
  Synthetic Oligonucleotide; GZMB exon 3; Set C
uugugggcccccaaggugacauuuauggagcugca

SEQ ID NO: 13390 - RNA, 33 nt, Artificial Sequence
  Synthetic Oligonucleotide; GZMB exon 3; Set C
ugugggcccccaaggugacauuuauggagcugc

SEQ ID NO: 13391 - RNA, 36 nt, Artificial Sequence
  Synthetic Oligonucleotide; GZMB exon 3; Set C
auugugggcccccaaggugacauuuauggagcugca

SEQ ID NO: 13392 - RNA, 34 nt, Artificial Sequence
  Synthetic Oligonucleotide; GZMB exon 3; Set C
uugugggcccccaaggugacauuuauggagcugc

SEQ ID NO: 13393 - RNA, 35 nt, Artificial Sequence
  Synthetic Oligonucleotide; GZMB exon 3; Set C
auugugggcccccaaggugacauuuauggagcugc

SEQ ID NO: 13394 - RNA, 36 nt, Artificial Sequence
  Synthetic Oligonucleotide; GZMB exon 3; Set C
uauugugggcccccaaggugacauuuauggagcugc

SEQ ID NO: 13395 - RNA, 37 nt, Artificial Sequence
  Synthetic Oligonucleotide; GZMB exon 3; Set C
auauugugggcccccaaggugacauuuauggagcugc

SEQ ID NO: 13396 - RNA, 18 nt, Artificial Sequence
  Synthetic Oligonucleotide; GZMB exon 3; Set A
gggcccccaaggugacau

SEQ ID NO: 13397 - RNA, 17 nt, Artificial Sequence
  Synthetic Oligonucleotide; GZMB exon 3; Set A
gggcccccaaggugaca

SEQ ID NO: 13398 - RNA, 18 nt, Artificial Sequence
  Synthetic Oligonucleotide; GZMB exon 3; Set A
ugggcccccaaggugaca

SEQ ID NO: 13399 - RNA, 16 nt, Artificial Sequence
  Synthetic Oligonucleotide; GZMB exon 3; Set A
gggcccccaaggugac

SEQ ID NO: 13400 - RNA, 15 nt, Artificial Sequence
  Synthetic Oligonucleotide; GZMB exon 3; Set A
gggcccccaagguga

SEQ ID NO: 13401 - RNA, 17 nt, Artificial Sequence
  Synthetic Oligonucleotide; GZMB exon 3; Set A
ugggcccccaaggugac

SEQ ID NO: 13402 - RNA, 16 nt, Artificial Sequence
  Synthetic Oligonucleotide; GZMB exon 3; Set A
ugggcccccaagguga

SEQ ID NO: 13403 - RNA, 18 nt, Artificial Sequence
  Synthetic Oligonucleotide; GZMB exon 3; Set A
gugggcccccaaggugac

SEQ ID NO: 13404 - RNA, 15 nt, Artificial Sequence
  Synthetic Oligonucleotide; GZMB exon 3; Set A
ugggcccccaaggug

SEQ ID NO: 13405 - RNA, 16 nt, Artificial Sequence
  Synthetic Oligonucleotide; GZMB exon 3; Set A
gugggcccccaaggug

SEQ ID NO: 13406 - RNA, 39 nt, Artificial Sequence
  Synthetic Oligonucleotide; GZMB exon 3; Set C
gcuccuguucuuugauauugugggcccccaaggugacau

SEQ ID NO: 13407 - RNA, 38 nt, Artificial Sequence
  Synthetic Oligonucleotide; GZMB exon 3; Set C
gcuccuguucuuugauauugugggcccccaaggugaca

SEQ ID NO: 13408 - RNA, 39 nt, Artificial Sequence
  Synthetic Oligonucleotide; GZMB exon 3; Set C
ggcuccuguucuuugauauugugggcccccaaggugaca

SEQ ID NO: 13409 - RNA, 37 nt, Artificial Sequence
  Synthetic Oligonucleotide; GZMB exon 3; Set C
gcuccuguucuuugauauugugggcccccaaggugac

SEQ ID NO: 13410 - RNA, 36 nt, Artificial Sequence
  Synthetic Oligonucleotide; GZMB exon 3; Set C
gcuccuguucuuugauauugugggcccccaagguga

SEQ ID NO: 13411 - RNA, 40 nt, Artificial Sequence
  Synthetic Oligonucleotide; GZMB exon 3; Set C
cggcuccuguucuuugauauugugggcccccaaggugaca

SEQ ID NO: 13412 - RNA, 38 nt, Artificial Sequence
  Synthetic Oligonucleotide; GZMB exon 3; Set C
ggcuccuguucuuugauauugugggcccccaaggugac

SEQ ID NO: 13413 - RNA, 37 nt, Artificial Sequence
  Synthetic Oligonucleotide; GZMB exon 3; Set C
ggcuccuguucuuugauauugugggcccccaagguga

SEQ ID NO: 13414 - RNA, 35 nt, Artificial Sequence
  Synthetic Oligonucleotide; GZMB exon 3; Set C
gcuccuguucuuugauauugugggcccccaaggug

SEQ ID NO: 13415 - RNA, 39 nt, Artificial Sequence
  Synthetic Oligonucleotide; GZMB exon 3; Set C
cggcuccuguucuuugauauugugggcccccaaggugac

SEQ ID NO: 13416 - RNA, 34 nt, Artificial Sequence
  Synthetic Oligonucleotide; GZMB exon 3; Set C
gcuccuguucuuugauauugugggcccccaaggu

SEQ ID NO: 13417 - RNA, 36 nt, Artificial Sequence
  Synthetic Oligonucleotide; GZMB exon 3; Set C
ggcuccuguucuuugauauugugggcccccaaggug

SEQ ID NO: 13418 - RNA, 38 nt, Artificial Sequence
  Synthetic Oligonucleotide; GZMB exon 3; Set C
cggcuccuguucuuugauauugugggcccccaagguga

SEQ ID NO: 13419 - RNA, 40 nt, Artificial Sequence
  Synthetic Oligonucleotide; GZMB exon 3; Set C
ucggcuccuguucuuugauauugugggcccccaaggugac

SEQ ID NO: 13420 - RNA, 33 nt, Artificial Sequence
  Synthetic Oligonucleotide; GZMB exon 3; Set C
gcuccuguucuuugauauugugggcccccaagg

SEQ ID NO: 13421 - RNA, 39 nt, Artificial Sequence
  Synthetic Oligonucleotide; GZMB exon 3; Set C
ucggcuccuguucuuugauauugugggcccccaagguga

SEQ ID NO: 13422 - RNA, 37 nt, Artificial Sequence
  Synthetic Oligonucleotide; GZMB exon 3; Set C
cggcuccuguucuuugauauugugggcccccaaggug

SEQ ID NO: 13423 - RNA, 36 nt, Artificial Sequence
  Synthetic Oligonucleotide; GZMB exon 3; Set C
cggcuccuguucuuugauauugugggcccccaaggu

SEQ ID NO: 13424 - RNA, 34 nt, Artificial Sequence
  Synthetic Oligonucleotide; GZMB exon 3; Set C
ggcuccuguucuuugauauugugggcccccaagg

SEQ ID NO: 13425 - RNA, 38 nt, Artificial Sequence
  Synthetic Oligonucleotide; GZMB exon 3; Set C
ucggcuccuguucuuugauauugugggcccccaaggug

SEQ ID NO: 13426 - RNA, 40 nt, Artificial Sequence
  Synthetic Oligonucleotide; GZMB exon 3; Set C
gucggcuccuguucuuugauauugugggcccccaagguga

SEQ ID NO: 13427 - RNA, 37 nt, Artificial Sequence
  Synthetic Oligonucleotide; GZMB exon 3; Set C
ucggcuccuguucuuugauauugugggcccccaaggu

SEQ ID NO: 13428 - RNA, 35 nt, Artificial Sequence
  Synthetic Oligonucleotide; GZMB exon 3; Set C
cggcuccuguucuuugauauugugggcccccaagg

SEQ ID NO: 13429 - RNA, 39 nt, Artificial Sequence
  Synthetic Oligonucleotide; GZMB exon 3; Set C
gucggcuccuguucuuugauauugugggcccccaaggug

SEQ ID NO: 13430 - RNA, 38 nt, Artificial Sequence
  Synthetic Oligonucleotide; GZMB exon 3; Set C
gucggcuccuguucuuugauauugugggcccccaaggu

SEQ ID NO: 13431 - RNA, 36 nt, Artificial Sequence
  Synthetic Oligonucleotide; GZMB exon 3; Set C
ucggcuccuguucuuugauauugugggcccccaagg

SEQ ID NO: 13432 - RNA, 40 nt, Artificial Sequence
  Synthetic Oligonucleotide; GZMB exon 3; Set C
ggucggcuccuguucuuugauauugugggcccccaaggug

SEQ ID NO: 13433 - RNA, 37 nt, Artificial Sequence
  Synthetic Oligonucleotide; GZMB exon 3; Set C
gucggcuccuguucuuugauauugugggcccccaagg

SEQ ID NO: 13434 - RNA, 38 nt, Artificial Sequence
  Synthetic Oligonucleotide; GZMB exon 3; Set C
ggucggcuccuguucuuugauauugugggcccccaagg

SEQ ID NO: 13435 - RNA, 26 nt, Artificial Sequence
  Synthetic Oligonucleotide; GZMB exon 3; Set A
cggcuccuguucuuugauauuguggg

SEQ ID NO: 13436 - RNA, 25 nt, Artificial Sequence
  Synthetic Oligonucleotide; GZMB exon 3; Set A
cggcuccuguucuuugauauugugg

SEQ ID NO: 13437 - RNA, 27 nt, Artificial Sequence
  Synthetic Oligonucleotide; GZMB exon 3; Set A
ucggcuccuguucuuugauauuguggg

SEQ ID NO: 13438 - RNA, 24 nt, Artificial Sequence
  Synthetic Oligonucleotide; GZMB exon 3; Set A
cggcuccuguucuuugauauugug

SEQ ID NO: 13439 - RNA, 28 nt, Artificial Sequence
  Synthetic Oligonucleotide; GZMB exon 3; Set C
gucggcuccuguucuuugauauuguggg

SEQ ID NO: 13440 - RNA, 23 nt, Artificial Sequence
  Synthetic Oligonucleotide; GZMB exon 3; Set A
cggcuccuguucuuugauauugu

SEQ ID NO: 13441 - RNA, 22 nt, Artificial Sequence
  Synthetic Oligonucleotide; GZMB exon 3; Set C
cggcuccuguucuuugauauug

SEQ ID NO: 13442 - RNA, 21 nt, Artificial Sequence
  Synthetic Oligonucleotide; GZMB exon 3; Set C
cggcuccuguucuuugauauu

SEQ ID NO: 13443 - RNA, 20 nt, Artificial Sequence
  Synthetic Oligonucleotide; GZMB exon 3; Set C
cggcuccuguucuuugauau

SEQ ID NO: 13444 - RNA, 19 nt, Artificial Sequence
  Synthetic Oligonucleotide; GZMB exon 3; Set C
cggcuccuguucuuugaua

SEQ ID NO: 13445 - RNA, 18 nt, Artificial Sequence
  Synthetic Oligonucleotide; GZMB exon 3; Set C
cggcuccuguucuuugau

SEQ ID NO: 13446 - RNA, 17 nt, Artificial Sequence
  Synthetic Oligonucleotide; GZMB exon 3; Set C
cggcuccuguucuuuga

SEQ ID NO: 13447 - RNA, 16 nt, Artificial Sequence
  Synthetic Oligonucleotide; GZMB exon 3; Set C
cggcuccuguucuuug

SEQ ID NO: 13448 - RNA, 15 nt, Artificial Sequence
  Synthetic Oligonucleotide; GZMB exon 3; Set C
cggcuccuguucuuu

SEQ ID NO: 13449 - RNA, 15 nt, Artificial Sequence
  Synthetic Oligonucleotide; GZMB exon 3; Set C
ucggcuccuguucuu

SEQ ID NO: 13450 - RNA, 17 nt, Artificial Sequence
  Synthetic Oligonucleotide; GZMB exon 3; Set C
gucggcuccuguucuuu

SEQ ID NO: 13451 - RNA, 16 nt, Artificial Sequence
  Synthetic Oligonucleotide; GZMB exon 3; Set C
gucggcuccuguucuu

SEQ ID NO: 13452 - RNA, 15 nt, Artificial Sequence
  Synthetic Oligonucleotide; GZMB exon 3; Set C
gucggcuccuguucu

SEQ ID NO: 13453 - RNA, 15 nt, Artificial Sequence
  Synthetic Oligonucleotide; GZMB exon 3; Set C
gggucggcuccuguu

SEQ ID NO: 13454 - RNA, 17 nt, Artificial Sequence
  Synthetic Oligonucleotide; GZMB exon 3; Set A
cugggucggcuccuguu

SEQ ID NO: 13455 - RNA, 16 nt, Artificial Sequence
  Synthetic Oligonucleotide; GZMB exon 3; Set A
cugggucggcuccugu

SEQ ID NO: 13456 - RNA, 18 nt, Artificial Sequence
  Synthetic Oligonucleotide; GZMB exon 3; Set A
gcugggucggcuccuguu

SEQ ID NO: 13457 - RNA, 17 nt, Artificial Sequence
  Synthetic Oligonucleotide; GZMB exon 3; Set A
gcugggucggcuccugu

SEQ ID NO: 13458 - RNA, 19 nt, Artificial Sequence
  Synthetic Oligonucleotide; GZMB exon 3; Set A
ugcugggucggcuccuguu

SEQ ID NO: 13459 - RNA, 18 nt, Artificial Sequence
  Synthetic Oligonucleotide; GZMB exon 3; Set A
ugcugggucggcuccugu

SEQ ID NO: 13460 - RNA, 40 nt, Artificial Sequence
  Synthetic Oligonucleotide; GZMB exon 3; Set C
ucacagggauaaacugcugggucggcuccuguucuuugau

SEQ ID NO: 13461 - RNA, 39 nt, Artificial Sequence
  Synthetic Oligonucleotide; GZMB exon 3; Set C
ucacagggauaaacugcugggucggcuccuguucuuuga

SEQ ID NO: 13462 - RNA, 38 nt, Artificial Sequence
  Synthetic Oligonucleotide; GZMB exon 3; Set C
ucacagggauaaacugcugggucggcuccuguucuuug

SEQ ID NO: 13463 - RNA, 37 nt, Artificial Sequence
  Synthetic Oligonucleotide; GZMB exon 3; Set C
ucacagggauaaacugcugggucggcuccuguucuuu

SEQ ID NO: 13464 - RNA, 36 nt, Artificial Sequence
  Synthetic Oligonucleotide; GZMB exon 3; Set C
ucacagggauaaacugcugggucggcuccuguucuu

SEQ ID NO: 13465 - RNA, 35 nt, Artificial Sequence
  Synthetic Oligonucleotide; GZMB exon 3; Set C
ucacagggauaaacugcugggucggcuccuguucu

SEQ ID NO: 13466 - RNA, 15 nt, Artificial Sequence
  Synthetic Oligonucleotide; GZMB exon 3; Set C
aaacugcugggucgg

SEQ ID NO: 13467 - RNA, 34 nt, Artificial Sequence
  Synthetic Oligonucleotide; GZMB exon 3; Set C
ucacagggauaaacugcugggucggcuccuguuc

SEQ ID NO: 13468 - RNA, 16 nt, Artificial Sequence
  Synthetic Oligonucleotide; GZMB exon 3; Set C
uaaacugcugggucgg

SEQ ID NO: 13469 - RNA, 33 nt, Artificial Sequence
  Synthetic Oligonucleotide; GZMB exon 3; Set C
ucacagggauaaacugcugggucggcuccuguu

SEQ ID NO: 13470 - RNA, 17 nt, Artificial Sequence
  Synthetic Oligonucleotide; GZMB exon 3; Set C
auaaacugcugggucgg

SEQ ID NO: 13471 - RNA, 32 nt, Artificial Sequence
  Synthetic Oligonucleotide; GZMB exon 3; Set C
ucacagggauaaacugcugggucggcuccugu

SEQ ID NO: 13472 - RNA, 18 nt, Artificial Sequence
  Synthetic Oligonucleotide; GZMB exon 3; Set C
gauaaacugcugggucgg

SEQ ID NO: 13473 - RNA, 19 nt, Artificial Sequence
  Synthetic Oligonucleotide; GZMB exon 3; Set C
ggauaaacugcugggucgg

SEQ ID NO: 13474 - RNA, 26 nt, Artificial Sequence
  Synthetic Oligonucleotide; GZMB exon 3; Set A
uucacagggauaaacugcugggucgg

SEQ ID NO: 13475 - RNA, 25 nt, Artificial Sequence
  Synthetic Oligonucleotide; GZMB exon 3; Set A
uucacagggauaaacugcugggucg

SEQ ID NO: 13476 - RNA, 27 nt, Artificial Sequence
  Synthetic Oligonucleotide; GZMB exon 3; Set A
uuucacagggauaaacugcugggucgg

SEQ ID NO: 13477 - RNA, 26 nt, Artificial Sequence
  Synthetic Oligonucleotide; GZMB exon 3; Set A
uuucacagggauaaacugcugggucg

SEQ ID NO: 13478 - RNA, 24 nt, Artificial Sequence
  Synthetic Oligonucleotide; GZMB exon 3; Set A
uucacagggauaaacugcuggguc

SEQ ID NO: 13479 - RNA, 28 nt, Artificial Sequence
  Synthetic Oligonucleotide; GZMB exon 3; Set A
uuuucacagggauaaacugcugggucgg

SEQ ID NO: 13480 - RNA, 23 nt, Artificial Sequence
  Synthetic Oligonucleotide; GZMB exon 3; Set A
uucacagggauaaacugcugggu

SEQ ID NO: 13481 - RNA, 27 nt, Artificial Sequence
  Synthetic Oligonucleotide; GZMB exon 3; Set A
uuuucacagggauaaacugcugggucg

SEQ ID NO: 13482 - RNA, 25 nt, Artificial Sequence
  Synthetic Oligonucleotide; GZMB exon 3; Set A
uuucacagggauaaacugcuggguc

SEQ ID NO: 13483 - RNA, 29 nt, Artificial Sequence
  Synthetic Oligonucleotide; GZMB exon 3; Set C
cuuuucacagggauaaacugcugggucgg

SEQ ID NO: 13484 - RNA, 20 nt, Artificial Sequence
  Synthetic Oligonucleotide; GZMB exon 3; Set C
ucacagggauaaacugcugg

SEQ ID NO: 13485 - RNA, 22 nt, Artificial Sequence
  Synthetic Oligonucleotide; GZMB exon 3; Set A
uucacagggauaaacugcuggg

SEQ ID NO: 13486 - RNA, 24 nt, Artificial Sequence
  Synthetic Oligonucleotide; GZMB exon 3; Set A
uuucacagggauaaacugcugggu

SEQ ID NO: 13487 - RNA, 28 nt, Artificial Sequence
  Synthetic Oligonucleotide; GZMB exon 3; Set A
cuuuucacagggauaaacugcugggucg

SEQ ID NO: 13488 - RNA, 26 nt, Artificial Sequence
  Synthetic Oligonucleotide; GZMB exon 3; Set A
uuuucacagggauaaacugcuggguc

SEQ ID NO: 13489 - RNA, 30 nt, Artificial Sequence
  Synthetic Oligonucleotide; GZMB exon 3; Set C
ucuuuucacagggauaaacugcugggucgg

SEQ ID NO: 13490 - RNA, 25 nt, Artificial Sequence
  Synthetic Oligonucleotide; GZMB exon 3; Set A
uuuucacagggauaaacugcugggu

SEQ ID NO: 13491 - RNA, 29 nt, Artificial Sequence
  Synthetic Oligonucleotide; GZMB exon 3; Set A
ucuuuucacagggauaaacugcugggucg

SEQ ID NO: 13492 - RNA, 27 nt, Artificial Sequence
  Synthetic Oligonucleotide; GZMB exon 3; Set A
cuuuucacagggauaaacugcuggguc

SEQ ID NO: 13493 - RNA, 31 nt, Artificial Sequence
  Synthetic Oligonucleotide; GZMB exon 3; Set C
gucuuuucacagggauaaacugcugggucgg

SEQ ID NO: 13494 - RNA, 20 nt, Artificial Sequence
  Synthetic Oligonucleotide; GZMB exon 3; Set C
uucacagggauaaacugcug

SEQ ID NO: 13495 - RNA, 26 nt, Artificial Sequence
  Synthetic Oligonucleotide; GZMB exon 3; Set A
cuuuucacagggauaaacugcugggu

SEQ ID NO: 13496 - RNA, 30 nt, Artificial Sequence
  Synthetic Oligonucleotide; GZMB exon 3; Set C
gucuuuucacagggauaaacugcugggucg

SEQ ID NO: 13497 - RNA, 28 nt, Artificial Sequence
  Synthetic Oligonucleotide; GZMB exon 3; Set A
ucuuuucacagggauaaacugcuggguc

SEQ ID NO: 13498 - RNA, 32 nt, Artificial Sequence
  Synthetic Oligonucleotide; GZMB exon 3; Set C
ggucuuuucacagggauaaacugcugggucgg

SEQ ID NO: 13499 - RNA, 21 nt, Artificial Sequence
  Synthetic Oligonucleotide; GZMB exon 3; Set C
uuucacagggauaaacugcug

SEQ ID NO: 13500 - RNA, 19 nt, Artificial Sequence
  Synthetic Oligonucleotide; GZMB exon 3; Set C
uucacagggauaaacugcu

SEQ ID NO: 13501 - RNA, 27 nt, Artificial Sequence
  Synthetic Oligonucleotide; GZMB exon 3; Set A
ucuuuucacagggauaaacugcugggu

SEQ ID NO: 13502 - RNA, 29 nt, Artificial Sequence
  Synthetic Oligonucleotide; GZMB exon 3; Set A
gucuuuucacagggauaaacugcuggguc

SEQ ID NO: 13503 - RNA, 33 nt, Artificial Sequence
  Synthetic Oligonucleotide; GZMB exon 3; Set C
gggucuuuucacagggauaaacugcugggucgg

SEQ ID NO: 13504 - RNA, 22 nt, Artificial Sequence
  Synthetic Oligonucleotide; GZMB exon 3; Set C
uuuucacagggauaaacugcug

SEQ ID NO: 13505 - RNA, 20 nt, Artificial Sequence
  Synthetic Oligonucleotide; GZMB exon 3; Set C
uuucacagggauaaacugcu

SEQ ID NO: 13506 - RNA, 18 nt, Artificial Sequence
  Synthetic Oligonucleotide; GZMB exon 3; Set C
uucacagggauaaacugc

SEQ ID NO: 13507 - RNA, 28 nt, Artificial Sequence
  Synthetic Oligonucleotide; GZMB exon 3; Set A
gucuuuucacagggauaaacugcugggu

SEQ ID NO: 13508 - RNA, 30 nt, Artificial Sequence
  Synthetic Oligonucleotide; GZMB exon 3; Set C
ggucuuuucacagggauaaacugcuggguc

SEQ ID NO: 13509 - RNA, 34 nt, Artificial Sequence
  Synthetic Oligonucleotide; GZMB exon 3; Set C
ugggucuuuucacagggauaaacugcugggucgg

SEQ ID NO: 13510 - RNA, 23 nt, Artificial Sequence
  Synthetic Oligonucleotide; GZMB exon 3; Set C
cuuuucacagggauaaacugcug

SEQ ID NO: 13511 - RNA, 39 nt, Artificial Sequence
  Synthetic Oligonucleotide; GZMB exon 3; Set C
ggaugggucuuuucacagggauaaacugcugggucggcu

SEQ ID NO: 13512 - RNA, 21 nt, Artificial Sequence
  Synthetic Oligonucleotide; GZMB exon 3; Set C
uuuucacagggauaaacugcu

SEQ ID NO: 13513 - RNA, 19 nt, Artificial Sequence
  Synthetic Oligonucleotide; GZMB exon 3; Set C
uuucacagggauaaacugc

SEQ ID NO: 13514 - RNA, 31 nt, Artificial Sequence
  Synthetic Oligonucleotide; GZMB exon 3; Set C
gggucuuuucacagggauaaacugcuggguc

SEQ ID NO: 13515 - RNA, 35 nt, Artificial Sequence
  Synthetic Oligonucleotide; GZMB exon 3; Set C
augggucuuuucacagggauaaacugcugggucgg

SEQ ID NO: 13516 - RNA, 38 nt, Artificial Sequence
  Synthetic Oligonucleotide; GZMB exon 3; Set C
ggaugggucuuuucacagggauaaacugcugggucggc

SEQ ID NO: 13517 - RNA, 24 nt, Artificial Sequence
  Synthetic Oligonucleotide; GZMB exon 3; Set C
ucuuuucacagggauaaacugcug

SEQ ID NO: 13518 - RNA, 40 nt, Artificial Sequence
  Synthetic Oligonucleotide; GZMB exon 3; Set C
gggaugggucuuuucacagggauaaacugcugggucggcu

SEQ ID NO: 13519 - RNA, 22 nt, Artificial Sequence
  Synthetic Oligonucleotide; GZMB exon 3; Set C
cuuuucacagggauaaacugcu

SEQ ID NO: 13520 - RNA, 20 nt, Artificial Sequence
  Synthetic Oligonucleotide; GZMB exon 3; Set C
uuuucacagggauaaacugc

SEQ ID NO: 13521 - RNA, 32 nt, Artificial Sequence
  Synthetic Oligonucleotide; GZMB exon 3; Set C
ugggucuuuucacagggauaaacugcuggguc

SEQ ID NO: 13522 - RNA, 36 nt, Artificial Sequence
  Synthetic Oligonucleotide; GZMB exon 3; Set C
gaugggucuuuucacagggauaaacugcugggucgg

SEQ ID NO: 13523 - RNA, 39 nt, Artificial Sequence
  Synthetic Oligonucleotide; GZMB exon 3; Set C
gggaugggucuuuucacagggauaaacugcugggucggc

SEQ ID NO: 13524 - RNA, 25 nt, Artificial Sequence
  Synthetic Oligonucleotide; GZMB exon 3; Set A
gucuuuucacagggauaaacugcug

SEQ ID NO: 13525 - RNA, 23 nt, Artificial Sequence
  Synthetic Oligonucleotide; GZMB exon 3; Set C
ucuuuucacagggauaaacugcu

SEQ ID NO: 13526 - RNA, 21 nt, Artificial Sequence
  Synthetic Oligonucleotide; GZMB exon 3; Set C
cuuuucacagggauaaacugc

SEQ ID NO: 13527 - RNA, 35 nt, Artificial Sequence
  Synthetic Oligonucleotide; GZMB exon 3; Set C
gaugggucuuuucacagggauaaacugcugggucg

SEQ ID NO: 13528 - RNA, 37 nt, Artificial Sequence
  Synthetic Oligonucleotide; GZMB exon 3; Set C
ggaugggucuuuucacagggauaaacugcugggucgg

SEQ ID NO: 13529 - RNA, 40 nt, Artificial Sequence
  Synthetic Oligonucleotide; GZMB exon 3; Set C
ggggaugggucuuuucacagggauaaacugcugggucggc

SEQ ID NO: 13530 - RNA, 24 nt, Artificial Sequence
  Synthetic Oligonucleotide; GZMB exon 3; Set A
gucuuuucacagggauaaacugcu

SEQ ID NO: 13531 - RNA, 22 nt, Artificial Sequence
  Synthetic Oligonucleotide; GZMB exon 3; Set C
ucuuuucacagggauaaacugc

SEQ ID NO: 13532 - RNA, 36 nt, Artificial Sequence
  Synthetic Oligonucleotide; GZMB exon 3; Set C
ggaugggucuuuucacagggauaaacugcugggucg

SEQ ID NO: 13533 - RNA, 34 nt, Artificial Sequence
  Synthetic Oligonucleotide; GZMB exon 3; Set C
gaugggucuuuucacagggauaaacugcuggguc

SEQ ID NO: 13534 - RNA, 38 nt, Artificial Sequence
  Synthetic Oligonucleotide; GZMB exon 3; Set C
gggaugggucuuuucacagggauaaacugcugggucgg

SEQ ID NO: 13535 - RNA, 25 nt, Artificial Sequence
  Synthetic Oligonucleotide; GZMB exon 3; Set A
ggucuuuucacagggauaaacugcu

SEQ ID NO: 13536 - RNA, 23 nt, Artificial Sequence
  Synthetic Oligonucleotide; GZMB exon 3; Set C
gucuuuucacagggauaaacugc

SEQ ID NO: 13537 - RNA, 33 nt, Artificial Sequence
  Synthetic Oligonucleotide; GZMB exon 3; Set C
gaugggucuuuucacagggauaaacugcugggu

SEQ ID NO: 13538 - RNA, 37 nt, Artificial Sequence
  Synthetic Oligonucleotide; GZMB exon 3; Set C
gggaugggucuuuucacagggauaaacugcugggucg

SEQ ID NO: 13539 - RNA, 35 nt, Artificial Sequence
  Synthetic Oligonucleotide; GZMB exon 3; Set C
ggaugggucuuuucacagggauaaacugcuggguc

SEQ ID NO: 13540 - RNA, 24 nt, Artificial Sequence
  Synthetic Oligonucleotide; GZMB exon 3; Set A
ggucuuuucacagggauaaacugc

SEQ ID NO: 13541 - RNA, 34 nt, Artificial Sequence
  Synthetic Oligonucleotide; GZMB exon 3; Set C
ggaugggucuuuucacagggauaaacugcugggu

SEQ ID NO: 13542 - RNA, 38 nt, Artificial Sequence
  Synthetic Oligonucleotide; GZMB exon 3; Set C
ggggaugggucuuuucacagggauaaacugcugggucg

SEQ ID NO: 13543 - RNA, 36 nt, Artificial Sequence
  Synthetic Oligonucleotide; GZMB exon 3; Set C
gggaugggucuuuucacagggauaaacugcuggguc

SEQ ID NO: 13544 - RNA, 33 nt, Artificial Sequence
  Synthetic Oligonucleotide; GZMB exon 3; Set C
ggaugggucuuuucacagggauaaacugcuggg

SEQ ID NO: 13545 - RNA, 25 nt, Artificial Sequence
  Synthetic Oligonucleotide; GZMB exon 3; Set A
gggucuuuucacagggauaaacugc

SEQ ID NO: 13546 - RNA, 35 nt, Artificial Sequence
  Synthetic Oligonucleotide; GZMB exon 3; Set C
gggaugggucuuuucacagggauaaacugcugggu

SEQ ID NO: 13547 - RNA, 39 nt, Artificial Sequence
  Synthetic Oligonucleotide; GZMB exon 3; Set C
gggggaugggucuuuucacagggauaaacugcugggucg

SEQ ID NO: 13548 - RNA, 37 nt, Artificial Sequence
  Synthetic Oligonucleotide; GZMB exon 3; Set C
ggggaugggucuuuucacagggauaaacugcuggguc

SEQ ID NO: 13549 - RNA, 34 nt, Artificial Sequence
  Synthetic Oligonucleotide; GZMB exon 3; Set C
gggaugggucuuuucacagggauaaacugcuggg

SEQ ID NO: 13550 - RNA, 30 nt, Artificial Sequence
  Synthetic Oligonucleotide; GZMB exon 3; Set A
gaugggucuuuucacagggauaaacugcug

SEQ ID NO: 13551 - RNA, 36 nt, Artificial Sequence
  Synthetic Oligonucleotide; GZMB exon 3; Set C
ggggaugggucuuuucacagggauaaacugcugggu

SEQ ID NO: 13552 - RNA, 40 nt, Artificial Sequence
  Synthetic Oligonucleotide; GZMB exon 3; Set C
ugggggaugggucuuuucacagggauaaacugcugggucg

SEQ ID NO: 13553 - RNA, 38 nt, Artificial Sequence
  Synthetic Oligonucleotide; GZMB exon 3; Set C
gggggaugggucuuuucacagggauaaacugcuggguc

SEQ ID NO: 13554 - RNA, 35 nt, Artificial Sequence
  Synthetic Oligonucleotide; GZMB exon 3; Set C
ggggaugggucuuuucacagggauaaacugcuggg

SEQ ID NO: 13555 - RNA, 31 nt, Artificial Sequence
  Synthetic Oligonucleotide; GZMB exon 3; Set C
ggaugggucuuuucacagggauaaacugcug

SEQ ID NO: 13556 - RNA, 29 nt, Artificial Sequence
  Synthetic Oligonucleotide; GZMB exon 3; Set A
gaugggucuuuucacagggauaaacugcu

SEQ ID NO: 13557 - RNA, 37 nt, Artificial Sequence
  Synthetic Oligonucleotide; GZMB exon 3; Set C
gggggaugggucuuuucacagggauaaacugcugggu

SEQ ID NO: 13558 - RNA, 39 nt, Artificial Sequence
  Synthetic Oligonucleotide; GZMB exon 3; Set C
ugggggaugggucuuuucacagggauaaacugcuggguc

SEQ ID NO: 13559 - RNA, 36 nt, Artificial Sequence
  Synthetic Oligonucleotide; GZMB exon 3; Set C
gggggaugggucuuuucacagggauaaacugcuggg

SEQ ID NO: 13560 - RNA, 32 nt, Artificial Sequence
  Synthetic Oligonucleotide; GZMB exon 3; Set C
gggaugggucuuuucacagggauaaacugcug

SEQ ID NO: 13561 - RNA, 30 nt, Artificial Sequence
  Synthetic Oligonucleotide; GZMB exon 3; Set C
ggaugggucuuuucacagggauaaacugcu

SEQ ID NO: 13562 - RNA, 28 nt, Artificial Sequence
  Synthetic Oligonucleotide; GZMB exon 3; Set A
gaugggucuuuucacagggauaaacugc

SEQ ID NO: 13563 - RNA, 38 nt, Artificial Sequence
  Synthetic Oligonucleotide; GZMB exon 3; Set C
ugggggaugggucuuuucacagggauaaacugcugggu

SEQ ID NO: 13564 - RNA, 40 nt, Artificial Sequence
  Synthetic Oligonucleotide; GZMB exon 3; Set C
augggggaugggucuuuucacagggauaaacugcuggguc

SEQ ID NO: 13565 - RNA, 37 nt, Artificial Sequence
  Synthetic Oligonucleotide; GZMB exon 3; Set C
ugggggaugggucuuuucacagggauaaacugcuggg

SEQ ID NO: 13566 - RNA, 33 nt, Artificial Sequence
  Synthetic Oligonucleotide; GZMB exon 3; Set C
ggggaugggucuuuucacagggauaaacugcug

SEQ ID NO: 13567 - RNA, 31 nt, Artificial Sequence
  Synthetic Oligonucleotide; GZMB exon 3; Set C
gggaugggucuuuucacagggauaaacugcu

SEQ ID NO: 13568 - RNA, 29 nt, Artificial Sequence
  Synthetic Oligonucleotide; GZMB exon 3; Set A
ggaugggucuuuucacagggauaaacugc

SEQ ID NO: 13569 - RNA, 39 nt, Artificial Sequence
  Synthetic Oligonucleotide; GZMB exon 3; Set C
augggggaugggucuuuucacagggauaaacugcugggu

SEQ ID NO: 13570 - RNA, 38 nt, Artificial Sequence
  Synthetic Oligonucleotide; GZMB exon 3; Set C
augggggaugggucuuuucacagggauaaacugcuggg

SEQ ID NO: 13571 - RNA, 34 nt, Artificial Sequence
  Synthetic Oligonucleotide; GZMB exon 3; Set C
gggggaugggucuuuucacagggauaaacugcug

SEQ ID NO: 13572 - RNA, 32 nt, Artificial Sequence
  Synthetic Oligonucleotide; GZMB exon 3; Set C
ggggaugggucuuuucacagggauaaacugcu

SEQ ID NO: 13573 - RNA, 40 nt, Artificial Sequence
  Synthetic Oligonucleotide; GZMB exon 3; Set C
gaugggggaugggucuuuucacagggauaaacugcugggu

SEQ ID NO: 13574 - RNA, 30 nt, Artificial Sequence
  Synthetic Oligonucleotide; GZMB exon 3; Set C
gggaugggucuuuucacagggauaaacugc

SEQ ID NO: 13575 - RNA, 39 nt, Artificial Sequence
  Synthetic Oligonucleotide; GZMB exon 3; Set C
gaugggggaugggucuuuucacagggauaaacugcuggg

SEQ ID NO: 13576 - RNA, 35 nt, Artificial Sequence
  Synthetic Oligonucleotide; GZMB exon 3; Set C
ugggggaugggucuuuucacagggauaaacugcug

SEQ ID NO: 13577 - RNA, 33 nt, Artificial Sequence
  Synthetic Oligonucleotide; GZMB exon 3; Set C
gggggaugggucuuuucacagggauaaacugcu

SEQ ID NO: 13578 - RNA, 31 nt, Artificial Sequence
  Synthetic Oligonucleotide; GZMB exon 3; Set C
ggggaugggucuuuucacagggauaaacugc

SEQ ID NO: 13579 - RNA, 36 nt, Artificial Sequence
  Synthetic Oligonucleotide; GZMB exon 3; Set C
augggggaugggucuuuucacagggauaaacugcug

SEQ ID NO: 13580 - RNA, 34 nt, Artificial Sequence
  Synthetic Oligonucleotide; GZMB exon 3; Set C
ugggggaugggucuuuucacagggauaaacugcu

SEQ ID NO: 13581 - RNA, 32 nt, Artificial Sequence
  Synthetic Oligonucleotide; GZMB exon 3; Set C
gggggaugggucuuuucacagggauaaacugc

SEQ ID NO: 13582 - RNA, 37 nt, Artificial Sequence
  Synthetic Oligonucleotide; GZMB exon 3; Set C
gaugggggaugggucuuuucacagggauaaacugcug

SEQ ID NO: 13583 - RNA, 35 nt, Artificial Sequence
  Synthetic Oligonucleotide; GZMB exon 3; Set C
augggggaugggucuuuucacagggauaaacugcu

SEQ ID NO: 13584 - RNA, 33 nt, Artificial Sequence
  Synthetic Oligonucleotide; GZMB exon 3; Set C
ugggggaugggucuuuucacagggauaaacugc

SEQ ID NO: 13585 - RNA, 38 nt, Artificial Sequence
  Synthetic Oligonucleotide; GZMB exon 3; Set C
ggaugggggaugggucuuuucacagggauaaacugcug

SEQ ID NO: 13586 - RNA, 36 nt, Artificial Sequence
  Synthetic Oligonucleotide; GZMB exon 3; Set C
gaugggggaugggucuuuucacagggauaaacugcu

SEQ ID NO: 13587 - RNA, 34 nt, Artificial Sequence
  Synthetic Oligonucleotide; GZMB exon 3; Set C
augggggaugggucuuuucacagggauaaacugc

SEQ ID NO: 13588 - RNA, 27 nt, Artificial Sequence
  Synthetic Oligonucleotide; GZMB exon 3; Set A
ggggaugggucuuuucacagggauaaa

SEQ ID NO: 13589 - RNA, 39 nt, Artificial Sequence
  Synthetic Oligonucleotide; GZMB exon 3; Set C
uggaugggggaugggucuuuucacagggauaaacugcug

SEQ ID NO: 13590 - RNA, 37 nt, Artificial Sequence
  Synthetic Oligonucleotide; GZMB exon 3; Set C
ggaugggggaugggucuuuucacagggauaaacugcu

SEQ ID NO: 13591 - RNA, 35 nt, Artificial Sequence
  Synthetic Oligonucleotide; GZMB exon 3; Set C
gaugggggaugggucuuuucacagggauaaacugc

SEQ ID NO: 13592 - RNA, 28 nt, Artificial Sequence
  Synthetic Oligonucleotide; GZMB exon 3; Set C
gggggaugggucuuuucacagggauaaa

SEQ ID NO: 13593 - RNA, 40 nt, Artificial Sequence
  Synthetic Oligonucleotide; GZMB exon 3; Set C
cuggaugggggaugggucuuuucacagggauaaacugcug

SEQ ID NO: 13594 - RNA, 38 nt, Artificial Sequence
  Synthetic Oligonucleotide; GZMB exon 3; Set C
uggaugggggaugggucuuuucacagggauaaacugcu

SEQ ID NO: 13595 - RNA, 36 nt, Artificial Sequence
  Synthetic Oligonucleotide; GZMB exon 3; Set C
ggaugggggaugggucuuuucacagggauaaacugc

SEQ ID NO: 13596 - RNA, 39 nt, Artificial Sequence
  Synthetic Oligonucleotide; GZMB exon 3; Set C
cuggaugggggaugggucuuuucacagggauaaacugcu

SEQ ID NO: 13597 - RNA, 37 nt, Artificial Sequence
  Synthetic Oligonucleotide; GZMB exon 3; Set C
uggaugggggaugggucuuuucacagggauaaacugc

SEQ ID NO: 13598 - RNA, 40 nt, Artificial Sequence
  Synthetic Oligonucleotide; GZMB exon 3; Set C
gcuggaugggggaugggucuuuucacagggauaaacugcu

SEQ ID NO: 13599 - RNA, 38 nt, Artificial Sequence
  Synthetic Oligonucleotide; GZMB exon 3; Set C
cuggaugggggaugggucuuuucacagggauaaacugc

SEQ ID NO: 13600 - RNA, 39 nt, Artificial Sequence
  Synthetic Oligonucleotide; GZMB exon 3; Set C
gcuggaugggggaugggucuuuucacagggauaaacugc

SEQ ID NO: 13601 - RNA, 17 nt, Artificial Sequence
  Synthetic Oligonucleotide; GZMB exon 3; Set C
ggggaugggucuuuuca

SEQ ID NO: 13602 - RNA, 18 nt, Artificial Sequence
  Synthetic Oligonucleotide; GZMB exon 3; Set A
gggggaugggucuuuuca

SEQ ID NO: 13603 - RNA, 19 nt, Artificial Sequence
  Synthetic Oligonucleotide; GZMB exon 3; Set A
ugggggaugggucuuuuca

SEQ ID NO: 13604 - RNA, 37 nt, Artificial Sequence
  Synthetic Oligonucleotide; GZMB exon 3; Set C
uuaggauuauaggcuggaugggggaugggucuuuuca

SEQ ID NO: 13605 - RNA, 37 nt, Artificial Sequence
  Synthetic Oligonucleotide; GZMB exon 3; Set C
cuuaggauuauaggcuggaugggggaugggucuuuuc

SEQ ID NO: 13606 - RNA, 38 nt, Artificial Sequence
  Synthetic Oligonucleotide; GZMB exon 3; Set C
ucuuaggauuauaggcuggaugggggaugggucuuuuc

SEQ ID NO: 13607 - RNA, 36 nt, Artificial Sequence
  Synthetic Oligonucleotide; GZMB exon 3; Set C
cuuaggauuauaggcuggaugggggaugggucuuuu

SEQ ID NO: 13608 - RNA, 39 nt, Artificial Sequence
  Synthetic Oligonucleotide; GZMB exon 3; Set C
uucuuaggauuauaggcuggaugggggaugggucuuuuc

SEQ ID NO: 13609 - RNA, 37 nt, Artificial Sequence
  Synthetic Oligonucleotide; GZMB exon 3; Set C
ucuuaggauuauaggcuggaugggggaugggucuuuu

SEQ ID NO: 13610 - RNA, 35 nt, Artificial Sequence
  Synthetic Oligonucleotide; GZMB exon 3; Set C
cuuaggauuauaggcuggaugggggaugggucuuu

SEQ ID NO: 13611 - RNA, 33 nt, Artificial Sequence
  Synthetic Oligonucleotide; GZMB exon 3; Set C
uuaggauuauaggcuggaugggggaugggucuu

SEQ ID NO: 13612 - RNA, 38 nt, Artificial Sequence
  Synthetic Oligonucleotide; GZMB exon 3; Set C
uucuuaggauuauaggcuggaugggggaugggucuuuu

SEQ ID NO: 13613 - RNA, 36 nt, Artificial Sequence
  Synthetic Oligonucleotide; GZMB exon 3; Set C
ucuuaggauuauaggcuggaugggggaugggucuuu

SEQ ID NO: 13614 - RNA, 34 nt, Artificial Sequence
  Synthetic Oligonucleotide; GZMB exon 3; Set C
cuuaggauuauaggcuggaugggggaugggucuu

SEQ ID NO: 13615 - RNA, 32 nt, Artificial Sequence
  Synthetic Oligonucleotide; GZMB exon 3; Set C
uuaggauuauaggcuggaugggggaugggucu

SEQ ID NO: 13616 - RNA, 37 nt, Artificial Sequence
  Synthetic Oligonucleotide; GZMB exon 3; Set C
uucuuaggauuauaggcuggaugggggaugggucuuu

SEQ ID NO: 13617 - RNA, 35 nt, Artificial Sequence
  Synthetic Oligonucleotide; GZMB exon 3; Set C
ucuuaggauuauaggcuggaugggggaugggucuu

SEQ ID NO: 13618 - RNA, 33 nt, Artificial Sequence
  Synthetic Oligonucleotide; GZMB exon 3; Set C
cuuaggauuauaggcuggaugggggaugggucu

SEQ ID NO: 13619 - RNA, 31 nt, Artificial Sequence
  Synthetic Oligonucleotide; GZMB exon 3; Set C
uuaggauuauaggcuggaugggggauggguc

SEQ ID NO: 13620 - RNA, 36 nt, Artificial Sequence
  Synthetic Oligonucleotide; GZMB exon 3; Set C
uucuuaggauuauaggcuggaugggggaugggucuu

SEQ ID NO: 13621 - RNA, 34 nt, Artificial Sequence
  Synthetic Oligonucleotide; GZMB exon 3; Set C
ucuuaggauuauaggcuggaugggggaugggucu

SEQ ID NO: 13622 - RNA, 32 nt, Artificial Sequence
  Synthetic Oligonucleotide; GZMB exon 3; Set C
cuuaggauuauaggcuggaugggggauggguc

SEQ ID NO: 13623 - RNA, 31 nt, Artificial Sequence
  Synthetic Oligonucleotide; GZMB exon 3; Set C
cuuaggauuauaggcuggaugggggaugggu

SEQ ID NO: 13624 - RNA, 35 nt, Artificial Sequence
  Synthetic Oligonucleotide; GZMB exon 3; Set C
uucuuaggauuauaggcuggaugggggaugggucu

SEQ ID NO: 13625 - RNA, 33 nt, Artificial Sequence
  Synthetic Oligonucleotide; GZMB exon 3; Set C
ucuuaggauuauaggcuggaugggggauggguc

SEQ ID NO: 13626 - RNA, 32 nt, Artificial Sequence
  Synthetic Oligonucleotide; GZMB exon 3; Set C
ucuuaggauuauaggcuggaugggggaugggu

SEQ ID NO: 13627 - RNA, 30 nt, Artificial Sequence
  Synthetic Oligonucleotide; GZMB exon 3; Set C
cuuaggauuauaggcuggaugggggauggg

SEQ ID NO: 13628 - RNA, 34 nt, Artificial Sequence
  Synthetic Oligonucleotide; GZMB exon 3; Set C
uucuuaggauuauaggcuggaugggggauggguc

SEQ ID NO: 13629 - RNA, 29 nt, Artificial Sequence
  Synthetic Oligonucleotide; GZMB exon 3; Set C
cuuaggauuauaggcuggaugggggaugg

SEQ ID NO: 13630 - RNA, 33 nt, Artificial Sequence
  Synthetic Oligonucleotide; GZMB exon 3; Set C
uucuuaggauuauaggcuggaugggggaugggu

SEQ ID NO: 13631 - RNA, 31 nt, Artificial Sequence
  Synthetic Oligonucleotide; GZMB exon 3; Set C
ucuuaggauuauaggcuggaugggggauggg

SEQ ID NO: 13632 - RNA, 30 nt, Artificial Sequence
  Synthetic Oligonucleotide; GZMB exon 3; Set C
ucuuaggauuauaggcuggaugggggaugg

SEQ ID NO: 13633 - RNA, 28 nt, Artificial Sequence
  Synthetic Oligonucleotide; GZMB exon 3; Set A
cuuaggauuauaggcuggaugggggaug

SEQ ID NO: 13634 - RNA, 32 nt, Artificial Sequence
  Synthetic Oligonucleotide; GZMB exon 3; Set C
uucuuaggauuauaggcuggaugggggauggg

SEQ ID NO: 13635 - RNA, 26 nt, Artificial Sequence
  Synthetic Oligonucleotide; GZMB exon 3; Set A
uuaggauuauaggcuggaugggggau

SEQ ID NO: 13636 - RNA, 31 nt, Artificial Sequence
  Synthetic Oligonucleotide; GZMB exon 3; Set C
uucuuaggauuauaggcuggaugggggaugg

SEQ ID NO: 13637 - RNA, 29 nt, Artificial Sequence
  Synthetic Oligonucleotide; GZMB exon 3; Set A
ucuuaggauuauaggcuggaugggggaug

SEQ ID NO: 13638 - RNA, 27 nt, Artificial Sequence
  Synthetic Oligonucleotide; GZMB exon 3; Set A
cuuaggauuauaggcuggaugggggau

SEQ ID NO: 13639 - RNA, 25 nt, Artificial Sequence
  Synthetic Oligonucleotide; GZMB exon 3; Set A
uuaggauuauaggcuggauggggga

SEQ ID NO: 13640 - RNA, 30 nt, Artificial Sequence
  Synthetic Oligonucleotide; GZMB exon 3; Set A
uucuuaggauuauaggcuggaugggggaug

SEQ ID NO: 13641 - RNA, 28 nt, Artificial Sequence
  Synthetic Oligonucleotide; GZMB exon 3; Set A
ucuuaggauuauaggcuggaugggggau

SEQ ID NO: 13642 - RNA, 26 nt, Artificial Sequence
  Synthetic Oligonucleotide; GZMB exon 3; Set A
cuuaggauuauaggcuggauggggga

SEQ ID NO: 13643 - RNA, 24 nt, Artificial Sequence
  Synthetic Oligonucleotide; GZMB exon 3; Set A
uuaggauuauaggcuggauggggg

SEQ ID NO: 13644 - RNA, 29 nt, Artificial Sequence
  Synthetic Oligonucleotide; GZMB exon 3; Set C
uucuuaggauuauaggcuggaugggggau

SEQ ID NO: 13645 - RNA, 27 nt, Artificial Sequence
  Synthetic Oligonucleotide; GZMB exon 3; Set C
ucuuaggauuauaggcuggauggggga

SEQ ID NO: 13646 - RNA, 23 nt, Artificial Sequence
  Synthetic Oligonucleotide; GZMB exon 3; Set A
uuaggauuauaggcuggaugggg

SEQ ID NO: 13647 - RNA, 28 nt, Artificial Sequence
  Synthetic Oligonucleotide; GZMB exon 3; Set C
uucuuaggauuauaggcuggauggggga

SEQ ID NO: 13648 - RNA, 22 nt, Artificial Sequence
  Synthetic Oligonucleotide; GZMB exon 3; Set C
uuaggauuauaggcuggauggg

SEQ ID NO: 13649 - RNA, 27 nt, Artificial Sequence
  Synthetic Oligonucleotide; GZMB exon 3; Set A
uucuuaggauuauaggcuggauggggg

SEQ ID NO: 13650 - RNA, 21 nt, Artificial Sequence
  Synthetic Oligonucleotide; GZMB exon 3; Set C
uuaggauuauaggcuggaugg

SEQ ID NO: 13651 - RNA, 20 nt, Artificial Sequence
  Synthetic Oligonucleotide; GZMB exon 3; Set C
uuaggauuauaggcuggaug

SEQ ID NO: 13652 - RNA, 19 nt, Artificial Sequence
  Synthetic Oligonucleotide; GZMB exon 3; Set C
uuaggauuauaggcuggau

SEQ ID NO: 13653 - RNA, 21 nt, Artificial Sequence
  Synthetic Oligonucleotide; GZMB exon 3; Set C
cuuaggauuauaggcuggaug

SEQ ID NO: 13654 - RNA, 18 nt, Artificial Sequence
  Synthetic Oligonucleotide; GZMB exon 3; Set C
uuaggauuauaggcugga

SEQ ID NO: 13655 - RNA, 22 nt, Artificial Sequence
  Synthetic Oligonucleotide; GZMB exon 3; Set C
ucuuaggauuauaggcuggaug

SEQ ID NO: 13656 - RNA, 20 nt, Artificial Sequence
  Synthetic Oligonucleotide; GZMB exon 3; Set C
cuuaggauuauaggcuggau

SEQ ID NO: 13657 - RNA, 24 nt, Artificial Sequence
  Synthetic Oligonucleotide; GZMB exon 3; Set C
uucuuaggauuauaggcuggaugg

SEQ ID NO: 13658 - RNA, 19 nt, Artificial Sequence
  Synthetic Oligonucleotide; GZMB exon 3; Set C
cuuaggauuauaggcugga

SEQ ID NO: 13659 - RNA, 17 nt, Artificial Sequence
  Synthetic Oligonucleotide; GZMB exon 3; Set C
uuaggauuauaggcugg

SEQ ID NO: 13660 - RNA, 23 nt, Artificial Sequence
  Synthetic Oligonucleotide; GZMB exon 3; Set C
uucuuaggauuauaggcuggaug

SEQ ID NO: 13661 - RNA, 21 nt, Artificial Sequence
  Synthetic Oligonucleotide; GZMB exon 3; Set C
ucuuaggauuauaggcuggau

SEQ ID NO: 13662 - RNA, 20 nt, Artificial Sequence
  Synthetic Oligonucleotide; GZMB exon 3; Set C
ucuuaggauuauaggcugga

SEQ ID NO: 13663 - RNA, 18 nt, Artificial Sequence
  Synthetic Oligonucleotide; GZMB exon 3; Set C
cuuaggauuauaggcugg

SEQ ID NO: 13664 - RNA, 22 nt, Artificial Sequence
  Synthetic Oligonucleotide; GZMB exon 3; Set C
uucuuaggauuauaggcuggau

SEQ ID NO: 13665 - RNA, 16 nt, Artificial Sequence
  Synthetic Oligonucleotide; GZMB exon 3; Set C
uuaggauuauaggcug

SEQ ID NO: 13666 - RNA, 21 nt, Artificial Sequence
  Synthetic Oligonucleotide; GZMB exon 3; Set C
uucuuaggauuauaggcugga

SEQ ID NO: 13667 - RNA, 19 nt, Artificial Sequence
  Synthetic Oligonucleotide; GZMB exon 3; Set C
ucuuaggauuauaggcugg

SEQ ID NO: 13668 - RNA, 15 nt, Artificial Sequence
  Synthetic Oligonucleotide; GZMB exon 3; Set C
uuaggauuauaggcu

SEQ ID NO: 13669 - RNA, 20 nt, Artificial Sequence
  Synthetic Oligonucleotide; GZMB exon 3; Set C
uucuuaggauuauaggcugg

SEQ ID NO: 13670 - RNA, 15 nt, Artificial Sequence
  Synthetic Oligonucleotide; GZMB exon 3; Set C
cuuaggauuauaggc

SEQ ID NO: 13671 - RNA, 19 nt, Artificial Sequence
  Synthetic Oligonucleotide; GZMB exon 3; Set C
uucuuaggauuauaggcug

SEQ ID NO: 13672 - RNA, 16 nt, Artificial Sequence
  Synthetic Oligonucleotide; GZMB exon 3; Set C
ucuuaggauuauaggc

SEQ ID NO: 13673 - RNA, 18 nt, Artificial Sequence
  Synthetic Oligonucleotide; GZMB exon 3; Set C
uucuuaggauuauaggcu

SEQ ID NO: 13674 - RNA, 15 nt, Artificial Sequence
  Synthetic Oligonucleotide; GZMB exon 3; Set C
ucuuaggauuauagg

SEQ ID NO: 13675 - RNA, 17 nt, Artificial Sequence
  Synthetic Oligonucleotide; GZMB exon 3; Set C
uucuuaggauuauaggc

SEQ ID NO: 13676 - RNA, 16 nt, Artificial Sequence
  Synthetic Oligonucleotide; GZMB exon 3; Set C
uucuuaggauuauagg

SEQ ID NO: 13677 - RNA, 15 nt, Artificial Sequence
  Synthetic Oligonucleotide; GZMB exon 3; Set C
uucuuaggauuauag

SEQ ID NO: 13678 - RNA, 30 nt, Artificial Sequence
  Synthetic Oligonucleotide; GZMB exon 3; Set A
gucguuggagaaguucuuaggauuauaggc

SEQ ID NO: 13679 - RNA, 29 nt, Artificial Sequence
  Synthetic Oligonucleotide; GZMB exon 3; Set A
gucguuggagaaguucuuaggauuauagg

SEQ ID NO: 13680 - RNA, 28 nt, Artificial Sequence
  Synthetic Oligonucleotide; GZMB exon 3; Set A
gucguuggagaaguucuuaggauuauag

SEQ ID NO: 13681 - RNA, 30 nt, Artificial Sequence
  Synthetic Oligonucleotide; GZMB exon 3; Set A
ugucguuggagaaguucuuaggauuauagg

SEQ ID NO: 13682 - RNA, 27 nt, Artificial Sequence
  Synthetic Oligonucleotide; GZMB exon 3; Set A
gucguuggagaaguucuuaggauuaua

SEQ ID NO: 13683 - RNA, 29 nt, Artificial Sequence
  Synthetic Oligonucleotide; GZMB exon 3; Set A
ugucguuggagaaguucuuaggauuauag

SEQ ID NO: 13684 - RNA, 26 nt, Artificial Sequence
  Synthetic Oligonucleotide; GZMB exon 3; Set C
gucguuggagaaguucuuaggauuau

SEQ ID NO: 13685 - RNA, 28 nt, Artificial Sequence
  Synthetic Oligonucleotide; GZMB exon 3; Set A
ugucguuggagaaguucuuaggauuaua

SEQ ID NO: 13686 - RNA, 25 nt, Artificial Sequence
  Synthetic Oligonucleotide; GZMB exon 3; Set C
gucguuggagaaguucuuaggauua

SEQ ID NO: 13687 - RNA, 27 nt, Artificial Sequence
  Synthetic Oligonucleotide; GZMB exon 3; Set A
ugucguuggagaaguucuuaggauuau

SEQ ID NO: 13688 - RNA, 29 nt, Artificial Sequence
  Synthetic Oligonucleotide; GZMB exon 3; Set A
augucguuggagaaguucuuaggauuaua

SEQ ID NO: 13689 - RNA, 24 nt, Artificial Sequence
  Synthetic Oligonucleotide; GZMB exon 3; Set C
gucguuggagaaguucuuaggauu

SEQ ID NO: 13690 - RNA, 26 nt, Artificial Sequence
  Synthetic Oligonucleotide; GZMB exon 3; Set A
ugucguuggagaaguucuuaggauua

SEQ ID NO: 13691 - RNA, 28 nt, Artificial Sequence
  Synthetic Oligonucleotide; GZMB exon 3; Set A
augucguuggagaaguucuuaggauuau

SEQ ID NO: 13692 - RNA, 23 nt, Artificial Sequence
  Synthetic Oligonucleotide; GZMB exon 3; Set C
gucguuggagaaguucuuaggau

SEQ ID NO: 13693 - RNA, 25 nt, Artificial Sequence
  Synthetic Oligonucleotide; GZMB exon 3; Set C
ugucguuggagaaguucuuaggauu

SEQ ID NO: 13694 - RNA, 27 nt, Artificial Sequence
  Synthetic Oligonucleotide; GZMB exon 3; Set A
augucguuggagaaguucuuaggauua

SEQ ID NO: 13695 - RNA, 15 nt, Artificial Sequence
  Synthetic Oligonucleotide; GZMB exon 3; Set C
uuggagaaguucuua

SEQ ID NO: 13696 - RNA, 24 nt, Artificial Sequence
  Synthetic Oligonucleotide; GZMB exon 3; Set C
ugucguuggagaaguucuuaggau

SEQ ID NO: 13697 - RNA, 26 nt, Artificial Sequence
  Synthetic Oligonucleotide; GZMB exon 3; Set C
augucguuggagaaguucuuaggauu

SEQ ID NO: 13698 - RNA, 22 nt, Artificial Sequence
  Synthetic Oligonucleotide; GZMB exon 3; Set C
gucguuggagaaguucuuagga

SEQ ID NO: 13699 - RNA, 34 nt, Artificial Sequence
  Synthetic Oligonucleotide; GZMB exon 3; Set A
caugaugucguuggagaaguucuuaggauuauag

SEQ ID NO: 13700 - RNA, 16 nt, Artificial Sequence
  Synthetic Oligonucleotide; GZMB exon 3; Set C
guuggagaaguucuua

SEQ ID NO: 13701 - RNA, 25 nt, Artificial Sequence
  Synthetic Oligonucleotide; GZMB exon 3; Set C
augucguuggagaaguucuuaggau

SEQ ID NO: 13702 - RNA, 33 nt, Artificial Sequence
  Synthetic Oligonucleotide; GZMB exon 3; Set A
caugaugucguuggagaaguucuuaggauuaua

SEQ ID NO: 13703 - RNA, 21 nt, Artificial Sequence
  Synthetic Oligonucleotide; GZMB exon 3; Set C
gucguuggagaaguucuuagg

SEQ ID NO: 13704 - RNA, 23 nt, Artificial Sequence
  Synthetic Oligonucleotide; GZMB exon 3; Set C
ugucguuggagaaguucuuagga

SEQ ID NO: 13705 - RNA, 35 nt, Artificial Sequence
  Synthetic Oligonucleotide; GZMB exon 3; Set A
gcaugaugucguuggagaaguucuuaggauuauag

SEQ ID NO: 13706 - RNA, 17 nt, Artificial Sequence
  Synthetic Oligonucleotide; GZMB exon 3; Set C
cguuggagaaguucuua

SEQ ID NO: 13707 - RNA, 15 nt, Artificial Sequence
  Synthetic Oligonucleotide; GZMB exon 3; Set C
guuggagaaguucuu

SEQ ID NO: 13708 - RNA, 32 nt, Artificial Sequence
  Synthetic Oligonucleotide; GZMB exon 3; Set A
caugaugucguuggagaaguucuuaggauuau

SEQ ID NO: 13709 - RNA, 34 nt, Artificial Sequence
  Synthetic Oligonucleotide; GZMB exon 3; Set A
gcaugaugucguuggagaaguucuuaggauuaua

SEQ ID NO: 13710 - RNA, 20 nt, Artificial Sequence
  Synthetic Oligonucleotide; GZMB exon 3; Set C
gucguuggagaaguucuuag

SEQ ID NO: 13711 - RNA, 22 nt, Artificial Sequence
  Synthetic Oligonucleotide; GZMB exon 3; Set C
ugucguuggagaaguucuuagg

SEQ ID NO: 13712 - RNA, 24 nt, Artificial Sequence
  Synthetic Oligonucleotide; GZMB exon 3; Set C
augucguuggagaaguucuuagga

SEQ ID NO: 13713 - RNA, 36 nt, Artificial Sequence
  Synthetic Oligonucleotide; GZMB exon 3; Set A
agcaugaugucguuggagaaguucuuaggauuauag

SEQ ID NO: 13714 - RNA, 18 nt, Artificial Sequence
  Synthetic Oligonucleotide; GZMB exon 3; Set C
ucguuggagaaguucuua

SEQ ID NO: 13715 - RNA, 16 nt, Artificial Sequence
  Synthetic Oligonucleotide; GZMB exon 3; Set C
cguuggagaaguucuu

SEQ ID NO: 13716 - RNA, 33 nt, Artificial Sequence
  Synthetic Oligonucleotide; GZMB exon 3; Set A
gcaugaugucguuggagaaguucuuaggauuau

SEQ ID NO: 13717 - RNA, 31 nt, Artificial Sequence
  Synthetic Oligonucleotide; GZMB exon 3; Set A
caugaugucguuggagaaguucuuaggauua

SEQ ID NO: 13718 - RNA, 35 nt, Artificial Sequence
  Synthetic Oligonucleotide; GZMB exon 3; Set A
agcaugaugucguuggagaaguucuuaggauuaua

SEQ ID NO: 13719 - RNA, 21 nt, Artificial Sequence
  Synthetic Oligonucleotide; GZMB exon 3; Set C
ugucguuggagaaguucuuag

SEQ ID NO: 13720 - RNA, 23 nt, Artificial Sequence
  Synthetic Oligonucleotide; GZMB exon 3; Set C
augucguuggagaaguucuuagg

SEQ ID NO: 13721 - RNA, 15 nt, Artificial Sequence
  Synthetic Oligonucleotide; GZMB exon 3; Set C
cguuggagaaguucu

SEQ ID NO: 13722 - RNA, 17 nt, Artificial Sequence
  Synthetic Oligonucleotide; GZMB exon 3; Set C
ucguuggagaaguucuu

SEQ ID NO: 13723 - RNA, 34 nt, Artificial Sequence
  Synthetic Oligonucleotide; GZMB exon 3; Set A
agcaugaugucguuggagaaguucuuaggauuau

SEQ ID NO: 13724 - RNA, 32 nt, Artificial Sequence
  Synthetic Oligonucleotide; GZMB exon 3; Set A
gcaugaugucguuggagaaguucuuaggauua

SEQ ID NO: 13725 - RNA, 30 nt, Artificial Sequence
  Synthetic Oligonucleotide; GZMB exon 3; Set A
caugaugucguuggagaaguucuuaggauu

SEQ ID NO: 13726 - RNA, 16 nt, Artificial Sequence
  Synthetic Oligonucleotide; GZMB exon 3; Set C
ucguuggagaaguucu

SEQ ID NO: 13727 - RNA, 29 nt, Artificial Sequence
  Synthetic Oligonucleotide; GZMB exon 3; Set A
caugaugucguuggagaaguucuuaggau

SEQ ID NO: 13728 - RNA, 33 nt, Artificial Sequence
  Synthetic Oligonucleotide; GZMB exon 3; Set A
agcaugaugucguuggagaaguucuuaggauua

SEQ ID NO: 13729 - RNA, 31 nt, Artificial Sequence
  Synthetic Oligonucleotide; GZMB exon 3; Set A
gcaugaugucguuggagaaguucuuaggauu

SEQ ID NO: 13730 - RNA, 15 nt, Artificial Sequence
  Synthetic Oligonucleotide; GZMB exon 3; Set C
ucguuggagaaguuc

SEQ ID NO: 13731 - RNA, 30 nt, Artificial Sequence
  Synthetic Oligonucleotide; GZMB exon 3; Set A
gcaugaugucguuggagaaguucuuaggau

SEQ ID NO: 13732 - RNA, 32 nt, Artificial Sequence
  Synthetic Oligonucleotide; GZMB exon 3; Set A
agcaugaugucguuggagaaguucuuaggauu

SEQ ID NO: 13733 - RNA, 28 nt, Artificial Sequence
  Synthetic Oligonucleotide; GZMB exon 3; Set A
caugaugucguuggagaaguucuuagga

SEQ ID NO: 13734 - RNA, 22 nt, Artificial Sequence
  Synthetic Oligonucleotide; GZMB exon 3; Set C
gaugucguuggagaaguucuua

SEQ ID NO: 13735 - RNA, 31 nt, Artificial Sequence
  Synthetic Oligonucleotide; GZMB exon 3; Set A
agcaugaugucguuggagaaguucuuaggau

SEQ ID NO: 13736 - RNA, 29 nt, Artificial Sequence
  Synthetic Oligonucleotide; GZMB exon 3; Set A
gcaugaugucguuggagaaguucuuagga

SEQ ID NO: 13737 - RNA, 27 nt, Artificial Sequence
  Synthetic Oligonucleotide; GZMB exon 3; Set A
caugaugucguuggagaaguucuuagg

SEQ ID NO: 13738 - RNA, 15 nt, Artificial Sequence
  Synthetic Oligonucleotide; GZMB exon 3; Set C
gucguuggagaaguu

SEQ ID NO: 13739 - RNA, 23 nt, Artificial Sequence
  Synthetic Oligonucleotide; GZMB exon 3; Set C
ugaugucguuggagaaguucuua

SEQ ID NO: 13740 - RNA, 21 nt, Artificial Sequence
  Synthetic Oligonucleotide; GZMB exon 3; Set C
gaugucguuggagaaguucuu

SEQ ID NO: 13741 - RNA, 30 nt, Artificial Sequence
  Synthetic Oligonucleotide; GZMB exon 3; Set A
agcaugaugucguuggagaaguucuuagga

SEQ ID NO: 13742 - RNA, 28 nt, Artificial Sequence
  Synthetic Oligonucleotide; GZMB exon 3; Set A
gcaugaugucguuggagaaguucuuagg

SEQ ID NO: 13743 - RNA, 26 nt, Artificial Sequence
  Synthetic Oligonucleotide; GZMB exon 3; Set C
caugaugucguuggagaaguucuuag

SEQ ID NO: 13744 - RNA, 16 nt, Artificial Sequence
  Synthetic Oligonucleotide; GZMB exon 3; Set C
ugucguuggagaaguu

SEQ ID NO: 13745 - RNA, 24 nt, Artificial Sequence
  Synthetic Oligonucleotide; GZMB exon 3; Set C
augaugucguuggagaaguucuua

SEQ ID NO: 13746 - RNA, 20 nt, Artificial Sequence
  Synthetic Oligonucleotide; GZMB exon 3; Set C
gaugucguuggagaaguucu

SEQ ID NO: 13747 - RNA, 22 nt, Artificial Sequence
  Synthetic Oligonucleotide; GZMB exon 3; Set C
ugaugucguuggagaaguucuu

SEQ ID NO: 13748 - RNA, 29 nt, Artificial Sequence
  Synthetic Oligonucleotide; GZMB exon 3; Set A
agcaugaugucguuggagaaguucuuagg

SEQ ID NO: 13749 - RNA, 27 nt, Artificial Sequence
  Synthetic Oligonucleotide; GZMB exon 3; Set A
gcaugaugucguuggagaaguucuuag

SEQ ID NO: 13750 - RNA, 17 nt, Artificial Sequence
  Synthetic Oligonucleotide; GZMB exon 3; Set C
augucguuggagaaguu

SEQ ID NO: 13751 - RNA, 15 nt, Artificial Sequence
  Synthetic Oligonucleotide; GZMB exon 3; Set C
ugucguuggagaagu

SEQ ID NO: 13752 - RNA, 19 nt, Artificial Sequence
  Synthetic Oligonucleotide; GZMB exon 3; Set C
gaugucguuggagaaguuc

SEQ ID NO: 13753 - RNA, 21 nt, Artificial Sequence
  Synthetic Oligonucleotide; GZMB exon 3; Set C
ugaugucguuggagaaguucu

SEQ ID NO: 13754 - RNA, 23 nt, Artificial Sequence
  Synthetic Oligonucleotide; GZMB exon 3; Set C
augaugucguuggagaaguucuu

SEQ ID NO: 13755 - RNA, 28 nt, Artificial Sequence
  Synthetic Oligonucleotide; GZMB exon 3; Set A
agcaugaugucguuggagaaguucuuag

SEQ ID NO: 13756 - RNA, 20 nt, Artificial Sequence
  Synthetic Oligonucleotide; GZMB exon 3; Set C
ugaugucguuggagaaguuc

SEQ ID NO: 13757 - RNA, 22 nt, Artificial Sequence
  Synthetic Oligonucleotide; GZMB exon 3; Set C
augaugucguuggagaaguucu

SEQ ID NO: 13758 - RNA, 15 nt, Artificial Sequence
  Synthetic Oligonucleotide; GZMB exon 3; Set C
augucguuggagaag

SEQ ID NO: 13759 - RNA, 21 nt, Artificial Sequence
  Synthetic Oligonucleotide; GZMB exon 3; Set C
augaugucguuggagaaguuc

SEQ ID NO: 13760 - RNA, 28 nt, Artificial Sequence
  Synthetic Oligonucleotide; GZMB exon 3; Set A
uagcaugaugucguuggagaaguucuua

SEQ ID NO: 13761 - RNA, 21 nt, Artificial Sequence
  Synthetic Oligonucleotide; GZMB exon 3; Set C
caugaugucguuggagaaguu

SEQ ID NO: 13762 - RNA, 29 nt, Artificial Sequence
  Synthetic Oligonucleotide; GZMB exon 3; Set A
guagcaugaugucguuggagaaguucuua

SEQ ID NO: 13763 - RNA, 27 nt, Artificial Sequence
  Synthetic Oligonucleotide; GZMB exon 3; Set A
uagcaugaugucguuggagaaguucuu

SEQ ID NO: 13764 - RNA, 22 nt, Artificial Sequence
  Synthetic Oligonucleotide; GZMB exon 3; Set C
gcaugaugucguuggagaaguu

SEQ ID NO: 13765 - RNA, 30 nt, Artificial Sequence
  Synthetic Oligonucleotide; GZMB exon 3; Set A
aguagcaugaugucguuggagaaguucuua

SEQ ID NO: 13766 - RNA, 26 nt, Artificial Sequence
  Synthetic Oligonucleotide; GZMB exon 3; Set A
uagcaugaugucguuggagaaguucu

SEQ ID NO: 13767 - RNA, 28 nt, Artificial Sequence
  Synthetic Oligonucleotide; GZMB exon 3; Set A
guagcaugaugucguuggagaaguucuu

SEQ ID NO: 13768 - RNA, 19 nt, Artificial Sequence
  Synthetic Oligonucleotide; GZMB exon 3; Set C
caugaugucguuggagaag

SEQ ID NO: 13769 - RNA, 23 nt, Artificial Sequence
  Synthetic Oligonucleotide; GZMB exon 3; Set C
agcaugaugucguuggagaaguu

SEQ ID NO: 13770 - RNA, 25 nt, Artificial Sequence
  Synthetic Oligonucleotide; GZMB exon 3; Set A
uagcaugaugucguuggagaaguuc

SEQ ID NO: 13771 - RNA, 27 nt, Artificial Sequence
  Synthetic Oligonucleotide; GZMB exon 3; Set A
guagcaugaugucguuggagaaguucu

SEQ ID NO: 13772 - RNA, 29 nt, Artificial Sequence
  Synthetic Oligonucleotide; GZMB exon 3; Set A
aguagcaugaugucguuggagaaguucuu

SEQ ID NO: 13773 - RNA, 20 nt, Artificial Sequence
  Synthetic Oligonucleotide; GZMB exon 3; Set C
gcaugaugucguuggagaag

SEQ ID NO: 13774 - RNA, 22 nt, Artificial Sequence
  Synthetic Oligonucleotide; GZMB exon 3; Set C
agcaugaugucguuggagaagu

SEQ ID NO: 13775 - RNA, 26 nt, Artificial Sequence
  Synthetic Oligonucleotide; GZMB exon 3; Set A
guagcaugaugucguuggagaaguuc

SEQ ID NO: 13776 - RNA, 28 nt, Artificial Sequence
  Synthetic Oligonucleotide; GZMB exon 3; Set A
aguagcaugaugucguuggagaaguucu

SEQ ID NO: 13777 - RNA, 21 nt, Artificial Sequence
  Synthetic Oligonucleotide; GZMB exon 3; Set C
agcaugaugucguuggagaag

SEQ ID NO: 13778 - RNA, 27 nt, Artificial Sequence
  Synthetic Oligonucleotide; GZMB exon 3; Set A
aguagcaugaugucguuggagaaguuc

SEQ ID NO: 13779 - RNA, 38 nt, Artificial Sequence
  Synthetic Oligonucleotide; GZMB exon 3; Set C
gugugccucaccugcaguagcaugaugucguuggagaa

SEQ ID NO: 13780 - RNA, 39 nt, Artificial Sequence
  Synthetic Oligonucleotide; GZMB exon 3; Set C
agugugccucaccugcaguagcaugaugucguuggagaa

SEQ ID NO: 13781 - RNA, 37 nt, Artificial Sequence
  Synthetic Oligonucleotide; GZMB exon 3; Set C
gugugccucaccugcaguagcaugaugucguuggaga

SEQ ID NO: 13782 - RNA, 40 nt, Artificial Sequence
  Synthetic Oligonucleotide; GZMB exon 3; Set C
gagugugccucaccugcaguagcaugaugucguuggagaa

SEQ ID NO: 13783 - RNA, 38 nt, Artificial Sequence
  Synthetic Oligonucleotide; GZMB exon 3; Set C
agugugccucaccugcaguagcaugaugucguuggaga

SEQ ID NO: 13784 - RNA, 36 nt, Artificial Sequence
  Synthetic Oligonucleotide; GZMB exon 3; Set C
gugugccucaccugcaguagcaugaugucguuggag

SEQ ID NO: 13785 - RNA, 39 nt, Artificial Sequence
  Synthetic Oligonucleotide; GZMB exon 3; Set C
gagugugccucaccugcaguagcaugaugucguuggaga

SEQ ID NO: 13786 - RNA, 35 nt, Artificial Sequence
  Synthetic Oligonucleotide; GZMB exon 3; Set C
gugugccucaccugcaguagcaugaugucguugga

SEQ ID NO: 13787 - RNA, 37 nt, Artificial Sequence
  Synthetic Oligonucleotide; GZMB exon 3; Set C
agugugccucaccugcaguagcaugaugucguuggag

SEQ ID NO: 13788 - RNA, 34 nt, Artificial Sequence
  Synthetic Oligonucleotide; GZMB exon 3; Set C
gugugccucaccugcaguagcaugaugucguugg

SEQ ID NO: 13789 - RNA, 40 nt, Artificial Sequence
  Synthetic Oligonucleotide; GZMB exon 3; Set C
ggagugugccucaccugcaguagcaugaugucguuggaga

SEQ ID NO: 13790 - RNA, 36 nt, Artificial Sequence
  Synthetic Oligonucleotide; GZMB exon 3; Set C
agugugccucaccugcaguagcaugaugucguugga

SEQ ID NO: 13791 - RNA, 38 nt, Artificial Sequence
  Synthetic Oligonucleotide; GZMB exon 3; Set C
gagugugccucaccugcaguagcaugaugucguuggag

SEQ ID NO: 13792 - RNA, 33 nt, Artificial Sequence
  Synthetic Oligonucleotide; GZMB exon 3; Set C
gugugccucaccugcaguagcaugaugucguug

SEQ ID NO: 13793 - RNA, 35 nt, Artificial Sequence
  Synthetic Oligonucleotide; GZMB exon 3; Set C
agugugccucaccugcaguagcaugaugucguugg

SEQ ID NO: 13794 - RNA, 37 nt, Artificial Sequence
  Synthetic Oligonucleotide; GZMB exon 3; Set C
gagugugccucaccugcaguagcaugaugucguugga

SEQ ID NO: 13795 - RNA, 39 nt, Artificial Sequence
  Synthetic Oligonucleotide; GZMB exon 3; Set C
ggagugugccucaccugcaguagcaugaugucguuggag

SEQ ID NO: 13796 - RNA, 32 nt, Artificial Sequence
  Synthetic Oligonucleotide; GZMB exon 3; Set C
gugugccucaccugcaguagcaugaugucguu

SEQ ID NO: 13797 - RNA, 34 nt, Artificial Sequence
  Synthetic Oligonucleotide; GZMB exon 3; Set C
agugugccucaccugcaguagcaugaugucguug

SEQ ID NO: 13798 - RNA, 36 nt, Artificial Sequence
  Synthetic Oligonucleotide; GZMB exon 3; Set C
gagugugccucaccugcaguagcaugaugucguugg

SEQ ID NO: 13799 - RNA, 38 nt, Artificial Sequence
  Synthetic Oligonucleotide; GZMB exon 3; Set C
ggagugugccucaccugcaguagcaugaugucguugga

SEQ ID NO: 13800 - RNA, 33 nt, Artificial Sequence
  Synthetic Oligonucleotide; GZMB exon 3; Set C
agugugccucaccugcaguagcaugaugucguu

SEQ ID NO: 13801 - RNA, 35 nt, Artificial Sequence
  Synthetic Oligonucleotide; GZMB exon 3; Set C
gagugugccucaccugcaguagcaugaugucguug

SEQ ID NO: 13802 - RNA, 31 nt, Artificial Sequence
  Synthetic Oligonucleotide; GZMB exon 3; Set C
gugugccucaccugcaguagcaugaugucgu

SEQ ID NO: 13803 - RNA, 37 nt, Artificial Sequence
  Synthetic Oligonucleotide; GZMB exon 3; Set C
ggagugugccucaccugcaguagcaugaugucguugg

SEQ ID NO: 13804 - RNA, 34 nt, Artificial Sequence
  Synthetic Oligonucleotide; GZMB exon 3; Set C
gagugugccucaccugcaguagcaugaugucguu

SEQ ID NO: 13805 - RNA, 36 nt, Artificial Sequence
  Synthetic Oligonucleotide; GZMB exon 3; Set C
ggagugugccucaccugcaguagcaugaugucguug

SEQ ID NO: 13806 - RNA, 32 nt, Artificial Sequence
  Synthetic Oligonucleotide; GZMB exon 3; Set C
agugugccucaccugcaguagcaugaugucgu

SEQ ID NO: 13807 - RNA, 30 nt, Artificial Sequence
  Synthetic Oligonucleotide; GZMB exon 3; Set C
gugugccucaccugcaguagcaugaugucg

SEQ ID NO: 13808 - RNA, 35 nt, Artificial Sequence
  Synthetic Oligonucleotide; GZMB exon 3; Set C
ggagugugccucaccugcaguagcaugaugucguu

SEQ ID NO: 13809 - RNA, 31 nt, Artificial Sequence
  Synthetic Oligonucleotide; GZMB exon 3; Set C
agugugccucaccugcaguagcaugaugucg

SEQ ID NO: 13810 - RNA, 33 nt, Artificial Sequence
  Synthetic Oligonucleotide; GZMB exon 3; Set C
gagugugccucaccugcaguagcaugaugucgu

SEQ ID NO: 13811 - RNA, 34 nt, Artificial Sequence
  Synthetic Oligonucleotide; GZMB exon 3; Set C
ggagugugccucaccugcaguagcaugaugucgu

SEQ ID NO: 13812 - RNA, 32 nt, Artificial Sequence
  Synthetic Oligonucleotide; GZMB exon 3; Set C
gagugugccucaccugcaguagcaugaugucg

SEQ ID NO: 13813 - RNA, 33 nt, Artificial Sequence
  Synthetic Oligonucleotide; GZMB exon 3; Set C
ggagugugccucaccugcaguagcaugaugucg

SEQ ID NO: 13814 - RNA, 27 nt, Artificial Sequence
  Synthetic Oligonucleotide; GZMB exon 3; Set C
agugugccucaccugcaguagcaugau

SEQ ID NO: 13815 - RNA, 26 nt, Artificial Sequence
  Synthetic Oligonucleotide; GZMB exon 3; Set C
agugugccucaccugcaguagcauga

SEQ ID NO: 13816 - RNA, 28 nt, Artificial Sequence
  Synthetic Oligonucleotide; GZMB exon 3; Set C
gagugugccucaccugcaguagcaugau

SEQ ID NO: 13817 - RNA, 27 nt, Artificial Sequence
  Synthetic Oligonucleotide; GZMB exon 3; Set C
gagugugccucaccugcaguagcauga

SEQ ID NO: 13818 - RNA, 29 nt, Artificial Sequence
  Synthetic Oligonucleotide; GZMB exon 3; Set C
ggagugugccucaccugcaguagcaugau

SEQ ID NO: 13819 - RNA, 28 nt, Artificial Sequence
  Synthetic Oligonucleotide; GZMB exon 3; Set C
ggagugugccucaccugcaguagcauga

SEQ ID NO: 13820 - RNA, 27 nt, Artificial Sequence
  Synthetic Oligonucleotide; GZMB exon 3; Set C
ggagugugccucaccugcaguagcaug

SEQ ID NO: 13821 - RNA, 40 nt, Artificial Sequence
  Synthetic Oligonucleotide; GZMB exon 3; Set C
aguggcaggagugugccucaccugcaguagcaugaugucg

SEQ ID NO: 13822 - RNA, 22 nt, Artificial Sequence
  Synthetic Oligonucleotide; GZMB exon 3; Set C
ggagugugccucaccugcagua

SEQ ID NO: 13823 - RNA, 37 nt, Artificial Sequence
  Synthetic Oligonucleotide; GZMB exon 3; Set C
agaguggcaggagugugccucaccugcaguagcauga

SEQ ID NO: 13824 - RNA, 39 nt, Artificial Sequence
  Synthetic Oligonucleotide; GZMB exon 3; Set C
aagaguggcaggagugugccucaccugcaguagcaugau

SEQ ID NO: 13825 - RNA, 38 nt, Artificial Sequence
  Synthetic Oligonucleotide; GZMB exon 3; Set C
aagaguggcaggagugugccucaccugcaguagcauga

SEQ ID NO: 13826 - RNA, 37 nt, Artificial Sequence
  Synthetic Oligonucleotide; GZMB exon 3; Set C
aagaguggcaggagugugccucaccugcaguagcaug

SEQ ID NO: 13827 - RNA, 33 nt, Artificial Sequence
  Synthetic Oligonucleotide; GZMB exon 3; Set C
aagaguggcaggagugugccucaccugcaguag

SEQ ID NO: 13828 - RNA, 32 nt, Artificial Sequence
  Synthetic Oligonucleotide; GZMB exon 3; Set C
aagaguggcaggagugugccucaccugcagua

SEQ ID NO: 13829 - RNA, 31 nt, Artificial Sequence
  Synthetic Oligonucleotide; GZMB exon 3; Set C
aagaguggcaggagugugccucaccugcagu

SEQ ID NO: 13830 - RNA, 35 nt, Artificial Sequence
  Synthetic Oligonucleotide; GZMB exon 3; Set C
agcaagaguggcaggagugugccucaccugcagua

SEQ ID NO: 13831 - RNA, 36 nt, Artificial Sequence
  Synthetic Oligonucleotide; GZMB exon 3; Set C
gagcaagaguggcaggagugugccucaccugcagua

SEQ ID NO: 13832 - RNA, 35 nt, Artificial Sequence
  Synthetic Oligonucleotide; GZMB exon 3; Set C
gagcaagaguggcaggagugugccucaccugcagu

SEQ ID NO: 13833 - RNA, 15 nt, Artificial Sequence
  Synthetic Oligonucleotide; GZMB exon 3; Set C
gcaagaguggcagga

SEQ ID NO: 13834 - RNA, 30 nt, Artificial Sequence
  Synthetic Oligonucleotide; GZMB exon 3; Set C
ggaccaagaagagcaagaguggcaggagug

SEQ ID NO: 13835 - RNA, 31 nt, Artificial Sequence
  Synthetic Oligonucleotide; GZMB exon 3; Set C
uggaccaagaagagcaagaguggcaggagug

SEQ ID NO: 13836 - RNA, 29 nt, Artificial Sequence
  Synthetic Oligonucleotide; GZMB exon 3; Set C
ggaccaagaagagcaagaguggcaggagu

SEQ ID NO: 13837 - RNA, 30 nt, Artificial Sequence
  Synthetic Oligonucleotide; GZMB exon 3; Set C
uggaccaagaagagcaagaguggcaggagu

SEQ ID NO: 13838 - RNA, 28 nt, Artificial Sequence
  Synthetic Oligonucleotide; GZMB exon 3; Set B
ggaccaagaagagcaagaguggcaggag

SEQ ID NO: 13839 - RNA, 27 nt, Artificial Sequence
  Synthetic Oligonucleotide; GZMB exon 3; Set C
ggaccaagaagagcaagaguggcagga

SEQ ID NO: 13840 - RNA, 29 nt, Artificial Sequence
  Synthetic Oligonucleotide; GZMB exon 3; Set B
uggaccaagaagagcaagaguggcaggag

SEQ ID NO: 13841 - RNA, 28 nt, Artificial Sequence
  Synthetic Oligonucleotide; GZMB exon 3; Set C
uggaccaagaagagcaagaguggcagga

SEQ ID NO: 13842 - RNA, 20 nt, Artificial Sequence
  Synthetic Oligonucleotide; GZMB exon 3; Set C
ggaccaagaagagcaagagu

SEQ ID NO: 13843 - RNA, 21 nt, Artificial Sequence
  Synthetic Oligonucleotide; GZMB exon 3; Set C
uggaccaagaagagcaagagu

SEQ ID NO: 13844 - RNA, 19 nt, Artificial Sequence
  Synthetic Oligonucleotide; GZMB exon 3; Set C
ggaccaagaagagcaagag

SEQ ID NO: 13845 - RNA, 20 nt, Artificial Sequence
  Synthetic Oligonucleotide; GZMB exon 3; Set C
uggaccaagaagagcaagag

SEQ ID NO: 13846 - RNA, 18 nt, Artificial Sequence
  Synthetic Oligonucleotide; GZMB exon 3; Set C
ggaccaagaagagcaaga

SEQ ID NO: 13847 - RNA, 17 nt, Artificial Sequence
  Synthetic Oligonucleotide; GZMB exon 3; Set C
ggaccaagaagagcaag

SEQ ID NO: 13848 - RNA, 19 nt, Artificial Sequence
  Synthetic Oligonucleotide; GZMB exon 3; Set C
uggaccaagaagagcaaga

SEQ ID NO: 13849 - RNA, 18 nt, Artificial Sequence
  Synthetic Oligonucleotide; GZMB exon 3; Set C
uggaccaagaagagcaag

SEQ ID NO: 13850 - RNA, 16 nt, Artificial Sequence
  Synthetic Oligonucleotide; GZMB exon 3; Set C
ggaccaagaagagcaa

SEQ ID NO: 13851 - RNA, 17 nt, Artificial Sequence
  Synthetic Oligonucleotide; GZMB exon 3; Set C
uggaccaagaagagcaa

SEQ ID NO: 13852 - RNA, 15 nt, Artificial Sequence
  Synthetic Oligonucleotide; GZMB exon 3; Set C
ggaccaagaagagca

SEQ ID NO: 13853 - RNA, 16 nt, Artificial Sequence
  Synthetic Oligonucleotide; GZMB exon 3; Set C
uggaccaagaagagca

SEQ ID NO: 13854 - RNA, 15 nt, Artificial Sequence
  Synthetic Oligonucleotide; GZMB exon 3; Set C
uggaccaagaagagc

SEQ ID NO: 13855 - RNA, 30 nt, Artificial Sequence
  Synthetic Oligonucleotide; GZMB exon 3; Set C
agagcagagugaggauggggguggagucac

SEQ ID NO: 13856 - RNA, 29 nt, Artificial Sequence
  Synthetic Oligonucleotide; GZMB exon 3; Set C
agagcagagugaggauggggguggaguca

SEQ ID NO: 13857 - RNA, 31 nt, Artificial Sequence
  Synthetic Oligonucleotide; GZMB exon 3; Set C
gagagcagagugaggauggggguggagucac

SEQ ID NO: 13858 - RNA, 30 nt, Artificial Sequence
  Synthetic Oligonucleotide; GZMB exon 3; Set C
gagagcagagugaggauggggguggaguca

SEQ ID NO: 13859 - RNA, 28 nt, Artificial Sequence
  Synthetic Oligonucleotide; GZMB exon 3; Set C
agagcagagugaggauggggguggaguc

SEQ ID NO: 13860 - RNA, 32 nt, Artificial Sequence
  Synthetic Oligonucleotide; GZMB exon 3; Set C
agagagcagagugaggauggggguggagucac

SEQ ID NO: 13861 - RNA, 31 nt, Artificial Sequence
  Synthetic Oligonucleotide; GZMB exon 3; Set C
agagagcagagugaggauggggguggaguca

SEQ ID NO: 13862 - RNA, 29 nt, Artificial Sequence
  Synthetic Oligonucleotide; GZMB exon 3; Set C
gagagcagagugaggauggggguggaguc

SEQ ID NO: 13863 - RNA, 33 nt, Artificial Sequence
  Synthetic Oligonucleotide; GZMB exon 3; Set C
cagagagcagagugaggauggggguggagucac

SEQ ID NO: 13864 - RNA, 32 nt, Artificial Sequence
  Synthetic Oligonucleotide; GZMB exon 3; Set C
cagagagcagagugaggauggggguggaguca

SEQ ID NO: 13865 - RNA, 30 nt, Artificial Sequence
  Synthetic Oligonucleotide; GZMB exon 3; Set C
agagagcagagugaggauggggguggaguc

SEQ ID NO: 13866 - RNA, 34 nt, Artificial Sequence
  Synthetic Oligonucleotide; GZMB exon 3; Set C
acagagagcagagugaggauggggguggagucac

SEQ ID NO: 13867 - RNA, 33 nt, Artificial Sequence
  Synthetic Oligonucleotide; GZMB exon 3; Set C
acagagagcagagugaggauggggguggaguca

SEQ ID NO: 13868 - RNA, 31 nt, Artificial Sequence
  Synthetic Oligonucleotide; GZMB exon 3; Set C
cagagagcagagugaggauggggguggaguc

SEQ ID NO: 13869 - RNA, 35 nt, Artificial Sequence
  Synthetic Oligonucleotide; GZMB exon 3; Set C
cacagagagcagagugaggauggggguggagucac

SEQ ID NO: 13870 - RNA, 34 nt, Artificial Sequence
  Synthetic Oligonucleotide; GZMB exon 3; Set C
cacagagagcagagugaggauggggguggaguca

SEQ ID NO: 13871 - RNA, 32 nt, Artificial Sequence
  Synthetic Oligonucleotide; GZMB exon 3; Set C
acagagagcagagugaggauggggguggaguc

SEQ ID NO: 13872 - RNA, 36 nt, Artificial Sequence
  Synthetic Oligonucleotide; GZMB exon 3; Set C
gcacagagagcagagugaggauggggguggagucac

SEQ ID NO: 13873 - RNA, 35 nt, Artificial Sequence
  Synthetic Oligonucleotide; GZMB exon 3; Set C
gcacagagagcagagugaggauggggguggaguca

SEQ ID NO: 13874 - RNA, 33 nt, Artificial Sequence
  Synthetic Oligonucleotide; GZMB exon 3; Set C
cacagagagcagagugaggauggggguggaguc

SEQ ID NO: 13875 - RNA, 37 nt, Artificial Sequence
  Synthetic Oligonucleotide; GZMB exon 3; Set C
ugcacagagagcagagugaggauggggguggagucac

SEQ ID NO: 13876 - RNA, 36 nt, Artificial Sequence
  Synthetic Oligonucleotide; GZMB exon 3; Set C
ugcacagagagcagagugaggauggggguggaguca

SEQ ID NO: 13877 - RNA, 34 nt, Artificial Sequence
  Synthetic Oligonucleotide; GZMB exon 3; Set C
gcacagagagcagagugaggauggggguggaguc

SEQ ID NO: 13878 - RNA, 35 nt, Artificial Sequence
  Synthetic Oligonucleotide; GZMB exon 3; Set C
ugcacagagagcagagugaggauggggguggaguc

SEQ ID NO: 13879 - RNA, 40 nt, Artificial Sequence
  Synthetic Oligonucleotide; GZMB exon 3; Set C
gagcugcacagagagcagagugaggauggggguggaguca

SEQ ID NO: 13880 - RNA, 39 nt, Artificial Sequence
  Synthetic Oligonucleotide; GZMB exon 3; Set C
gagcugcacagagagcagagugaggauggggguggaguc

SEQ ID NO: 13881 - RNA, 40 nt, Artificial Sequence
  Synthetic Oligonucleotide; GZMB exon 3; Set C
ggagcugcacagagagcagagugaggauggggguggaguc

SEQ ID NO: 13882 - RNA, 40 nt, Artificial Sequence
  Synthetic Oligonucleotide; GZMB exon 3; Set C
aaggugacauuuauggagcugcacagagagcagagugagg

SEQ ID NO: 13883 - RNA, 39 nt, Artificial Sequence
  Synthetic Oligonucleotide; GZMB exon 3; Set C
aaggugacauuuauggagcugcacagagagcagagugag

SEQ ID NO: 13884 - RNA, 38 nt, Artificial Sequence
  Synthetic Oligonucleotide; GZMB exon 3; Set C
aaggugacauuuauggagcugcacagagagcagaguga

SEQ ID NO: 13885 - RNA, 37 nt, Artificial Sequence
  Synthetic Oligonucleotide; GZMB exon 3; Set C
aaggugacauuuauggagcugcacagagagcagagug

SEQ ID NO: 13886 - RNA, 36 nt, Artificial Sequence
  Synthetic Oligonucleotide; GZMB exon 3; Set C
aaggugacauuuauggagcugcacagagagcagagu

SEQ ID NO: 13887 - RNA, 29 nt, Artificial Sequence
  Synthetic Oligonucleotide; GZMB exon 3; Set A
aaggugacauuuauggagcugcacagaga

SEQ ID NO: 13888 - RNA, 28 nt, Artificial Sequence
  Synthetic Oligonucleotide; GZMB exon 3; Set A
aaggugacauuuauggagcugcacagag

SEQ ID NO: 13889 - RNA, 27 nt, Artificial Sequence
  Synthetic Oligonucleotide; GZMB exon 3; Set A
aaggugacauuuauggagcugcacaga

SEQ ID NO: 13890 - RNA, 26 nt, Artificial Sequence
  Synthetic Oligonucleotide; GZMB exon 3; Set A
aaggugacauuuauggagcugcacag

SEQ ID NO: 13891 - RNA, 25 nt, Artificial Sequence
  Synthetic Oligonucleotide; GZMB exon 3; Set A
aaggugacauuuauggagcugcaca

SEQ ID NO: 13892 - RNA, 18 nt, Artificial Sequence
  Synthetic Oligonucleotide; GZMB exon 3; Set C
aaggugacauuuauggag

SEQ ID NO: 13893 - RNA, 17 nt, Artificial Sequence
  Synthetic Oligonucleotide; GZMB exon 3; Set C
aaggugacauuuaugga

SEQ ID NO: 13894 - RNA, 16 nt, Artificial Sequence
  Synthetic Oligonucleotide; GZMB exon 3; Set C
aaggugacauuuaugg

SEQ ID NO: 13895 - RNA, 19 nt, Artificial Sequence
  Synthetic Oligonucleotide; GZMB exon 3; Set A
gauauugugggcccccaag

SEQ ID NO: 13896 - RNA, 20 nt, Artificial Sequence
  Synthetic Oligonucleotide; GZMB exon 3; Set A
ugauauugugggcccccaag

SEQ ID NO: 13897 - RNA, 21 nt, Artificial Sequence
  Synthetic Oligonucleotide; GZMB exon 3; Set A
uugauauugugggcccccaag

SEQ ID NO: 13898 - RNA, 22 nt, Artificial Sequence
  Synthetic Oligonucleotide; GZMB exon 3; Set A
uuugauauugugggcccccaag

SEQ ID NO: 13899 - RNA, 23 nt, Artificial Sequence
  Synthetic Oligonucleotide; GZMB exon 3; Set A
cuuugauauugugggcccccaag

SEQ ID NO: 13900 - RNA, 24 nt, Artificial Sequence
  Synthetic Oligonucleotide; GZMB exon 3; Set A
ucuuugauauugugggcccccaag

SEQ ID NO: 13901 - RNA, 25 nt, Artificial Sequence
  Synthetic Oligonucleotide; GZMB exon 3; Set A
uucuuugauauugugggcccccaag

SEQ ID NO: 13902 - RNA, 26 nt, Artificial Sequence
  Synthetic Oligonucleotide; GZMB exon 3; Set A
guucuuugauauugugggcccccaag

SEQ ID NO: 13903 - RNA, 27 nt, Artificial Sequence
  Synthetic Oligonucleotide; GZMB exon 3; Set A
uguucuuugauauugugggcccccaag

SEQ ID NO: 13904 - RNA, 15 nt, Artificial Sequence
  Synthetic Oligonucleotide; GZMB exon 3; Set C
uuugauauugugggc

SEQ ID NO: 13905 - RNA, 16 nt, Artificial Sequence
  Synthetic Oligonucleotide; GZMB exon 3; Set C
cuuugauauugugggc

SEQ ID NO: 13906 - RNA, 17 nt, Artificial Sequence
  Synthetic Oligonucleotide; GZMB exon 3; Set C
ucuuugauauugugggc

SEQ ID NO: 13907 - RNA, 18 nt, Artificial Sequence
  Synthetic Oligonucleotide; GZMB exon 3; Set C
uucuuugauauugugggc

SEQ ID NO: 13908 - RNA, 39 nt, Artificial Sequence
  Synthetic Oligonucleotide; GZMB exon 3; Set C
ugggucggcuccuguucuuugauauugugggcccccaag

SEQ ID NO: 13909 - RNA, 27 nt, Artificial Sequence
  Synthetic Oligonucleotide; GZMB exon 3; Set C
ucacagggauaaacugcugggucggcu

SEQ ID NO: 13910 - RNA, 26 nt, Artificial Sequence
  Synthetic Oligonucleotide; GZMB exon 3; Set C
ucacagggauaaacugcugggucggc

SEQ ID NO: 13911 - RNA, 25 nt, Artificial Sequence
  Synthetic Oligonucleotide; GZMB exon 3; Set A
ucacagggauaaacugcugggucgg

SEQ ID NO: 13912 - RNA, 24 nt, Artificial Sequence
  Synthetic Oligonucleotide; GZMB exon 3; Set A
ucacagggauaaacugcugggucg

SEQ ID NO: 13913 - RNA, 23 nt, Artificial Sequence
  Synthetic Oligonucleotide; GZMB exon 3; Set A
ucacagggauaaacugcuggguc

SEQ ID NO: 13914 - RNA, 22 nt, Artificial Sequence
  Synthetic Oligonucleotide; GZMB exon 3; Set A
ucacagggauaaacugcugggu

SEQ ID NO: 13915 - RNA, 21 nt, Artificial Sequence
  Synthetic Oligonucleotide; GZMB exon 3; Set A
ucacagggauaaacugcuggg

SEQ ID NO: 13916 - RNA, 19 nt, Artificial Sequence
  Synthetic Oligonucleotide; GZMB exon 3; Set C
ucacagggauaaacugcug

SEQ ID NO: 13917 - RNA, 18 nt, Artificial Sequence
  Synthetic Oligonucleotide; GZMB exon 3; Set C
ucacagggauaaacugcu

SEQ ID NO: 13918 - RNA, 17 nt, Artificial Sequence
  Synthetic Oligonucleotide; GZMB exon 3; Set C
ucacagggauaaacugc

SEQ ID NO: 13919 - RNA, 39 nt, Artificial Sequence
  Synthetic Oligonucleotide; GZMB exon 3; Set C
ggggaugggucuuuucacagggauaaacugcugggucgg

SEQ ID NO: 13920 - RNA, 40 nt, Artificial Sequence
  Synthetic Oligonucleotide; GZMB exon 3; Set C
gggggaugggucuuuucacagggauaaacugcugggucgg

SEQ ID NO: 13921 - RNA, 38 nt, Artificial Sequence
  Synthetic Oligonucleotide; GZMB exon 3; Set C
cuuaggauuauaggcuggaugggggaugggucuuuuca

SEQ ID NO: 13922 - RNA, 39 nt, Artificial Sequence
  Synthetic Oligonucleotide; GZMB exon 3; Set C
ucuuaggauuauaggcuggaugggggaugggucuuuuca

SEQ ID NO: 13923 - RNA, 40 nt, Artificial Sequence
  Synthetic Oligonucleotide; GZMB exon 3; Set C
uucuuaggauuauaggcuggaugggggaugggucuuuuca

SEQ ID NO: 13924 - RNA, 25 nt, Artificial Sequence
  Synthetic Oligonucleotide; GZMB exon 3; Set A
cuuaggauuauaggcuggauggggg

SEQ ID NO: 13925 - RNA, 26 nt, Artificial Sequence
  Synthetic Oligonucleotide; GZMB exon 3; Set A
ucuuaggauuauaggcuggauggggg

SEQ ID NO: 13926 - RNA, 24 nt, Artificial Sequence
  Synthetic Oligonucleotide; GZMB exon 3; Set A
cuuaggauuauaggcuggaugggg

SEQ ID NO: 13927 - RNA, 25 nt, Artificial Sequence
  Synthetic Oligonucleotide; GZMB exon 3; Set A
ucuuaggauuauaggcuggaugggg

SEQ ID NO: 13928 - RNA, 23 nt, Artificial Sequence
  Synthetic Oligonucleotide; GZMB exon 3; Set A
cuuaggauuauaggcuggauggg

SEQ ID NO: 13929 - RNA, 22 nt, Artificial Sequence
  Synthetic Oligonucleotide; GZMB exon 3; Set C
cuuaggauuauaggcuggaugg

SEQ ID NO: 13930 - RNA, 26 nt, Artificial Sequence
  Synthetic Oligonucleotide; GZMB exon 3; Set A
uucuuaggauuauaggcuggaugggg

SEQ ID NO: 13931 - RNA, 24 nt, Artificial Sequence
  Synthetic Oligonucleotide; GZMB exon 3; Set A
ucuuaggauuauaggcuggauggg

SEQ ID NO: 13932 - RNA, 23 nt, Artificial Sequence
  Synthetic Oligonucleotide; GZMB exon 3; Set C
ucuuaggauuauaggcuggaugg

SEQ ID NO: 13933 - RNA, 25 nt, Artificial Sequence
  Synthetic Oligonucleotide; GZMB exon 3; Set A
uucuuaggauuauaggcuggauggg

SEQ ID NO: 13934 - RNA, 17 nt, Artificial Sequence
  Synthetic Oligonucleotide; GZMB exon 3; Set C
cuuaggauuauaggcug

SEQ ID NO: 13935 - RNA, 16 nt, Artificial Sequence
  Synthetic Oligonucleotide; GZMB exon 3; Set C
cuuaggauuauaggcu

SEQ ID NO: 13936 - RNA, 18 nt, Artificial Sequence
  Synthetic Oligonucleotide; GZMB exon 3; Set C
ucuuaggauuauaggcug

SEQ ID NO: 13937 - RNA, 17 nt, Artificial Sequence
  Synthetic Oligonucleotide; GZMB exon 3; Set C
ucuuaggauuauaggcu

SEQ ID NO: 13938 - RNA, 40 nt, Artificial Sequence
  Synthetic Oligonucleotide; GZMB exon 3; Set C
gucguuggagaaguucuuaggauuauaggcuggauggggg

SEQ ID NO: 13939 - RNA, 39 nt, Artificial Sequence
  Synthetic Oligonucleotide; GZMB exon 3; Set C
gucguuggagaaguucuuaggauuauaggcuggaugggg

SEQ ID NO: 13940 - RNA, 38 nt, Artificial Sequence
  Synthetic Oligonucleotide; GZMB exon 3; Set C
gucguuggagaaguucuuaggauuauaggcuggauggg

SEQ ID NO: 13941 - RNA, 40 nt, Artificial Sequence
  Synthetic Oligonucleotide; GZMB exon 3; Set C
ugucguuggagaaguucuuaggauuauaggcuggaugggg

SEQ ID NO: 13942 - RNA, 37 nt, Artificial Sequence
  Synthetic Oligonucleotide; GZMB exon 3; Set C
gucguuggagaaguucuuaggauuauaggcuggaugg

SEQ ID NO: 13943 - RNA, 39 nt, Artificial Sequence
  Synthetic Oligonucleotide; GZMB exon 3; Set C
ugucguuggagaaguucuuaggauuauaggcuggauggg

SEQ ID NO: 13944 - RNA, 36 nt, Artificial Sequence
  Synthetic Oligonucleotide; GZMB exon 3; Set C
gucguuggagaaguucuuaggauuauaggcuggaug

SEQ ID NO: 13945 - RNA, 38 nt, Artificial Sequence
  Synthetic Oligonucleotide; GZMB exon 3; Set C
ugucguuggagaaguucuuaggauuauaggcuggaugg

SEQ ID NO: 13946 - RNA, 40 nt, Artificial Sequence
  Synthetic Oligonucleotide; GZMB exon 3; Set C
augucguuggagaaguucuuaggauuauaggcuggauggg

SEQ ID NO: 13947 - RNA, 35 nt, Artificial Sequence
  Synthetic Oligonucleotide; GZMB exon 3; Set C
gucguuggagaaguucuuaggauuauaggcuggau

SEQ ID NO: 13948 - RNA, 37 nt, Artificial Sequence
  Synthetic Oligonucleotide; GZMB exon 3; Set C
ugucguuggagaaguucuuaggauuauaggcuggaug

SEQ ID NO: 13949 - RNA, 39 nt, Artificial Sequence
  Synthetic Oligonucleotide; GZMB exon 3; Set C
augucguuggagaaguucuuaggauuauaggcuggaugg

SEQ ID NO: 13950 - RNA, 34 nt, Artificial Sequence
  Synthetic Oligonucleotide; GZMB exon 3; Set C
gucguuggagaaguucuuaggauuauaggcugga

SEQ ID NO: 13951 - RNA, 36 nt, Artificial Sequence
  Synthetic Oligonucleotide; GZMB exon 3; Set C
ugucguuggagaaguucuuaggauuauaggcuggau

SEQ ID NO: 13952 - RNA, 38 nt, Artificial Sequence
  Synthetic Oligonucleotide; GZMB exon 3; Set C
augucguuggagaaguucuuaggauuauaggcuggaug

SEQ ID NO: 13953 - RNA, 35 nt, Artificial Sequence
  Synthetic Oligonucleotide; GZMB exon 3; Set C
ugucguuggagaaguucuuaggauuauaggcugga

SEQ ID NO: 13954 - RNA, 33 nt, Artificial Sequence
  Synthetic Oligonucleotide; GZMB exon 3; Set A
gucguuggagaaguucuuaggauuauaggcugg

SEQ ID NO: 13955 - RNA, 37 nt, Artificial Sequence
  Synthetic Oligonucleotide; GZMB exon 3; Set C
augucguuggagaaguucuuaggauuauaggcuggau

SEQ ID NO: 13956 - RNA, 36 nt, Artificial Sequence
  Synthetic Oligonucleotide; GZMB exon 3; Set C
augucguuggagaaguucuuaggauuauaggcugga

SEQ ID NO: 13957 - RNA, 34 nt, Artificial Sequence
  Synthetic Oligonucleotide; GZMB exon 3; Set A
ugucguuggagaaguucuuaggauuauaggcugg

SEQ ID NO: 13958 - RNA, 32 nt, Artificial Sequence
  Synthetic Oligonucleotide; GZMB exon 3; Set A
gucguuggagaaguucuuaggauuauaggcug

SEQ ID NO: 13959 - RNA, 35 nt, Artificial Sequence
  Synthetic Oligonucleotide; GZMB exon 3; Set A
augucguuggagaaguucuuaggauuauaggcugg

SEQ ID NO: 13960 - RNA, 31 nt, Artificial Sequence
  Synthetic Oligonucleotide; GZMB exon 3; Set A
gucguuggagaaguucuuaggauuauaggcu

SEQ ID NO: 13961 - RNA, 33 nt, Artificial Sequence
  Synthetic Oligonucleotide; GZMB exon 3; Set A
ugucguuggagaaguucuuaggauuauaggcug

SEQ ID NO: 13962 - RNA, 32 nt, Artificial Sequence
  Synthetic Oligonucleotide; GZMB exon 3; Set A
ugucguuggagaaguucuuaggauuauaggcu

SEQ ID NO: 13963 - RNA, 34 nt, Artificial Sequence
  Synthetic Oligonucleotide; GZMB exon 3; Set A
augucguuggagaaguucuuaggauuauaggcug

SEQ ID NO: 13964 - RNA, 31 nt, Artificial Sequence
  Synthetic Oligonucleotide; GZMB exon 3; Set A
ugucguuggagaaguucuuaggauuauaggc

SEQ ID NO: 13965 - RNA, 33 nt, Artificial Sequence
  Synthetic Oligonucleotide; GZMB exon 3; Set A
augucguuggagaaguucuuaggauuauaggcu

SEQ ID NO: 13966 - RNA, 32 nt, Artificial Sequence
  Synthetic Oligonucleotide; GZMB exon 3; Set A
augucguuggagaaguucuuaggauuauaggc

SEQ ID NO: 13967 - RNA, 40 nt, Artificial Sequence
  Synthetic Oligonucleotide; GZMB exon 3; Set C
caugaugucguuggagaaguucuuaggauuauaggcugga

SEQ ID NO: 13968 - RNA, 31 nt, Artificial Sequence
  Synthetic Oligonucleotide; GZMB exon 3; Set A
augucguuggagaaguucuuaggauuauagg

SEQ ID NO: 13969 - RNA, 39 nt, Artificial Sequence
  Synthetic Oligonucleotide; GZMB exon 3; Set C
caugaugucguuggagaaguucuuaggauuauaggcugg

SEQ ID NO: 13970 - RNA, 30 nt, Artificial Sequence
  Synthetic Oligonucleotide; GZMB exon 3; Set A
augucguuggagaaguucuuaggauuauag

SEQ ID NO: 13971 - RNA, 40 nt, Artificial Sequence
  Synthetic Oligonucleotide; GZMB exon 3; Set C
gcaugaugucguuggagaaguucuuaggauuauaggcugg

SEQ ID NO: 13972 - RNA, 38 nt, Artificial Sequence
  Synthetic Oligonucleotide; GZMB exon 3; Set C
caugaugucguuggagaaguucuuaggauuauaggcug

SEQ ID NO: 13973 - RNA, 37 nt, Artificial Sequence
  Synthetic Oligonucleotide; GZMB exon 3; Set C
caugaugucguuggagaaguucuuaggauuauaggcu

SEQ ID NO: 13974 - RNA, 39 nt, Artificial Sequence
  Synthetic Oligonucleotide; GZMB exon 3; Set C
gcaugaugucguuggagaaguucuuaggauuauaggcug

SEQ ID NO: 13975 - RNA, 36 nt, Artificial Sequence
  Synthetic Oligonucleotide; GZMB exon 3; Set A
caugaugucguuggagaaguucuuaggauuauaggc

SEQ ID NO: 13976 - RNA, 38 nt, Artificial Sequence
  Synthetic Oligonucleotide; GZMB exon 3; Set C
gcaugaugucguuggagaaguucuuaggauuauaggcu

SEQ ID NO: 13977 - RNA, 40 nt, Artificial Sequence
  Synthetic Oligonucleotide; GZMB exon 3; Set C
agcaugaugucguuggagaaguucuuaggauuauaggcug

SEQ ID NO: 13978 - RNA, 35 nt, Artificial Sequence
  Synthetic Oligonucleotide; GZMB exon 3; Set A
caugaugucguuggagaaguucuuaggauuauagg

SEQ ID NO: 13979 - RNA, 37 nt, Artificial Sequence
  Synthetic Oligonucleotide; GZMB exon 3; Set C
gcaugaugucguuggagaaguucuuaggauuauaggc

SEQ ID NO: 13980 - RNA, 39 nt, Artificial Sequence
  Synthetic Oligonucleotide; GZMB exon 3; Set C
agcaugaugucguuggagaaguucuuaggauuauaggcu

SEQ ID NO: 13981 - RNA, 36 nt, Artificial Sequence
  Synthetic Oligonucleotide; GZMB exon 3; Set A
gcaugaugucguuggagaaguucuuaggauuauagg

SEQ ID NO: 13982 - RNA, 38 nt, Artificial Sequence
  Synthetic Oligonucleotide; GZMB exon 3; Set C
agcaugaugucguuggagaaguucuuaggauuauaggc

SEQ ID NO: 13983 - RNA, 37 nt, Artificial Sequence
  Synthetic Oligonucleotide; GZMB exon 3; Set A
agcaugaugucguuggagaaguucuuaggauuauagg

SEQ ID NO: 13984 - RNA, 22 nt, Artificial Sequence
  Synthetic Oligonucleotide; GZMB exon 3; Set C
augucguuggagaaguucuuag

SEQ ID NO: 13985 - RNA, 16 nt, Artificial Sequence
  Synthetic Oligonucleotide; GZMB exon 3; Set C
augucguuggagaagu

SEQ ID NO: 13986 - RNA, 20 nt, Artificial Sequence
  Synthetic Oligonucleotide; GZMB exon 3; Set C
caugaugucguuggagaagu

SEQ ID NO: 13987 - RNA, 21 nt, Artificial Sequence
  Synthetic Oligonucleotide; GZMB exon 3; Set C
gcaugaugucguuggagaagu

SEQ ID NO: 13988 - RNA, 18 nt, Artificial Sequence
  Synthetic Oligonucleotide; GZMB exon 3; Set C
caugaugucguuggagaa

SEQ ID NO: 13989 - RNA, 19 nt, Artificial Sequence
  Synthetic Oligonucleotide; GZMB exon 3; Set C
gcaugaugucguuggagaa

SEQ ID NO: 13990 - RNA, 17 nt, Artificial Sequence
  Synthetic Oligonucleotide; GZMB exon 3; Set C
caugaugucguuggaga

SEQ ID NO: 13991 - RNA, 20 nt, Artificial Sequence
  Synthetic Oligonucleotide; GZMB exon 3; Set C
agcaugaugucguuggagaa

SEQ ID NO: 13992 - RNA, 18 nt, Artificial Sequence
  Synthetic Oligonucleotide; GZMB exon 3; Set C
gcaugaugucguuggaga

SEQ ID NO: 13993 - RNA, 16 nt, Artificial Sequence
  Synthetic Oligonucleotide; GZMB exon 3; Set C
caugaugucguuggag

SEQ ID NO: 13994 - RNA, 19 nt, Artificial Sequence
  Synthetic Oligonucleotide; GZMB exon 3; Set C
agcaugaugucguuggaga

SEQ ID NO: 13995 - RNA, 15 nt, Artificial Sequence
  Synthetic Oligonucleotide; GZMB exon 3; Set C
caugaugucguugga

SEQ ID NO: 13996 - RNA, 17 nt, Artificial Sequence
  Synthetic Oligonucleotide; GZMB exon 3; Set C
gcaugaugucguuggag

SEQ ID NO: 13997 - RNA, 16 nt, Artificial Sequence
  Synthetic Oligonucleotide; GZMB exon 3; Set C
gcaugaugucguugga

SEQ ID NO: 13998 - RNA, 18 nt, Artificial Sequence
  Synthetic Oligonucleotide; GZMB exon 3; Set C
agcaugaugucguuggag

SEQ ID NO: 13999 - RNA, 15 nt, Artificial Sequence
  Synthetic Oligonucleotide; GZMB exon 3; Set C
gcaugaugucguugg

SEQ ID NO: 14000 - RNA, 17 nt, Artificial Sequence
  Synthetic Oligonucleotide; GZMB exon 3; Set C
agcaugaugucguugga

SEQ ID NO: 14001 - RNA, 16 nt, Artificial Sequence
  Synthetic Oligonucleotide; GZMB exon 3; Set C
agcaugaugucguugg

SEQ ID NO: 14002 - RNA, 15 nt, Artificial Sequence
  Synthetic Oligonucleotide; GZMB exon 3; Set C
agcaugaugucguug

SEQ ID NO: 14003 - RNA, 26 nt, Artificial Sequence
  Synthetic Oligonucleotide; GZMB exon 3; Set C
gugugccucaccugcaguagcaugau

SEQ ID NO: 14004 - RNA, 25 nt, Artificial Sequence
  Synthetic Oligonucleotide; GZMB exon 3; Set C
gugugccucaccugcaguagcauga

SEQ ID NO: 14005 - RNA, 24 nt, Artificial Sequence
  Synthetic Oligonucleotide; GZMB exon 3; Set C
gugugccucaccugcaguagcaug

SEQ ID NO: 14006 - RNA, 25 nt, Artificial Sequence
  Synthetic Oligonucleotide; GZMB exon 3; Set C
agugugccucaccugcaguagcaug

SEQ ID NO: 14007 - RNA, 26 nt, Artificial Sequence
  Synthetic Oligonucleotide; GZMB exon 3; Set C
gagugugccucaccugcaguagcaug

SEQ ID NO: 14008 - RNA, 20 nt, Artificial Sequence
  Synthetic Oligonucleotide; GZMB exon 3; Set B
gugugccucaccugcaguag

SEQ ID NO: 14009 - RNA, 19 nt, Artificial Sequence
  Synthetic Oligonucleotide; GZMB exon 3; Set B
gugugccucaccugcagua

SEQ ID NO: 14010 - RNA, 21 nt, Artificial Sequence
  Synthetic Oligonucleotide; GZMB exon 3; Set B
agugugccucaccugcaguag

SEQ ID NO: 14011 - RNA, 18 nt, Artificial Sequence
  Synthetic Oligonucleotide; GZMB exon 3; Set B
gugugccucaccugcagu

SEQ ID NO: 14012 - RNA, 20 nt, Artificial Sequence
  Synthetic Oligonucleotide; GZMB exon 3; Set B
agugugccucaccugcagua

SEQ ID NO: 14013 - RNA, 22 nt, Artificial Sequence
  Synthetic Oligonucleotide; GZMB exon 3; Set B
gagugugccucaccugcaguag

SEQ ID NO: 14014 - RNA, 19 nt, Artificial Sequence
  Synthetic Oligonucleotide; GZMB exon 3; Set B
agugugccucaccugcagu

SEQ ID NO: 14015 - RNA, 21 nt, Artificial Sequence
  Synthetic Oligonucleotide; GZMB exon 3; Set B
gagugugccucaccugcagua

SEQ ID NO: 14016 - RNA, 23 nt, Artificial Sequence
  Synthetic Oligonucleotide; GZMB exon 3; Set C
ggagugugccucaccugcaguag

SEQ ID NO: 14017 - RNA, 20 nt, Artificial Sequence
  Synthetic Oligonucleotide; GZMB exon 3; Set B
gagugugccucaccugcagu

SEQ ID NO: 14018 - RNA, 36 nt, Artificial Sequence
  Synthetic Oligonucleotide; GZMB exon 3; Set C
aguggcaggagugugccucaccugcaguagcaugau

SEQ ID NO: 14019 - RNA, 21 nt, Artificial Sequence
  Synthetic Oligonucleotide; GZMB exon 3; Set C
ggagugugccucaccugcagu

SEQ ID NO: 14020 - RNA, 35 nt, Artificial Sequence
  Synthetic Oligonucleotide; GZMB exon 3; Set C
aguggcaggagugugccucaccugcaguagcauga

SEQ ID NO: 14021 - RNA, 37 nt, Artificial Sequence
  Synthetic Oligonucleotide; GZMB exon 3; Set C
gaguggcaggagugugccucaccugcaguagcaugau

SEQ ID NO: 14022 - RNA, 36 nt, Artificial Sequence
  Synthetic Oligonucleotide; GZMB exon 3; Set C
gaguggcaggagugugccucaccugcaguagcauga

SEQ ID NO: 14023 - RNA, 38 nt, Artificial Sequence
  Synthetic Oligonucleotide; GZMB exon 3; Set C
agaguggcaggagugugccucaccugcaguagcaugau

SEQ ID NO: 14024 - RNA, 34 nt, Artificial Sequence
  Synthetic Oligonucleotide; GZMB exon 3; Set C
aguggcaggagugugccucaccugcaguagcaug

SEQ ID NO: 14025 - RNA, 35 nt, Artificial Sequence
  Synthetic Oligonucleotide; GZMB exon 3; Set C
gaguggcaggagugugccucaccugcaguagcaug

SEQ ID NO: 14026 - RNA, 40 nt, Artificial Sequence
  Synthetic Oligonucleotide; GZMB exon 3; Set C
caagaguggcaggagugugccucaccugcaguagcaugau

SEQ ID NO: 14027 - RNA, 36 nt, Artificial Sequence
  Synthetic Oligonucleotide; GZMB exon 3; Set C
agaguggcaggagugugccucaccugcaguagcaug

SEQ ID NO: 14028 - RNA, 39 nt, Artificial Sequence
  Synthetic Oligonucleotide; GZMB exon 3; Set C
caagaguggcaggagugugccucaccugcaguagcauga

SEQ ID NO: 14029 - RNA, 30 nt, Artificial Sequence
  Synthetic Oligonucleotide; GZMB exon 3; Set C
aguggcaggagugugccucaccugcaguag

SEQ ID NO: 14030 - RNA, 40 nt, Artificial Sequence
  Synthetic Oligonucleotide; GZMB exon 3; Set C
gcaagaguggcaggagugugccucaccugcaguagcauga

SEQ ID NO: 14031 - RNA, 38 nt, Artificial Sequence
  Synthetic Oligonucleotide; GZMB exon 3; Set C
caagaguggcaggagugugccucaccugcaguagcaug

SEQ ID NO: 14032 - RNA, 29 nt, Artificial Sequence
  Synthetic Oligonucleotide; GZMB exon 3; Set C
aguggcaggagugugccucaccugcagua

SEQ ID NO: 14033 - RNA, 31 nt, Artificial Sequence
  Synthetic Oligonucleotide; GZMB exon 3; Set C
gaguggcaggagugugccucaccugcaguag

SEQ ID NO: 14034 - RNA, 39 nt, Artificial Sequence
  Synthetic Oligonucleotide; GZMB exon 3; Set C
gcaagaguggcaggagugugccucaccugcaguagcaug

SEQ ID NO: 14035 - RNA, 28 nt, Artificial Sequence
  Synthetic Oligonucleotide; GZMB exon 3; Set C
aguggcaggagugugccucaccugcagu

SEQ ID NO: 14036 - RNA, 30 nt, Artificial Sequence
  Synthetic Oligonucleotide; GZMB exon 3; Set C
gaguggcaggagugugccucaccugcagua

SEQ ID NO: 14037 - RNA, 32 nt, Artificial Sequence
  Synthetic Oligonucleotide; GZMB exon 3; Set C
agaguggcaggagugugccucaccugcaguag

SEQ ID NO: 14038 - RNA, 40 nt, Artificial Sequence
  Synthetic Oligonucleotide; GZMB exon 3; Set C
agcaagaguggcaggagugugccucaccugcaguagcaug

SEQ ID NO: 14039 - RNA, 29 nt, Artificial Sequence
  Synthetic Oligonucleotide; GZMB exon 3; Set C
gaguggcaggagugugccucaccugcagu

SEQ ID NO: 14040 - RNA, 31 nt, Artificial Sequence
  Synthetic Oligonucleotide; GZMB exon 3; Set C
agaguggcaggagugugccucaccugcagua

SEQ ID NO: 14041 - RNA, 30 nt, Artificial Sequence
  Synthetic Oligonucleotide; GZMB exon 3; Set C
agaguggcaggagugugccucaccugcagu

SEQ ID NO: 14042 - RNA, 34 nt, Artificial Sequence
  Synthetic Oligonucleotide; GZMB exon 3; Set C
caagaguggcaggagugugccucaccugcaguag

SEQ ID NO: 14043 - RNA, 33 nt, Artificial Sequence
  Synthetic Oligonucleotide; GZMB exon 3; Set C
caagaguggcaggagugugccucaccugcagua

SEQ ID NO: 14044 - RNA, 35 nt, Artificial Sequence
  Synthetic Oligonucleotide; GZMB exon 3; Set C
gcaagaguggcaggagugugccucaccugcaguag

SEQ ID NO: 14045 - RNA, 32 nt, Artificial Sequence
  Synthetic Oligonucleotide; GZMB exon 3; Set C
caagaguggcaggagugugccucaccugcagu

SEQ ID NO: 14046 - RNA, 34 nt, Artificial Sequence
  Synthetic Oligonucleotide; GZMB exon 3; Set C
gcaagaguggcaggagugugccucaccugcagua

SEQ ID NO: 14047 - RNA, 36 nt, Artificial Sequence
  Synthetic Oligonucleotide; GZMB exon 3; Set C
agcaagaguggcaggagugugccucaccugcaguag

SEQ ID NO: 14048 - RNA, 33 nt, Artificial Sequence
  Synthetic Oligonucleotide; GZMB exon 3; Set C
gcaagaguggcaggagugugccucaccugcagu

SEQ ID NO: 14049 - RNA, 37 nt, Artificial Sequence
  Synthetic Oligonucleotide; GZMB exon 3; Set C
gagcaagaguggcaggagugugccucaccugcaguag

SEQ ID NO: 14050 - RNA, 34 nt, Artificial Sequence
  Synthetic Oligonucleotide; GZMB exon 3; Set C
agcaagaguggcaggagugugccucaccugcagu

SEQ ID NO: 14051 - RNA, 21 nt, Artificial Sequence
  Synthetic Oligonucleotide; GZMB exon 3; Set B
agagcaagaguggcaggagug

SEQ ID NO: 14052 - RNA, 20 nt, Artificial Sequence
  Synthetic Oligonucleotide; GZMB exon 3; Set B
agagcaagaguggcaggagu

SEQ ID NO: 14053 - RNA, 22 nt, Artificial Sequence
  Synthetic Oligonucleotide; GZMB exon 3; Set B
aagagcaagaguggcaggagug

SEQ ID NO: 14054 - RNA, 21 nt, Artificial Sequence
  Synthetic Oligonucleotide; GZMB exon 3; Set B
aagagcaagaguggcaggagu

SEQ ID NO: 14055 - RNA, 23 nt, Artificial Sequence
  Synthetic Oligonucleotide; GZMB exon 3; Set B
gaagagcaagaguggcaggagug

SEQ ID NO: 14056 - RNA, 19 nt, Artificial Sequence
  Synthetic Oligonucleotide; GZMB exon 3; Set C
agagcaagaguggcaggag

SEQ ID NO: 14057 - RNA, 24 nt, Artificial Sequence
  Synthetic Oligonucleotide; GZMB exon 3; Set B
agaagagcaagaguggcaggagug

SEQ ID NO: 14058 - RNA, 18 nt, Artificial Sequence
  Synthetic Oligonucleotide; GZMB exon 3; Set C
agagcaagaguggcagga

SEQ ID NO: 14059 - RNA, 22 nt, Artificial Sequence
  Synthetic Oligonucleotide; GZMB exon 3; Set B
gaagagcaagaguggcaggagu

SEQ ID NO: 14060 - RNA, 20 nt, Artificial Sequence
  Synthetic Oligonucleotide; GZMB exon 3; Set C
aagagcaagaguggcaggag

SEQ ID NO: 14061 - RNA, 23 nt, Artificial Sequence
  Synthetic Oligonucleotide; GZMB exon 3; Set B
agaagagcaagaguggcaggagu

SEQ ID NO: 14062 - RNA, 25 nt, Artificial Sequence
  Synthetic Oligonucleotide; GZMB exon 3; Set B
aagaagagcaagaguggcaggagug

SEQ ID NO: 14063 - RNA, 19 nt, Artificial Sequence
  Synthetic Oligonucleotide; GZMB exon 3; Set C
aagagcaagaguggcagga

SEQ ID NO: 14064 - RNA, 21 nt, Artificial Sequence
  Synthetic Oligonucleotide; GZMB exon 3; Set B
gaagagcaagaguggcaggag

SEQ ID NO: 14065 - RNA, 24 nt, Artificial Sequence
  Synthetic Oligonucleotide; GZMB exon 3; Set B
aagaagagcaagaguggcaggagu

SEQ ID NO: 14066 - RNA, 20 nt, Artificial Sequence
  Synthetic Oligonucleotide; GZMB exon 3; Set B
gaagagcaagaguggcagga

SEQ ID NO: 14067 - RNA, 22 nt, Artificial Sequence
  Synthetic Oligonucleotide; GZMB exon 3; Set B
agaagagcaagaguggcaggag

SEQ ID NO: 14068 - RNA, 21 nt, Artificial Sequence
  Synthetic Oligonucleotide; GZMB exon 3; Set B
agaagagcaagaguggcagga

SEQ ID NO: 14069 - RNA, 27 nt, Artificial Sequence
  Synthetic Oligonucleotide; GZMB exon 3; Set B
ccaagaagagcaagaguggcaggagug

SEQ ID NO: 14070 - RNA, 23 nt, Artificial Sequence
  Synthetic Oligonucleotide; GZMB exon 3; Set C
aagaagagcaagaguggcaggag

SEQ ID NO: 14071 - RNA, 22 nt, Artificial Sequence
  Synthetic Oligonucleotide; GZMB exon 3; Set C
aagaagagcaagaguggcagga

SEQ ID NO: 14072 - RNA, 26 nt, Artificial Sequence
  Synthetic Oligonucleotide; GZMB exon 3; Set B
ccaagaagagcaagaguggcaggagu

SEQ ID NO: 14073 - RNA, 15 nt, Artificial Sequence
  Synthetic Oligonucleotide; GZMB exon 3; Set C
aagaagagcaagagu

SEQ ID NO: 14074 - RNA, 17 nt, Artificial Sequence
  Synthetic Oligonucleotide; GZMB exon 3; Set C
ccaagaagagcaagagu

SEQ ID NO: 14075 - RNA, 18 nt, Artificial Sequence
  Synthetic Oligonucleotide; GZMB exon 3; Set C
accaagaagagcaagagu

SEQ ID NO: 14076 - RNA, 16 nt, Artificial Sequence
  Synthetic Oligonucleotide; GZMB exon 3; Set C
ccaagaagagcaagag

SEQ ID NO: 14077 - RNA, 15 nt, Artificial Sequence
  Synthetic Oligonucleotide; GZMB exon 3; Set C
ccaagaagagcaaga

SEQ ID NO: 14078 - RNA, 17 nt, Artificial Sequence
  Synthetic Oligonucleotide; GZMB exon 3; Set C
accaagaagagcaagag

SEQ ID NO: 14079 - RNA, 15 nt, Artificial Sequence
  Synthetic Oligonucleotide; GZMB exon 3; Set C
accaagaagagcaag

SEQ ID NO: 14080 - RNA, 24 nt, Artificial Sequence
  Synthetic Oligonucleotide; GZMB exon 3; Set A
aaggugacauuuauggagcugcac

SEQ ID NO: 14081 - RNA, 35 nt, Artificial Sequence
  Synthetic Oligonucleotide; GZMB exon 3; Set C
gcccccaaggugacauuuauggagcugcacagaga

SEQ ID NO: 14082 - RNA, 23 nt, Artificial Sequence
  Synthetic Oligonucleotide; GZMB exon 3; Set A
aaggugacauuuauggagcugca

SEQ ID NO: 14083 - RNA, 36 nt, Artificial Sequence
  Synthetic Oligonucleotide; GZMB exon 3; Set C
ggcccccaaggugacauuuauggagcugcacagaga

SEQ ID NO: 14084 - RNA, 34 nt, Artificial Sequence
  Synthetic Oligonucleotide; GZMB exon 3; Set C
gcccccaaggugacauuuauggagcugcacagag

SEQ ID NO: 14085 - RNA, 22 nt, Artificial Sequence
  Synthetic Oligonucleotide; GZMB exon 3; Set C
aaggugacauuuauggagcugc

SEQ ID NO: 14086 - RNA, 35 nt, Artificial Sequence
  Synthetic Oligonucleotide; GZMB exon 3; Set C
ggcccccaaggugacauuuauggagcugcacagag

SEQ ID NO: 14087 - RNA, 34 nt, Artificial Sequence
  Synthetic Oligonucleotide; GZMB exon 3; Set C
ggcccccaaggugacauuuauggagcugcacaga

SEQ ID NO: 14088 - RNA, 21 nt, Artificial Sequence
  Synthetic Oligonucleotide; GZMB exon 3; Set A
gcccccaaggugacauuuaug

SEQ ID NO: 14089 - RNA, 23 nt, Artificial Sequence
  Synthetic Oligonucleotide; GZMB exon 3; Set A
ggcccccaaggugacauuuaugg

SEQ ID NO: 14090 - RNA, 20 nt, Artificial Sequence
  Synthetic Oligonucleotide; GZMB exon 3; Set A
gcccccaaggugacauuuau

SEQ ID NO: 14091 - RNA, 22 nt, Artificial Sequence
  Synthetic Oligonucleotide; GZMB exon 3; Set A
ggcccccaaggugacauuuaug

SEQ ID NO: 14092 - RNA, 21 nt, Artificial Sequence
  Synthetic Oligonucleotide; GZMB exon 3; Set A
ggcccccaaggugacauuuau

SEQ ID NO: 14093 - RNA, 20 nt, Artificial Sequence
  Synthetic Oligonucleotide; GZMB exon 3; Set A
ggcccccaaggugacauuua

SEQ ID NO: 14094 - RNA, 19 nt, Artificial Sequence
  Synthetic Oligonucleotide; GZMB exon 3; Set A
ggcccccaaggugacauuu

SEQ ID NO: 14095 - RNA, 15 nt, Artificial Sequence
  Synthetic Oligonucleotide; GZMB exon 3; Set C
uugugggcccccaag

SEQ ID NO: 14096 - RNA, 16 nt, Artificial Sequence
  Synthetic Oligonucleotide; GZMB exon 3; Set C
auugugggcccccaag

SEQ ID NO: 14097 - RNA, 17 nt, Artificial Sequence
  Synthetic Oligonucleotide; GZMB exon 3; Set C
uauugugggcccccaag

SEQ ID NO: 14098 - RNA, 18 nt, Artificial Sequence
  Synthetic Oligonucleotide; GZMB exon 3; Set C
auauugugggcccccaag

SEQ ID NO: 14099 - RNA, 15 nt, Artificial Sequence
  Synthetic Oligonucleotide; GZMB exon 3; Set C
ugauauugugggccc

SEQ ID NO: 14100 - RNA, 16 nt, Artificial Sequence
  Synthetic Oligonucleotide; GZMB exon 3; Set C
uugauauugugggccc

SEQ ID NO: 14101 - RNA, 15 nt, Artificial Sequence
  Synthetic Oligonucleotide; GZMB exon 3; Set C
uugauauugugggcc

SEQ ID NO: 14102 - RNA, 17 nt, Artificial Sequence
  Synthetic Oligonucleotide; GZMB exon 3; Set C
uuugauauugugggccc

SEQ ID NO: 14103 - RNA, 16 nt, Artificial Sequence
  Synthetic Oligonucleotide; GZMB exon 3; Set C
uuugauauugugggcc

SEQ ID NO: 14104 - RNA, 18 nt, Artificial Sequence
  Synthetic Oligonucleotide; GZMB exon 3; Set C
cuuugauauugugggccc

SEQ ID NO: 14105 - RNA, 17 nt, Artificial Sequence
  Synthetic Oligonucleotide; GZMB exon 3; Set C
cuuugauauugugggcc

SEQ ID NO: 14106 - RNA, 19 nt, Artificial Sequence
  Synthetic Oligonucleotide; GZMB exon 3; Set C
ucuuugauauugugggccc

SEQ ID NO: 14107 - RNA, 18 nt, Artificial Sequence
  Synthetic Oligonucleotide; GZMB exon 3; Set C
ucuuugauauugugggcc

SEQ ID NO: 14108 - RNA, 20 nt, Artificial Sequence
  Synthetic Oligonucleotide; GZMB exon 3; Set C
uucuuugauauugugggccc

SEQ ID NO: 14109 - RNA, 19 nt, Artificial Sequence
  Synthetic Oligonucleotide; GZMB exon 3; Set C
uucuuugauauugugggcc

SEQ ID NO: 14110 - RNA, 32 nt, Artificial Sequence
  Synthetic Oligonucleotide; GZMB exon 3; Set C
gcuccuguucuuugauauugugggcccccaag

SEQ ID NO: 14111 - RNA, 20 nt, Artificial Sequence
  Synthetic Oligonucleotide; GZMB exon 3; Set C
guucuuugauauugugggcc

SEQ ID NO: 14112 - RNA, 33 nt, Artificial Sequence
  Synthetic Oligonucleotide; GZMB exon 3; Set C
ggcuccuguucuuugauauugugggcccccaag

SEQ ID NO: 14113 - RNA, 19 nt, Artificial Sequence
  Synthetic Oligonucleotide; GZMB exon 3; Set C
guucuuugauauugugggc

SEQ ID NO: 14114 - RNA, 21 nt, Artificial Sequence
  Synthetic Oligonucleotide; GZMB exon 3; Set C
uguucuuugauauugugggcc

SEQ ID NO: 14115 - RNA, 20 nt, Artificial Sequence
  Synthetic Oligonucleotide; GZMB exon 3; Set C
uguucuuugauauugugggc

SEQ ID NO: 14116 - RNA, 35 nt, Artificial Sequence
  Synthetic Oligonucleotide; GZMB exon 3; Set C
ucggcuccuguucuuugauauugugggcccccaag

SEQ ID NO: 14117 - RNA, 36 nt, Artificial Sequence
  Synthetic Oligonucleotide; GZMB exon 3; Set C
gucggcuccuguucuuugauauugugggcccccaag

SEQ ID NO: 14118 - RNA, 37 nt, Artificial Sequence
  Synthetic Oligonucleotide; GZMB exon 3; Set C
ggucggcuccuguucuuugauauugugggcccccaag

SEQ ID NO: 14119 - RNA, 38 nt, Artificial Sequence
  Synthetic Oligonucleotide; GZMB exon 3; Set C
gggucggcuccuguucuuugauauugugggcccccaag

SEQ ID NO: 14120 - RNA, 40 nt, Artificial Sequence
  Synthetic Oligonucleotide; GZMB exon 3; Set C
cugggucggcuccuguucuuugauauugugggcccccaag

SEQ ID NO: 14121 - RNA, 31 nt, Artificial Sequence
  Synthetic Oligonucleotide; GZMB exon 3; Set C
gggucggcuccuguucuuugauauugugggc

SEQ ID NO: 14122 - RNA, 33 nt, Artificial Sequence
  Synthetic Oligonucleotide; GZMB exon 3; Set C
ugggucggcuccuguucuuugauauugugggcc

SEQ ID NO: 14123 - RNA, 32 nt, Artificial Sequence
  Synthetic Oligonucleotide; GZMB exon 3; Set C
ugggucggcuccuguucuuugauauugugggc

SEQ ID NO: 14124 - RNA, 40 nt, Artificial Sequence
  Synthetic Oligonucleotide; GZMB exon 3; Set C
aaacugcugggucggcuccuguucuuugauauugugggcc

SEQ ID NO: 14125 - RNA, 39 nt, Artificial Sequence
  Synthetic Oligonucleotide; GZMB exon 3; Set C
aaacugcugggucggcuccuguucuuugauauugugggc

SEQ ID NO: 14126 - RNA, 40 nt, Artificial Sequence
  Synthetic Oligonucleotide; GZMB exon 3; Set C
uaaacugcugggucggcuccuguucuuugauauugugggc

SEQ ID NO: 14127 - RNA, 29 nt, Artificial Sequence
  Synthetic Oligonucleotide; GZMB exon 3; Set C
uaggcuggaugggggaugggucuuuucac

SEQ ID NO: 14128 - RNA, 30 nt, Artificial Sequence
  Synthetic Oligonucleotide; GZMB exon 3; Set C
auaggcuggaugggggaugggucuuuucac

SEQ ID NO: 14129 - RNA, 31 nt, Artificial Sequence
  Synthetic Oligonucleotide; GZMB exon 3; Set C
uauaggcuggaugggggaugggucuuuucac

SEQ ID NO: 14130 - RNA, 32 nt, Artificial Sequence
  Synthetic Oligonucleotide; GZMB exon 3; Set C
uuauaggcuggaugggggaugggucuuuucac

SEQ ID NO: 14131 - RNA, 33 nt, Artificial Sequence
  Synthetic Oligonucleotide; GZMB exon 3; Set C
auuauaggcuggaugggggaugggucuuuucac

SEQ ID NO: 14132 - RNA, 34 nt, Artificial Sequence
  Synthetic Oligonucleotide; GZMB exon 3; Set C
gauuauaggcuggaugggggaugggucuuuucac

SEQ ID NO: 14133 - RNA, 35 nt, Artificial Sequence
  Synthetic Oligonucleotide; GZMB exon 3; Set C
ggauuauaggcuggaugggggaugggucuuuucac

SEQ ID NO: 14134 - RNA, 36 nt, Artificial Sequence
  Synthetic Oligonucleotide; GZMB exon 3; Set C
aggauuauaggcuggaugggggaugggucuuuucac

SEQ ID NO: 14135 - RNA, 37 nt, Artificial Sequence
  Synthetic Oligonucleotide; GZMB exon 3; Set C
uaggauuauaggcuggaugggggaugggucuuuucac

SEQ ID NO: 14136 - RNA, 19 nt, Artificial Sequence
  Synthetic Oligonucleotide; GZMB exon 3; Set C
gucguuggagaaguucuua

SEQ ID NO: 14137 - RNA, 20 nt, Artificial Sequence
  Synthetic Oligonucleotide; GZMB exon 3; Set C
ugucguuggagaaguucuua

SEQ ID NO: 14138 - RNA, 18 nt, Artificial Sequence
  Synthetic Oligonucleotide; GZMB exon 3; Set C
gucguuggagaaguucuu

SEQ ID NO: 14139 - RNA, 21 nt, Artificial Sequence
  Synthetic Oligonucleotide; GZMB exon 3; Set C
augucguuggagaaguucuua

SEQ ID NO: 14140 - RNA, 17 nt, Artificial Sequence
  Synthetic Oligonucleotide; GZMB exon 3; Set C
gucguuggagaaguucu

SEQ ID NO: 14141 - RNA, 19 nt, Artificial Sequence
  Synthetic Oligonucleotide; GZMB exon 3; Set C
ugucguuggagaaguucuu

SEQ ID NO: 14142 - RNA, 16 nt, Artificial Sequence
  Synthetic Oligonucleotide; GZMB exon 3; Set C
gucguuggagaaguuc

SEQ ID NO: 14143 - RNA, 17 nt, Artificial Sequence
  Synthetic Oligonucleotide; GZMB exon 3; Set C
ugucguuggagaaguuc

SEQ ID NO: 14144 - RNA, 18 nt, Artificial Sequence
  Synthetic Oligonucleotide; GZMB exon 3; Set C
augucguuggagaaguuc

SEQ ID NO: 14145 - RNA, 25 nt, Artificial Sequence
  Synthetic Oligonucleotide; GZMB exon 3; Set C
caugaugucguuggagaaguucuua

SEQ ID NO: 14146 - RNA, 26 nt, Artificial Sequence
  Synthetic Oligonucleotide; GZMB exon 3; Set A
gcaugaugucguuggagaaguucuua

SEQ ID NO: 14147 - RNA, 27 nt, Artificial Sequence
  Synthetic Oligonucleotide; GZMB exon 3; Set A
agcaugaugucguuggagaaguucuua

SEQ ID NO: 14148 - RNA, 40 nt, Artificial Sequence
  Synthetic Oligonucleotide; GZMB exon 3; Set C
cugcaguagcaugaugucguuggagaaguucuuaggauua

SEQ ID NO: 14149 - RNA, 22 nt, Artificial Sequence
  Synthetic Oligonucleotide; GZMB exon 3; Set C
caugaugucguuggagaaguuc

SEQ ID NO: 14150 - RNA, 39 nt, Artificial Sequence
  Synthetic Oligonucleotide; GZMB exon 3; Set C
cugcaguagcaugaugucguuggagaaguucuuaggauu

SEQ ID NO: 14151 - RNA, 23 nt, Artificial Sequence
  Synthetic Oligonucleotide; GZMB exon 3; Set A
gcaugaugucguuggagaaguuc

SEQ ID NO: 14152 - RNA, 38 nt, Artificial Sequence
  Synthetic Oligonucleotide; GZMB exon 3; Set C
cugcaguagcaugaugucguuggagaaguucuuaggau

SEQ ID NO: 14153 - RNA, 24 nt, Artificial Sequence
  Synthetic Oligonucleotide; GZMB exon 3; Set A
agcaugaugucguuggagaaguuc

SEQ ID NO: 14154 - RNA, 37 nt, Artificial Sequence
  Synthetic Oligonucleotide; GZMB exon 3; Set C
cugcaguagcaugaugucguuggagaaguucuuagga

SEQ ID NO: 14155 - RNA, 36 nt, Artificial Sequence
  Synthetic Oligonucleotide; GZMB exon 3; Set C
cugcaguagcaugaugucguuggagaaguucuuagg

SEQ ID NO: 14156 - RNA, 35 nt, Artificial Sequence
  Synthetic Oligonucleotide; GZMB exon 3; Set C
cugcaguagcaugaugucguuggagaaguucuuag

SEQ ID NO: 14157 - RNA, 40 nt, Artificial Sequence
  Synthetic Oligonucleotide; GZMB exon 3; Set C
ucaccugcaguagcaugaugucguuggagaaguucuuagg

SEQ ID NO: 14158 - RNA, 39 nt, Artificial Sequence
  Synthetic Oligonucleotide; GZMB exon 3; Set C
ucaccugcaguagcaugaugucguuggagaaguucuuag

SEQ ID NO: 14159 - RNA, 30 nt, Artificial Sequence
  Synthetic Oligonucleotide; GZMB exon 3; Set A
cugcaguagcaugaugucguuggagaaguu

SEQ ID NO: 14160 - RNA, 28 nt, Artificial Sequence
  Synthetic Oligonucleotide; GZMB exon 3; Set B
cugcaguagcaugaugucguuggagaag

SEQ ID NO: 14161 - RNA, 34 nt, Artificial Sequence
  Synthetic Oligonucleotide; GZMB exon 3; Set C
ucaccugcaguagcaugaugucguuggagaaguu

SEQ ID NO: 14162 - RNA, 33 nt, Artificial Sequence
  Synthetic Oligonucleotide; GZMB exon 3; Set C
ucaccugcaguagcaugaugucguuggagaagu

SEQ ID NO: 14163 - RNA, 32 nt, Artificial Sequence
  Synthetic Oligonucleotide; GZMB exon 3; Set C
ucaccugcaguagcaugaugucguuggagaag

SEQ ID NO: 14164 - RNA, 31 nt, Artificial Sequence
  Synthetic Oligonucleotide; GZMB exon 3; Set C
ucaccugcaguagcaugaugucguuggagaa

SEQ ID NO: 14165 - RNA, 25 nt, Artificial Sequence
  Synthetic Oligonucleotide; GZMB exon 3; Set B
ucaccugcaguagcaugaugucguu

SEQ ID NO: 14166 - RNA, 29 nt, Artificial Sequence
  Synthetic Oligonucleotide; GZMB exon 3; Set C
gugugccucaccugcaguagcaugauguc

SEQ ID NO: 14167 - RNA, 30 nt, Artificial Sequence
  Synthetic Oligonucleotide; GZMB exon 3; Set C
agugugccucaccugcaguagcaugauguc

SEQ ID NO: 14168 - RNA, 28 nt, Artificial Sequence
  Synthetic Oligonucleotide; GZMB exon 3; Set C
gugugccucaccugcaguagcaugaugu

SEQ ID NO: 14169 - RNA, 31 nt, Artificial Sequence
  Synthetic Oligonucleotide; GZMB exon 3; Set C
gagugugccucaccugcaguagcaugauguc

SEQ ID NO: 14170 - RNA, 29 nt, Artificial Sequence
  Synthetic Oligonucleotide; GZMB exon 3; Set C
agugugccucaccugcaguagcaugaugu

SEQ ID NO: 14171 - RNA, 32 nt, Artificial Sequence
  Synthetic Oligonucleotide; GZMB exon 3; Set C
ggagugugccucaccugcaguagcaugauguc

SEQ ID NO: 14172 - RNA, 30 nt, Artificial Sequence
  Synthetic Oligonucleotide; GZMB exon 3; Set C
gagugugccucaccugcaguagcaugaugu

SEQ ID NO: 14173 - RNA, 31 nt, Artificial Sequence
  Synthetic Oligonucleotide; GZMB exon 3; Set C
ggagugugccucaccugcaguagcaugaugu

SEQ ID NO: 14174 - RNA, 30 nt, Artificial Sequence
  Synthetic Oligonucleotide; GZMB exon 3; Set C
ggagugugccucaccugcaguagcaugaug

SEQ ID NO: 14175 - RNA, 39 nt, Artificial Sequence
  Synthetic Oligonucleotide; GZMB exon 3; Set C
aguggcaggagugugccucaccugcaguagcaugauguc

SEQ ID NO: 14176 - RNA, 40 nt, Artificial Sequence
  Synthetic Oligonucleotide; GZMB exon 3; Set C
gaguggcaggagugugccucaccugcaguagcaugauguc

SEQ ID NO: 14177 - RNA, 40 nt, Artificial Sequence
  Synthetic Oligonucleotide; GZMB exon 3; Set C
aagaguggcaggagugugccucaccugcaguagcaugaug

SEQ ID NO: 14178 - RNA, 37 nt, Artificial Sequence
  Synthetic Oligonucleotide; GZMB exon 3; Set C
agagcaagaguggcaggagugugccucaccugcagua

SEQ ID NO: 14179 - RNA, 36 nt, Artificial Sequence
  Synthetic Oligonucleotide; GZMB exon 3; Set C
agagcaagaguggcaggagugugccucaccugcagu

SEQ ID NO: 14180 - RNA, 38 nt, Artificial Sequence
  Synthetic Oligonucleotide; GZMB exon 3; Set C
aagagcaagaguggcaggagugugccucaccugcagua

SEQ ID NO: 14181 - RNA, 37 nt, Artificial Sequence
  Synthetic Oligonucleotide; GZMB exon 3; Set C
aagagcaagaguggcaggagugugccucaccugcagu

SEQ ID NO: 14182 - RNA, 39 nt, Artificial Sequence
  Synthetic Oligonucleotide; GZMB exon 3; Set C
gaagagcaagaguggcaggagugugccucaccugcagua

SEQ ID NO: 14183 - RNA, 38 nt, Artificial Sequence
  Synthetic Oligonucleotide; GZMB exon 3; Set C
gaagagcaagaguggcaggagugugccucaccugcagu

SEQ ID NO: 14184 - RNA, 40 nt, Artificial Sequence
  Synthetic Oligonucleotide; GZMB exon 3; Set C
agaagagcaagaguggcaggagugugccucaccugcagua

SEQ ID NO: 14185 - RNA, 39 nt, Artificial Sequence
  Synthetic Oligonucleotide; GZMB exon 3; Set C
agaagagcaagaguggcaggagugugccucaccugcagu

SEQ ID NO: 14186 - RNA, 40 nt, Artificial Sequence
  Synthetic Oligonucleotide; GZMB exon 3; Set C
aagaagagcaagaguggcaggagugugccucaccugcagu

SEQ ID NO: 14187 - RNA, 15 nt, Artificial Sequence
  Synthetic Oligonucleotide; GZMB exon 3; Set C
agcaagaguggcagg

SEQ ID NO: 14188 - RNA, 16 nt, Artificial Sequence
  Synthetic Oligonucleotide; GZMB exon 3; Set C
gagcaagaguggcagg

SEQ ID NO: 14189 - RNA, 28 nt, Artificial Sequence
  Synthetic Oligonucleotide; GZMB exon 3; Set B
accaagaagagcaagaguggcaggagug

SEQ ID NO: 14190 - RNA, 27 nt, Artificial Sequence
  Synthetic Oligonucleotide; GZMB exon 3; Set B
accaagaagagcaagaguggcaggagu

SEQ ID NO: 14191 - RNA, 29 nt, Artificial Sequence
  Synthetic Oligonucleotide; GZMB exon 3; Set B
gaccaagaagagcaagaguggcaggagug

SEQ ID NO: 14192 - RNA, 25 nt, Artificial Sequence
  Synthetic Oligonucleotide; GZMB exon 3; Set B
ccaagaagagcaagaguggcaggag

SEQ ID NO: 14193 - RNA, 24 nt, Artificial Sequence
  Synthetic Oligonucleotide; GZMB exon 3; Set B
ccaagaagagcaagaguggcagga

SEQ ID NO: 14194 - RNA, 28 nt, Artificial Sequence
  Synthetic Oligonucleotide; GZMB exon 3; Set B
gaccaagaagagcaagaguggcaggagu

SEQ ID NO: 14195 - RNA, 26 nt, Artificial Sequence
  Synthetic Oligonucleotide; GZMB exon 3; Set B
accaagaagagcaagaguggcaggag

SEQ ID NO: 14196 - RNA, 25 nt, Artificial Sequence
  Synthetic Oligonucleotide; GZMB exon 3; Set B
accaagaagagcaagaguggcagga

SEQ ID NO: 14197 - RNA, 27 nt, Artificial Sequence
  Synthetic Oligonucleotide; GZMB exon 3; Set B
gaccaagaagagcaagaguggcaggag

SEQ ID NO: 14198 - RNA, 26 nt, Artificial Sequence
  Synthetic Oligonucleotide; GZMB exon 3; Set B
gaccaagaagagcaagaguggcagga

SEQ ID NO: 14199 - RNA, 39 nt, Artificial Sequence
  Synthetic Oligonucleotide; GZMB exon 3; Set C
gaaccaacuggaccaagaagagcaagaguggcaggagug

SEQ ID NO: 14200 - RNA, 19 nt, Artificial Sequence
  Synthetic Oligonucleotide; GZMB exon 3; Set C
gaccaagaagagcaagagu

SEQ ID NO: 14201 - RNA, 38 nt, Artificial Sequence
  Synthetic Oligonucleotide; GZMB exon 3; Set C
gaaccaacuggaccaagaagagcaagaguggcaggagu

SEQ ID NO: 14202 - RNA, 16 nt, Artificial Sequence
  Synthetic Oligonucleotide; GZMB exon 3; Set C
accaagaagagcaaga

SEQ ID NO: 14203 - RNA, 18 nt, Artificial Sequence
  Synthetic Oligonucleotide; GZMB exon 3; Set C
gaccaagaagagcaagag

SEQ ID NO: 14204 - RNA, 37 nt, Artificial Sequence
  Synthetic Oligonucleotide; GZMB exon 3; Set C
gaaccaacuggaccaagaagagcaagaguggcaggag

SEQ ID NO: 14205 - RNA, 17 nt, Artificial Sequence
  Synthetic Oligonucleotide; GZMB exon 3; Set C
gaccaagaagagcaaga

SEQ ID NO: 14206 - RNA, 36 nt, Artificial Sequence
  Synthetic Oligonucleotide; GZMB exon 3; Set C
gaaccaacuggaccaagaagagcaagaguggcagga

SEQ ID NO: 14207 - RNA, 16 nt, Artificial Sequence
  Synthetic Oligonucleotide; GZMB exon 3; Set C
gaccaagaagagcaag

SEQ ID NO: 14208 - RNA, 15 nt, Artificial Sequence
  Synthetic Oligonucleotide; GZMB exon 3; Set C
gaccaagaagagcaa

SEQ ID NO: 14209 - RNA, 29 nt, Artificial Sequence
  Synthetic Oligonucleotide; GZMB exon 3; Set B
gaaccaacuggaccaagaagagcaagagu

SEQ ID NO: 14210 - RNA, 28 nt, Artificial Sequence
  Synthetic Oligonucleotide; GZMB exon 3; Set B
gaaccaacuggaccaagaagagcaagag

SEQ ID NO: 14211 - RNA, 27 nt, Artificial Sequence
  Synthetic Oligonucleotide; GZMB exon 3; Set B
gaaccaacuggaccaagaagagcaaga

SEQ ID NO: 14212 - RNA, 26 nt, Artificial Sequence
  Synthetic Oligonucleotide; GZMB exon 3; Set B
gaaccaacuggaccaagaagagcaag

SEQ ID NO: 14213 - RNA, 25 nt, Artificial Sequence
  Synthetic Oligonucleotide; GZMB exon 3; Set B
gaaccaacuggaccaagaagagcaa

SEQ ID NO: 14214 - RNA, 24 nt, Artificial Sequence
  Synthetic Oligonucleotide; GZMB exon 3; Set B
gaaccaacuggaccaagaagagca

SEQ ID NO: 14215 - RNA, 23 nt, Artificial Sequence
  Synthetic Oligonucleotide; GZMB exon 3; Set B
gaaccaacuggaccaagaagagc

SEQ ID NO: 14216 - RNA, 22 nt, Artificial Sequence
  Synthetic Oligonucleotide; GZMB exon 3; Set C
gaaccaacuggaccaagaagag

SEQ ID NO: 14217 - RNA, 15 nt, Artificial Sequence
  Synthetic Oligonucleotide; GZMB exon 4; Set C
uggggaagaggcaag

SEQ ID NO: 14218 - RNA, 16 nt, Artificial Sequence
  Synthetic Oligonucleotide; GZMB exon 4; Set C
guggggaagaggcaag

SEQ ID NO: 14219 - RNA, 17 nt, Artificial Sequence
  Synthetic Oligonucleotide; GZMB exon 4; Set C
gguggggaagaggcaag

SEQ ID NO: 14220 - RNA, 18 nt, Artificial Sequence
  Synthetic Oligonucleotide; GZMB exon 4; Set C
ugguggggaagaggcaag

SEQ ID NO: 14221 - RNA, 19 nt, Artificial Sequence
  Synthetic Oligonucleotide; GZMB exon 4; Set C
cugguggggaagaggcaag

SEQ ID NO: 14222 - RNA, 20 nt, Artificial Sequence
  Synthetic Oligonucleotide; GZMB exon 4; Set A
gcugguggggaagaggcaag

SEQ ID NO: 14223 - RNA, 21 nt, Artificial Sequence
  Synthetic Oligonucleotide; GZMB exon 4; Set A
agcugguggggaagaggcaag

SEQ ID NO: 14224 - RNA, 30 nt, Artificial Sequence
  Synthetic Oligonucleotide; GZMB exon 4; Set C
uuucucuccagcugguggggaagaggcaag

SEQ ID NO: 14225 - RNA, 22 nt, Artificial Sequence
  Synthetic Oligonucleotide; GZMB exon 4; Set A
uuucucuccagcugguggggaa

SEQ ID NO: 14226 - RNA, 21 nt, Artificial Sequence
  Synthetic Oligonucleotide; GZMB exon 4; Set A
uuucucuccagcuggugggga

SEQ ID NO: 14227 - RNA, 20 nt, Artificial Sequence
  Synthetic Oligonucleotide; GZMB exon 4; Set A
uuucucuccagcuggugggg

SEQ ID NO: 14228 - RNA, 19 nt, Artificial Sequence
  Synthetic Oligonucleotide; GZMB exon 4; Set A
uuucucuccagcugguggg

SEQ ID NO: 14229 - RNA, 26 nt, Artificial Sequence
  Synthetic Oligonucleotide; GZMB exon 4; Set C
gcacagcucugguccgcuuggccuuu

SEQ ID NO: 14230 - RNA, 27 nt, Artificial Sequence
  Synthetic Oligonucleotide; GZMB exon 4; Set C
ugcacagcucugguccgcuuggccuuu

SEQ ID NO: 14231 - RNA, 33 nt, Artificial Sequence
  Synthetic Oligonucleotide; GZMB exon 4; Set C
aggggcugcacagcucugguccgcuuggccuuu

SEQ ID NO: 14232 - RNA, 34 nt, Artificial Sequence
  Synthetic Oligonucleotide; GZMB exon 4; Set C
gaggggcugcacagcucugguccgcuuggccuuu

SEQ ID NO: 14233 - RNA, 35 nt, Artificial Sequence
  Synthetic Oligonucleotide; GZMB exon 4; Set C
ugaggggcugcacagcucugguccgcuuggccuuu

SEQ ID NO: 14234 - RNA, 28 nt, Artificial Sequence
  Synthetic Oligonucleotide; GZMB exon 4; Set C
ugaggggcugcacagcucugguccgcuu

SEQ ID NO: 14235 - RNA, 27 nt, Artificial Sequence
  Synthetic Oligonucleotide; GZMB exon 4; Set C
ugaggggcugcacagcucugguccgcu

SEQ ID NO: 14236 - RNA, 29 nt, Artificial Sequence
  Synthetic Oligonucleotide; GZMB exon 4; Set C
guggggaagaggcaagaaaguccagguca

SEQ ID NO: 14237 - RNA, 31 nt, Artificial Sequence
  Synthetic Oligonucleotide; GZMB exon 4; Set C
ugguggggaagaggcaagaaaguccagguca

SEQ ID NO: 14238 - RNA, 33 nt, Artificial Sequence
  Synthetic Oligonucleotide; GZMB exon 4; Set C
gcugguggggaagaggcaagaaaguccagguca

SEQ ID NO: 14239 - RNA, 34 nt, Artificial Sequence
  Synthetic Oligonucleotide; GZMB exon 4; Set C
agcugguggggaagaggcaagaaaguccagguca

SEQ ID NO: 14240 - RNA, 15 nt, Artificial Sequence
  Synthetic Oligonucleotide; GZMB exon 4; Set C
guggggaagaggcaa

SEQ ID NO: 14241 - RNA, 16 nt, Artificial Sequence
  Synthetic Oligonucleotide; GZMB exon 4; Set C
gguggggaagaggcaa

SEQ ID NO: 14242 - RNA, 17 nt, Artificial Sequence
  Synthetic Oligonucleotide; GZMB exon 4; Set C
ugguggggaagaggcaa

SEQ ID NO: 14243 - RNA, 18 nt, Artificial Sequence
  Synthetic Oligonucleotide; GZMB exon 4; Set C
cugguggggaagaggcaa

SEQ ID NO: 14244 - RNA, 19 nt, Artificial Sequence
  Synthetic Oligonucleotide; GZMB exon 4; Set A
gcugguggggaagaggcaa

SEQ ID NO: 14245 - RNA, 20 nt, Artificial Sequence
  Synthetic Oligonucleotide; GZMB exon 4; Set A
agcugguggggaagaggcaa

SEQ ID NO: 14246 - RNA, 15 nt, Artificial Sequence
  Synthetic Oligonucleotide; GZMB exon 4; Set C
gcugguggggaagag

SEQ ID NO: 14247 - RNA, 26 nt, Artificial Sequence
  Synthetic Oligonucleotide; GZMB exon 4; Set C
ucuccagcugguggggaagaggcaag

SEQ ID NO: 14248 - RNA, 16 nt, Artificial Sequence
  Synthetic Oligonucleotide; GZMB exon 4; Set C
agcugguggggaagag

SEQ ID NO: 14249 - RNA, 25 nt, Artificial Sequence
  Synthetic Oligonucleotide; GZMB exon 4; Set C
ucuccagcugguggggaagaggcaa

SEQ ID NO: 14250 - RNA, 15 nt, Artificial Sequence
  Synthetic Oligonucleotide; GZMB exon 4; Set C
agcugguggggaaga

SEQ ID NO: 14251 - RNA, 29 nt, Artificial Sequence
  Synthetic Oligonucleotide; GZMB exon 4; Set C
uuucucuccagcugguggggaagaggcaa

SEQ ID NO: 14252 - RNA, 20 nt, Artificial Sequence
  Synthetic Oligonucleotide; GZMB exon 4; Set A
ucuccagcugguggggaaga

SEQ ID NO: 14253 - RNA, 19 nt, Artificial Sequence
  Synthetic Oligonucleotide; GZMB exon 4; Set A
ucuccagcugguggggaag

SEQ ID NO: 14254 - RNA, 18 nt, Artificial Sequence
  Synthetic Oligonucleotide; GZMB exon 4; Set A
ucuccagcugguggggaa

SEQ ID NO: 14255 - RNA, 17 nt, Artificial Sequence
  Synthetic Oligonucleotide; GZMB exon 4; Set A
ucuccagcuggugggga

SEQ ID NO: 14256 - RNA, 25 nt, Artificial Sequence
  Synthetic Oligonucleotide; GZMB exon 4; Set A
uuucucuccagcugguggggaagag

SEQ ID NO: 14257 - RNA, 16 nt, Artificial Sequence
  Synthetic Oligonucleotide; GZMB exon 4; Set A
ucuccagcuggugggg

SEQ ID NO: 14258 - RNA, 24 nt, Artificial Sequence
  Synthetic Oligonucleotide; GZMB exon 4; Set A
uuucucuccagcugguggggaaga

SEQ ID NO: 14259 - RNA, 37 nt, Artificial Sequence
  Synthetic Oligonucleotide; GZMB exon 4; Set C
cuuggccuuucucuccagcugguggggaagaggcaag

SEQ ID NO: 14260 - RNA, 15 nt, Artificial Sequence
  Synthetic Oligonucleotide; GZMB exon 4; Set C
ucuccagcugguggg

SEQ ID NO: 14261 - RNA, 23 nt, Artificial Sequence
  Synthetic Oligonucleotide; GZMB exon 4; Set A
uuucucuccagcugguggggaag

SEQ ID NO: 14262 - RNA, 38 nt, Artificial Sequence
  Synthetic Oligonucleotide; GZMB exon 4; Set C
gcuuggccuuucucuccagcugguggggaagaggcaag

SEQ ID NO: 14263 - RNA, 36 nt, Artificial Sequence
  Synthetic Oligonucleotide; GZMB exon 4; Set C
cuuggccuuucucuccagcugguggggaagaggcaa

SEQ ID NO: 14264 - RNA, 39 nt, Artificial Sequence
  Synthetic Oligonucleotide; GZMB exon 4; Set C
cgcuuggccuuucucuccagcugguggggaagaggcaag

SEQ ID NO: 14265 - RNA, 37 nt, Artificial Sequence
  Synthetic Oligonucleotide; GZMB exon 4; Set C
gcuuggccuuucucuccagcugguggggaagaggcaa

SEQ ID NO: 14266 - RNA, 40 nt, Artificial Sequence
  Synthetic Oligonucleotide; GZMB exon 4; Set C
ccgcuuggccuuucucuccagcugguggggaagaggcaag

SEQ ID NO: 14267 - RNA, 38 nt, Artificial Sequence
  Synthetic Oligonucleotide; GZMB exon 4; Set C
cgcuuggccuuucucuccagcugguggggaagaggcaa

SEQ ID NO: 14268 - RNA, 18 nt, Artificial Sequence
  Synthetic Oligonucleotide; GZMB exon 4; Set C
uuucucuccagcuggugg

SEQ ID NO: 14269 - RNA, 40 nt, Artificial Sequence
  Synthetic Oligonucleotide; GZMB exon 4; Set C
uccgcuuggccuuucucuccagcugguggggaagaggcaa

SEQ ID NO: 14270 - RNA, 32 nt, Artificial Sequence
  Synthetic Oligonucleotide; GZMB exon 4; Set C
cuuggccuuucucuccagcugguggggaagag

SEQ ID NO: 14271 - RNA, 17 nt, Artificial Sequence
  Synthetic Oligonucleotide; GZMB exon 4; Set C
uuucucuccagcuggug

SEQ ID NO: 14272 - RNA, 31 nt, Artificial Sequence
  Synthetic Oligonucleotide; GZMB exon 4; Set C
cuuggccuuucucuccagcugguggggaaga

SEQ ID NO: 14273 - RNA, 33 nt, Artificial Sequence
  Synthetic Oligonucleotide; GZMB exon 4; Set C
gcuuggccuuucucuccagcugguggggaagag

SEQ ID NO: 14274 - RNA, 16 nt, Artificial Sequence
  Synthetic Oligonucleotide; GZMB exon 4; Set C
uuucucuccagcuggu

SEQ ID NO: 14275 - RNA, 30 nt, Artificial Sequence
  Synthetic Oligonucleotide; GZMB exon 4; Set C
cuuggccuuucucuccagcugguggggaag

SEQ ID NO: 14276 - RNA, 32 nt, Artificial Sequence
  Synthetic Oligonucleotide; GZMB exon 4; Set C
gcuuggccuuucucuccagcugguggggaaga

SEQ ID NO: 14277 - RNA, 29 nt, Artificial Sequence
  Synthetic Oligonucleotide; GZMB exon 4; Set C
cuuggccuuucucuccagcugguggggaa

SEQ ID NO: 14278 - RNA, 15 nt, Artificial Sequence
  Synthetic Oligonucleotide; GZMB exon 4; Set C
uuucucuccagcugg

SEQ ID NO: 14279 - RNA, 31 nt, Artificial Sequence
  Synthetic Oligonucleotide; GZMB exon 4; Set C
gcuuggccuuucucuccagcugguggggaag

SEQ ID NO: 14280 - RNA, 33 nt, Artificial Sequence
  Synthetic Oligonucleotide; GZMB exon 4; Set C
cgcuuggccuuucucuccagcugguggggaaga

SEQ ID NO: 14281 - RNA, 28 nt, Artificial Sequence
  Synthetic Oligonucleotide; GZMB exon 4; Set C
cuuggccuuucucuccagcuggugggga

SEQ ID NO: 14282 - RNA, 30 nt, Artificial Sequence
  Synthetic Oligonucleotide; GZMB exon 4; Set C
gcuuggccuuucucuccagcugguggggaa

SEQ ID NO: 14283 - RNA, 32 nt, Artificial Sequence
  Synthetic Oligonucleotide; GZMB exon 4; Set C
cgcuuggccuuucucuccagcugguggggaag

SEQ ID NO: 14284 - RNA, 27 nt, Artificial Sequence
  Synthetic Oligonucleotide; GZMB exon 4; Set C
cuuggccuuucucuccagcuggugggg

SEQ ID NO: 14285 - RNA, 29 nt, Artificial Sequence
  Synthetic Oligonucleotide; GZMB exon 4; Set C
gcuuggccuuucucuccagcuggugggga

SEQ ID NO: 14286 - RNA, 31 nt, Artificial Sequence
  Synthetic Oligonucleotide; GZMB exon 4; Set C
cgcuuggccuuucucuccagcugguggggaa

SEQ ID NO: 14287 - RNA, 33 nt, Artificial Sequence
  Synthetic Oligonucleotide; GZMB exon 4; Set C
ccgcuuggccuuucucuccagcugguggggaag

SEQ ID NO: 14288 - RNA, 35 nt, Artificial Sequence
  Synthetic Oligonucleotide; GZMB exon 4; Set C
uccgcuuggccuuucucuccagcugguggggaaga

SEQ ID NO: 14289 - RNA, 26 nt, Artificial Sequence
  Synthetic Oligonucleotide; GZMB exon 4; Set C
cuuggccuuucucuccagcugguggg

SEQ ID NO: 14290 - RNA, 28 nt, Artificial Sequence
  Synthetic Oligonucleotide; GZMB exon 4; Set C
gcuuggccuuucucuccagcuggugggg

SEQ ID NO: 14291 - RNA, 30 nt, Artificial Sequence
  Synthetic Oligonucleotide; GZMB exon 4; Set C
cgcuuggccuuucucuccagcuggugggga

SEQ ID NO: 14292 - RNA, 32 nt, Artificial Sequence
  Synthetic Oligonucleotide; GZMB exon 4; Set C
ccgcuuggccuuucucuccagcugguggggaa

SEQ ID NO: 14293 - RNA, 34 nt, Artificial Sequence
  Synthetic Oligonucleotide; GZMB exon 4; Set C
uccgcuuggccuuucucuccagcugguggggaag

SEQ ID NO: 14294 - RNA, 27 nt, Artificial Sequence
  Synthetic Oligonucleotide; GZMB exon 4; Set C
gcuuggccuuucucuccagcugguggg

SEQ ID NO: 14295 - RNA, 29 nt, Artificial Sequence
  Synthetic Oligonucleotide; GZMB exon 4; Set C
cgcuuggccuuucucuccagcuggugggg

SEQ ID NO: 14296 - RNA, 25 nt, Artificial Sequence
  Synthetic Oligonucleotide; GZMB exon 4; Set C
cuuggccuuucucuccagcuggugg

SEQ ID NO: 14297 - RNA, 31 nt, Artificial Sequence
  Synthetic Oligonucleotide; GZMB exon 4; Set C
ccgcuuggccuuucucuccagcuggugggga

SEQ ID NO: 14298 - RNA, 33 nt, Artificial Sequence
  Synthetic Oligonucleotide; GZMB exon 4; Set C
uccgcuuggccuuucucuccagcugguggggaa

SEQ ID NO: 14299 - RNA, 37 nt, Artificial Sequence
  Synthetic Oligonucleotide; GZMB exon 4; Set C
gguccgcuuggccuuucucuccagcugguggggaaga

SEQ ID NO: 14300 - RNA, 24 nt, Artificial Sequence
  Synthetic Oligonucleotide; GZMB exon 4; Set A
cuuggccuuucucuccagcuggug

SEQ ID NO: 14301 - RNA, 28 nt, Artificial Sequence
  Synthetic Oligonucleotide; GZMB exon 4; Set C
cgcuuggccuuucucuccagcugguggg

SEQ ID NO: 14302 - RNA, 30 nt, Artificial Sequence
  Synthetic Oligonucleotide; GZMB exon 4; Set C
ccgcuuggccuuucucuccagcuggugggg

SEQ ID NO: 14303 - RNA, 26 nt, Artificial Sequence
  Synthetic Oligonucleotide; GZMB exon 4; Set C
gcuuggccuuucucuccagcuggugg

SEQ ID NO: 14304 - RNA, 32 nt, Artificial Sequence
  Synthetic Oligonucleotide; GZMB exon 4; Set C
uccgcuuggccuuucucuccagcuggugggga

SEQ ID NO: 14305 - RNA, 34 nt, Artificial Sequence
  Synthetic Oligonucleotide; GZMB exon 4; Set C
guccgcuuggccuuucucuccagcugguggggaa

SEQ ID NO: 14306 - RNA, 36 nt, Artificial Sequence
  Synthetic Oligonucleotide; GZMB exon 4; Set C
gguccgcuuggccuuucucuccagcugguggggaag

SEQ ID NO: 14307 - RNA, 38 nt, Artificial Sequence
  Synthetic Oligonucleotide; GZMB exon 4; Set C
ugguccgcuuggccuuucucuccagcugguggggaaga

SEQ ID NO: 14308 - RNA, 25 nt, Artificial Sequence
  Synthetic Oligonucleotide; GZMB exon 4; Set C
gcuuggccuuucucuccagcuggug

SEQ ID NO: 14309 - RNA, 29 nt, Artificial Sequence
  Synthetic Oligonucleotide; GZMB exon 4; Set C
ccgcuuggccuuucucuccagcugguggg

SEQ ID NO: 14310 - RNA, 31 nt, Artificial Sequence
  Synthetic Oligonucleotide; GZMB exon 4; Set C
uccgcuuggccuuucucuccagcuggugggg

SEQ ID NO: 14311 - RNA, 27 nt, Artificial Sequence
  Synthetic Oligonucleotide; GZMB exon 4; Set C
cgcuuggccuuucucuccagcuggugg

SEQ ID NO: 14312 - RNA, 33 nt, Artificial Sequence
  Synthetic Oligonucleotide; GZMB exon 4; Set C
guccgcuuggccuuucucuccagcuggugggga

SEQ ID NO: 14313 - RNA, 23 nt, Artificial Sequence
  Synthetic Oligonucleotide; GZMB exon 4; Set C
cuuggccuuucucuccagcuggu

SEQ ID NO: 14314 - RNA, 35 nt, Artificial Sequence
  Synthetic Oligonucleotide; GZMB exon 4; Set C
gguccgcuuggccuuucucuccagcugguggggaa

SEQ ID NO: 14315 - RNA, 37 nt, Artificial Sequence
  Synthetic Oligonucleotide; GZMB exon 4; Set C
ugguccgcuuggccuuucucuccagcugguggggaag

SEQ ID NO: 14316 - RNA, 39 nt, Artificial Sequence
  Synthetic Oligonucleotide; GZMB exon 4; Set C
cugguccgcuuggccuuucucuccagcugguggggaaga

SEQ ID NO: 14317 - RNA, 26 nt, Artificial Sequence
  Synthetic Oligonucleotide; GZMB exon 4; Set C
cgcuuggccuuucucuccagcuggug

SEQ ID NO: 14318 - RNA, 30 nt, Artificial Sequence
  Synthetic Oligonucleotide; GZMB exon 4; Set C
uccgcuuggccuuucucuccagcugguggg

SEQ ID NO: 14319 - RNA, 32 nt, Artificial Sequence
  Synthetic Oligonucleotide; GZMB exon 4; Set C
guccgcuuggccuuucucuccagcuggugggg

SEQ ID NO: 14320 - RNA, 28 nt, Artificial Sequence
  Synthetic Oligonucleotide; GZMB exon 4; Set C
ccgcuuggccuuucucuccagcuggugg

SEQ ID NO: 14321 - RNA, 34 nt, Artificial Sequence
  Synthetic Oligonucleotide; GZMB exon 4; Set C
gguccgcuuggccuuucucuccagcuggugggga

SEQ ID NO: 14322 - RNA, 24 nt, Artificial Sequence
  Synthetic Oligonucleotide; GZMB exon 4; Set C
gcuuggccuuucucuccagcuggu

SEQ ID NO: 14323 - RNA, 36 nt, Artificial Sequence
  Synthetic Oligonucleotide; GZMB exon 4; Set C
ugguccgcuuggccuuucucuccagcugguggggaa

SEQ ID NO: 14324 - RNA, 22 nt, Artificial Sequence
  Synthetic Oligonucleotide; GZMB exon 4; Set A
cuuggccuuucucuccagcugg

SEQ ID NO: 14325 - RNA, 38 nt, Artificial Sequence
  Synthetic Oligonucleotide; GZMB exon 4; Set C
cugguccgcuuggccuuucucuccagcugguggggaag

SEQ ID NO: 14326 - RNA, 40 nt, Artificial Sequence
  Synthetic Oligonucleotide; GZMB exon 4; Set C
ucugguccgcuuggccuuucucuccagcugguggggaaga

SEQ ID NO: 14327 - RNA, 27 nt, Artificial Sequence
  Synthetic Oligonucleotide; GZMB exon 4; Set C
ccgcuuggccuuucucuccagcuggug

SEQ ID NO: 14328 - RNA, 31 nt, Artificial Sequence
  Synthetic Oligonucleotide; GZMB exon 4; Set C
guccgcuuggccuuucucuccagcugguggg

SEQ ID NO: 14329 - RNA, 33 nt, Artificial Sequence
  Synthetic Oligonucleotide; GZMB exon 4; Set C
gguccgcuuggccuuucucuccagcuggugggg

SEQ ID NO: 14330 - RNA, 29 nt, Artificial Sequence
  Synthetic Oligonucleotide; GZMB exon 4; Set C
uccgcuuggccuuucucuccagcuggugg

SEQ ID NO: 14331 - RNA, 35 nt, Artificial Sequence
  Synthetic Oligonucleotide; GZMB exon 4; Set C
ugguccgcuuggccuuucucuccagcuggugggga

SEQ ID NO: 14332 - RNA, 25 nt, Artificial Sequence
  Synthetic Oligonucleotide; GZMB exon 4; Set C
cgcuuggccuuucucuccagcuggu

SEQ ID NO: 14333 - RNA, 37 nt, Artificial Sequence
  Synthetic Oligonucleotide; GZMB exon 4; Set C
cugguccgcuuggccuuucucuccagcugguggggaa

SEQ ID NO: 14334 - RNA, 23 nt, Artificial Sequence
  Synthetic Oligonucleotide; GZMB exon 4; Set C
gcuuggccuuucucuccagcugg

SEQ ID NO: 14335 - RNA, 21 nt, Artificial Sequence
  Synthetic Oligonucleotide; GZMB exon 4; Set A
cuuggccuuucucuccagcug

SEQ ID NO: 14336 - RNA, 39 nt, Artificial Sequence
  Synthetic Oligonucleotide; GZMB exon 4; Set C
ucugguccgcuuggccuuucucuccagcugguggggaag

SEQ ID NO: 14337 - RNA, 28 nt, Artificial Sequence
  Synthetic Oligonucleotide; GZMB exon 4; Set C
uccgcuuggccuuucucuccagcuggug

SEQ ID NO: 14338 - RNA, 32 nt, Artificial Sequence
  Synthetic Oligonucleotide; GZMB exon 4; Set C
gguccgcuuggccuuucucuccagcugguggg

SEQ ID NO: 14339 - RNA, 34 nt, Artificial Sequence
  Synthetic Oligonucleotide; GZMB exon 4; Set C
ugguccgcuuggccuuucucuccagcuggugggg

SEQ ID NO: 14340 - RNA, 30 nt, Artificial Sequence
  Synthetic Oligonucleotide; GZMB exon 4; Set C
guccgcuuggccuuucucuccagcuggugg

SEQ ID NO: 14341 - RNA, 36 nt, Artificial Sequence
  Synthetic Oligonucleotide; GZMB exon 4; Set C
cugguccgcuuggccuuucucuccagcuggugggga

SEQ ID NO: 14342 - RNA, 38 nt, Artificial Sequence
  Synthetic Oligonucleotide; GZMB exon 4; Set C
ucugguccgcuuggccuuucucuccagcugguggggaa

SEQ ID NO: 14343 - RNA, 26 nt, Artificial Sequence
  Synthetic Oligonucleotide; GZMB exon 4; Set C
ccgcuuggccuuucucuccagcuggu

SEQ ID NO: 14344 - RNA, 24 nt, Artificial Sequence
  Synthetic Oligonucleotide; GZMB exon 4; Set C
cgcuuggccuuucucuccagcugg

SEQ ID NO: 14345 - RNA, 20 nt, Artificial Sequence
  Synthetic Oligonucleotide; GZMB exon 4; Set A
cuuggccuuucucuccagcu

SEQ ID NO: 14346 - RNA, 22 nt, Artificial Sequence
  Synthetic Oligonucleotide; GZMB exon 4; Set A
gcuuggccuuucucuccagcug

SEQ ID NO: 14347 - RNA, 29 nt, Artificial Sequence
  Synthetic Oligonucleotide; GZMB exon 4; Set C
guccgcuuggccuuucucuccagcuggug

SEQ ID NO: 14348 - RNA, 33 nt, Artificial Sequence
  Synthetic Oligonucleotide; GZMB exon 4; Set C
ugguccgcuuggccuuucucuccagcugguggg

SEQ ID NO: 14349 - RNA, 35 nt, Artificial Sequence
  Synthetic Oligonucleotide; GZMB exon 4; Set C
cugguccgcuuggccuuucucuccagcuggugggg

SEQ ID NO: 14350 - RNA, 31 nt, Artificial Sequence
  Synthetic Oligonucleotide; GZMB exon 4; Set C
gguccgcuuggccuuucucuccagcuggugg

SEQ ID NO: 14351 - RNA, 37 nt, Artificial Sequence
  Synthetic Oligonucleotide; GZMB exon 4; Set C
ucugguccgcuuggccuuucucuccagcuggugggga

SEQ ID NO: 14352 - RNA, 27 nt, Artificial Sequence
  Synthetic Oligonucleotide; GZMB exon 4; Set C
uccgcuuggccuuucucuccagcuggu

SEQ ID NO: 14353 - RNA, 25 nt, Artificial Sequence
  Synthetic Oligonucleotide; GZMB exon 4; Set C
ccgcuuggccuuucucuccagcugg

SEQ ID NO: 14354 - RNA, 21 nt, Artificial Sequence
  Synthetic Oligonucleotide; GZMB exon 4; Set A
gcuuggccuuucucuccagcu

SEQ ID NO: 14355 - RNA, 23 nt, Artificial Sequence
  Synthetic Oligonucleotide; GZMB exon 4; Set C
cgcuuggccuuucucuccagcug

SEQ ID NO: 14356 - RNA, 19 nt, Artificial Sequence
  Synthetic Oligonucleotide; GZMB exon 4; Set A
cuuggccuuucucuccagc

SEQ ID NO: 14357 - RNA, 30 nt, Artificial Sequence
  Synthetic Oligonucleotide; GZMB exon 4; Set C
gguccgcuuggccuuucucuccagcuggug

SEQ ID NO: 14358 - RNA, 34 nt, Artificial Sequence
  Synthetic Oligonucleotide; GZMB exon 4; Set C
cugguccgcuuggccuuucucuccagcugguggg

SEQ ID NO: 14359 - RNA, 36 nt, Artificial Sequence
  Synthetic Oligonucleotide; GZMB exon 4; Set C
ucugguccgcuuggccuuucucuccagcuggugggg

SEQ ID NO: 14360 - RNA, 32 nt, Artificial Sequence
  Synthetic Oligonucleotide; GZMB exon 4; Set C
ugguccgcuuggccuuucucuccagcuggugg

SEQ ID NO: 14361 - RNA, 26 nt, Artificial Sequence
  Synthetic Oligonucleotide; GZMB exon 4; Set C
uccgcuuggccuuucucuccagcugg

SEQ ID NO: 14362 - RNA, 22 nt, Artificial Sequence
  Synthetic Oligonucleotide; GZMB exon 4; Set C
cgcuuggccuuucucuccagcu

SEQ ID NO: 14363 - RNA, 20 nt, Artificial Sequence
  Synthetic Oligonucleotide; GZMB exon 4; Set A
gcuuggccuuucucuccagc

SEQ ID NO: 14364 - RNA, 31 nt, Artificial Sequence
  Synthetic Oligonucleotide; GZMB exon 4; Set C
ugguccgcuuggccuuucucuccagcuggug

SEQ ID NO: 14365 - RNA, 35 nt, Artificial Sequence
  Synthetic Oligonucleotide; GZMB exon 4; Set C
ucugguccgcuuggccuuucucuccagcugguggg

SEQ ID NO: 14366 - RNA, 33 nt, Artificial Sequence
  Synthetic Oligonucleotide; GZMB exon 4; Set C
cugguccgcuuggccuuucucuccagcuggugg

SEQ ID NO: 14367 - RNA, 29 nt, Artificial Sequence
  Synthetic Oligonucleotide; GZMB exon 4; Set C
gguccgcuuggccuuucucuccagcuggu

SEQ ID NO: 14368 - RNA, 21 nt, Artificial Sequence
  Synthetic Oligonucleotide; GZMB exon 4; Set A
cgcuuggccuuucucuccagc

SEQ ID NO: 14369 - RNA, 32 nt, Artificial Sequence
  Synthetic Oligonucleotide; GZMB exon 4; Set C
cugguccgcuuggccuuucucuccagcuggug

SEQ ID NO: 14370 - RNA, 34 nt, Artificial Sequence
  Synthetic Oligonucleotide; GZMB exon 4; Set C
ucugguccgcuuggccuuucucuccagcuggugg

SEQ ID NO: 14371 - RNA, 30 nt, Artificial Sequence
  Synthetic Oligonucleotide; GZMB exon 4; Set C
ugguccgcuuggccuuucucuccagcuggu

SEQ ID NO: 14372 - RNA, 28 nt, Artificial Sequence
  Synthetic Oligonucleotide; GZMB exon 4; Set C
gguccgcuuggccuuucucuccagcugg

SEQ ID NO: 14373 - RNA, 33 nt, Artificial Sequence
  Synthetic Oligonucleotide; GZMB exon 4; Set C
ucugguccgcuuggccuuucucuccagcuggug

SEQ ID NO: 14374 - RNA, 31 nt, Artificial Sequence
  Synthetic Oligonucleotide; GZMB exon 4; Set C
cugguccgcuuggccuuucucuccagcuggu

SEQ ID NO: 14375 - RNA, 29 nt, Artificial Sequence
  Synthetic Oligonucleotide; GZMB exon 4; Set C
ugguccgcuuggccuuucucuccagcugg

SEQ ID NO: 14376 - RNA, 27 nt, Artificial Sequence
  Synthetic Oligonucleotide; GZMB exon 4; Set C
gguccgcuuggccuuucucuccagcug

SEQ ID NO: 14377 - RNA, 32 nt, Artificial Sequence
  Synthetic Oligonucleotide; GZMB exon 4; Set C
ucugguccgcuuggccuuucucuccagcuggu

SEQ ID NO: 14378 - RNA, 30 nt, Artificial Sequence
  Synthetic Oligonucleotide; GZMB exon 4; Set C
cugguccgcuuggccuuucucuccagcugg

SEQ ID NO: 14379 - RNA, 26 nt, Artificial Sequence
  Synthetic Oligonucleotide; GZMB exon 4; Set C
gguccgcuuggccuuucucuccagcu

SEQ ID NO: 14380 - RNA, 28 nt, Artificial Sequence
  Synthetic Oligonucleotide; GZMB exon 4; Set C
ugguccgcuuggccuuucucuccagcug

SEQ ID NO: 14381 - RNA, 31 nt, Artificial Sequence
  Synthetic Oligonucleotide; GZMB exon 4; Set C
ucugguccgcuuggccuuucucuccagcugg

SEQ ID NO: 14382 - RNA, 27 nt, Artificial Sequence
  Synthetic Oligonucleotide; GZMB exon 4; Set C
ugguccgcuuggccuuucucuccagcu

SEQ ID NO: 14383 - RNA, 29 nt, Artificial Sequence
  Synthetic Oligonucleotide; GZMB exon 4; Set C
cugguccgcuuggccuuucucuccagcug

SEQ ID NO: 14384 - RNA, 15 nt, Artificial Sequence
  Synthetic Oligonucleotide; GZMB exon 4; Set C
gcuuggccuuucucu

SEQ ID NO: 14385 - RNA, 25 nt, Artificial Sequence
  Synthetic Oligonucleotide; GZMB exon 4; Set C
gguccgcuuggccuuucucuccagc

SEQ ID NO: 14386 - RNA, 28 nt, Artificial Sequence
  Synthetic Oligonucleotide; GZMB exon 4; Set C
cugguccgcuuggccuuucucuccagcu

SEQ ID NO: 14387 - RNA, 30 nt, Artificial Sequence
  Synthetic Oligonucleotide; GZMB exon 4; Set C
ucugguccgcuuggccuuucucuccagcug

SEQ ID NO: 14388 - RNA, 16 nt, Artificial Sequence
  Synthetic Oligonucleotide; GZMB exon 4; Set C
cgcuuggccuuucucu

SEQ ID NO: 14389 - RNA, 26 nt, Artificial Sequence
  Synthetic Oligonucleotide; GZMB exon 4; Set C
ugguccgcuuggccuuucucuccagc

SEQ ID NO: 14390 - RNA, 29 nt, Artificial Sequence
  Synthetic Oligonucleotide; GZMB exon 4; Set C
ucugguccgcuuggccuuucucuccagcu

SEQ ID NO: 14391 - RNA, 17 nt, Artificial Sequence
  Synthetic Oligonucleotide; GZMB exon 4; Set A
ccgcuuggccuuucucu

SEQ ID NO: 14392 - RNA, 27 nt, Artificial Sequence
  Synthetic Oligonucleotide; GZMB exon 4; Set C
cugguccgcuuggccuuucucuccagc

SEQ ID NO: 14393 - RNA, 18 nt, Artificial Sequence
  Synthetic Oligonucleotide; GZMB exon 4; Set A
uccgcuuggccuuucucu

SEQ ID NO: 14394 - RNA, 28 nt, Artificial Sequence
  Synthetic Oligonucleotide; GZMB exon 4; Set C
ucugguccgcuuggccuuucucuccagc

SEQ ID NO: 14395 - RNA, 19 nt, Artificial Sequence
  Synthetic Oligonucleotide; GZMB exon 4; Set A
guccgcuuggccuuucucu

SEQ ID NO: 14396 - RNA, 40 nt, Artificial Sequence
  Synthetic Oligonucleotide; GZMB exon 4; Set C
gcacagcucugguccgcuuggccuuucucuccagcuggug

SEQ ID NO: 14397 - RNA, 20 nt, Artificial Sequence
  Synthetic Oligonucleotide; GZMB exon 4; Set A
gguccgcuuggccuuucucu

SEQ ID NO: 14398 - RNA, 39 nt, Artificial Sequence
  Synthetic Oligonucleotide; GZMB exon 4; Set C
gcacagcucugguccgcuuggccuuucucuccagcuggu

SEQ ID NO: 14399 - RNA, 21 nt, Artificial Sequence
  Synthetic Oligonucleotide; GZMB exon 4; Set A
ugguccgcuuggccuuucucu

SEQ ID NO: 14400 - RNA, 40 nt, Artificial Sequence
  Synthetic Oligonucleotide; GZMB exon 4; Set C
ugcacagcucugguccgcuuggccuuucucuccagcuggu

SEQ ID NO: 14401 - RNA, 38 nt, Artificial Sequence
  Synthetic Oligonucleotide; GZMB exon 4; Set C
gcacagcucugguccgcuuggccuuucucuccagcugg

SEQ ID NO: 14402 - RNA, 22 nt, Artificial Sequence
  Synthetic Oligonucleotide; GZMB exon 4; Set C
cugguccgcuuggccuuucucu

SEQ ID NO: 14403 - RNA, 15 nt, Artificial Sequence
  Synthetic Oligonucleotide; GZMB exon 4; Set C
guccgcuuggccuuu

SEQ ID NO: 14404 - RNA, 39 nt, Artificial Sequence
  Synthetic Oligonucleotide; GZMB exon 4; Set C
ugcacagcucugguccgcuuggccuuucucuccagcugg

SEQ ID NO: 14405 - RNA, 37 nt, Artificial Sequence
  Synthetic Oligonucleotide; GZMB exon 4; Set C
gcacagcucugguccgcuuggccuuucucuccagcug

SEQ ID NO: 14406 - RNA, 23 nt, Artificial Sequence
  Synthetic Oligonucleotide; GZMB exon 4; Set C
ucugguccgcuuggccuuucucu

SEQ ID NO: 14407 - RNA, 16 nt, Artificial Sequence
  Synthetic Oligonucleotide; GZMB exon 4; Set A
gguccgcuuggccuuu

SEQ ID NO: 14408 - RNA, 36 nt, Artificial Sequence
  Synthetic Oligonucleotide; GZMB exon 4; Set C
gcacagcucugguccgcuuggccuuucucuccagcu

SEQ ID NO: 14409 - RNA, 38 nt, Artificial Sequence
  Synthetic Oligonucleotide; GZMB exon 4; Set C
ugcacagcucugguccgcuuggccuuucucuccagcug

SEQ ID NO: 14410 - RNA, 17 nt, Artificial Sequence
  Synthetic Oligonucleotide; GZMB exon 4; Set A
ugguccgcuuggccuuu

SEQ ID NO: 14411 - RNA, 37 nt, Artificial Sequence
  Synthetic Oligonucleotide; GZMB exon 4; Set C
ugcacagcucugguccgcuuggccuuucucuccagcu

SEQ ID NO: 14412 - RNA, 35 nt, Artificial Sequence
  Synthetic Oligonucleotide; GZMB exon 4; Set C
gcacagcucugguccgcuuggccuuucucuccagc

SEQ ID NO: 14413 - RNA, 18 nt, Artificial Sequence
  Synthetic Oligonucleotide; GZMB exon 4; Set A
cugguccgcuuggccuuu

SEQ ID NO: 14414 - RNA, 36 nt, Artificial Sequence
  Synthetic Oligonucleotide; GZMB exon 4; Set C
ugcacagcucugguccgcuuggccuuucucuccagc

SEQ ID NO: 14415 - RNA, 19 nt, Artificial Sequence
  Synthetic Oligonucleotide; GZMB exon 4; Set A
ucugguccgcuuggccuuu

SEQ ID NO: 14416 - RNA, 30 nt, Artificial Sequence
  Synthetic Oligonucleotide; GZMB exon 4; Set C
gcacagcucugguccgcuuggccuuucucu

SEQ ID NO: 14417 - RNA, 31 nt, Artificial Sequence
  Synthetic Oligonucleotide; GZMB exon 4; Set C
ugcacagcucugguccgcuuggccuuucucu

SEQ ID NO: 14418 - RNA, 25 nt, Artificial Sequence
  Synthetic Oligonucleotide; GZMB exon 4; Set C
cacagcucugguccgcuuggccuuu

SEQ ID NO: 14419 - RNA, 28 nt, Artificial Sequence
  Synthetic Oligonucleotide; GZMB exon 4; Set C
cugcacagcucugguccgcuuggccuuu

SEQ ID NO: 14420 - RNA, 29 nt, Artificial Sequence
  Synthetic Oligonucleotide; GZMB exon 4; Set C
gcugcacagcucugguccgcuuggccuuu

SEQ ID NO: 14421 - RNA, 37 nt, Artificial Sequence
  Synthetic Oligonucleotide; GZMB exon 4; Set C
aggggcugcacagcucugguccgcuuggccuuucucu

SEQ ID NO: 14422 - RNA, 38 nt, Artificial Sequence
  Synthetic Oligonucleotide; GZMB exon 4; Set C
gaggggcugcacagcucugguccgcuuggccuuucucu

SEQ ID NO: 14423 - RNA, 39 nt, Artificial Sequence
  Synthetic Oligonucleotide; GZMB exon 4; Set C
ugaggggcugcacagcucugguccgcuuggccuuucucu

SEQ ID NO: 14424 - RNA, 18 nt, Artificial Sequence
  Synthetic Oligonucleotide; GZMB exon 4; Set A
cacagcucugguccgcuu

SEQ ID NO: 14425 - RNA, 20 nt, Artificial Sequence
  Synthetic Oligonucleotide; GZMB exon 4; Set A
gcacagcucugguccgcuug

SEQ ID NO: 14426 - RNA, 19 nt, Artificial Sequence
  Synthetic Oligonucleotide; GZMB exon 4; Set A
gcacagcucugguccgcuu

SEQ ID NO: 14427 - RNA, 21 nt, Artificial Sequence
  Synthetic Oligonucleotide; GZMB exon 4; Set A
ugcacagcucugguccgcuug

SEQ ID NO: 14428 - RNA, 20 nt, Artificial Sequence
  Synthetic Oligonucleotide; GZMB exon 4; Set A
ugcacagcucugguccgcuu

SEQ ID NO: 14429 - RNA, 18 nt, Artificial Sequence
  Synthetic Oligonucleotide; GZMB exon 4; Set A
gcacagcucugguccgcu

SEQ ID NO: 14430 - RNA, 21 nt, Artificial Sequence
  Synthetic Oligonucleotide; GZMB exon 4; Set C
cugcacagcucugguccgcuu

SEQ ID NO: 14431 - RNA, 19 nt, Artificial Sequence
  Synthetic Oligonucleotide; GZMB exon 4; Set A
ugcacagcucugguccgcu

SEQ ID NO: 14432 - RNA, 17 nt, Artificial Sequence
  Synthetic Oligonucleotide; GZMB exon 4; Set A
gcacagcucugguccgc

SEQ ID NO: 14433 - RNA, 22 nt, Artificial Sequence
  Synthetic Oligonucleotide; GZMB exon 4; Set C
gcugcacagcucugguccgcuu

SEQ ID NO: 14434 - RNA, 20 nt, Artificial Sequence
  Synthetic Oligonucleotide; GZMB exon 4; Set C
cugcacagcucugguccgcu

SEQ ID NO: 14435 - RNA, 18 nt, Artificial Sequence
  Synthetic Oligonucleotide; GZMB exon 4; Set A
ugcacagcucugguccgc

SEQ ID NO: 14436 - RNA, 16 nt, Artificial Sequence
  Synthetic Oligonucleotide; GZMB exon 4; Set A
gcacagcucugguccg

SEQ ID NO: 14437 - RNA, 21 nt, Artificial Sequence
  Synthetic Oligonucleotide; GZMB exon 4; Set C
gcugcacagcucugguccgcu

SEQ ID NO: 14438 - RNA, 15 nt, Artificial Sequence
  Synthetic Oligonucleotide; GZMB exon 4; Set C
gcacagcucuggucc

SEQ ID NO: 14439 - RNA, 17 nt, Artificial Sequence
  Synthetic Oligonucleotide; GZMB exon 4; Set A
ugcacagcucugguccg

SEQ ID NO: 14440 - RNA, 16 nt, Artificial Sequence
  Synthetic Oligonucleotide; GZMB exon 4; Set C
ugcacagcucuggucc

SEQ ID NO: 14441 - RNA, 27 nt, Artificial Sequence
  Synthetic Oligonucleotide; GZMB exon 4; Set C
aggggcugcacagcucugguccgcuug

SEQ ID NO: 14442 - RNA, 26 nt, Artificial Sequence
  Synthetic Oligonucleotide; GZMB exon 4; Set C
aggggcugcacagcucugguccgcuu

SEQ ID NO: 14443 - RNA, 28 nt, Artificial Sequence
  Synthetic Oligonucleotide; GZMB exon 4; Set C
gaggggcugcacagcucugguccgcuug

SEQ ID NO: 14444 - RNA, 27 nt, Artificial Sequence
  Synthetic Oligonucleotide; GZMB exon 4; Set C
gaggggcugcacagcucugguccgcuu

SEQ ID NO: 14445 - RNA, 25 nt, Artificial Sequence
  Synthetic Oligonucleotide; GZMB exon 4; Set C
aggggcugcacagcucugguccgcu

SEQ ID NO: 14446 - RNA, 29 nt, Artificial Sequence
  Synthetic Oligonucleotide; GZMB exon 4; Set C
ugaggggcugcacagcucugguccgcuug

SEQ ID NO: 14447 - RNA, 26 nt, Artificial Sequence
  Synthetic Oligonucleotide; GZMB exon 4; Set C
gaggggcugcacagcucugguccgcu

SEQ ID NO: 14448 - RNA, 24 nt, Artificial Sequence
  Synthetic Oligonucleotide; GZMB exon 4; Set C
aggggcugcacagcucugguccgc

SEQ ID NO: 14449 - RNA, 25 nt, Artificial Sequence
  Synthetic Oligonucleotide; GZMB exon 4; Set C
gaggggcugcacagcucugguccgc

SEQ ID NO: 14450 - RNA, 23 nt, Artificial Sequence
  Synthetic Oligonucleotide; GZMB exon 4; Set C
aggggcugcacagcucugguccg

SEQ ID NO: 14451 - RNA, 26 nt, Artificial Sequence
  Synthetic Oligonucleotide; GZMB exon 4; Set C
ugaggggcugcacagcucugguccgc

SEQ ID NO: 14452 - RNA, 22 nt, Artificial Sequence
  Synthetic Oligonucleotide; GZMB exon 4; Set C
aggggcugcacagcucuggucc

SEQ ID NO: 14453 - RNA, 24 nt, Artificial Sequence
  Synthetic Oligonucleotide; GZMB exon 4; Set C
gaggggcugcacagcucugguccg

SEQ ID NO: 14454 - RNA, 23 nt, Artificial Sequence
  Synthetic Oligonucleotide; GZMB exon 4; Set C
gaggggcugcacagcucuggucc

SEQ ID NO: 14455 - RNA, 25 nt, Artificial Sequence
  Synthetic Oligonucleotide; GZMB exon 4; Set C
ugaggggcugcacagcucugguccg

SEQ ID NO: 14456 - RNA, 20 nt, Artificial Sequence
  Synthetic Oligonucleotide; GZMB exon 4; Set C
aggggcugcacagcucuggu

SEQ ID NO: 14457 - RNA, 24 nt, Artificial Sequence
  Synthetic Oligonucleotide; GZMB exon 4; Set C
ugaggggcugcacagcucuggucc

SEQ ID NO: 14458 - RNA, 19 nt, Artificial Sequence
  Synthetic Oligonucleotide; GZMB exon 4; Set A
aggggcugcacagcucugg

SEQ ID NO: 14459 - RNA, 21 nt, Artificial Sequence
  Synthetic Oligonucleotide; GZMB exon 4; Set C
gaggggcugcacagcucuggu

SEQ ID NO: 14460 - RNA, 23 nt, Artificial Sequence
  Synthetic Oligonucleotide; GZMB exon 4; Set C
ugaggggcugcacagcucugguc

SEQ ID NO: 14461 - RNA, 20 nt, Artificial Sequence
  Synthetic Oligonucleotide; GZMB exon 4; Set C
gaggggcugcacagcucugg

SEQ ID NO: 14462 - RNA, 22 nt, Artificial Sequence
  Synthetic Oligonucleotide; GZMB exon 4; Set C
ugaggggcugcacagcucuggu

SEQ ID NO: 14463 - RNA, 18 nt, Artificial Sequence
  Synthetic Oligonucleotide; GZMB exon 4; Set A
aggggcugcacagcucug

SEQ ID NO: 14464 - RNA, 21 nt, Artificial Sequence
  Synthetic Oligonucleotide; GZMB exon 4; Set C
ugaggggcugcacagcucugg

SEQ ID NO: 14465 - RNA, 17 nt, Artificial Sequence
  Synthetic Oligonucleotide; GZMB exon 4; Set A
aggggcugcacagcucu

SEQ ID NO: 14466 - RNA, 19 nt, Artificial Sequence
  Synthetic Oligonucleotide; GZMB exon 4; Set A
gaggggcugcacagcucug

SEQ ID NO: 14467 - RNA, 18 nt, Artificial Sequence
  Synthetic Oligonucleotide; GZMB exon 4; Set A
gaggggcugcacagcucu

SEQ ID NO: 14468 - RNA, 20 nt, Artificial Sequence
  Synthetic Oligonucleotide; GZMB exon 4; Set A
ugaggggcugcacagcucug

SEQ ID NO: 14469 - RNA, 19 nt, Artificial Sequence
  Synthetic Oligonucleotide; GZMB exon 4; Set A
ugaggggcugcacagcucu

SEQ ID NO: 14470 - RNA, 22 nt, Artificial Sequence
  Synthetic Oligonucleotide; GZMB exon 4; Set C
uguuuucccaggggggccgucu

SEQ ID NO: 14471 - RNA, 18 nt, Artificial Sequence
  Synthetic Oligonucleotide; GZMB exon 4; Set C
aaaggaagucuuuuuaau

SEQ ID NO: 14472 - RNA, 19 nt, Artificial Sequence
  Synthetic Oligonucleotide; GZMB exon 4; Set C
uaaaggaagucuuuuuaau

SEQ ID NO: 14473 - RNA, 17 nt, Artificial Sequence
  Synthetic Oligonucleotide; GZMB exon 4; Set C
aaaggaagucuuuuuaa

SEQ ID NO: 14474 - RNA, 18 nt, Artificial Sequence
  Synthetic Oligonucleotide; GZMB exon 4; Set C
uaaaggaagucuuuuuaa

SEQ ID NO: 14475 - RNA, 16 nt, Artificial Sequence
  Synthetic Oligonucleotide; GZMB exon 4; Set C
aaaggaagucuuuuua

SEQ ID NO: 14476 - RNA, 20 nt, Artificial Sequence
  Synthetic Oligonucleotide; GZMB exon 4; Set C
uuaaaggaagucuuuuuaau

SEQ ID NO: 14477 - RNA, 17 nt, Artificial Sequence
  Synthetic Oligonucleotide; GZMB exon 4; Set C
uaaaggaagucuuuuua

SEQ ID NO: 14478 - RNA, 19 nt, Artificial Sequence
  Synthetic Oligonucleotide; GZMB exon 4; Set C
uuaaaggaagucuuuuuaa

SEQ ID NO: 14479 - RNA, 18 nt, Artificial Sequence
  Synthetic Oligonucleotide; GZMB exon 4; Set C
uuaaaggaagucuuuuua

SEQ ID NO: 14480 - RNA, 31 nt, Artificial Sequence
  Synthetic Oligonucleotide; GZMB exon 4; Set C
auagucuuaccuuaaaggaagucuuuuuaau

SEQ ID NO: 14481 - RNA, 30 nt, Artificial Sequence
  Synthetic Oligonucleotide; GZMB exon 4; Set C
auagucuuaccuuaaaggaagucuuuuuaa

SEQ ID NO: 14482 - RNA, 32 nt, Artificial Sequence
  Synthetic Oligonucleotide; GZMB exon 4; Set C
cauagucuuaccuuaaaggaagucuuuuuaau

SEQ ID NO: 14483 - RNA, 18 nt, Artificial Sequence
  Synthetic Oligonucleotide; GZMB exon 4; Set C
cagccaacgaacuucugg

SEQ ID NO: 14484 - RNA, 19 nt, Artificial Sequence
  Synthetic Oligonucleotide; GZMB exon 4; Set C
ucagccaacgaacuucugg

SEQ ID NO: 14485 - RNA, 17 nt, Artificial Sequence
  Synthetic Oligonucleotide; GZMB exon 4; Set C
cagccaacgaacuucug

SEQ ID NO: 14486 - RNA, 20 nt, Artificial Sequence
  Synthetic Oligonucleotide; GZMB exon 4; Set C
gucagccaacgaacuucugg

SEQ ID NO: 14487 - RNA, 18 nt, Artificial Sequence
  Synthetic Oligonucleotide; GZMB exon 4; Set C
ucagccaacgaacuucug

SEQ ID NO: 14488 - RNA, 21 nt, Artificial Sequence
  Synthetic Oligonucleotide; GZMB exon 4; Set A
ggucagccaacgaacuucugg

SEQ ID NO: 14489 - RNA, 19 nt, Artificial Sequence
  Synthetic Oligonucleotide; GZMB exon 4; Set C
gucagccaacgaacuucug

SEQ ID NO: 14490 - RNA, 17 nt, Artificial Sequence
  Synthetic Oligonucleotide; GZMB exon 4; Set C
ucagccaacgaacuucu

SEQ ID NO: 14491 - RNA, 20 nt, Artificial Sequence
  Synthetic Oligonucleotide; GZMB exon 4; Set C
ggucagccaacgaacuucug

SEQ ID NO: 14492 - RNA, 18 nt, Artificial Sequence
  Synthetic Oligonucleotide; GZMB exon 4; Set C
gucagccaacgaacuucu

SEQ ID NO: 14493 - RNA, 19 nt, Artificial Sequence
  Synthetic Oligonucleotide; GZMB exon 4; Set C
ggucagccaacgaacuucu

SEQ ID NO: 14494 - RNA, 32 nt, Artificial Sequence
  Synthetic Oligonucleotide; GZMB exon 4; Set A
aagaaaguccaggucagccaacgaacuucugg

SEQ ID NO: 14495 - RNA, 33 nt, Artificial Sequence
  Synthetic Oligonucleotide; GZMB exon 4; Set C
caagaaaguccaggucagccaacgaacuucugg

SEQ ID NO: 14496 - RNA, 38 nt, Artificial Sequence
  Synthetic Oligonucleotide; GZMB exon 4; Set C
agaggcaagaaaguccaggucagccaacgaacuucugg

SEQ ID NO: 14497 - RNA, 39 nt, Artificial Sequence
  Synthetic Oligonucleotide; GZMB exon 4; Set C
aagaggcaagaaaguccaggucagccaacgaacuucugg

SEQ ID NO: 14498 - RNA, 40 nt, Artificial Sequence
  Synthetic Oligonucleotide; GZMB exon 4; Set C
gaagaggcaagaaaguccaggucagccaacgaacuucugg

SEQ ID NO: 14499 - RNA, 40 nt, Artificial Sequence
  Synthetic Oligonucleotide; GZMB exon 4; Set C
ggaagaggcaagaaaguccaggucagccaacgaacuucug

SEQ ID NO: 14500 - RNA, 39 nt, Artificial Sequence
  Synthetic Oligonucleotide; GZMB exon 4; Set C
ggaagaggcaagaaaguccaggucagccaacgaacuucu

SEQ ID NO: 14501 - RNA, 40 nt, Artificial Sequence
  Synthetic Oligonucleotide; GZMB exon 4; Set C
gggaagaggcaagaaaguccaggucagccaacgaacuucu

SEQ ID NO: 14502 - RNA, 17 nt, Artificial Sequence
  Synthetic Oligonucleotide; GZMB exon 4; Set C
aagaaaguccaggucag

SEQ ID NO: 14503 - RNA, 16 nt, Artificial Sequence
  Synthetic Oligonucleotide; GZMB exon 4; Set C
aagaaaguccagguca

SEQ ID NO: 14504 - RNA, 18 nt, Artificial Sequence
  Synthetic Oligonucleotide; GZMB exon 4; Set C
caagaaaguccaggucag

SEQ ID NO: 14505 - RNA, 17 nt, Artificial Sequence
  Synthetic Oligonucleotide; GZMB exon 4; Set C
caagaaaguccagguca

SEQ ID NO: 14506 - RNA, 15 nt, Artificial Sequence
  Synthetic Oligonucleotide; GZMB exon 4; Set C
aagaaaguccagguc

SEQ ID NO: 14507 - RNA, 16 nt, Artificial Sequence
  Synthetic Oligonucleotide; GZMB exon 4; Set C
caagaaaguccagguc

SEQ ID NO: 14508 - RNA, 30 nt, Artificial Sequence
  Synthetic Oligonucleotide; GZMB exon 4; Set A
gaagaggcaagaaaguccaggucagccaac

SEQ ID NO: 14509 - RNA, 31 nt, Artificial Sequence
  Synthetic Oligonucleotide; GZMB exon 4; Set C
ggaagaggcaagaaaguccaggucagccaac

SEQ ID NO: 14510 - RNA, 32 nt, Artificial Sequence
  Synthetic Oligonucleotide; GZMB exon 4; Set C
gggaagaggcaagaaaguccaggucagccaac

SEQ ID NO: 14511 - RNA, 33 nt, Artificial Sequence
  Synthetic Oligonucleotide; GZMB exon 4; Set C
ggggaagaggcaagaaaguccaggucagccaac

SEQ ID NO: 14512 - RNA, 22 nt, Artificial Sequence
  Synthetic Oligonucleotide; GZMB exon 4; Set C
agaggcaagaaaguccagguca

SEQ ID NO: 14513 - RNA, 24 nt, Artificial Sequence
  Synthetic Oligonucleotide; GZMB exon 4; Set C
aagaggcaagaaaguccaggucag

SEQ ID NO: 14514 - RNA, 34 nt, Artificial Sequence
  Synthetic Oligonucleotide; GZMB exon 4; Set C
uggggaagaggcaagaaaguccaggucagccaac

SEQ ID NO: 14515 - RNA, 23 nt, Artificial Sequence
  Synthetic Oligonucleotide; GZMB exon 4; Set C
aagaggcaagaaaguccagguca

SEQ ID NO: 14516 - RNA, 25 nt, Artificial Sequence
  Synthetic Oligonucleotide; GZMB exon 4; Set A
gaagaggcaagaaaguccaggucag

SEQ ID NO: 14517 - RNA, 35 nt, Artificial Sequence
  Synthetic Oligonucleotide; GZMB exon 4; Set C
guggggaagaggcaagaaaguccaggucagccaac

SEQ ID NO: 14518 - RNA, 24 nt, Artificial Sequence
  Synthetic Oligonucleotide; GZMB exon 4; Set A
gaagaggcaagaaaguccagguca

SEQ ID NO: 14519 - RNA, 22 nt, Artificial Sequence
  Synthetic Oligonucleotide; GZMB exon 4; Set C
aagaggcaagaaaguccagguc

SEQ ID NO: 14520 - RNA, 26 nt, Artificial Sequence
  Synthetic Oligonucleotide; GZMB exon 4; Set A
ggaagaggcaagaaaguccaggucag

SEQ ID NO: 14521 - RNA, 36 nt, Artificial Sequence
  Synthetic Oligonucleotide; GZMB exon 4; Set C
gguggggaagaggcaagaaaguccaggucagccaac

SEQ ID NO: 14522 - RNA, 25 nt, Artificial Sequence
  Synthetic Oligonucleotide; GZMB exon 4; Set A
ggaagaggcaagaaaguccagguca

SEQ ID NO: 14523 - RNA, 23 nt, Artificial Sequence
  Synthetic Oligonucleotide; GZMB exon 4; Set C
gaagaggcaagaaaguccagguc

SEQ ID NO: 14524 - RNA, 21 nt, Artificial Sequence
  Synthetic Oligonucleotide; GZMB exon 4; Set C
aagaggcaagaaaguccaggu

SEQ ID NO: 14525 - RNA, 27 nt, Artificial Sequence
  Synthetic Oligonucleotide; GZMB exon 4; Set A
gggaagaggcaagaaaguccaggucag

SEQ ID NO: 14526 - RNA, 37 nt, Artificial Sequence
  Synthetic Oligonucleotide; GZMB exon 4; Set C
ugguggggaagaggcaagaaaguccaggucagccaac

SEQ ID NO: 14527 - RNA, 26 nt, Artificial Sequence
  Synthetic Oligonucleotide; GZMB exon 4; Set A
gggaagaggcaagaaaguccagguca

SEQ ID NO: 14528 - RNA, 24 nt, Artificial Sequence
  Synthetic Oligonucleotide; GZMB exon 4; Set A
ggaagaggcaagaaaguccagguc

SEQ ID NO: 14529 - RNA, 22 nt, Artificial Sequence
  Synthetic Oligonucleotide; GZMB exon 4; Set C
gaagaggcaagaaaguccaggu

SEQ ID NO: 14530 - RNA, 28 nt, Artificial Sequence
  Synthetic Oligonucleotide; GZMB exon 4; Set A
ggggaagaggcaagaaaguccaggucag

SEQ ID NO: 14531 - RNA, 38 nt, Artificial Sequence
  Synthetic Oligonucleotide; GZMB exon 4; Set C
cugguggggaagaggcaagaaaguccaggucagccaac

SEQ ID NO: 14532 - RNA, 27 nt, Artificial Sequence
  Synthetic Oligonucleotide; GZMB exon 4; Set A
ggggaagaggcaagaaaguccagguca

SEQ ID NO: 14533 - RNA, 25 nt, Artificial Sequence
  Synthetic Oligonucleotide; GZMB exon 4; Set A
gggaagaggcaagaaaguccagguc

SEQ ID NO: 14534 - RNA, 23 nt, Artificial Sequence
  Synthetic Oligonucleotide; GZMB exon 4; Set A
ggaagaggcaagaaaguccaggu

SEQ ID NO: 14535 - RNA, 29 nt, Artificial Sequence
  Synthetic Oligonucleotide; GZMB exon 4; Set A
uggggaagaggcaagaaaguccaggucag

SEQ ID NO: 14536 - RNA, 39 nt, Artificial Sequence
  Synthetic Oligonucleotide; GZMB exon 4; Set C
gcugguggggaagaggcaagaaaguccaggucagccaac

SEQ ID NO: 14537 - RNA, 28 nt, Artificial Sequence
  Synthetic Oligonucleotide; GZMB exon 4; Set A
uggggaagaggcaagaaaguccagguca

SEQ ID NO: 14538 - RNA, 26 nt, Artificial Sequence
  Synthetic Oligonucleotide; GZMB exon 4; Set A
ggggaagaggcaagaaaguccagguc

SEQ ID NO: 14539 - RNA, 24 nt, Artificial Sequence
  Synthetic Oligonucleotide; GZMB exon 4; Set A
gggaagaggcaagaaaguccaggu

SEQ ID NO: 14540 - RNA, 30 nt, Artificial Sequence
  Synthetic Oligonucleotide; GZMB exon 4; Set C
guggggaagaggcaagaaaguccaggucag

SEQ ID NO: 14541 - RNA, 40 nt, Artificial Sequence
  Synthetic Oligonucleotide; GZMB exon 4; Set C
agcugguggggaagaggcaagaaaguccaggucagccaac

SEQ ID NO: 14542 - RNA, 27 nt, Artificial Sequence
  Synthetic Oligonucleotide; GZMB exon 4; Set A
uggggaagaggcaagaaaguccagguc

SEQ ID NO: 14543 - RNA, 25 nt, Artificial Sequence
  Synthetic Oligonucleotide; GZMB exon 4; Set A
ggggaagaggcaagaaaguccaggu

SEQ ID NO: 14544 - RNA, 31 nt, Artificial Sequence
  Synthetic Oligonucleotide; GZMB exon 4; Set C
gguggggaagaggcaagaaaguccaggucag

SEQ ID NO: 14545 - RNA, 30 nt, Artificial Sequence
  Synthetic Oligonucleotide; GZMB exon 4; Set C
gguggggaagaggcaagaaaguccagguca

SEQ ID NO: 14546 - RNA, 28 nt, Artificial Sequence
  Synthetic Oligonucleotide; GZMB exon 4; Set A
guggggaagaggcaagaaaguccagguc

SEQ ID NO: 14547 - RNA, 26 nt, Artificial Sequence
  Synthetic Oligonucleotide; GZMB exon 4; Set A
uggggaagaggcaagaaaguccaggu

SEQ ID NO: 14548 - RNA, 32 nt, Artificial Sequence
  Synthetic Oligonucleotide; GZMB exon 4; Set C
ugguggggaagaggcaagaaaguccaggucag

SEQ ID NO: 14549 - RNA, 29 nt, Artificial Sequence
  Synthetic Oligonucleotide; GZMB exon 4; Set C
gguggggaagaggcaagaaaguccagguc

SEQ ID NO: 14550 - RNA, 27 nt, Artificial Sequence
  Synthetic Oligonucleotide; GZMB exon 4; Set A
guggggaagaggcaagaaaguccaggu

SEQ ID NO: 14551 - RNA, 33 nt, Artificial Sequence
  Synthetic Oligonucleotide; GZMB exon 4; Set C
cugguggggaagaggcaagaaaguccaggucag

SEQ ID NO: 14552 - RNA, 32 nt, Artificial Sequence
  Synthetic Oligonucleotide; GZMB exon 4; Set C
cugguggggaagaggcaagaaaguccagguca

SEQ ID NO: 14553 - RNA, 30 nt, Artificial Sequence
  Synthetic Oligonucleotide; GZMB exon 4; Set C
ugguggggaagaggcaagaaaguccagguc

SEQ ID NO: 14554 - RNA, 28 nt, Artificial Sequence
  Synthetic Oligonucleotide; GZMB exon 4; Set C
gguggggaagaggcaagaaaguccaggu

SEQ ID NO: 14555 - RNA, 34 nt, Artificial Sequence
  Synthetic Oligonucleotide; GZMB exon 4; Set C
gcugguggggaagaggcaagaaaguccaggucag

SEQ ID NO: 14556 - RNA, 31 nt, Artificial Sequence
  Synthetic Oligonucleotide; GZMB exon 4; Set C
cugguggggaagaggcaagaaaguccagguc

SEQ ID NO: 14557 - RNA, 29 nt, Artificial Sequence
  Synthetic Oligonucleotide; GZMB exon 4; Set C
ugguggggaagaggcaagaaaguccaggu

SEQ ID NO: 14558 - RNA, 35 nt, Artificial Sequence
  Synthetic Oligonucleotide; GZMB exon 4; Set C
agcugguggggaagaggcaagaaaguccaggucag

SEQ ID NO: 14559 - RNA, 32 nt, Artificial Sequence
  Synthetic Oligonucleotide; GZMB exon 4; Set C
gcugguggggaagaggcaagaaaguccagguc

SEQ ID NO: 14560 - RNA, 30 nt, Artificial Sequence
  Synthetic Oligonucleotide; GZMB exon 4; Set C
cugguggggaagaggcaagaaaguccaggu

SEQ ID NO: 14561 - RNA, 33 nt, Artificial Sequence
  Synthetic Oligonucleotide; GZMB exon 4; Set C
agcugguggggaagaggcaagaaaguccagguc

SEQ ID NO: 14562 - RNA, 31 nt, Artificial Sequence
  Synthetic Oligonucleotide; GZMB exon 4; Set C
gcugguggggaagaggcaagaaaguccaggu

SEQ ID NO: 14563 - RNA, 32 nt, Artificial Sequence
  Synthetic Oligonucleotide; GZMB exon 4; Set C
agcugguggggaagaggcaagaaaguccaggu

SEQ ID NO: 14564 - RNA, 40 nt, Artificial Sequence
  Synthetic Oligonucleotide; GZMB exon 4; Set C
ucuccagcugguggggaagaggcaagaaaguccaggucag

SEQ ID NO: 14565 - RNA, 39 nt, Artificial Sequence
  Synthetic Oligonucleotide; GZMB exon 4; Set C
ucuccagcugguggggaagaggcaagaaaguccagguca

SEQ ID NO: 14566 - RNA, 38 nt, Artificial Sequence
  Synthetic Oligonucleotide; GZMB exon 4; Set C
ucuccagcugguggggaagaggcaagaaaguccagguc

SEQ ID NO: 14567 - RNA, 37 nt, Artificial Sequence
  Synthetic Oligonucleotide; GZMB exon 4; Set C
ucuccagcugguggggaagaggcaagaaaguccaggu

SEQ ID NO: 14568 - RNA, 31 nt, Artificial Sequence
  Synthetic Oligonucleotide; GZMB exon 4; Set C
cuuucucuccagcugguggggaagaggcaag

SEQ ID NO: 14569 - RNA, 21 nt, Artificial Sequence
  Synthetic Oligonucleotide; GZMB exon 4; Set A
ucuccagcugguggggaagag

SEQ ID NO: 14570 - RNA, 32 nt, Artificial Sequence
  Synthetic Oligonucleotide; GZMB exon 4; Set C
ccuuucucuccagcugguggggaagaggcaag

SEQ ID NO: 14571 - RNA, 36 nt, Artificial Sequence
  Synthetic Oligonucleotide; GZMB exon 4; Set C
uuggccuuucucuccagcugguggggaagaggcaag

SEQ ID NO: 14572 - RNA, 35 nt, Artificial Sequence
  Synthetic Oligonucleotide; GZMB exon 4; Set C
uuggccuuucucuccagcugguggggaagaggcaa

SEQ ID NO: 14573 - RNA, 24 nt, Artificial Sequence
  Synthetic Oligonucleotide; GZMB exon 4; Set A
cuuucucuccagcugguggggaag

SEQ ID NO: 14574 - RNA, 23 nt, Artificial Sequence
  Synthetic Oligonucleotide; GZMB exon 4; Set A
cuuucucuccagcugguggggaa

SEQ ID NO: 14575 - RNA, 25 nt, Artificial Sequence
  Synthetic Oligonucleotide; GZMB exon 4; Set C
ccuuucucuccagcugguggggaag

SEQ ID NO: 14576 - RNA, 22 nt, Artificial Sequence
  Synthetic Oligonucleotide; GZMB exon 4; Set A
cuuucucuccagcuggugggga

SEQ ID NO: 14577 - RNA, 24 nt, Artificial Sequence
  Synthetic Oligonucleotide; GZMB exon 4; Set C
ccuuucucuccagcugguggggaa

SEQ ID NO: 14578 - RNA, 21 nt, Artificial Sequence
  Synthetic Oligonucleotide; GZMB exon 4; Set A
cuuucucuccagcuggugggg

SEQ ID NO: 14579 - RNA, 23 nt, Artificial Sequence
  Synthetic Oligonucleotide; GZMB exon 4; Set C
ccuuucucuccagcuggugggga

SEQ ID NO: 14580 - RNA, 39 nt, Artificial Sequence
  Synthetic Oligonucleotide; GZMB exon 4; Set C
ccgcuuggccuuucucuccagcugguggggaagaggcaa

SEQ ID NO: 14581 - RNA, 31 nt, Artificial Sequence
  Synthetic Oligonucleotide; GZMB exon 4; Set C
uuggccuuucucuccagcugguggggaagag

SEQ ID NO: 14582 - RNA, 20 nt, Artificial Sequence
  Synthetic Oligonucleotide; GZMB exon 4; Set A
cuuucucuccagcugguggg

SEQ ID NO: 14583 - RNA, 22 nt, Artificial Sequence
  Synthetic Oligonucleotide; GZMB exon 4; Set A
ccuuucucuccagcuggugggg

SEQ ID NO: 14584 - RNA, 30 nt, Artificial Sequence
  Synthetic Oligonucleotide; GZMB exon 4; Set C
uuggccuuucucuccagcugguggggaaga

SEQ ID NO: 14585 - RNA, 21 nt, Artificial Sequence
  Synthetic Oligonucleotide; GZMB exon 4; Set A
ccuuucucuccagcugguggg

SEQ ID NO: 14586 - RNA, 19 nt, Artificial Sequence
  Synthetic Oligonucleotide; GZMB exon 4; Set A
cuuucucuccagcuggugg

SEQ ID NO: 14587 - RNA, 29 nt, Artificial Sequence
  Synthetic Oligonucleotide; GZMB exon 4; Set C
uuggccuuucucuccagcugguggggaag

SEQ ID NO: 14588 - RNA, 18 nt, Artificial Sequence
  Synthetic Oligonucleotide; GZMB exon 4; Set C
cuuucucuccagcuggug

SEQ ID NO: 14589 - RNA, 20 nt, Artificial Sequence
  Synthetic Oligonucleotide; GZMB exon 4; Set A
ccuuucucuccagcuggugg

SEQ ID NO: 14590 - RNA, 28 nt, Artificial Sequence
  Synthetic Oligonucleotide; GZMB exon 4; Set C
uuggccuuucucuccagcugguggggaa

SEQ ID NO: 14591 - RNA, 34 nt, Artificial Sequence
  Synthetic Oligonucleotide; GZMB exon 4; Set C
cgcuuggccuuucucuccagcugguggggaagag

SEQ ID NO: 14592 - RNA, 19 nt, Artificial Sequence
  Synthetic Oligonucleotide; GZMB exon 4; Set A
ccuuucucuccagcuggug

SEQ ID NO: 14593 - RNA, 27 nt, Artificial Sequence
  Synthetic Oligonucleotide; GZMB exon 4; Set C
uuggccuuucucuccagcuggugggga

SEQ ID NO: 14594 - RNA, 35 nt, Artificial Sequence
  Synthetic Oligonucleotide; GZMB exon 4; Set C
ccgcuuggccuuucucuccagcugguggggaagag

SEQ ID NO: 14595 - RNA, 26 nt, Artificial Sequence
  Synthetic Oligonucleotide; GZMB exon 4; Set C
uuggccuuucucuccagcuggugggg

SEQ ID NO: 14596 - RNA, 34 nt, Artificial Sequence
  Synthetic Oligonucleotide; GZMB exon 4; Set C
ccgcuuggccuuucucuccagcugguggggaaga

SEQ ID NO: 14597 - RNA, 36 nt, Artificial Sequence
  Synthetic Oligonucleotide; GZMB exon 4; Set C
uccgcuuggccuuucucuccagcugguggggaagag

SEQ ID NO: 14598 - RNA, 25 nt, Artificial Sequence
  Synthetic Oligonucleotide; GZMB exon 4; Set C
uuggccuuucucuccagcugguggg

SEQ ID NO: 14599 - RNA, 37 nt, Artificial Sequence
  Synthetic Oligonucleotide; GZMB exon 4; Set C
guccgcuuggccuuucucuccagcugguggggaagag

SEQ ID NO: 14600 - RNA, 24 nt, Artificial Sequence
  Synthetic Oligonucleotide; GZMB exon 4; Set C
uuggccuuucucuccagcuggugg

SEQ ID NO: 14601 - RNA, 36 nt, Artificial Sequence
  Synthetic Oligonucleotide; GZMB exon 4; Set C
guccgcuuggccuuucucuccagcugguggggaaga

SEQ ID NO: 14602 - RNA, 38 nt, Artificial Sequence
  Synthetic Oligonucleotide; GZMB exon 4; Set C
gguccgcuuggccuuucucuccagcugguggggaagag

SEQ ID NO: 14603 - RNA, 23 nt, Artificial Sequence
  Synthetic Oligonucleotide; GZMB exon 4; Set A
uuggccuuucucuccagcuggug

SEQ ID NO: 14604 - RNA, 35 nt, Artificial Sequence
  Synthetic Oligonucleotide; GZMB exon 4; Set C
guccgcuuggccuuucucuccagcugguggggaag

SEQ ID NO: 14605 - RNA, 39 nt, Artificial Sequence
  Synthetic Oligonucleotide; GZMB exon 4; Set C
ugguccgcuuggccuuucucuccagcugguggggaagag

SEQ ID NO: 14606 - RNA, 22 nt, Artificial Sequence
  Synthetic Oligonucleotide; GZMB exon 4; Set A
uuggccuuucucuccagcuggu

SEQ ID NO: 14607 - RNA, 40 nt, Artificial Sequence
  Synthetic Oligonucleotide; GZMB exon 4; Set C
cugguccgcuuggccuuucucuccagcugguggggaagag

SEQ ID NO: 14608 - RNA, 21 nt, Artificial Sequence
  Synthetic Oligonucleotide; GZMB exon 4; Set A
uuggccuuucucuccagcugg

SEQ ID NO: 14609 - RNA, 20 nt, Artificial Sequence
  Synthetic Oligonucleotide; GZMB exon 4; Set A
uuggccuuucucuccagcug

SEQ ID NO: 14610 - RNA, 19 nt, Artificial Sequence
  Synthetic Oligonucleotide; GZMB exon 4; Set A
uuggccuuucucuccagcu

SEQ ID NO: 14611 - RNA, 18 nt, Artificial Sequence
  Synthetic Oligonucleotide; GZMB exon 4; Set A
uuggccuuucucuccagc

SEQ ID NO: 14612 - RNA, 28 nt, Artificial Sequence
  Synthetic Oligonucleotide; GZMB exon 4; Set C
guccgcuuggccuuucucuccagcuggu

SEQ ID NO: 14613 - RNA, 24 nt, Artificial Sequence
  Synthetic Oligonucleotide; GZMB exon 4; Set C
ccgcuuggccuuucucuccagcug

SEQ ID NO: 14614 - RNA, 27 nt, Artificial Sequence
  Synthetic Oligonucleotide; GZMB exon 4; Set C
guccgcuuggccuuucucuccagcugg

SEQ ID NO: 14615 - RNA, 23 nt, Artificial Sequence
  Synthetic Oligonucleotide; GZMB exon 4; Set C
ccgcuuggccuuucucuccagcu

SEQ ID NO: 14616 - RNA, 25 nt, Artificial Sequence
  Synthetic Oligonucleotide; GZMB exon 4; Set C
uccgcuuggccuuucucuccagcug

SEQ ID NO: 14617 - RNA, 24 nt, Artificial Sequence
  Synthetic Oligonucleotide; GZMB exon 4; Set C
uccgcuuggccuuucucuccagcu

SEQ ID NO: 14618 - RNA, 26 nt, Artificial Sequence
  Synthetic Oligonucleotide; GZMB exon 4; Set C
guccgcuuggccuuucucuccagcug

SEQ ID NO: 14619 - RNA, 22 nt, Artificial Sequence
  Synthetic Oligonucleotide; GZMB exon 4; Set C
ccgcuuggccuuucucuccagc

SEQ ID NO: 14620 - RNA, 25 nt, Artificial Sequence
  Synthetic Oligonucleotide; GZMB exon 4; Set C
guccgcuuggccuuucucuccagcu

SEQ ID NO: 14621 - RNA, 23 nt, Artificial Sequence
  Synthetic Oligonucleotide; GZMB exon 4; Set C
uccgcuuggccuuucucuccagc

SEQ ID NO: 14622 - RNA, 24 nt, Artificial Sequence
  Synthetic Oligonucleotide; GZMB exon 4; Set C
guccgcuuggccuuucucuccagc

SEQ ID NO: 14623 - RNA, 40 nt, Artificial Sequence
  Synthetic Oligonucleotide; GZMB exon 4; Set C
cacagcucugguccgcuuggccuuucucuccagcuggugg

SEQ ID NO: 14624 - RNA, 39 nt, Artificial Sequence
  Synthetic Oligonucleotide; GZMB exon 4; Set C
cacagcucugguccgcuuggccuuucucuccagcuggug

SEQ ID NO: 14625 - RNA, 38 nt, Artificial Sequence
  Synthetic Oligonucleotide; GZMB exon 4; Set C
cacagcucugguccgcuuggccuuucucuccagcuggu

SEQ ID NO: 14626 - RNA, 37 nt, Artificial Sequence
  Synthetic Oligonucleotide; GZMB exon 4; Set C
cacagcucugguccgcuuggccuuucucuccagcugg

SEQ ID NO: 14627 - RNA, 36 nt, Artificial Sequence
  Synthetic Oligonucleotide; GZMB exon 4; Set C
cacagcucugguccgcuuggccuuucucuccagcug

SEQ ID NO: 14628 - RNA, 35 nt, Artificial Sequence
  Synthetic Oligonucleotide; GZMB exon 4; Set C
cacagcucugguccgcuuggccuuucucuccagcu

SEQ ID NO: 14629 - RNA, 40 nt, Artificial Sequence
  Synthetic Oligonucleotide; GZMB exon 4; Set C
cugcacagcucugguccgcuuggccuuucucuccagcugg

SEQ ID NO: 14630 - RNA, 34 nt, Artificial Sequence
  Synthetic Oligonucleotide; GZMB exon 4; Set C
cacagcucugguccgcuuggccuuucucuccagc

SEQ ID NO: 14631 - RNA, 39 nt, Artificial Sequence
  Synthetic Oligonucleotide; GZMB exon 4; Set C
cugcacagcucugguccgcuuggccuuucucuccagcug

SEQ ID NO: 14632 - RNA, 15 nt, Artificial Sequence
  Synthetic Oligonucleotide; GZMB exon 4; Set A
gguccgcuuggccuu

SEQ ID NO: 14633 - RNA, 38 nt, Artificial Sequence
  Synthetic Oligonucleotide; GZMB exon 4; Set C
cugcacagcucugguccgcuuggccuuucucuccagcu

SEQ ID NO: 14634 - RNA, 40 nt, Artificial Sequence
  Synthetic Oligonucleotide; GZMB exon 4; Set C
gcugcacagcucugguccgcuuggccuuucucuccagcug

SEQ ID NO: 14635 - RNA, 16 nt, Artificial Sequence
  Synthetic Oligonucleotide; GZMB exon 4; Set A
ugguccgcuuggccuu

SEQ ID NO: 14636 - RNA, 39 nt, Artificial Sequence
  Synthetic Oligonucleotide; GZMB exon 4; Set C
gcugcacagcucugguccgcuuggccuuucucuccagcu

SEQ ID NO: 14637 - RNA, 37 nt, Artificial Sequence
  Synthetic Oligonucleotide; GZMB exon 4; Set C
cugcacagcucugguccgcuuggccuuucucuccagc

SEQ ID NO: 14638 - RNA, 17 nt, Artificial Sequence
  Synthetic Oligonucleotide; GZMB exon 4; Set A
cugguccgcuuggccuu

SEQ ID NO: 14639 - RNA, 38 nt, Artificial Sequence
  Synthetic Oligonucleotide; GZMB exon 4; Set C
gcugcacagcucugguccgcuuggccuuucucuccagc

SEQ ID NO: 14640 - RNA, 18 nt, Artificial Sequence
  Synthetic Oligonucleotide; GZMB exon 4; Set A
ucugguccgcuuggccuu

SEQ ID NO: 14641 - RNA, 29 nt, Artificial Sequence
  Synthetic Oligonucleotide; GZMB exon 4; Set C
cacagcucugguccgcuuggccuuucucu

SEQ ID NO: 14642 - RNA, 32 nt, Artificial Sequence
  Synthetic Oligonucleotide; GZMB exon 4; Set C
cugcacagcucugguccgcuuggccuuucucu

SEQ ID NO: 14643 - RNA, 33 nt, Artificial Sequence
  Synthetic Oligonucleotide; GZMB exon 4; Set C
gcugcacagcucugguccgcuuggccuuucucu

SEQ ID NO: 14644 - RNA, 25 nt, Artificial Sequence
  Synthetic Oligonucleotide; GZMB exon 4; Set C
gcacagcucugguccgcuuggccuu

SEQ ID NO: 14645 - RNA, 26 nt, Artificial Sequence
  Synthetic Oligonucleotide; GZMB exon 4; Set C
ugcacagcucugguccgcuuggccuu

SEQ ID NO: 14646 - RNA, 24 nt, Artificial Sequence
  Synthetic Oligonucleotide; GZMB exon 4; Set C
gcacagcucugguccgcuuggccu

SEQ ID NO: 14647 - RNA, 25 nt, Artificial Sequence
  Synthetic Oligonucleotide; GZMB exon 4; Set C
ugcacagcucugguccgcuuggccu

SEQ ID NO: 14648 - RNA, 19 nt, Artificial Sequence
  Synthetic Oligonucleotide; GZMB exon 4; Set A
cacagcucugguccgcuug

SEQ ID NO: 14649 - RNA, 17 nt, Artificial Sequence
  Synthetic Oligonucleotide; GZMB exon 4; Set A
cacagcucugguccgcu

SEQ ID NO: 14650 - RNA, 16 nt, Artificial Sequence
  Synthetic Oligonucleotide; GZMB exon 4; Set A
cacagcucugguccgc

SEQ ID NO: 14651 - RNA, 22 nt, Artificial Sequence
  Synthetic Oligonucleotide; GZMB exon 4; Set C
cugcacagcucugguccgcuug

SEQ ID NO: 14652 - RNA, 32 nt, Artificial Sequence
  Synthetic Oligonucleotide; GZMB exon 4; Set C
aggggcugcacagcucugguccgcuuggccuu

SEQ ID NO: 14653 - RNA, 15 nt, Artificial Sequence
  Synthetic Oligonucleotide; GZMB exon 4; Set C
cacagcucugguccg

SEQ ID NO: 14654 - RNA, 23 nt, Artificial Sequence
  Synthetic Oligonucleotide; GZMB exon 4; Set C
gcugcacagcucugguccgcuug

SEQ ID NO: 14655 - RNA, 33 nt, Artificial Sequence
  Synthetic Oligonucleotide; GZMB exon 4; Set C
gaggggcugcacagcucugguccgcuuggccuu

SEQ ID NO: 14656 - RNA, 31 nt, Artificial Sequence
  Synthetic Oligonucleotide; GZMB exon 4; Set C
aggggcugcacagcucugguccgcuuggccu

SEQ ID NO: 14657 - RNA, 34 nt, Artificial Sequence
  Synthetic Oligonucleotide; GZMB exon 4; Set C
ugaggggcugcacagcucugguccgcuuggccuu

SEQ ID NO: 14658 - RNA, 32 nt, Artificial Sequence
  Synthetic Oligonucleotide; GZMB exon 4; Set C
gaggggcugcacagcucugguccgcuuggccu

SEQ ID NO: 14659 - RNA, 19 nt, Artificial Sequence
  Synthetic Oligonucleotide; GZMB exon 4; Set A
cugcacagcucugguccgc

SEQ ID NO: 14660 - RNA, 33 nt, Artificial Sequence
  Synthetic Oligonucleotide; GZMB exon 4; Set C
ugaggggcugcacagcucugguccgcuuggccu

SEQ ID NO: 14661 - RNA, 20 nt, Artificial Sequence
  Synthetic Oligonucleotide; GZMB exon 4; Set C
gcugcacagcucugguccgc

SEQ ID NO: 14662 - RNA, 18 nt, Artificial Sequence
  Synthetic Oligonucleotide; GZMB exon 4; Set A
cugcacagcucugguccg

SEQ ID NO: 14663 - RNA, 17 nt, Artificial Sequence
  Synthetic Oligonucleotide; GZMB exon 4; Set A
cugcacagcucuggucc

SEQ ID NO: 14664 - RNA, 19 nt, Artificial Sequence
  Synthetic Oligonucleotide; GZMB exon 4; Set A
gcugcacagcucugguccg

SEQ ID NO: 14665 - RNA, 15 nt, Artificial Sequence
  Synthetic Oligonucleotide; GZMB exon 4; Set C
ugcacagcucugguc

SEQ ID NO: 14666 - RNA, 18 nt, Artificial Sequence
  Synthetic Oligonucleotide; GZMB exon 4; Set A
gcugcacagcucuggucc

SEQ ID NO: 14667 - RNA, 16 nt, Artificial Sequence
  Synthetic Oligonucleotide; GZMB exon 4; Set C
cugcacagcucugguc

SEQ ID NO: 14668 - RNA, 15 nt, Artificial Sequence
  Synthetic Oligonucleotide; GZMB exon 4; Set C
cugcacagcucuggu

SEQ ID NO: 14669 - RNA, 17 nt, Artificial Sequence
  Synthetic Oligonucleotide; GZMB exon 4; Set A
gcugcacagcucugguc

SEQ ID NO: 14670 - RNA, 16 nt, Artificial Sequence
  Synthetic Oligonucleotide; GZMB exon 4; Set A
gcugcacagcucuggu

SEQ ID NO: 14671 - RNA, 15 nt, Artificial Sequence
  Synthetic Oligonucleotide; GZMB exon 4; Set C
gcugcacagcucugg

SEQ ID NO: 14672 - RNA, 21 nt, Artificial Sequence
  Synthetic Oligonucleotide; GZMB exon 4; Set C
aggggcugcacagcucugguc

SEQ ID NO: 14673 - RNA, 22 nt, Artificial Sequence
  Synthetic Oligonucleotide; GZMB exon 4; Set C
gaggggcugcacagcucugguc

SEQ ID NO: 14674 - RNA, 15 nt, Artificial Sequence
  Synthetic Oligonucleotide; GZMB exon 4; Set C
ucaccugggccuugu

SEQ ID NO: 14675 - RNA, 16 nt, Artificial Sequence
  Synthetic Oligonucleotide; GZMB exon 4; Set C
uucaccugggccuugu

SEQ ID NO: 14676 - RNA, 15 nt, Artificial Sequence
  Synthetic Oligonucleotide; GZMB exon 4; Set C
uucaccugggccuug

SEQ ID NO: 14677 - RNA, 17 nt, Artificial Sequence
  Synthetic Oligonucleotide; GZMB exon 4; Set A
cuucaccugggccuugu

SEQ ID NO: 14678 - RNA, 16 nt, Artificial Sequence
  Synthetic Oligonucleotide; GZMB exon 4; Set C
cuucaccugggccuug

SEQ ID NO: 14679 - RNA, 15 nt, Artificial Sequence
  Synthetic Oligonucleotide; GZMB exon 4; Set C
cuucaccugggccuu

SEQ ID NO: 14680 - RNA, 28 nt, Artificial Sequence
  Synthetic Oligonucleotide; GZMB exon 4; Set C
gucugcccuggcuucaccugggccuugu

SEQ ID NO: 14681 - RNA, 29 nt, Artificial Sequence
  Synthetic Oligonucleotide; GZMB exon 4; Set C
ugucugcccuggcuucaccugggccuugu

SEQ ID NO: 14682 - RNA, 27 nt, Artificial Sequence
  Synthetic Oligonucleotide; GZMB exon 4; Set C
gucugcccuggcuucaccugggccuug

SEQ ID NO: 14683 - RNA, 28 nt, Artificial Sequence
  Synthetic Oligonucleotide; GZMB exon 4; Set C
ugucugcccuggcuucaccugggccuug

SEQ ID NO: 14684 - RNA, 27 nt, Artificial Sequence
  Synthetic Oligonucleotide; GZMB exon 4; Set C
ugucugcccuggcuucaccugggccuu

SEQ ID NO: 14685 - RNA, 16 nt, Artificial Sequence
  Synthetic Oligonucleotide; GZMB exon 4; Set A
gucugcccuggcuuca

SEQ ID NO: 14686 - RNA, 15 nt, Artificial Sequence
  Synthetic Oligonucleotide; GZMB exon 4; Set C
gucugcccuggcuuc

SEQ ID NO: 14687 - RNA, 17 nt, Artificial Sequence
  Synthetic Oligonucleotide; GZMB exon 4; Set A
ugucugcccuggcuuca

SEQ ID NO: 14688 - RNA, 16 nt, Artificial Sequence
  Synthetic Oligonucleotide; GZMB exon 4; Set C
ugucugcccuggcuuc

SEQ ID NO: 14689 - RNA, 19 nt, Artificial Sequence
  Synthetic Oligonucleotide; GZMB exon 4; Set C
uuucccaggggggccgucu

SEQ ID NO: 14690 - RNA, 20 nt, Artificial Sequence
  Synthetic Oligonucleotide; GZMB exon 4; Set C
uuuucccaggggggccgucu

SEQ ID NO: 14691 - RNA, 18 nt, Artificial Sequence
  Synthetic Oligonucleotide; GZMB exon 4; Set C
uuucccaggggggccguc

SEQ ID NO: 14692 - RNA, 21 nt, Artificial Sequence
  Synthetic Oligonucleotide; GZMB exon 4; Set C
guuuucccaggggggccgucu

SEQ ID NO: 14693 - RNA, 19 nt, Artificial Sequence
  Synthetic Oligonucleotide; GZMB exon 4; Set C
uuuucccaggggggccguc

SEQ ID NO: 14694 - RNA, 17 nt, Artificial Sequence
  Synthetic Oligonucleotide; GZMB exon 4; Set A
uuucccaggggggccgu

SEQ ID NO: 14695 - RNA, 20 nt, Artificial Sequence
  Synthetic Oligonucleotide; GZMB exon 4; Set C
guuuucccaggggggccguc

SEQ ID NO: 14696 - RNA, 18 nt, Artificial Sequence
  Synthetic Oligonucleotide; GZMB exon 4; Set A
uuuucccaggggggccgu

SEQ ID NO: 14697 - RNA, 21 nt, Artificial Sequence
  Synthetic Oligonucleotide; GZMB exon 4; Set C
uguuuucccaggggggccguc

SEQ ID NO: 14698 - RNA, 19 nt, Artificial Sequence
  Synthetic Oligonucleotide; GZMB exon 4; Set C
guuuucccaggggggccgu

SEQ ID NO: 14699 - RNA, 20 nt, Artificial Sequence
  Synthetic Oligonucleotide; GZMB exon 4; Set C
uguuuucccaggggggccgu

SEQ ID NO: 14700 - RNA, 16 nt, Artificial Sequence
  Synthetic Oligonucleotide; GZMB exon 4; Set C
ugugugugaguguuuu

SEQ ID NO: 14701 - RNA, 21 nt, Artificial Sequence
  Synthetic Oligonucleotide; GZMB exon 4; Set C
uguagugugugugaguguuuu

SEQ ID NO: 14702 - RNA, 20 nt, Artificial Sequence
  Synthetic Oligonucleotide; GZMB exon 4; Set C
uguagugugugugaguguuu

SEQ ID NO: 14703 - RNA, 19 nt, Artificial Sequence
  Synthetic Oligonucleotide; GZMB exon 4; Set C
uguagugugugugaguguu

SEQ ID NO: 14704 - RNA, 18 nt, Artificial Sequence
  Synthetic Oligonucleotide; GZMB exon 4; Set C
uguagugugugugagugu

SEQ ID NO: 14705 - RNA, 31 nt, Artificial Sequence
  Synthetic Oligonucleotide; GZMB exon 4; Set A
cuucaccucuuguagugugugugaguguuuu

SEQ ID NO: 14706 - RNA, 30 nt, Artificial Sequence
  Synthetic Oligonucleotide; GZMB exon 4; Set A
cuucaccucuuguagugugugugaguguuu

SEQ ID NO: 14707 - RNA, 29 nt, Artificial Sequence
  Synthetic Oligonucleotide; GZMB exon 4; Set A
cuucaccucuuguagugugugugaguguu

SEQ ID NO: 14708 - RNA, 28 nt, Artificial Sequence
  Synthetic Oligonucleotide; GZMB exon 4; Set A
cuucaccucuuguagugugugugagugu

SEQ ID NO: 14709 - RNA, 37 nt, Artificial Sequence
  Synthetic Oligonucleotide; GZMB exon 4; Set C
ugucaucuucaccucuuguagugugugugaguguuuu

SEQ ID NO: 14710 - RNA, 36 nt, Artificial Sequence
  Synthetic Oligonucleotide; GZMB exon 4; Set C
ugucaucuucaccucuuguagugugugugaguguuu

SEQ ID NO: 14711 - RNA, 32 nt, Artificial Sequence
  Synthetic Oligonucleotide; GZMB exon 4; Set A
cguaauaauggcguaagucagauucgcacuuu

SEQ ID NO: 14712 - RNA, 33 nt, Artificial Sequence
  Synthetic Oligonucleotide; GZMB exon 4; Set A
ucguaauaauggcguaagucagauucgcacuuu

SEQ ID NO: 14713 - RNA, 31 nt, Artificial Sequence
  Synthetic Oligonucleotide; GZMB exon 4; Set A
cguaauaauggcguaagucagauucgcacuu

SEQ ID NO: 14714 - RNA, 32 nt, Artificial Sequence
  Synthetic Oligonucleotide; GZMB exon 4; Set A
ucguaauaauggcguaagucagauucgcacuu

SEQ ID NO: 14715 - RNA, 30 nt, Artificial Sequence
  Synthetic Oligonucleotide; GZMB exon 4; Set A
cguaauaauggcguaagucagauucgcacu

SEQ ID NO: 14716 - RNA, 34 nt, Artificial Sequence
  Synthetic Oligonucleotide; GZMB exon 4; Set A
gucguaauaauggcguaagucagauucgcacuuu

SEQ ID NO: 14717 - RNA, 31 nt, Artificial Sequence
  Synthetic Oligonucleotide; GZMB exon 4; Set A
ucguaauaauggcguaagucagauucgcacu

SEQ ID NO: 14718 - RNA, 33 nt, Artificial Sequence
  Synthetic Oligonucleotide; GZMB exon 4; Set A
gucguaauaauggcguaagucagauucgcacuu

SEQ ID NO: 14719 - RNA, 35 nt, Artificial Sequence
  Synthetic Oligonucleotide; GZMB exon 4; Set C
ugucguaauaauggcguaagucagauucgcacuuu

SEQ ID NO: 14720 - RNA, 29 nt, Artificial Sequence
  Synthetic Oligonucleotide; GZMB exon 4; Set A
cguaauaauggcguaagucagauucgcac

SEQ ID NO: 14721 - RNA, 32 nt, Artificial Sequence
  Synthetic Oligonucleotide; GZMB exon 4; Set A
gucguaauaauggcguaagucagauucgcacu

SEQ ID NO: 14722 - RNA, 34 nt, Artificial Sequence
  Synthetic Oligonucleotide; GZMB exon 4; Set C
ugucguaauaauggcguaagucagauucgcacuu

SEQ ID NO: 14723 - RNA, 36 nt, Artificial Sequence
  Synthetic Oligonucleotide; GZMB exon 4; Set C
cugucguaauaauggcguaagucagauucgcacuuu

SEQ ID NO: 14724 - RNA, 30 nt, Artificial Sequence
  Synthetic Oligonucleotide; GZMB exon 4; Set A
ucguaauaauggcguaagucagauucgcac

SEQ ID NO: 14725 - RNA, 33 nt, Artificial Sequence
  Synthetic Oligonucleotide; GZMB exon 4; Set C
ugucguaauaauggcguaagucagauucgcacu

SEQ ID NO: 14726 - RNA, 35 nt, Artificial Sequence
  Synthetic Oligonucleotide; GZMB exon 4; Set C
cugucguaauaauggcguaagucagauucgcacuu

SEQ ID NO: 14727 - RNA, 31 nt, Artificial Sequence
  Synthetic Oligonucleotide; GZMB exon 4; Set A
gucguaauaauggcguaagucagauucgcac

SEQ ID NO: 14728 - RNA, 34 nt, Artificial Sequence
  Synthetic Oligonucleotide; GZMB exon 4; Set C
cugucguaauaauggcguaagucagauucgcacu

SEQ ID NO: 14729 - RNA, 32 nt, Artificial Sequence
  Synthetic Oligonucleotide; GZMB exon 4; Set A
ugucguaauaauggcguaagucagauucgcac

SEQ ID NO: 14730 - RNA, 33 nt, Artificial Sequence
  Synthetic Oligonucleotide; GZMB exon 4; Set A
cugucguaauaauggcguaagucagauucgcac

SEQ ID NO: 14731 - RNA, 15 nt, Artificial Sequence
  Synthetic Oligonucleotide; GZMB exon 4; Set C
ugucguaauaauggc

SEQ ID NO: 14732 - RNA, 16 nt, Artificial Sequence
  Synthetic Oligonucleotide; GZMB exon 4; Set C
cugucguaauaauggc

SEQ ID NO: 14733 - RNA, 15 nt, Artificial Sequence
  Synthetic Oligonucleotide; GZMB exon 4; Set C
cugucguaauaaugg

SEQ ID NO: 14734 - RNA, 40 nt, Artificial Sequence
  Synthetic Oligonucleotide; GZMB exon 4; Set C
aaucucugggucccccacgcacaacucaaugguacugucg

SEQ ID NO: 14735 - RNA, 15 nt, Artificial Sequence
  Synthetic Oligonucleotide; GZMB exon 4; Set C
aaaggaagucuuuuu

SEQ ID NO: 14736 - RNA, 16 nt, Artificial Sequence
  Synthetic Oligonucleotide; GZMB exon 4; Set C
uaaaggaagucuuuuu

SEQ ID NO: 14737 - RNA, 17 nt, Artificial Sequence
  Synthetic Oligonucleotide; GZMB exon 4; Set C
uuaaaggaagucuuuuu

SEQ ID NO: 14738 - RNA, 15 nt, Artificial Sequence
  Synthetic Oligonucleotide; GZMB exon 4; Set C
uaaaggaagucuuuu

SEQ ID NO: 14739 - RNA, 16 nt, Artificial Sequence
  Synthetic Oligonucleotide; GZMB exon 4; Set C
uuaaaggaagucuuuu

SEQ ID NO: 14740 - RNA, 29 nt, Artificial Sequence
  Synthetic Oligonucleotide; GZMB exon 4; Set C
agucuuaccuuaaaggaagucuuuuuaau

SEQ ID NO: 14741 - RNA, 30 nt, Artificial Sequence
  Synthetic Oligonucleotide; GZMB exon 4; Set C
uagucuuaccuuaaaggaagucuuuuuaau

SEQ ID NO: 14742 - RNA, 28 nt, Artificial Sequence
  Synthetic Oligonucleotide; GZMB exon 4; Set C
agucuuaccuuaaaggaagucuuuuuaa

SEQ ID NO: 14743 - RNA, 29 nt, Artificial Sequence
  Synthetic Oligonucleotide; GZMB exon 4; Set C
uagucuuaccuuaaaggaagucuuuuuaa

SEQ ID NO: 14744 - RNA, 27 nt, Artificial Sequence
  Synthetic Oligonucleotide; GZMB exon 4; Set C
agucuuaccuuaaaggaagucuuuuua

SEQ ID NO: 14745 - RNA, 28 nt, Artificial Sequence
  Synthetic Oligonucleotide; GZMB exon 4; Set C
uagucuuaccuuaaaggaagucuuuuua

SEQ ID NO: 14746 - RNA, 26 nt, Artificial Sequence
  Synthetic Oligonucleotide; GZMB exon 4; Set C
agucuuaccuuaaaggaagucuuuuu

SEQ ID NO: 14747 - RNA, 29 nt, Artificial Sequence
  Synthetic Oligonucleotide; GZMB exon 4; Set C
auagucuuaccuuaaaggaagucuuuuua

SEQ ID NO: 14748 - RNA, 31 nt, Artificial Sequence
  Synthetic Oligonucleotide; GZMB exon 4; Set C
cauagucuuaccuuaaaggaagucuuuuuaa

SEQ ID NO: 14749 - RNA, 27 nt, Artificial Sequence
  Synthetic Oligonucleotide; GZMB exon 4; Set C
uagucuuaccuuaaaggaagucuuuuu

SEQ ID NO: 14750 - RNA, 25 nt, Artificial Sequence
  Synthetic Oligonucleotide; GZMB exon 4; Set C
agucuuaccuuaaaggaagucuuuu

SEQ ID NO: 14751 - RNA, 30 nt, Artificial Sequence
  Synthetic Oligonucleotide; GZMB exon 4; Set C
cauagucuuaccuuaaaggaagucuuuuua

SEQ ID NO: 14752 - RNA, 28 nt, Artificial Sequence
  Synthetic Oligonucleotide; GZMB exon 4; Set C
auagucuuaccuuaaaggaagucuuuuu

SEQ ID NO: 14753 - RNA, 26 nt, Artificial Sequence
  Synthetic Oligonucleotide; GZMB exon 4; Set C
uagucuuaccuuaaaggaagucuuuu

SEQ ID NO: 14754 - RNA, 29 nt, Artificial Sequence
  Synthetic Oligonucleotide; GZMB exon 4; Set C
cauagucuuaccuuaaaggaagucuuuuu

SEQ ID NO: 14755 - RNA, 27 nt, Artificial Sequence
  Synthetic Oligonucleotide; GZMB exon 4; Set C
auagucuuaccuuaaaggaagucuuuu

SEQ ID NO: 14756 - RNA, 28 nt, Artificial Sequence
  Synthetic Oligonucleotide; GZMB exon 4; Set C
cauagucuuaccuuaaaggaagucuuuu

SEQ ID NO: 14757 - RNA, 20 nt, Artificial Sequence
  Synthetic Oligonucleotide; GZMB exon 4; Set C
agucuuaccuuaaaggaagu

SEQ ID NO: 14758 - RNA, 21 nt, Artificial Sequence
  Synthetic Oligonucleotide; GZMB exon 4; Set C
uagucuuaccuuaaaggaagu

SEQ ID NO: 14759 - RNA, 19 nt, Artificial Sequence
  Synthetic Oligonucleotide; GZMB exon 4; Set C
agucuuaccuuaaaggaag

SEQ ID NO: 14760 - RNA, 22 nt, Artificial Sequence
  Synthetic Oligonucleotide; GZMB exon 4; Set C
auagucuuaccuuaaaggaagu

SEQ ID NO: 14761 - RNA, 20 nt, Artificial Sequence
  Synthetic Oligonucleotide; GZMB exon 4; Set C
uagucuuaccuuaaaggaag

SEQ ID NO: 14762 - RNA, 18 nt, Artificial Sequence
  Synthetic Oligonucleotide; GZMB exon 4; Set C
agucuuaccuuaaaggaa

SEQ ID NO: 14763 - RNA, 23 nt, Artificial Sequence
  Synthetic Oligonucleotide; GZMB exon 4; Set C
cauagucuuaccuuaaaggaagu

SEQ ID NO: 14764 - RNA, 21 nt, Artificial Sequence
  Synthetic Oligonucleotide; GZMB exon 4; Set C
auagucuuaccuuaaaggaag

SEQ ID NO: 14765 - RNA, 19 nt, Artificial Sequence
  Synthetic Oligonucleotide; GZMB exon 4; Set C
uagucuuaccuuaaaggaa

SEQ ID NO: 14766 - RNA, 20 nt, Artificial Sequence
  Synthetic Oligonucleotide; GZMB exon 4; Set C
auagucuuaccuuaaaggaa

SEQ ID NO: 14767 - RNA, 22 nt, Artificial Sequence
  Synthetic Oligonucleotide; GZMB exon 4; Set C
cauagucuuaccuuaaaggaag

SEQ ID NO: 14768 - RNA, 21 nt, Artificial Sequence
  Synthetic Oligonucleotide; GZMB exon 4; Set C
cauagucuuaccuuaaaggaa

SEQ ID NO: 14769 - RNA, 16 nt, Artificial Sequence
  Synthetic Oligonucleotide; GZMB exon 4; Set C
auagucuuaccuuaaa

SEQ ID NO: 14770 - RNA, 17 nt, Artificial Sequence
  Synthetic Oligonucleotide; GZMB exon 4; Set C
cauagucuuaccuuaaa

SEQ ID NO: 14771 - RNA, 16 nt, Artificial Sequence
  Synthetic Oligonucleotide; GZMB exon 4; Set C
cauagucuuaccuuaa

SEQ ID NO: 14772 - RNA, 16 nt, Artificial Sequence
  Synthetic Oligonucleotide; GZMB exon 4; Set C
cagccaacgaacuucu

SEQ ID NO: 14773 - RNA, 31 nt, Artificial Sequence
  Synthetic Oligonucleotide; GZMB exon 4; Set A
aagaaaguccaggucagccaacgaacuucug

SEQ ID NO: 14774 - RNA, 32 nt, Artificial Sequence
  Synthetic Oligonucleotide; GZMB exon 4; Set A
caagaaaguccaggucagccaacgaacuucug

SEQ ID NO: 14775 - RNA, 30 nt, Artificial Sequence
  Synthetic Oligonucleotide; GZMB exon 4; Set A
aagaaaguccaggucagccaacgaacuucu

SEQ ID NO: 14776 - RNA, 31 nt, Artificial Sequence
  Synthetic Oligonucleotide; GZMB exon 4; Set A
caagaaaguccaggucagccaacgaacuucu

SEQ ID NO: 14777 - RNA, 37 nt, Artificial Sequence
  Synthetic Oligonucleotide; GZMB exon 4; Set C
gaggcaagaaaguccaggucagccaacgaacuucugg

SEQ ID NO: 14778 - RNA, 36 nt, Artificial Sequence
  Synthetic Oligonucleotide; GZMB exon 4; Set C
gaggcaagaaaguccaggucagccaacgaacuucug

SEQ ID NO: 14779 - RNA, 37 nt, Artificial Sequence
  Synthetic Oligonucleotide; GZMB exon 4; Set C
agaggcaagaaaguccaggucagccaacgaacuucug

SEQ ID NO: 14780 - RNA, 38 nt, Artificial Sequence
  Synthetic Oligonucleotide; GZMB exon 4; Set C
aagaggcaagaaaguccaggucagccaacgaacuucug

SEQ ID NO: 14781 - RNA, 36 nt, Artificial Sequence
  Synthetic Oligonucleotide; GZMB exon 4; Set C
agaggcaagaaaguccaggucagccaacgaacuucu

SEQ ID NO: 14782 - RNA, 39 nt, Artificial Sequence
  Synthetic Oligonucleotide; GZMB exon 4; Set C
gaagaggcaagaaaguccaggucagccaacgaacuucug

SEQ ID NO: 14783 - RNA, 37 nt, Artificial Sequence
  Synthetic Oligonucleotide; GZMB exon 4; Set C
aagaggcaagaaaguccaggucagccaacgaacuucu

SEQ ID NO: 14784 - RNA, 22 nt, Artificial Sequence
  Synthetic Oligonucleotide; GZMB exon 4; Set C
aagaaaguccaggucagccaac

SEQ ID NO: 14785 - RNA, 38 nt, Artificial Sequence
  Synthetic Oligonucleotide; GZMB exon 4; Set C
gaagaggcaagaaaguccaggucagccaacgaacuucu

SEQ ID NO: 14786 - RNA, 23 nt, Artificial Sequence
  Synthetic Oligonucleotide; GZMB exon 4; Set A
caagaaaguccaggucagccaac

SEQ ID NO: 14787 - RNA, 27 nt, Artificial Sequence
  Synthetic Oligonucleotide; GZMB exon 4; Set A
gaggcaagaaaguccaggucagccaac

SEQ ID NO: 14788 - RNA, 28 nt, Artificial Sequence
  Synthetic Oligonucleotide; GZMB exon 4; Set A
agaggcaagaaaguccaggucagccaac

SEQ ID NO: 14789 - RNA, 29 nt, Artificial Sequence
  Synthetic Oligonucleotide; GZMB exon 4; Set A
aagaggcaagaaaguccaggucagccaac

SEQ ID NO: 14790 - RNA, 15 nt, Artificial Sequence
  Synthetic Oligonucleotide; GZMB exon 4; Set C
caagaaaguccaggu

SEQ ID NO: 14791 - RNA, 22 nt, Artificial Sequence
  Synthetic Oligonucleotide; GZMB exon 4; Set C
gaggcaagaaaguccaggucag

SEQ ID NO: 14792 - RNA, 21 nt, Artificial Sequence
  Synthetic Oligonucleotide; GZMB exon 4; Set C
gaggcaagaaaguccagguca

SEQ ID NO: 14793 - RNA, 23 nt, Artificial Sequence
  Synthetic Oligonucleotide; GZMB exon 4; Set C
agaggcaagaaaguccaggucag

SEQ ID NO: 14794 - RNA, 20 nt, Artificial Sequence
  Synthetic Oligonucleotide; GZMB exon 4; Set C
gaggcaagaaaguccagguc

SEQ ID NO: 14795 - RNA, 21 nt, Artificial Sequence
  Synthetic Oligonucleotide; GZMB exon 4; Set C
agaggcaagaaaguccagguc

SEQ ID NO: 14796 - RNA, 19 nt, Artificial Sequence
  Synthetic Oligonucleotide; GZMB exon 4; Set C
gaggcaagaaaguccaggu

SEQ ID NO: 14797 - RNA, 20 nt, Artificial Sequence
  Synthetic Oligonucleotide; GZMB exon 4; Set C
agaggcaagaaaguccaggu

SEQ ID NO: 14798 - RNA, 30 nt, Artificial Sequence
  Synthetic Oligonucleotide; GZMB exon 4; Set C
cuuucucuccagcugguggggaagaggcaa

SEQ ID NO: 14799 - RNA, 31 nt, Artificial Sequence
  Synthetic Oligonucleotide; GZMB exon 4; Set C
ccuuucucuccagcugguggggaagaggcaa

SEQ ID NO: 14800 - RNA, 35 nt, Artificial Sequence
  Synthetic Oligonucleotide; GZMB exon 4; Set C
uggccuuucucuccagcugguggggaagaggcaag

SEQ ID NO: 14801 - RNA, 26 nt, Artificial Sequence
  Synthetic Oligonucleotide; GZMB exon 4; Set A
cuuucucuccagcugguggggaagag

SEQ ID NO: 14802 - RNA, 25 nt, Artificial Sequence
  Synthetic Oligonucleotide; GZMB exon 4; Set C
cuuucucuccagcugguggggaaga

SEQ ID NO: 14803 - RNA, 27 nt, Artificial Sequence
  Synthetic Oligonucleotide; GZMB exon 4; Set C
ccuuucucuccagcugguggggaagag

SEQ ID NO: 14804 - RNA, 26 nt, Artificial Sequence
  Synthetic Oligonucleotide; GZMB exon 4; Set C
ccuuucucuccagcugguggggaaga

SEQ ID NO: 14805 - RNA, 27 nt, Artificial Sequence
  Synthetic Oligonucleotide; GZMB exon 4; Set C
uggccuuucucuccagcugguggggaa

SEQ ID NO: 14806 - RNA, 26 nt, Artificial Sequence
  Synthetic Oligonucleotide; GZMB exon 4; Set C
uggccuuucucuccagcuggugggga

SEQ ID NO: 14807 - RNA, 25 nt, Artificial Sequence
  Synthetic Oligonucleotide; GZMB exon 4; Set C
uggccuuucucuccagcuggugggg

SEQ ID NO: 14808 - RNA, 17 nt, Artificial Sequence
  Synthetic Oligonucleotide; GZMB exon 4; Set C
cuuucucuccagcuggu

SEQ ID NO: 14809 - RNA, 24 nt, Artificial Sequence
  Synthetic Oligonucleotide; GZMB exon 4; Set C
uggccuuucucuccagcugguggg

SEQ ID NO: 14810 - RNA, 18 nt, Artificial Sequence
  Synthetic Oligonucleotide; GZMB exon 4; Set C
ccuuucucuccagcuggu

SEQ ID NO: 14811 - RNA, 16 nt, Artificial Sequence
  Synthetic Oligonucleotide; GZMB exon 4; Set C
cuuucucuccagcugg

SEQ ID NO: 14812 - RNA, 23 nt, Artificial Sequence
  Synthetic Oligonucleotide; GZMB exon 4; Set C
uggccuuucucuccagcuggugg

SEQ ID NO: 14813 - RNA, 17 nt, Artificial Sequence
  Synthetic Oligonucleotide; GZMB exon 4; Set C
ccuuucucuccagcugg

SEQ ID NO: 14814 - RNA, 15 nt, Artificial Sequence
  Synthetic Oligonucleotide; GZMB exon 4; Set C
cuuucucuccagcug

SEQ ID NO: 14815 - RNA, 22 nt, Artificial Sequence
  Synthetic Oligonucleotide; GZMB exon 4; Set A
uggccuuucucuccagcuggug

SEQ ID NO: 14816 - RNA, 16 nt, Artificial Sequence
  Synthetic Oligonucleotide; GZMB exon 4; Set C
ccuuucucuccagcug

SEQ ID NO: 14817 - RNA, 15 nt, Artificial Sequence
  Synthetic Oligonucleotide; GZMB exon 4; Set C
ccuuucucuccagcu

SEQ ID NO: 14818 - RNA, 40 nt, Artificial Sequence
  Synthetic Oligonucleotide; GZMB exon 4; Set C
cucugguccgcuuggccuuucucuccagcugguggggaag

SEQ ID NO: 14819 - RNA, 39 nt, Artificial Sequence
  Synthetic Oligonucleotide; GZMB exon 4; Set C
cucugguccgcuuggccuuucucuccagcugguggggaa

SEQ ID NO: 14820 - RNA, 38 nt, Artificial Sequence
  Synthetic Oligonucleotide; GZMB exon 4; Set C
cucugguccgcuuggccuuucucuccagcuggugggga

SEQ ID NO: 14821 - RNA, 37 nt, Artificial Sequence
  Synthetic Oligonucleotide; GZMB exon 4; Set C
cucugguccgcuuggccuuucucuccagcuggugggg

SEQ ID NO: 14822 - RNA, 36 nt, Artificial Sequence
  Synthetic Oligonucleotide; GZMB exon 4; Set C
cucugguccgcuuggccuuucucuccagcugguggg

SEQ ID NO: 14823 - RNA, 35 nt, Artificial Sequence
  Synthetic Oligonucleotide; GZMB exon 4; Set C
cucugguccgcuuggccuuucucuccagcuggugg

SEQ ID NO: 14824 - RNA, 34 nt, Artificial Sequence
  Synthetic Oligonucleotide; GZMB exon 4; Set C
cucugguccgcuuggccuuucucuccagcuggug

SEQ ID NO: 14825 - RNA, 33 nt, Artificial Sequence
  Synthetic Oligonucleotide; GZMB exon 4; Set C
cucugguccgcuuggccuuucucuccagcuggu

SEQ ID NO: 14826 - RNA, 32 nt, Artificial Sequence
  Synthetic Oligonucleotide; GZMB exon 4; Set C
cucugguccgcuuggccuuucucuccagcugg

SEQ ID NO: 14827 - RNA, 31 nt, Artificial Sequence
  Synthetic Oligonucleotide; GZMB exon 4; Set C
cucugguccgcuuggccuuucucuccagcug

SEQ ID NO: 14828 - RNA, 30 nt, Artificial Sequence
  Synthetic Oligonucleotide; GZMB exon 4; Set C
cucugguccgcuuggccuuucucuccagcu

SEQ ID NO: 14829 - RNA, 29 nt, Artificial Sequence
  Synthetic Oligonucleotide; GZMB exon 4; Set C
cucugguccgcuuggccuuucucuccagc

SEQ ID NO: 14830 - RNA, 24 nt, Artificial Sequence
  Synthetic Oligonucleotide; GZMB exon 4; Set C
cucugguccgcuuggccuuucucu

SEQ ID NO: 14831 - RNA, 15 nt, Artificial Sequence
  Synthetic Oligonucleotide; GZMB exon 4; Set A
ugguccgcuuggccu

SEQ ID NO: 14832 - RNA, 20 nt, Artificial Sequence
  Synthetic Oligonucleotide; GZMB exon 4; Set A
cucugguccgcuuggccuuu

SEQ ID NO: 14833 - RNA, 16 nt, Artificial Sequence
  Synthetic Oligonucleotide; GZMB exon 4; Set A
cugguccgcuuggccu

SEQ ID NO: 14834 - RNA, 21 nt, Artificial Sequence
  Synthetic Oligonucleotide; GZMB exon 4; Set C
gcucugguccgcuuggccuuu

SEQ ID NO: 14835 - RNA, 17 nt, Artificial Sequence
  Synthetic Oligonucleotide; GZMB exon 4; Set A
ucugguccgcuuggccu

SEQ ID NO: 14836 - RNA, 24 nt, Artificial Sequence
  Synthetic Oligonucleotide; GZMB exon 4; Set C
cacagcucugguccgcuuggccuu

SEQ ID NO: 14837 - RNA, 23 nt, Artificial Sequence
  Synthetic Oligonucleotide; GZMB exon 4; Set C
cacagcucugguccgcuuggccu

SEQ ID NO: 14838 - RNA, 27 nt, Artificial Sequence
  Synthetic Oligonucleotide; GZMB exon 4; Set C
cugcacagcucugguccgcuuggccuu

SEQ ID NO: 14839 - RNA, 28 nt, Artificial Sequence
  Synthetic Oligonucleotide; GZMB exon 4; Set C
gcugcacagcucugguccgcuuggccuu

SEQ ID NO: 14840 - RNA, 26 nt, Artificial Sequence
  Synthetic Oligonucleotide; GZMB exon 4; Set C
cugcacagcucugguccgcuuggccu

SEQ ID NO: 14841 - RNA, 22 nt, Artificial Sequence
  Synthetic Oligonucleotide; GZMB exon 4; Set C
gcacagcucugguccgcuuggc

SEQ ID NO: 14842 - RNA, 27 nt, Artificial Sequence
  Synthetic Oligonucleotide; GZMB exon 4; Set C
gcugcacagcucugguccgcuuggccu

SEQ ID NO: 14843 - RNA, 21 nt, Artificial Sequence
  Synthetic Oligonucleotide; GZMB exon 4; Set C
gcacagcucugguccgcuugg

SEQ ID NO: 14844 - RNA, 23 nt, Artificial Sequence
  Synthetic Oligonucleotide; GZMB exon 4; Set C
ugcacagcucugguccgcuuggc

SEQ ID NO: 14845 - RNA, 22 nt, Artificial Sequence
  Synthetic Oligonucleotide; GZMB exon 4; Set C
ugcacagcucugguccgcuugg

SEQ ID NO: 14846 - RNA, 29 nt, Artificial Sequence
  Synthetic Oligonucleotide; GZMB exon 4; Set C
aggggcugcacagcucugguccgcuuggc

SEQ ID NO: 14847 - RNA, 28 nt, Artificial Sequence
  Synthetic Oligonucleotide; GZMB exon 4; Set C
aggggcugcacagcucugguccgcuugg

SEQ ID NO: 14848 - RNA, 30 nt, Artificial Sequence
  Synthetic Oligonucleotide; GZMB exon 4; Set C
gaggggcugcacagcucugguccgcuuggc

SEQ ID NO: 14849 - RNA, 29 nt, Artificial Sequence
  Synthetic Oligonucleotide; GZMB exon 4; Set C
gaggggcugcacagcucugguccgcuugg

SEQ ID NO: 14850 - RNA, 31 nt, Artificial Sequence
  Synthetic Oligonucleotide; GZMB exon 4; Set C
ugaggggcugcacagcucugguccgcuuggc

SEQ ID NO: 14851 - RNA, 30 nt, Artificial Sequence
  Synthetic Oligonucleotide; GZMB exon 4; Set C
ugaggggcugcacagcucugguccgcuugg

SEQ ID NO: 14852 - RNA, 16 nt, Artificial Sequence
  Synthetic Oligonucleotide; GZMB exon 4; Set A
aggggcugcacagcuc

SEQ ID NO: 14853 - RNA, 17 nt, Artificial Sequence
  Synthetic Oligonucleotide; GZMB exon 4; Set A
gaggggcugcacagcuc

SEQ ID NO: 14854 - RNA, 18 nt, Artificial Sequence
  Synthetic Oligonucleotide; GZMB exon 4; Set A
ugaggggcugcacagcuc

SEQ ID NO: 14855 - RNA, 40 nt, Artificial Sequence
  Synthetic Oligonucleotide; GZMB exon 4; Set C
uguugcuagguagccugaggggcugcacagcucugguccg

SEQ ID NO: 14856 - RNA, 39 nt, Artificial Sequence
  Synthetic Oligonucleotide; GZMB exon 4; Set C
uguugcuagguagccugaggggcugcacagcucuggucc

SEQ ID NO: 14857 - RNA, 40 nt, Artificial Sequence
  Synthetic Oligonucleotide; GZMB exon 4; Set C
uuguugcuagguagccugaggggcugcacagcucuggucc

SEQ ID NO: 14858 - RNA, 38 nt, Artificial Sequence
  Synthetic Oligonucleotide; GZMB exon 4; Set C
uguugcuagguagccugaggggcugcacagcucugguc

SEQ ID NO: 14859 - RNA, 37 nt, Artificial Sequence
  Synthetic Oligonucleotide; GZMB exon 4; Set C
uguugcuagguagccugaggggcugcacagcucuggu

SEQ ID NO: 14860 - RNA, 39 nt, Artificial Sequence
  Synthetic Oligonucleotide; GZMB exon 4; Set C
uuguugcuagguagccugaggggcugcacagcucugguc

SEQ ID NO: 14861 - RNA, 36 nt, Artificial Sequence
  Synthetic Oligonucleotide; GZMB exon 4; Set C
uguugcuagguagccugaggggcugcacagcucugg

SEQ ID NO: 14862 - RNA, 38 nt, Artificial Sequence
  Synthetic Oligonucleotide; GZMB exon 4; Set C
uuguugcuagguagccugaggggcugcacagcucuggu

SEQ ID NO: 14863 - RNA, 40 nt, Artificial Sequence
  Synthetic Oligonucleotide; GZMB exon 4; Set C
cuuguugcuagguagccugaggggcugcacagcucugguc

SEQ ID NO: 14864 - RNA, 37 nt, Artificial Sequence
  Synthetic Oligonucleotide; GZMB exon 4; Set C
uuguugcuagguagccugaggggcugcacagcucugg

SEQ ID NO: 14865 - RNA, 39 nt, Artificial Sequence
  Synthetic Oligonucleotide; GZMB exon 4; Set C
cuuguugcuagguagccugaggggcugcacagcucuggu

SEQ ID NO: 14866 - RNA, 35 nt, Artificial Sequence
  Synthetic Oligonucleotide; GZMB exon 4; Set C
uguugcuagguagccugaggggcugcacagcucug

SEQ ID NO: 14867 - RNA, 38 nt, Artificial Sequence
  Synthetic Oligonucleotide; GZMB exon 4; Set C
cuuguugcuagguagccugaggggcugcacagcucugg

SEQ ID NO: 14868 - RNA, 34 nt, Artificial Sequence
  Synthetic Oligonucleotide; GZMB exon 4; Set C
uguugcuagguagccugaggggcugcacagcucu

SEQ ID NO: 14869 - RNA, 36 nt, Artificial Sequence
  Synthetic Oligonucleotide; GZMB exon 4; Set C
uuguugcuagguagccugaggggcugcacagcucug

SEQ ID NO: 14870 - RNA, 35 nt, Artificial Sequence
  Synthetic Oligonucleotide; GZMB exon 4; Set C
uuguugcuagguagccugaggggcugcacagcucu

SEQ ID NO: 14871 - RNA, 37 nt, Artificial Sequence
  Synthetic Oligonucleotide; GZMB exon 4; Set C
cuuguugcuagguagccugaggggcugcacagcucug

SEQ ID NO: 14872 - RNA, 36 nt, Artificial Sequence
  Synthetic Oligonucleotide; GZMB exon 4; Set C
cuuguugcuagguagccugaggggcugcacagcucu

SEQ ID NO: 14873 - RNA, 27 nt, Artificial Sequence
  Synthetic Oligonucleotide; GZMB exon 4; Set C
uguugcuagguagccugaggggcugca

SEQ ID NO: 14874 - RNA, 28 nt, Artificial Sequence
  Synthetic Oligonucleotide; GZMB exon 4; Set C
uuguugcuagguagccugaggggcugca

SEQ ID NO: 14875 - RNA, 26 nt, Artificial Sequence
  Synthetic Oligonucleotide; GZMB exon 4; Set C
uguugcuagguagccugaggggcugc

SEQ ID NO: 14876 - RNA, 29 nt, Artificial Sequence
  Synthetic Oligonucleotide; GZMB exon 4; Set C
cuuguugcuagguagccugaggggcugca

SEQ ID NO: 14877 - RNA, 27 nt, Artificial Sequence
  Synthetic Oligonucleotide; GZMB exon 4; Set C
uuguugcuagguagccugaggggcugc

SEQ ID NO: 14878 - RNA, 28 nt, Artificial Sequence
  Synthetic Oligonucleotide; GZMB exon 4; Set C
cuuguugcuagguagccugaggggcugc

SEQ ID NO: 14879 - RNA, 22 nt, Artificial Sequence
  Synthetic Oligonucleotide; GZMB exon 4; Set A
cuuguugcuagguagccugagg

SEQ ID NO: 14880 - RNA, 39 nt, Artificial Sequence
  Synthetic Oligonucleotide; GZMB exon 4; Set C
ucaccugggccuuguugcuagguagccugaggggcugca

SEQ ID NO: 14881 - RNA, 40 nt, Artificial Sequence
  Synthetic Oligonucleotide; GZMB exon 4; Set C
uucaccugggccuuguugcuagguagccugaggggcugca

SEQ ID NO: 14882 - RNA, 38 nt, Artificial Sequence
  Synthetic Oligonucleotide; GZMB exon 4; Set C
ucaccugggccuuguugcuagguagccugaggggcugc

SEQ ID NO: 14883 - RNA, 39 nt, Artificial Sequence
  Synthetic Oligonucleotide; GZMB exon 4; Set C
uucaccugggccuuguugcuagguagccugaggggcugc

SEQ ID NO: 14884 - RNA, 40 nt, Artificial Sequence
  Synthetic Oligonucleotide; GZMB exon 4; Set C
cuucaccugggccuuguugcuagguagccugaggggcugc

SEQ ID NO: 14885 - RNA, 32 nt, Artificial Sequence
  Synthetic Oligonucleotide; GZMB exon 4; Set C
ucaccugggccuuguugcuagguagccugagg

SEQ ID NO: 14886 - RNA, 33 nt, Artificial Sequence
  Synthetic Oligonucleotide; GZMB exon 4; Set C
uucaccugggccuuguugcuagguagccugagg

SEQ ID NO: 14887 - RNA, 31 nt, Artificial Sequence
  Synthetic Oligonucleotide; GZMB exon 4; Set C
ucaccugggccuuguugcuagguagccugag

SEQ ID NO: 14888 - RNA, 34 nt, Artificial Sequence
  Synthetic Oligonucleotide; GZMB exon 4; Set C
cuucaccugggccuuguugcuagguagccugagg

SEQ ID NO: 14889 - RNA, 32 nt, Artificial Sequence
  Synthetic Oligonucleotide; GZMB exon 4; Set C
uucaccugggccuuguugcuagguagccugag

SEQ ID NO: 14890 - RNA, 31 nt, Artificial Sequence
  Synthetic Oligonucleotide; GZMB exon 4; Set C
uucaccugggccuuguugcuagguagccuga

SEQ ID NO: 14891 - RNA, 33 nt, Artificial Sequence
  Synthetic Oligonucleotide; GZMB exon 4; Set C
cuucaccugggccuuguugcuagguagccugag

SEQ ID NO: 14892 - RNA, 32 nt, Artificial Sequence
  Synthetic Oligonucleotide; GZMB exon 4; Set C
cuucaccugggccuuguugcuagguagccuga

SEQ ID NO: 14893 - RNA, 16 nt, Artificial Sequence
  Synthetic Oligonucleotide; GZMB exon 4; Set C
ucaccugggccuuguu

SEQ ID NO: 14894 - RNA, 17 nt, Artificial Sequence
  Synthetic Oligonucleotide; GZMB exon 4; Set C
uucaccugggccuuguu

SEQ ID NO: 14895 - RNA, 18 nt, Artificial Sequence
  Synthetic Oligonucleotide; GZMB exon 4; Set A
cuucaccugggccuuguu

SEQ ID NO: 14896 - RNA, 27 nt, Artificial Sequence
  Synthetic Oligonucleotide; GZMB exon 4; Set C
ucugcccuggcuucaccugggccuugu

SEQ ID NO: 14897 - RNA, 26 nt, Artificial Sequence
  Synthetic Oligonucleotide; GZMB exon 4; Set C
ucugcccuggcuucaccugggccuug

SEQ ID NO: 14898 - RNA, 25 nt, Artificial Sequence
  Synthetic Oligonucleotide; GZMB exon 4; Set C
ucugcccuggcuucaccugggccuu

SEQ ID NO: 14899 - RNA, 26 nt, Artificial Sequence
  Synthetic Oligonucleotide; GZMB exon 4; Set C
gucugcccuggcuucaccugggccuu

SEQ ID NO: 14900 - RNA, 15 nt, Artificial Sequence
  Synthetic Oligonucleotide; GZMB exon 4; Set C
ucugcccuggcuuca

SEQ ID NO: 14901 - RNA, 15 nt, Artificial Sequence
  Synthetic Oligonucleotide; GZMB exon 4; Set C
ugucugcccuggcuu

SEQ ID NO: 14902 - RNA, 32 nt, Artificial Sequence
  Synthetic Oligonucleotide; GZMB exon 4; Set C
gccggccacacugcaugucugcccuggcuuca

SEQ ID NO: 14903 - RNA, 31 nt, Artificial Sequence
  Synthetic Oligonucleotide; GZMB exon 4; Set C
gccggccacacugcaugucugcccuggcuuc

SEQ ID NO: 14904 - RNA, 33 nt, Artificial Sequence
  Synthetic Oligonucleotide; GZMB exon 4; Set C
agccggccacacugcaugucugcccuggcuuca

SEQ ID NO: 14905 - RNA, 32 nt, Artificial Sequence
  Synthetic Oligonucleotide; GZMB exon 4; Set C
agccggccacacugcaugucugcccuggcuuc

SEQ ID NO: 14906 - RNA, 31 nt, Artificial Sequence
  Synthetic Oligonucleotide; GZMB exon 4; Set C
agccggccacacugcaugucugcccuggcuu

SEQ ID NO: 14907 - RNA, 40 nt, Artificial Sequence
  Synthetic Oligonucleotide; GZMB exon 4; Set C
ucugcccccagccggccacacugcaugucugcccuggcuu

SEQ ID NO: 14908 - RNA, 20 nt, Artificial Sequence
  Synthetic Oligonucleotide; GZMB exon 4; Set C
gccggccacacugcaugucu

SEQ ID NO: 14909 - RNA, 19 nt, Artificial Sequence
  Synthetic Oligonucleotide; GZMB exon 4; Set C
gccggccacacugcauguc

SEQ ID NO: 14910 - RNA, 21 nt, Artificial Sequence
  Synthetic Oligonucleotide; GZMB exon 4; Set C
agccggccacacugcaugucu

SEQ ID NO: 14911 - RNA, 20 nt, Artificial Sequence
  Synthetic Oligonucleotide; GZMB exon 4; Set C
agccggccacacugcauguc

SEQ ID NO: 14912 - RNA, 18 nt, Artificial Sequence
  Synthetic Oligonucleotide; GZMB exon 4; Set C
gccggccacacugcaugu

SEQ ID NO: 14913 - RNA, 19 nt, Artificial Sequence
  Synthetic Oligonucleotide; GZMB exon 4; Set C
agccggccacacugcaugu

SEQ ID NO: 14914 - RNA, 30 nt, Artificial Sequence
  Synthetic Oligonucleotide; GZMB exon 4; Set C
ucugcccccagccggccacacugcaugucu

SEQ ID NO: 14915 - RNA, 29 nt, Artificial Sequence
  Synthetic Oligonucleotide; GZMB exon 4; Set C
ucugcccccagccggccacacugcauguc

SEQ ID NO: 14916 - RNA, 31 nt, Artificial Sequence
  Synthetic Oligonucleotide; GZMB exon 4; Set C
gucugcccccagccggccacacugcaugucu

SEQ ID NO: 14917 - RNA, 30 nt, Artificial Sequence
  Synthetic Oligonucleotide; GZMB exon 4; Set C
gucugcccccagccggccacacugcauguc

SEQ ID NO: 14918 - RNA, 32 nt, Artificial Sequence
  Synthetic Oligonucleotide; GZMB exon 4; Set C
cgucugcccccagccggccacacugcaugucu

SEQ ID NO: 14919 - RNA, 29 nt, Artificial Sequence
  Synthetic Oligonucleotide; GZMB exon 4; Set C
gucugcccccagccggccacacugcaugu

SEQ ID NO: 14920 - RNA, 31 nt, Artificial Sequence
  Synthetic Oligonucleotide; GZMB exon 4; Set C
cgucugcccccagccggccacacugcauguc

SEQ ID NO: 14921 - RNA, 30 nt, Artificial Sequence
  Synthetic Oligonucleotide; GZMB exon 4; Set C
cgucugcccccagccggccacacugcaugu

SEQ ID NO: 14922 - RNA, 15 nt, Artificial Sequence
  Synthetic Oligonucleotide; GZMB exon 4; Set A
cgucugcccccagcc

SEQ ID NO: 14923 - RNA, 29 nt, Artificial Sequence
  Synthetic Oligonucleotide; GZMB exon 4; Set C
uuucccaggggggccgucugcccccagcc

SEQ ID NO: 14924 - RNA, 28 nt, Artificial Sequence
  Synthetic Oligonucleotide; GZMB exon 4; Set C
uuucccaggggggccgucugcccccagc

SEQ ID NO: 14925 - RNA, 30 nt, Artificial Sequence
  Synthetic Oligonucleotide; GZMB exon 4; Set C
uuuucccaggggggccgucugcccccagcc

SEQ ID NO: 14926 - RNA, 29 nt, Artificial Sequence
  Synthetic Oligonucleotide; GZMB exon 4; Set C
uuuucccaggggggccgucugcccccagc

SEQ ID NO: 14927 - RNA, 31 nt, Artificial Sequence
  Synthetic Oligonucleotide; GZMB exon 4; Set C
guuuucccaggggggccgucugcccccagcc

SEQ ID NO: 14928 - RNA, 30 nt, Artificial Sequence
  Synthetic Oligonucleotide; GZMB exon 4; Set C
guuuucccaggggggccgucugcccccagc

SEQ ID NO: 14929 - RNA, 32 nt, Artificial Sequence
  Synthetic Oligonucleotide; GZMB exon 4; Set C
uguuuucccaggggggccgucugcccccagcc

SEQ ID NO: 14930 - RNA, 31 nt, Artificial Sequence
  Synthetic Oligonucleotide; GZMB exon 4; Set C
uguuuucccaggggggccgucugcccccagc

SEQ ID NO: 14931 - RNA, 15 nt, Artificial Sequence
  Synthetic Oligonucleotide; GZMB exon 4; Set C
uguuuucccaggggg

SEQ ID NO: 14932 - RNA, 30 nt, Artificial Sequence
  Synthetic Oligonucleotide; GZMB exon 4; Set C
ugugugaguguuuucccaggggggccgucu

SEQ ID NO: 14933 - RNA, 31 nt, Artificial Sequence
  Synthetic Oligonucleotide; GZMB exon 4; Set C
gugugugaguguuuucccaggggggccgucu

SEQ ID NO: 14934 - RNA, 29 nt, Artificial Sequence
  Synthetic Oligonucleotide; GZMB exon 4; Set C
ugugugaguguuuucccaggggggccguc

SEQ ID NO: 14935 - RNA, 32 nt, Artificial Sequence
  Synthetic Oligonucleotide; GZMB exon 4; Set C
ugugugugaguguuuucccaggggggccgucu

SEQ ID NO: 14936 - RNA, 30 nt, Artificial Sequence
  Synthetic Oligonucleotide; GZMB exon 4; Set C
gugugugaguguuuucccaggggggccguc

SEQ ID NO: 14937 - RNA, 28 nt, Artificial Sequence
  Synthetic Oligonucleotide; GZMB exon 4; Set C
ugugugaguguuuucccaggggggccgu

SEQ ID NO: 14938 - RNA, 31 nt, Artificial Sequence
  Synthetic Oligonucleotide; GZMB exon 4; Set C
ugugugugaguguuuucccaggggggccguc

SEQ ID NO: 14939 - RNA, 29 nt, Artificial Sequence
  Synthetic Oligonucleotide; GZMB exon 4; Set C
gugugugaguguuuucccaggggggccgu

SEQ ID NO: 14940 - RNA, 30 nt, Artificial Sequence
  Synthetic Oligonucleotide; GZMB exon 4; Set C
ugugugugaguguuuucccaggggggccgu

SEQ ID NO: 14941 - RNA, 37 nt, Artificial Sequence
  Synthetic Oligonucleotide; GZMB exon 4; Set C
uguagugugugugaguguuuucccaggggggccgucu

SEQ ID NO: 14942 - RNA, 38 nt, Artificial Sequence
  Synthetic Oligonucleotide; GZMB exon 4; Set C
uuguagugugugugaguguuuucccaggggggccgucu

SEQ ID NO: 14943 - RNA, 36 nt, Artificial Sequence
  Synthetic Oligonucleotide; GZMB exon 4; Set C
uguagugugugugaguguuuucccaggggggccguc

SEQ ID NO: 14944 - RNA, 39 nt, Artificial Sequence
  Synthetic Oligonucleotide; GZMB exon 4; Set C
cuuguagugugugugaguguuuucccaggggggccgucu

SEQ ID NO: 14945 - RNA, 37 nt, Artificial Sequence
  Synthetic Oligonucleotide; GZMB exon 4; Set C
uuguagugugugugaguguuuucccaggggggccguc

SEQ ID NO: 14946 - RNA, 35 nt, Artificial Sequence
  Synthetic Oligonucleotide; GZMB exon 4; Set C
uguagugugugugaguguuuucccaggggggccgu

SEQ ID NO: 14947 - RNA, 40 nt, Artificial Sequence
  Synthetic Oligonucleotide; GZMB exon 4; Set C
ucuuguagugugugugaguguuuucccaggggggccgucu

SEQ ID NO: 14948 - RNA, 38 nt, Artificial Sequence
  Synthetic Oligonucleotide; GZMB exon 4; Set C
cuuguagugugugugaguguuuucccaggggggccguc

SEQ ID NO: 14949 - RNA, 39 nt, Artificial Sequence
  Synthetic Oligonucleotide; GZMB exon 4; Set C
ucuuguagugugugugaguguuuucccaggggggccguc

SEQ ID NO: 14950 - RNA, 37 nt, Artificial Sequence
  Synthetic Oligonucleotide; GZMB exon 4; Set C
cuuguagugugugugaguguuuucccaggggggccgu

SEQ ID NO: 14951 - RNA, 38 nt, Artificial Sequence
  Synthetic Oligonucleotide; GZMB exon 4; Set C
ucuuguagugugugugaguguuuucccaggggggccgu

SEQ ID NO: 14952 - RNA, 15 nt, Artificial Sequence
  Synthetic Oligonucleotide; GZMB exon 4; Set C
gugugugaguguuuu

SEQ ID NO: 14953 - RNA, 27 nt, Artificial Sequence
  Synthetic Oligonucleotide; GZMB exon 4; Set A
uguagugugugugaguguuuucccagg

SEQ ID NO: 14954 - RNA, 15 nt, Artificial Sequence
  Synthetic Oligonucleotide; GZMB exon 4; Set C
ugugugugaguguuu

SEQ ID NO: 14955 - RNA, 19 nt, Artificial Sequence
  Synthetic Oligonucleotide; GZMB exon 4; Set C
uagugugugugaguguuuu

SEQ ID NO: 14956 - RNA, 20 nt, Artificial Sequence
  Synthetic Oligonucleotide; GZMB exon 4; Set C
guagugugugugaguguuuu

SEQ ID NO: 14957 - RNA, 18 nt, Artificial Sequence
  Synthetic Oligonucleotide; GZMB exon 4; Set C
uagugugugugaguguuu

SEQ ID NO: 14958 - RNA, 19 nt, Artificial Sequence
  Synthetic Oligonucleotide; GZMB exon 4; Set C
guagugugugugaguguuu

SEQ ID NO: 14959 - RNA, 22 nt, Artificial Sequence
  Synthetic Oligonucleotide; GZMB exon 4; Set C
uuguagugugugugaguguuuu

SEQ ID NO: 14960 - RNA, 18 nt, Artificial Sequence
  Synthetic Oligonucleotide; GZMB exon 4; Set C
guagugugugugaguguu

SEQ ID NO: 14961 - RNA, 23 nt, Artificial Sequence
  Synthetic Oligonucleotide; GZMB exon 4; Set C
cuuguagugugugugaguguuuu

SEQ ID NO: 14962 - RNA, 21 nt, Artificial Sequence
  Synthetic Oligonucleotide; GZMB exon 4; Set C
uuguagugugugugaguguuu

SEQ ID NO: 14963 - RNA, 17 nt, Artificial Sequence
  Synthetic Oligonucleotide; GZMB exon 4; Set C
guagugugugugagugu

SEQ ID NO: 14964 - RNA, 39 nt, Artificial Sequence
  Synthetic Oligonucleotide; GZMB exon 4; Set C
cuucaccucuuguagugugugugaguguuuucccagggg

SEQ ID NO: 14965 - RNA, 24 nt, Artificial Sequence
  Synthetic Oligonucleotide; GZMB exon 4; Set C
ucuuguagugugugugaguguuuu

SEQ ID NO: 14966 - RNA, 22 nt, Artificial Sequence
  Synthetic Oligonucleotide; GZMB exon 4; Set C
cuuguagugugugugaguguuu

SEQ ID NO: 14967 - RNA, 20 nt, Artificial Sequence
  Synthetic Oligonucleotide; GZMB exon 4; Set C
uuguagugugugugaguguu

SEQ ID NO: 14968 - RNA, 38 nt, Artificial Sequence
  Synthetic Oligonucleotide; GZMB exon 4; Set C
cuucaccucuuguagugugugugaguguuuucccaggg

SEQ ID NO: 14969 - RNA, 23 nt, Artificial Sequence
  Synthetic Oligonucleotide; GZMB exon 4; Set C
ucuuguagugugugugaguguuu

SEQ ID NO: 14970 - RNA, 21 nt, Artificial Sequence
  Synthetic Oligonucleotide; GZMB exon 4; Set C
cuuguagugugugugaguguu

SEQ ID NO: 14971 - RNA, 19 nt, Artificial Sequence
  Synthetic Oligonucleotide; GZMB exon 4; Set C
uuguagugugugugagugu

SEQ ID NO: 14972 - RNA, 37 nt, Artificial Sequence
  Synthetic Oligonucleotide; GZMB exon 4; Set C
cuucaccucuuguagugugugugaguguuuucccagg

SEQ ID NO: 14973 - RNA, 22 nt, Artificial Sequence
  Synthetic Oligonucleotide; GZMB exon 4; Set C
ucuuguagugugugugaguguu

SEQ ID NO: 14974 - RNA, 20 nt, Artificial Sequence
  Synthetic Oligonucleotide; GZMB exon 4; Set C
cuuguagugugugugagugu

SEQ ID NO: 14975 - RNA, 21 nt, Artificial Sequence
  Synthetic Oligonucleotide; GZMB exon 4; Set C
ucuuguagugugugugagugu

SEQ ID NO: 14976 - RNA, 35 nt, Artificial Sequence
  Synthetic Oligonucleotide; GZMB exon 4; Set C
ugucaucuucaccucuuguagugugugugaguguu

SEQ ID NO: 14977 - RNA, 34 nt, Artificial Sequence
  Synthetic Oligonucleotide; GZMB exon 4; Set C
ugucaucuucaccucuuguagugugugugagugu

SEQ ID NO: 14978 - RNA, 20 nt, Artificial Sequence
  Synthetic Oligonucleotide; GZMB exon 4; Set C
cuucaccucuuguagugugu

SEQ ID NO: 14979 - RNA, 19 nt, Artificial Sequence
  Synthetic Oligonucleotide; GZMB exon 4; Set C
cuucaccucuuguagugug

SEQ ID NO: 14980 - RNA, 18 nt, Artificial Sequence
  Synthetic Oligonucleotide; GZMB exon 4; Set C
cuucaccucuuguagugu

SEQ ID NO: 14981 - RNA, 26 nt, Artificial Sequence
  Synthetic Oligonucleotide; GZMB exon 4; Set A
ugucaucuucaccucuuguagugugu

SEQ ID NO: 14982 - RNA, 26 nt, Artificial Sequence
  Synthetic Oligonucleotide; GZMB exon 4; Set A
uuucgaucuuccugcacugucaucuu

SEQ ID NO: 14983 - RNA, 27 nt, Artificial Sequence
  Synthetic Oligonucleotide; GZMB exon 4; Set A
cuuucgaucuuccugcacugucaucuu

SEQ ID NO: 14984 - RNA, 28 nt, Artificial Sequence
  Synthetic Oligonucleotide; GZMB exon 4; Set A
acuuucgaucuuccugcacugucaucuu

SEQ ID NO: 14985 - RNA, 29 nt, Artificial Sequence
  Synthetic Oligonucleotide; GZMB exon 4; Set C
cacuuucgaucuuccugcacugucaucuu

SEQ ID NO: 14986 - RNA, 21 nt, Artificial Sequence
  Synthetic Oligonucleotide; GZMB exon 4; Set A
cuuucgaucuuccugcacugu

SEQ ID NO: 14987 - RNA, 22 nt, Artificial Sequence
  Synthetic Oligonucleotide; GZMB exon 4; Set A
acuuucgaucuuccugcacugu

SEQ ID NO: 14988 - RNA, 23 nt, Artificial Sequence
  Synthetic Oligonucleotide; GZMB exon 4; Set A
cacuuucgaucuuccugcacugu

SEQ ID NO: 14989 - RNA, 23 nt, Artificial Sequence
  Synthetic Oligonucleotide; GZMB exon 4; Set A
ggcguaagucagauucgcacuuu

SEQ ID NO: 14990 - RNA, 24 nt, Artificial Sequence
  Synthetic Oligonucleotide; GZMB exon 4; Set A
uggcguaagucagauucgcacuuu

SEQ ID NO: 14991 - RNA, 23 nt, Artificial Sequence
  Synthetic Oligonucleotide; GZMB exon 4; Set A
uggcguaagucagauucgcacuu

SEQ ID NO: 14992 - RNA, 40 nt, Artificial Sequence
  Synthetic Oligonucleotide; GZMB exon 4; Set C
aaugguacugucguaauaauggcguaagucagauucgcac

SEQ ID NO: 14993 - RNA, 23 nt, Artificial Sequence
  Synthetic Oligonucleotide; GZMB exon 4; Set C
aaugguacugucguaauaauggc

SEQ ID NO: 14994 - RNA, 22 nt, Artificial Sequence
  Synthetic Oligonucleotide; GZMB exon 4; Set C
aaugguacugucguaauaaugg

SEQ ID NO: 14995 - RNA, 15 nt, Artificial Sequence
  Synthetic Oligonucleotide; GZMB exon 4; Set C
caaugguacugucgu

SEQ ID NO: 14996 - RNA, 16 nt, Artificial Sequence
  Synthetic Oligonucleotide; GZMB exon 4; Set C
ucaaugguacugucgu

SEQ ID NO: 14997 - RNA, 15 nt, Artificial Sequence
  Synthetic Oligonucleotide; GZMB exon 4; Set C
ucaaugguacugucg

SEQ ID NO: 14998 - RNA, 39 nt, Artificial Sequence
  Synthetic Oligonucleotide; GZMB exon 4; Set C
aaucucugggucccccacgcacaacucaaugguacuguc

SEQ ID NO: 14999 - RNA, 40 nt, Artificial Sequence
  Synthetic Oligonucleotide; GZMB exon 4; Set C
uaaucucugggucccccacgcacaacucaaugguacuguc

SEQ ID NO: 15000 - RNA, 38 nt, Artificial Sequence
  Synthetic Oligonucleotide; GZMB exon 4; Set C
aaucucugggucccccacgcacaacucaaugguacugu

SEQ ID NO: 15001 - RNA, 39 nt, Artificial Sequence
  Synthetic Oligonucleotide; GZMB exon 4; Set C
uaaucucugggucccccacgcacaacucaaugguacugu

SEQ ID NO: 15002 - RNA, 37 nt, Artificial Sequence
  Synthetic Oligonucleotide; GZMB exon 4; Set C
aaucucugggucccccacgcacaacucaaugguacug

SEQ ID NO: 15003 - RNA, 40 nt, Artificial Sequence
  Synthetic Oligonucleotide; GZMB exon 4; Set C
uuaaucucugggucccccacgcacaacucaaugguacugu

SEQ ID NO: 15004 - RNA, 38 nt, Artificial Sequence
  Synthetic Oligonucleotide; GZMB exon 4; Set C
uaaucucugggucccccacgcacaacucaaugguacug

SEQ ID NO: 15005 - RNA, 39 nt, Artificial Sequence
  Synthetic Oligonucleotide; GZMB exon 4; Set C
uuaaucucugggucccccacgcacaacucaaugguacug

SEQ ID NO: 15006 - RNA, 40 nt, Artificial Sequence
  Synthetic Oligonucleotide; GZMB exon 4; Set C
uuuaaucucugggucccccacgcacaacucaaugguacug

SEQ ID NO: 15007 - RNA, 15 nt, Artificial Sequence
  Synthetic Oligonucleotide; GZMB exon 4; Set C
uagucuuaccuuaaa

SEQ ID NO: 15008 - RNA, 15 nt, Artificial Sequence
  Synthetic Oligonucleotide; GZMB exon 4; Set C
auagucuuaccuuaa

SEQ ID NO: 15009 - RNA, 15 nt, Artificial Sequence
  Synthetic Oligonucleotide; GZMB exon 4; Set C
cauagucuuaccuua

SEQ ID NO: 15010 - RNA, 29 nt, Artificial Sequence
  Synthetic Oligonucleotide; GZMB exon 4; Set C
ccaagagccaauccaggcaggugcauagu

SEQ ID NO: 15011 - RNA, 28 nt, Artificial Sequence
  Synthetic Oligonucleotide; GZMB exon 4; Set C
ccaagagccaauccaggcaggugcauag

SEQ ID NO: 15012 - RNA, 34 nt, Artificial Sequence
  Synthetic Oligonucleotide; GZMB exon 4; Set C
uucucccaagagccaauccaggcaggugcauagu

SEQ ID NO: 15013 - RNA, 33 nt, Artificial Sequence
  Synthetic Oligonucleotide; GZMB exon 4; Set C
uucucccaagagccaauccaggcaggugcauag

SEQ ID NO: 15014 - RNA, 35 nt, Artificial Sequence
  Synthetic Oligonucleotide; GZMB exon 4; Set C
uuucucccaagagccaauccaggcaggugcauagu

SEQ ID NO: 15015 - RNA, 32 nt, Artificial Sequence
  Synthetic Oligonucleotide; GZMB exon 4; Set C
uucucccaagagccaauccaggcaggugcaua

SEQ ID NO: 15016 - RNA, 34 nt, Artificial Sequence
  Synthetic Oligonucleotide; GZMB exon 4; Set C
uuucucccaagagccaauccaggcaggugcauag

SEQ ID NO: 15017 - RNA, 36 nt, Artificial Sequence
  Synthetic Oligonucleotide; GZMB exon 4; Set C
cuuucucccaagagccaauccaggcaggugcauagu

SEQ ID NO: 15018 - RNA, 33 nt, Artificial Sequence
  Synthetic Oligonucleotide; GZMB exon 4; Set C
uuucucccaagagccaauccaggcaggugcaua

SEQ ID NO: 15019 - RNA, 35 nt, Artificial Sequence
  Synthetic Oligonucleotide; GZMB exon 4; Set C
cuuucucccaagagccaauccaggcaggugcauag

SEQ ID NO: 15020 - RNA, 37 nt, Artificial Sequence
  Synthetic Oligonucleotide; GZMB exon 4; Set C
ucuuucucccaagagccaauccaggcaggugcauagu

SEQ ID NO: 15021 - RNA, 31 nt, Artificial Sequence
  Synthetic Oligonucleotide; GZMB exon 4; Set C
uucucccaagagccaauccaggcaggugcau

SEQ ID NO: 15022 - RNA, 34 nt, Artificial Sequence
  Synthetic Oligonucleotide; GZMB exon 4; Set C
cuuucucccaagagccaauccaggcaggugcaua

SEQ ID NO: 15023 - RNA, 36 nt, Artificial Sequence
  Synthetic Oligonucleotide; GZMB exon 4; Set C
ucuuucucccaagagccaauccaggcaggugcauag

SEQ ID NO: 15024 - RNA, 32 nt, Artificial Sequence
  Synthetic Oligonucleotide; GZMB exon 4; Set C
uuucucccaagagccaauccaggcaggugcau

SEQ ID NO: 15025 - RNA, 35 nt, Artificial Sequence
  Synthetic Oligonucleotide; GZMB exon 4; Set C
ucuuucucccaagagccaauccaggcaggugcaua

SEQ ID NO: 15026 - RNA, 33 nt, Artificial Sequence
  Synthetic Oligonucleotide; GZMB exon 4; Set C
cuuucucccaagagccaauccaggcaggugcau

SEQ ID NO: 15027 - RNA, 34 nt, Artificial Sequence
  Synthetic Oligonucleotide; GZMB exon 4; Set C
ucuuucucccaagagccaauccaggcaggugcau

SEQ ID NO: 15028 - RNA, 16 nt, Artificial Sequence
  Synthetic Oligonucleotide; GZMB exon 4; Set C
ucagccaacgaacuuc

SEQ ID NO: 15029 - RNA, 17 nt, Artificial Sequence
  Synthetic Oligonucleotide; GZMB exon 4; Set C
gucagccaacgaacuuc

SEQ ID NO: 15030 - RNA, 18 nt, Artificial Sequence
  Synthetic Oligonucleotide; GZMB exon 4; Set C
ggucagccaacgaacuuc

SEQ ID NO: 15031 - RNA, 35 nt, Artificial Sequence
  Synthetic Oligonucleotide; GZMB exon 4; Set C
gaggcaagaaaguccaggucagccaacgaacuucu

SEQ ID NO: 15032 - RNA, 38 nt, Artificial Sequence
  Synthetic Oligonucleotide; GZMB exon 4; Set C
ggaagaggcaagaaaguccaggucagccaacgaacuuc

SEQ ID NO: 15033 - RNA, 39 nt, Artificial Sequence
  Synthetic Oligonucleotide; GZMB exon 4; Set C
gggaagaggcaagaaaguccaggucagccaacgaacuuc

SEQ ID NO: 15034 - RNA, 40 nt, Artificial Sequence
  Synthetic Oligonucleotide; GZMB exon 4; Set C
ggggaagaggcaagaaaguccaggucagccaacgaacuuc

SEQ ID NO: 15035 - RNA, 27 nt, Artificial Sequence
  Synthetic Oligonucleotide; GZMB exon 4; Set C
cucuccagcugguggggaagaggcaag

SEQ ID NO: 15036 - RNA, 28 nt, Artificial Sequence
  Synthetic Oligonucleotide; GZMB exon 4; Set C
ucucuccagcugguggggaagaggcaag

SEQ ID NO: 15037 - RNA, 26 nt, Artificial Sequence
  Synthetic Oligonucleotide; GZMB exon 4; Set C
cucuccagcugguggggaagaggcaa

SEQ ID NO: 15038 - RNA, 29 nt, Artificial Sequence
  Synthetic Oligonucleotide; GZMB exon 4; Set C
uucucuccagcugguggggaagaggcaag

SEQ ID NO: 15039 - RNA, 27 nt, Artificial Sequence
  Synthetic Oligonucleotide; GZMB exon 4; Set C
ucucuccagcugguggggaagaggcaa

SEQ ID NO: 15040 - RNA, 28 nt, Artificial Sequence
  Synthetic Oligonucleotide; GZMB exon 4; Set C
uucucuccagcugguggggaagaggcaa

SEQ ID NO: 15041 - RNA, 33 nt, Artificial Sequence
  Synthetic Oligonucleotide; GZMB exon 4; Set C
gccuuucucuccagcugguggggaagaggcaag

SEQ ID NO: 15042 - RNA, 21 nt, Artificial Sequence
  Synthetic Oligonucleotide; GZMB exon 4; Set A
cucuccagcugguggggaaga

SEQ ID NO: 15043 - RNA, 34 nt, Artificial Sequence
  Synthetic Oligonucleotide; GZMB exon 4; Set C
ggccuuucucuccagcugguggggaagaggcaag

SEQ ID NO: 15044 - RNA, 32 nt, Artificial Sequence
  Synthetic Oligonucleotide; GZMB exon 4; Set C
gccuuucucuccagcugguggggaagaggcaa

SEQ ID NO: 15045 - RNA, 20 nt, Artificial Sequence
  Synthetic Oligonucleotide; GZMB exon 4; Set A
cucuccagcugguggggaag

SEQ ID NO: 15046 - RNA, 22 nt, Artificial Sequence
  Synthetic Oligonucleotide; GZMB exon 4; Set A
ucucuccagcugguggggaaga

SEQ ID NO: 15047 - RNA, 24 nt, Artificial Sequence
  Synthetic Oligonucleotide; GZMB exon 4; Set A
uucucuccagcugguggggaagag

SEQ ID NO: 15048 - RNA, 19 nt, Artificial Sequence
  Synthetic Oligonucleotide; GZMB exon 4; Set A
cucuccagcugguggggaa

SEQ ID NO: 15049 - RNA, 33 nt, Artificial Sequence
  Synthetic Oligonucleotide; GZMB exon 4; Set C
ggccuuucucuccagcugguggggaagaggcaa

SEQ ID NO: 15050 - RNA, 21 nt, Artificial Sequence
  Synthetic Oligonucleotide; GZMB exon 4; Set A
ucucuccagcugguggggaag

SEQ ID NO: 15051 - RNA, 23 nt, Artificial Sequence
  Synthetic Oligonucleotide; GZMB exon 4; Set A
uucucuccagcugguggggaaga

SEQ ID NO: 15052 - RNA, 18 nt, Artificial Sequence
  Synthetic Oligonucleotide; GZMB exon 4; Set A
cucuccagcuggugggga

SEQ ID NO: 15053 - RNA, 20 nt, Artificial Sequence
  Synthetic Oligonucleotide; GZMB exon 4; Set A
ucucuccagcugguggggaa

SEQ ID NO: 15054 - RNA, 34 nt, Artificial Sequence
  Synthetic Oligonucleotide; GZMB exon 4; Set C
uggccuuucucuccagcugguggggaagaggcaa

SEQ ID NO: 15055 - RNA, 22 nt, Artificial Sequence
  Synthetic Oligonucleotide; GZMB exon 4; Set A
uucucuccagcugguggggaag

SEQ ID NO: 15056 - RNA, 17 nt, Artificial Sequence
  Synthetic Oligonucleotide; GZMB exon 4; Set A
cucuccagcuggugggg

SEQ ID NO: 15057 - RNA, 19 nt, Artificial Sequence
  Synthetic Oligonucleotide; GZMB exon 4; Set A
ucucuccagcuggugggga

SEQ ID NO: 15058 - RNA, 21 nt, Artificial Sequence
  Synthetic Oligonucleotide; GZMB exon 4; Set A
uucucuccagcugguggggaa

SEQ ID NO: 15059 - RNA, 16 nt, Artificial Sequence
  Synthetic Oligonucleotide; GZMB exon 4; Set C
cucuccagcugguggg

SEQ ID NO: 15060 - RNA, 18 nt, Artificial Sequence
  Synthetic Oligonucleotide; GZMB exon 4; Set A
ucucuccagcuggugggg

SEQ ID NO: 15061 - RNA, 20 nt, Artificial Sequence
  Synthetic Oligonucleotide; GZMB exon 4; Set A
uucucuccagcuggugggga

SEQ ID NO: 15062 - RNA, 17 nt, Artificial Sequence
  Synthetic Oligonucleotide; GZMB exon 4; Set A
ucucuccagcugguggg

SEQ ID NO: 15063 - RNA, 19 nt, Artificial Sequence
  Synthetic Oligonucleotide; GZMB exon 4; Set A
uucucuccagcuggugggg

SEQ ID NO: 15064 - RNA, 15 nt, Artificial Sequence
  Synthetic Oligonucleotide; GZMB exon 4; Set C
cucuccagcuggugg

SEQ ID NO: 15065 - RNA, 29 nt, Artificial Sequence
  Synthetic Oligonucleotide; GZMB exon 4; Set C
ggccuuucucuccagcugguggggaagag

SEQ ID NO: 15066 - RNA, 18 nt, Artificial Sequence
  Synthetic Oligonucleotide; GZMB exon 4; Set A
uucucuccagcugguggg

SEQ ID NO: 15067 - RNA, 16 nt, Artificial Sequence
  Synthetic Oligonucleotide; GZMB exon 4; Set C
ucucuccagcuggugg

SEQ ID NO: 15068 - RNA, 26 nt, Artificial Sequence
  Synthetic Oligonucleotide; GZMB exon 4; Set C
gccuuucucuccagcugguggggaag

SEQ ID NO: 15069 - RNA, 28 nt, Artificial Sequence
  Synthetic Oligonucleotide; GZMB exon 4; Set C
ggccuuucucuccagcugguggggaaga

SEQ ID NO: 15070 - RNA, 30 nt, Artificial Sequence
  Synthetic Oligonucleotide; GZMB exon 4; Set C
uggccuuucucuccagcugguggggaagag

SEQ ID NO: 15071 - RNA, 15 nt, Artificial Sequence
  Synthetic Oligonucleotide; GZMB exon 4; Set C
ucucuccagcuggug

SEQ ID NO: 15072 - RNA, 17 nt, Artificial Sequence
  Synthetic Oligonucleotide; GZMB exon 4; Set C
uucucuccagcuggugg

SEQ ID NO: 15073 - RNA, 25 nt, Artificial Sequence
  Synthetic Oligonucleotide; GZMB exon 4; Set C
gccuuucucuccagcugguggggaa

SEQ ID NO: 15074 - RNA, 27 nt, Artificial Sequence
  Synthetic Oligonucleotide; GZMB exon 4; Set C
ggccuuucucuccagcugguggggaag

SEQ ID NO: 15075 - RNA, 29 nt, Artificial Sequence
  Synthetic Oligonucleotide; GZMB exon 4; Set C
uggccuuucucuccagcugguggggaaga

SEQ ID NO: 15076 - RNA, 16 nt, Artificial Sequence
  Synthetic Oligonucleotide; GZMB exon 4; Set C
uucucuccagcuggug

SEQ ID NO: 15077 - RNA, 24 nt, Artificial Sequence
  Synthetic Oligonucleotide; GZMB exon 4; Set C
gccuuucucuccagcuggugggga

SEQ ID NO: 15078 - RNA, 26 nt, Artificial Sequence
  Synthetic Oligonucleotide; GZMB exon 4; Set C
ggccuuucucuccagcugguggggaa

SEQ ID NO: 15079 - RNA, 28 nt, Artificial Sequence
  Synthetic Oligonucleotide; GZMB exon 4; Set C
uggccuuucucuccagcugguggggaag

SEQ ID NO: 15080 - RNA, 23 nt, Artificial Sequence
  Synthetic Oligonucleotide; GZMB exon 4; Set C
gccuuucucuccagcuggugggg

SEQ ID NO: 15081 - RNA, 25 nt, Artificial Sequence
  Synthetic Oligonucleotide; GZMB exon 4; Set C
ggccuuucucuccagcuggugggga

SEQ ID NO: 15082 - RNA, 15 nt, Artificial Sequence
  Synthetic Oligonucleotide; GZMB exon 4; Set C
uucucuccagcuggu

SEQ ID NO: 15083 - RNA, 22 nt, Artificial Sequence
  Synthetic Oligonucleotide; GZMB exon 4; Set C
gccuuucucuccagcugguggg

SEQ ID NO: 15084 - RNA, 24 nt, Artificial Sequence
  Synthetic Oligonucleotide; GZMB exon 4; Set C
ggccuuucucuccagcuggugggg

SEQ ID NO: 15085 - RNA, 23 nt, Artificial Sequence
  Synthetic Oligonucleotide; GZMB exon 4; Set C
ggccuuucucuccagcugguggg

SEQ ID NO: 15086 - RNA, 21 nt, Artificial Sequence
  Synthetic Oligonucleotide; GZMB exon 4; Set A
gccuuucucuccagcuggugg

SEQ ID NO: 15087 - RNA, 20 nt, Artificial Sequence
  Synthetic Oligonucleotide; GZMB exon 4; Set A
gccuuucucuccagcuggug

SEQ ID NO: 15088 - RNA, 22 nt, Artificial Sequence
  Synthetic Oligonucleotide; GZMB exon 4; Set C
ggccuuucucuccagcuggugg

SEQ ID NO: 15089 - RNA, 21 nt, Artificial Sequence
  Synthetic Oligonucleotide; GZMB exon 4; Set A
ggccuuucucuccagcuggug

SEQ ID NO: 15090 - RNA, 19 nt, Artificial Sequence
  Synthetic Oligonucleotide; GZMB exon 4; Set A
gccuuucucuccagcuggu

SEQ ID NO: 15091 - RNA, 20 nt, Artificial Sequence
  Synthetic Oligonucleotide; GZMB exon 4; Set A
ggccuuucucuccagcuggu

SEQ ID NO: 15092 - RNA, 21 nt, Artificial Sequence
  Synthetic Oligonucleotide; GZMB exon 4; Set A
uggccuuucucuccagcuggu

SEQ ID NO: 15093 - RNA, 19 nt, Artificial Sequence
  Synthetic Oligonucleotide; GZMB exon 4; Set A
ggccuuucucuccagcugg

SEQ ID NO: 15094 - RNA, 20 nt, Artificial Sequence
  Synthetic Oligonucleotide; GZMB exon 4; Set A
uggccuuucucuccagcugg

SEQ ID NO: 15095 - RNA, 18 nt, Artificial Sequence
  Synthetic Oligonucleotide; GZMB exon 4; Set A
ggccuuucucuccagcug

SEQ ID NO: 15096 - RNA, 17 nt, Artificial Sequence
  Synthetic Oligonucleotide; GZMB exon 4; Set A
ggccuuucucuccagcu

SEQ ID NO: 15097 - RNA, 19 nt, Artificial Sequence
  Synthetic Oligonucleotide; GZMB exon 4; Set A
uggccuuucucuccagcug

SEQ ID NO: 15098 - RNA, 18 nt, Artificial Sequence
  Synthetic Oligonucleotide; GZMB exon 4; Set A
uggccuuucucuccagcu

SEQ ID NO: 15099 - RNA, 16 nt, Artificial Sequence
  Synthetic Oligonucleotide; GZMB exon 4; Set C
ggccuuucucuccagc

SEQ ID NO: 15100 - RNA, 17 nt, Artificial Sequence
  Synthetic Oligonucleotide; GZMB exon 4; Set C
uggccuuucucuccagc

SEQ ID NO: 15101 - RNA, 40 nt, Artificial Sequence
  Synthetic Oligonucleotide; GZMB exon 4; Set C
gcucugguccgcuuggccuuucucuccagcugguggggaa

SEQ ID NO: 15102 - RNA, 39 nt, Artificial Sequence
  Synthetic Oligonucleotide; GZMB exon 4; Set C
gcucugguccgcuuggccuuucucuccagcuggugggga

SEQ ID NO: 15103 - RNA, 38 nt, Artificial Sequence
  Synthetic Oligonucleotide; GZMB exon 4; Set C
gcucugguccgcuuggccuuucucuccagcuggugggg

SEQ ID NO: 15104 - RNA, 37 nt, Artificial Sequence
  Synthetic Oligonucleotide; GZMB exon 4; Set C
gcucugguccgcuuggccuuucucuccagcugguggg

SEQ ID NO: 15105 - RNA, 36 nt, Artificial Sequence
  Synthetic Oligonucleotide; GZMB exon 4; Set C
gcucugguccgcuuggccuuucucuccagcuggugg

SEQ ID NO: 15106 - RNA, 35 nt, Artificial Sequence
  Synthetic Oligonucleotide; GZMB exon 4; Set C
gcucugguccgcuuggccuuucucuccagcuggug

SEQ ID NO: 15107 - RNA, 34 nt, Artificial Sequence
  Synthetic Oligonucleotide; GZMB exon 4; Set C
gcucugguccgcuuggccuuucucuccagcuggu

SEQ ID NO: 15108 - RNA, 33 nt, Artificial Sequence
  Synthetic Oligonucleotide; GZMB exon 4; Set C
gcucugguccgcuuggccuuucucuccagcugg

SEQ ID NO: 15109 - RNA, 15 nt, Artificial Sequence
  Synthetic Oligonucleotide; GZMB exon 4; Set C
cgcuuggccuuucuc

SEQ ID NO: 15110 - RNA, 32 nt, Artificial Sequence
  Synthetic Oligonucleotide; GZMB exon 4; Set C
gcucugguccgcuuggccuuucucuccagcug

SEQ ID NO: 15111 - RNA, 16 nt, Artificial Sequence
  Synthetic Oligonucleotide; GZMB exon 4; Set C
ccgcuuggccuuucuc

SEQ ID NO: 15112 - RNA, 31 nt, Artificial Sequence
  Synthetic Oligonucleotide; GZMB exon 4; Set C
gcucugguccgcuuggccuuucucuccagcu

SEQ ID NO: 15113 - RNA, 15 nt, Artificial Sequence
  Synthetic Oligonucleotide; GZMB exon 4; Set C
ccgcuuggccuuucu

SEQ ID NO: 15114 - RNA, 17 nt, Artificial Sequence
  Synthetic Oligonucleotide; GZMB exon 4; Set C
uccgcuuggccuuucuc

SEQ ID NO: 15115 - RNA, 30 nt, Artificial Sequence
  Synthetic Oligonucleotide; GZMB exon 4; Set C
gcucugguccgcuuggccuuucucuccagc

SEQ ID NO: 15116 - RNA, 16 nt, Artificial Sequence
  Synthetic Oligonucleotide; GZMB exon 4; Set C
uccgcuuggccuuucu

SEQ ID NO: 15117 - RNA, 18 nt, Artificial Sequence
  Synthetic Oligonucleotide; GZMB exon 4; Set A
guccgcuuggccuuucuc

SEQ ID NO: 15118 - RNA, 15 nt, Artificial Sequence
  Synthetic Oligonucleotide; GZMB exon 4; Set C
uccgcuuggccuuuc

SEQ ID NO: 15119 - RNA, 17 nt, Artificial Sequence
  Synthetic Oligonucleotide; GZMB exon 4; Set A
guccgcuuggccuuucu

SEQ ID NO: 15120 - RNA, 19 nt, Artificial Sequence
  Synthetic Oligonucleotide; GZMB exon 4; Set A
gguccgcuuggccuuucuc

SEQ ID NO: 15121 - RNA, 16 nt, Artificial Sequence
  Synthetic Oligonucleotide; GZMB exon 4; Set C
guccgcuuggccuuuc

SEQ ID NO: 15122 - RNA, 18 nt, Artificial Sequence
  Synthetic Oligonucleotide; GZMB exon 4; Set A
gguccgcuuggccuuucu

SEQ ID NO: 15123 - RNA, 20 nt, Artificial Sequence
  Synthetic Oligonucleotide; GZMB exon 4; Set A
ugguccgcuuggccuuucuc

SEQ ID NO: 15124 - RNA, 17 nt, Artificial Sequence
  Synthetic Oligonucleotide; GZMB exon 4; Set A
gguccgcuuggccuuuc

SEQ ID NO: 15125 - RNA, 19 nt, Artificial Sequence
  Synthetic Oligonucleotide; GZMB exon 4; Set A
ugguccgcuuggccuuucu

SEQ ID NO: 15126 - RNA, 21 nt, Artificial Sequence
  Synthetic Oligonucleotide; GZMB exon 4; Set A
cugguccgcuuggccuuucuc

SEQ ID NO: 15127 - RNA, 18 nt, Artificial Sequence
  Synthetic Oligonucleotide; GZMB exon 4; Set A
ugguccgcuuggccuuuc

SEQ ID NO: 15128 - RNA, 20 nt, Artificial Sequence
  Synthetic Oligonucleotide; GZMB exon 4; Set A
cugguccgcuuggccuuucu

SEQ ID NO: 15129 - RNA, 22 nt, Artificial Sequence
  Synthetic Oligonucleotide; GZMB exon 4; Set A
ucugguccgcuuggccuuucuc

SEQ ID NO: 15130 - RNA, 25 nt, Artificial Sequence
  Synthetic Oligonucleotide; GZMB exon 4; Set C
gcucugguccgcuuggccuuucucu

SEQ ID NO: 15131 - RNA, 19 nt, Artificial Sequence
  Synthetic Oligonucleotide; GZMB exon 4; Set A
cugguccgcuuggccuuuc

SEQ ID NO: 15132 - RNA, 21 nt, Artificial Sequence
  Synthetic Oligonucleotide; GZMB exon 4; Set A
ucugguccgcuuggccuuucu

SEQ ID NO: 15133 - RNA, 20 nt, Artificial Sequence
  Synthetic Oligonucleotide; GZMB exon 4; Set A
ucugguccgcuuggccuuuc

SEQ ID NO: 15134 - RNA, 15 nt, Artificial Sequence
  Synthetic Oligonucleotide; GZMB exon 4; Set A
cugguccgcuuggcc

SEQ ID NO: 15135 - RNA, 16 nt, Artificial Sequence
  Synthetic Oligonucleotide; GZMB exon 4; Set A
ucugguccgcuuggcc

SEQ ID NO: 15136 - RNA, 15 nt, Artificial Sequence
  Synthetic Oligonucleotide; GZMB exon 4; Set C
ucugguccgcuuggc

SEQ ID NO: 15137 - RNA, 29 nt, Artificial Sequence
  Synthetic Oligonucleotide; GZMB exon 4; Set C
gcacagcucugguccgcuuggccuuucuc

SEQ ID NO: 15138 - RNA, 28 nt, Artificial Sequence
  Synthetic Oligonucleotide; GZMB exon 4; Set C
gcacagcucugguccgcuuggccuuucu

SEQ ID NO: 15139 - RNA, 30 nt, Artificial Sequence
  Synthetic Oligonucleotide; GZMB exon 4; Set C
ugcacagcucugguccgcuuggccuuucuc

SEQ ID NO: 15140 - RNA, 27 nt, Artificial Sequence
  Synthetic Oligonucleotide; GZMB exon 4; Set C
gcacagcucugguccgcuuggccuuuc

SEQ ID NO: 15141 - RNA, 29 nt, Artificial Sequence
  Synthetic Oligonucleotide; GZMB exon 4; Set C
ugcacagcucugguccgcuuggccuuucu

SEQ ID NO: 15142 - RNA, 28 nt, Artificial Sequence
  Synthetic Oligonucleotide; GZMB exon 4; Set C
ugcacagcucugguccgcuuggccuuuc

SEQ ID NO: 15143 - RNA, 15 nt, Artificial Sequence
  Synthetic Oligonucleotide; GZMB exon 4; Set C
gcucugguccgcuug

SEQ ID NO: 15144 - RNA, 21 nt, Artificial Sequence
  Synthetic Oligonucleotide; GZMB exon 4; Set C
cacagcucugguccgcuuggc

SEQ ID NO: 15145 - RNA, 23 nt, Artificial Sequence
  Synthetic Oligonucleotide; GZMB exon 4; Set C
gcacagcucugguccgcuuggcc

SEQ ID NO: 15146 - RNA, 20 nt, Artificial Sequence
  Synthetic Oligonucleotide; GZMB exon 4; Set A
cacagcucugguccgcuugg

SEQ ID NO: 15147 - RNA, 36 nt, Artificial Sequence
  Synthetic Oligonucleotide; GZMB exon 4; Set C
aggggcugcacagcucugguccgcuuggccuuucuc

SEQ ID NO: 15148 - RNA, 24 nt, Artificial Sequence
  Synthetic Oligonucleotide; GZMB exon 4; Set C
ugcacagcucugguccgcuuggcc

SEQ ID NO: 15149 - RNA, 35 nt, Artificial Sequence
  Synthetic Oligonucleotide; GZMB exon 4; Set C
aggggcugcacagcucugguccgcuuggccuuucu

SEQ ID NO: 15150 - RNA, 37 nt, Artificial Sequence
  Synthetic Oligonucleotide; GZMB exon 4; Set C
gaggggcugcacagcucugguccgcuuggccuuucuc

SEQ ID NO: 15151 - RNA, 24 nt, Artificial Sequence
  Synthetic Oligonucleotide; GZMB exon 4; Set C
cugcacagcucugguccgcuuggc

SEQ ID NO: 15152 - RNA, 34 nt, Artificial Sequence
  Synthetic Oligonucleotide; GZMB exon 4; Set C
aggggcugcacagcucugguccgcuuggccuuuc

SEQ ID NO: 15153 - RNA, 36 nt, Artificial Sequence
  Synthetic Oligonucleotide; GZMB exon 4; Set C
gaggggcugcacagcucugguccgcuuggccuuucu

SEQ ID NO: 15154 - RNA, 38 nt, Artificial Sequence
  Synthetic Oligonucleotide; GZMB exon 4; Set C
ugaggggcugcacagcucugguccgcuuggccuuucuc

SEQ ID NO: 15155 - RNA, 23 nt, Artificial Sequence
  Synthetic Oligonucleotide; GZMB exon 4; Set C
cugcacagcucugguccgcuugg

SEQ ID NO: 15156 - RNA, 25 nt, Artificial Sequence
  Synthetic Oligonucleotide; GZMB exon 4; Set C
gcugcacagcucugguccgcuuggc

SEQ ID NO: 15157 - RNA, 35 nt, Artificial Sequence
  Synthetic Oligonucleotide; GZMB exon 4; Set C
gaggggcugcacagcucugguccgcuuggccuuuc

SEQ ID NO: 15158 - RNA, 37 nt, Artificial Sequence
  Synthetic Oligonucleotide; GZMB exon 4; Set C
ugaggggcugcacagcucugguccgcuuggccuuucu

SEQ ID NO: 15159 - RNA, 24 nt, Artificial Sequence
  Synthetic Oligonucleotide; GZMB exon 4; Set C
gcugcacagcucugguccgcuugg

SEQ ID NO: 15160 - RNA, 36 nt, Artificial Sequence
  Synthetic Oligonucleotide; GZMB exon 4; Set C
ugaggggcugcacagcucugguccgcuuggccuuuc

SEQ ID NO: 15161 - RNA, 30 nt, Artificial Sequence
  Synthetic Oligonucleotide; GZMB exon 4; Set C
aggggcugcacagcucugguccgcuuggcc

SEQ ID NO: 15162 - RNA, 31 nt, Artificial Sequence
  Synthetic Oligonucleotide; GZMB exon 4; Set C
gaggggcugcacagcucugguccgcuuggcc

SEQ ID NO: 15163 - RNA, 32 nt, Artificial Sequence
  Synthetic Oligonucleotide; GZMB exon 4; Set C
ugaggggcugcacagcucugguccgcuuggcc

SEQ ID NO: 15164 - RNA, 15 nt, Artificial Sequence
  Synthetic Oligonucleotide; GZMB exon 4; Set A
aggggcugcacagcu

SEQ ID NO: 15165 - RNA, 16 nt, Artificial Sequence
  Synthetic Oligonucleotide; GZMB exon 4; Set A
gaggggcugcacagcu

SEQ ID NO: 15166 - RNA, 17 nt, Artificial Sequence
  Synthetic Oligonucleotide; GZMB exon 4; Set A
ugaggggcugcacagcu

SEQ ID NO: 15167 - RNA, 40 nt, Artificial Sequence
  Synthetic Oligonucleotide; GZMB exon 4; Set C
guugcuagguagccugaggggcugcacagcucugguccgc

SEQ ID NO: 15168 - RNA, 39 nt, Artificial Sequence
  Synthetic Oligonucleotide; GZMB exon 4; Set C
guugcuagguagccugaggggcugcacagcucugguccg

SEQ ID NO: 15169 - RNA, 38 nt, Artificial Sequence
  Synthetic Oligonucleotide; GZMB exon 4; Set C
guugcuagguagccugaggggcugcacagcucuggucc

SEQ ID NO: 15170 - RNA, 36 nt, Artificial Sequence
  Synthetic Oligonucleotide; GZMB exon 4; Set C
guugcuagguagccugaggggcugcacagcucuggu

SEQ ID NO: 15171 - RNA, 28 nt, Artificial Sequence
  Synthetic Oligonucleotide; GZMB exon 4; Set C
uguugcuagguagccugaggggcugcac

SEQ ID NO: 15172 - RNA, 29 nt, Artificial Sequence
  Synthetic Oligonucleotide; GZMB exon 4; Set C
uuguugcuagguagccugaggggcugcac

SEQ ID NO: 15173 - RNA, 30 nt, Artificial Sequence
  Synthetic Oligonucleotide; GZMB exon 4; Set C
cuuguugcuagguagccugaggggcugcac

SEQ ID NO: 15174 - RNA, 25 nt, Artificial Sequence
  Synthetic Oligonucleotide; GZMB exon 4; Set C
uguugcuagguagccugaggggcug

SEQ ID NO: 15175 - RNA, 26 nt, Artificial Sequence
  Synthetic Oligonucleotide; GZMB exon 4; Set C
uuguugcuagguagccugaggggcug

SEQ ID NO: 15176 - RNA, 24 nt, Artificial Sequence
  Synthetic Oligonucleotide; GZMB exon 4; Set C
uguugcuagguagccugaggggcu

SEQ ID NO: 15177 - RNA, 27 nt, Artificial Sequence
  Synthetic Oligonucleotide; GZMB exon 4; Set C
cuuguugcuagguagccugaggggcug

SEQ ID NO: 15178 - RNA, 25 nt, Artificial Sequence
  Synthetic Oligonucleotide; GZMB exon 4; Set C
uuguugcuagguagccugaggggcu

SEQ ID NO: 15179 - RNA, 26 nt, Artificial Sequence
  Synthetic Oligonucleotide; GZMB exon 4; Set C
cuuguugcuagguagccugaggggcu

SEQ ID NO: 15180 - RNA, 20 nt, Artificial Sequence
  Synthetic Oligonucleotide; GZMB exon 4; Set A
uguugcuagguagccugagg

SEQ ID NO: 15181 - RNA, 21 nt, Artificial Sequence
  Synthetic Oligonucleotide; GZMB exon 4; Set A
uuguugcuagguagccugagg

SEQ ID NO: 15182 - RNA, 19 nt, Artificial Sequence
  Synthetic Oligonucleotide; GZMB exon 4; Set C
uguugcuagguagccugag

SEQ ID NO: 15183 - RNA, 18 nt, Artificial Sequence
  Synthetic Oligonucleotide; GZMB exon 4; Set C
uguugcuagguagccuga

SEQ ID NO: 15184 - RNA, 20 nt, Artificial Sequence
  Synthetic Oligonucleotide; GZMB exon 4; Set C
uuguugcuagguagccugag

SEQ ID NO: 15185 - RNA, 19 nt, Artificial Sequence
  Synthetic Oligonucleotide; GZMB exon 4; Set C
uuguugcuagguagccuga

SEQ ID NO: 15186 - RNA, 21 nt, Artificial Sequence
  Synthetic Oligonucleotide; GZMB exon 4; Set A
cuuguugcuagguagccugag

SEQ ID NO: 15187 - RNA, 20 nt, Artificial Sequence
  Synthetic Oligonucleotide; GZMB exon 4; Set A
cuuguugcuagguagccuga

SEQ ID NO: 15188 - RNA, 40 nt, Artificial Sequence
  Synthetic Oligonucleotide; GZMB exon 4; Set C
ucaccugggccuuguugcuagguagccugaggggcugcac

SEQ ID NO: 15189 - RNA, 37 nt, Artificial Sequence
  Synthetic Oligonucleotide; GZMB exon 4; Set C
ucaccugggccuuguugcuagguagccugaggggcug

SEQ ID NO: 15190 - RNA, 38 nt, Artificial Sequence
  Synthetic Oligonucleotide; GZMB exon 4; Set C
uucaccugggccuuguugcuagguagccugaggggcug

SEQ ID NO: 15191 - RNA, 36 nt, Artificial Sequence
  Synthetic Oligonucleotide; GZMB exon 4; Set C
ucaccugggccuuguugcuagguagccugaggggcu

SEQ ID NO: 15192 - RNA, 39 nt, Artificial Sequence
  Synthetic Oligonucleotide; GZMB exon 4; Set C
cuucaccugggccuuguugcuagguagccugaggggcug

SEQ ID NO: 15193 - RNA, 37 nt, Artificial Sequence
  Synthetic Oligonucleotide; GZMB exon 4; Set C
uucaccugggccuuguugcuagguagccugaggggcu

SEQ ID NO: 15194 - RNA, 38 nt, Artificial Sequence
  Synthetic Oligonucleotide; GZMB exon 4; Set C
cuucaccugggccuuguugcuagguagccugaggggcu

SEQ ID NO: 15195 - RNA, 30 nt, Artificial Sequence
  Synthetic Oligonucleotide; GZMB exon 4; Set C
ucaccugggccuuguugcuagguagccuga

SEQ ID NO: 15196 - RNA, 28 nt, Artificial Sequence
  Synthetic Oligonucleotide; GZMB exon 4; Set C
ucugcccuggcuucaccugggccuuguu

SEQ ID NO: 15197 - RNA, 29 nt, Artificial Sequence
  Synthetic Oligonucleotide; GZMB exon 4; Set C
gucugcccuggcuucaccugggccuuguu

SEQ ID NO: 15198 - RNA, 30 nt, Artificial Sequence
  Synthetic Oligonucleotide; GZMB exon 4; Set C
ugucugcccuggcuucaccugggccuuguu

SEQ ID NO: 15199 - RNA, 30 nt, Artificial Sequence
  Synthetic Oligonucleotide; GZMB exon 4; Set C
gccggccacacugcaugucugcccuggcuu

SEQ ID NO: 15200 - RNA, 28 nt, Artificial Sequence
  Synthetic Oligonucleotide; GZMB exon 4; Set C
ucugcccccagccggccacacugcaugu

SEQ ID NO: 15201 - RNA, 38 nt, Artificial Sequence
  Synthetic Oligonucleotide; GZMB exon 4; Set C
gggggccgucugcccccagccggccacacugcaugucu

SEQ ID NO: 15202 - RNA, 37 nt, Artificial Sequence
  Synthetic Oligonucleotide; GZMB exon 4; Set C
gggggccgucugcccccagccggccacacugcauguc

SEQ ID NO: 15203 - RNA, 39 nt, Artificial Sequence
  Synthetic Oligonucleotide; GZMB exon 4; Set C
ggggggccgucugcccccagccggccacacugcaugucu

SEQ ID NO: 15204 - RNA, 38 nt, Artificial Sequence
  Synthetic Oligonucleotide; GZMB exon 4; Set C
ggggggccgucugcccccagccggccacacugcauguc

SEQ ID NO: 15205 - RNA, 40 nt, Artificial Sequence
  Synthetic Oligonucleotide; GZMB exon 4; Set C
aggggggccgucugcccccagccggccacacugcaugucu

SEQ ID NO: 15206 - RNA, 39 nt, Artificial Sequence
  Synthetic Oligonucleotide; GZMB exon 4; Set C
aggggggccgucugcccccagccggccacacugcauguc

SEQ ID NO: 15207 - RNA, 37 nt, Artificial Sequence
  Synthetic Oligonucleotide; GZMB exon 4; Set C
ggggggccgucugcccccagccggccacacugcaugu

SEQ ID NO: 15208 - RNA, 38 nt, Artificial Sequence
  Synthetic Oligonucleotide; GZMB exon 4; Set C
aggggggccgucugcccccagccggccacacugcaugu

SEQ ID NO: 15209 - RNA, 22 nt, Artificial Sequence
  Synthetic Oligonucleotide; GZMB exon 4; Set C
ggggggccgucugcccccagcc

SEQ ID NO: 15210 - RNA, 21 nt, Artificial Sequence
  Synthetic Oligonucleotide; GZMB exon 4; Set C
ggggggccgucugcccccagc

SEQ ID NO: 15211 - RNA, 23 nt, Artificial Sequence
  Synthetic Oligonucleotide; GZMB exon 4; Set C
aggggggccgucugcccccagcc

SEQ ID NO: 15212 - RNA, 22 nt, Artificial Sequence
  Synthetic Oligonucleotide; GZMB exon 4; Set C
aggggggccgucugcccccagc

SEQ ID NO: 15213 - RNA, 40 nt, Artificial Sequence
  Synthetic Oligonucleotide; GZMB exon 4; Set C
ugugugaguguuuucccaggggggccgucugcccccagcc

SEQ ID NO: 15214 - RNA, 39 nt, Artificial Sequence
  Synthetic Oligonucleotide; GZMB exon 4; Set C
ugugugaguguuuucccaggggggccgucugcccccagc

SEQ ID NO: 15215 - RNA, 40 nt, Artificial Sequence
  Synthetic Oligonucleotide; GZMB exon 4; Set C
gugugugaguguuuucccaggggggccgucugcccccagc

SEQ ID NO: 15216 - RNA, 29 nt, Artificial Sequence
  Synthetic Oligonucleotide; GZMB exon 4; Set C
gugugaguguuuucccaggggggccgucu

SEQ ID NO: 15217 - RNA, 33 nt, Artificial Sequence
  Synthetic Oligonucleotide; GZMB exon 4; Set C
gugugugugaguguuuucccaggggggccgucu

SEQ ID NO: 15218 - RNA, 34 nt, Artificial Sequence
  Synthetic Oligonucleotide; GZMB exon 4; Set C
agugugugugaguguuuucccaggggggccgucu

SEQ ID NO: 15219 - RNA, 32 nt, Artificial Sequence
  Synthetic Oligonucleotide; GZMB exon 4; Set C
gugugugugaguguuuucccaggggggccguc

SEQ ID NO: 15220 - RNA, 35 nt, Artificial Sequence
  Synthetic Oligonucleotide; GZMB exon 4; Set C
uagugugugugaguguuuucccaggggggccgucu

SEQ ID NO: 15221 - RNA, 33 nt, Artificial Sequence
  Synthetic Oligonucleotide; GZMB exon 4; Set C
agugugugugaguguuuucccaggggggccguc

SEQ ID NO: 15222 - RNA, 31 nt, Artificial Sequence
  Synthetic Oligonucleotide; GZMB exon 4; Set C
gugugugugaguguuuucccaggggggccgu

SEQ ID NO: 15223 - RNA, 36 nt, Artificial Sequence
  Synthetic Oligonucleotide; GZMB exon 4; Set C
guagugugugugaguguuuucccaggggggccgucu

SEQ ID NO: 15224 - RNA, 34 nt, Artificial Sequence
  Synthetic Oligonucleotide; GZMB exon 4; Set C
uagugugugugaguguuuucccaggggggccguc

SEQ ID NO: 15225 - RNA, 32 nt, Artificial Sequence
  Synthetic Oligonucleotide; GZMB exon 4; Set C
agugugugugaguguuuucccaggggggccgu

SEQ ID NO: 15226 - RNA, 35 nt, Artificial Sequence
  Synthetic Oligonucleotide; GZMB exon 4; Set C
guagugugugugaguguuuucccaggggggccguc

SEQ ID NO: 15227 - RNA, 33 nt, Artificial Sequence
  Synthetic Oligonucleotide; GZMB exon 4; Set C
uagugugugugaguguuuucccaggggggccgu

SEQ ID NO: 15228 - RNA, 23 nt, Artificial Sequence
  Synthetic Oligonucleotide; GZMB exon 4; Set A
ugugugaguguuuucccaggggg

SEQ ID NO: 15229 - RNA, 34 nt, Artificial Sequence
  Synthetic Oligonucleotide; GZMB exon 4; Set C
guagugugugugaguguuuucccaggggggccgu

SEQ ID NO: 15230 - RNA, 22 nt, Artificial Sequence
  Synthetic Oligonucleotide; GZMB exon 4; Set A
ugugugaguguuuucccagggg

SEQ ID NO: 15231 - RNA, 21 nt, Artificial Sequence
  Synthetic Oligonucleotide; GZMB exon 4; Set A
ugugugaguguuuucccaggg

SEQ ID NO: 15232 - RNA, 23 nt, Artificial Sequence
  Synthetic Oligonucleotide; GZMB exon 4; Set A
gugugugaguguuuucccagggg

SEQ ID NO: 15233 - RNA, 25 nt, Artificial Sequence
  Synthetic Oligonucleotide; GZMB exon 4; Set C
ugugugugaguguuuucccaggggg

SEQ ID NO: 15234 - RNA, 36 nt, Artificial Sequence
  Synthetic Oligonucleotide; GZMB exon 4; Set C
uuguagugugugugaguguuuucccaggggggccgu

SEQ ID NO: 15235 - RNA, 20 nt, Artificial Sequence
  Synthetic Oligonucleotide; GZMB exon 4; Set C
ugugugaguguuuucccagg

SEQ ID NO: 15236 - RNA, 22 nt, Artificial Sequence
  Synthetic Oligonucleotide; GZMB exon 4; Set A
gugugugaguguuuucccaggg

SEQ ID NO: 15237 - RNA, 24 nt, Artificial Sequence
  Synthetic Oligonucleotide; GZMB exon 4; Set A
ugugugugaguguuuucccagggg

SEQ ID NO: 15238 - RNA, 21 nt, Artificial Sequence
  Synthetic Oligonucleotide; GZMB exon 4; Set A
gugugugaguguuuucccagg

SEQ ID NO: 15239 - RNA, 23 nt, Artificial Sequence
  Synthetic Oligonucleotide; GZMB exon 4; Set A
ugugugugaguguuuucccaggg

SEQ ID NO: 15240 - RNA, 22 nt, Artificial Sequence
  Synthetic Oligonucleotide; GZMB exon 4; Set A
ugugugugaguguuuucccagg

SEQ ID NO: 15241 - RNA, 30 nt, Artificial Sequence
  Synthetic Oligonucleotide; GZMB exon 4; Set C
uguagugugugugaguguuuucccaggggg

SEQ ID NO: 15242 - RNA, 29 nt, Artificial Sequence
  Synthetic Oligonucleotide; GZMB exon 4; Set C
uguagugugugugaguguuuucccagggg

SEQ ID NO: 15243 - RNA, 26 nt, Artificial Sequence
  Synthetic Oligonucleotide; GZMB exon 4; Set A
guagugugugugaguguuuucccagg

SEQ ID NO: 15244 - RNA, 28 nt, Artificial Sequence
  Synthetic Oligonucleotide; GZMB exon 4; Set A
uguagugugugugaguguuuucccaggg

SEQ ID NO: 15245 - RNA, 29 nt, Artificial Sequence
  Synthetic Oligonucleotide; GZMB exon 4; Set A
uuguagugugugugaguguuuucccaggg

SEQ ID NO: 15246 - RNA, 28 nt, Artificial Sequence
  Synthetic Oligonucleotide; GZMB exon 4; Set A
uuguagugugugugaguguuuucccagg

SEQ ID NO: 15247 - RNA, 30 nt, Artificial Sequence
  Synthetic Oligonucleotide; GZMB exon 4; Set C
cuuguagugugugugaguguuuucccaggg

SEQ ID NO: 15248 - RNA, 32 nt, Artificial Sequence
  Synthetic Oligonucleotide; GZMB exon 4; Set C
ucuuguagugugugugaguguuuucccagggg

SEQ ID NO: 15249 - RNA, 17 nt, Artificial Sequence
  Synthetic Oligonucleotide; GZMB exon 4; Set C
gugugugugaguguuuu

SEQ ID NO: 15250 - RNA, 29 nt, Artificial Sequence
  Synthetic Oligonucleotide; GZMB exon 4; Set A
cuuguagugugugugaguguuuucccagg

SEQ ID NO: 15251 - RNA, 31 nt, Artificial Sequence
  Synthetic Oligonucleotide; GZMB exon 4; Set C
ucuuguagugugugugaguguuuucccaggg

SEQ ID NO: 15252 - RNA, 18 nt, Artificial Sequence
  Synthetic Oligonucleotide; GZMB exon 4; Set C
agugugugugaguguuuu

SEQ ID NO: 15253 - RNA, 16 nt, Artificial Sequence
  Synthetic Oligonucleotide; GZMB exon 4; Set C
gugugugugaguguuu

SEQ ID NO: 15254 - RNA, 30 nt, Artificial Sequence
  Synthetic Oligonucleotide; GZMB exon 4; Set A
ucuuguagugugugugaguguuuucccagg

SEQ ID NO: 15255 - RNA, 17 nt, Artificial Sequence
  Synthetic Oligonucleotide; GZMB exon 4; Set C
agugugugugaguguuu

SEQ ID NO: 15256 - RNA, 15 nt, Artificial Sequence
  Synthetic Oligonucleotide; GZMB exon 4; Set C
gugugugugaguguu

SEQ ID NO: 15257 - RNA, 16 nt, Artificial Sequence
  Synthetic Oligonucleotide; GZMB exon 4; Set C
agugugugugaguguu

SEQ ID NO: 15258 - RNA, 17 nt, Artificial Sequence
  Synthetic Oligonucleotide; GZMB exon 4; Set C
uagugugugugaguguu

SEQ ID NO: 15259 - RNA, 15 nt, Artificial Sequence
  Synthetic Oligonucleotide; GZMB exon 4; Set C
agugugugugagugu

SEQ ID NO: 15260 - RNA, 16 nt, Artificial Sequence
  Synthetic Oligonucleotide; GZMB exon 4; Set C
uagugugugugagugu

SEQ ID NO: 15261 - RNA, 40 nt, Artificial Sequence
  Synthetic Oligonucleotide; GZMB exon 4; Set C
cuucaccucuuguagugugugugaguguuuucccaggggg

SEQ ID NO: 15262 - RNA, 25 nt, Artificial Sequence
  Synthetic Oligonucleotide; GZMB exon 4; Set A
cucuuguagugugugugaguguuuu

SEQ ID NO: 15263 - RNA, 21 nt, Artificial Sequence
  Synthetic Oligonucleotide; GZMB exon 4; Set C
cuucaccucuuguagugugug

SEQ ID NO: 15264 - RNA, 17 nt, Artificial Sequence
  Synthetic Oligonucleotide; GZMB exon 4; Set C
cuucaccucuuguagug

SEQ ID NO: 15265 - RNA, 16 nt, Artificial Sequence
  Synthetic Oligonucleotide; GZMB exon 4; Set C
cuucaccucuuguagu

SEQ ID NO: 15266 - RNA, 15 nt, Artificial Sequence
  Synthetic Oligonucleotide; GZMB exon 4; Set C
cuucaccucuuguag

SEQ ID NO: 15267 - RNA, 25 nt, Artificial Sequence
  Synthetic Oligonucleotide; GZMB exon 4; Set A
ugucaucuucaccucuuguagugug

SEQ ID NO: 15268 - RNA, 24 nt, Artificial Sequence
  Synthetic Oligonucleotide; GZMB exon 4; Set A
ugucaucuucaccucuuguagugu

SEQ ID NO: 15269 - RNA, 19 nt, Artificial Sequence
  Synthetic Oligonucleotide; GZMB exon 4; Set C
ugucaucuucaccucuugu

SEQ ID NO: 15270 - RNA, 36 nt, Artificial Sequence
  Synthetic Oligonucleotide; GZMB exon 4; Set C
uuucgaucuuccugcacugucaucuucaccucuugu

SEQ ID NO: 15271 - RNA, 38 nt, Artificial Sequence
  Synthetic Oligonucleotide; GZMB exon 4; Set C
cuuucgaucuuccugcacugucaucuucaccucuugua

SEQ ID NO: 15272 - RNA, 37 nt, Artificial Sequence
  Synthetic Oligonucleotide; GZMB exon 4; Set C
cuuucgaucuuccugcacugucaucuucaccucuugu

SEQ ID NO: 15273 - RNA, 39 nt, Artificial Sequence
  Synthetic Oligonucleotide; GZMB exon 4; Set C
acuuucgaucuuccugcacugucaucuucaccucuugua

SEQ ID NO: 15274 - RNA, 38 nt, Artificial Sequence
  Synthetic Oligonucleotide; GZMB exon 4; Set C
acuuucgaucuuccugcacugucaucuucaccucuugu

SEQ ID NO: 15275 - RNA, 36 nt, Artificial Sequence
  Synthetic Oligonucleotide; GZMB exon 4; Set C
cuuucgaucuuccugcacugucaucuucaccucuug

SEQ ID NO: 15276 - RNA, 40 nt, Artificial Sequence
  Synthetic Oligonucleotide; GZMB exon 4; Set C
cacuuucgaucuuccugcacugucaucuucaccucuugua

SEQ ID NO: 15277 - RNA, 39 nt, Artificial Sequence
  Synthetic Oligonucleotide; GZMB exon 4; Set C
cacuuucgaucuuccugcacugucaucuucaccucuugu

SEQ ID NO: 15278 - RNA, 37 nt, Artificial Sequence
  Synthetic Oligonucleotide; GZMB exon 4; Set C
acuuucgaucuuccugcacugucaucuucaccucuug

SEQ ID NO: 15279 - RNA, 36 nt, Artificial Sequence
  Synthetic Oligonucleotide; GZMB exon 4; Set C
acuuucgaucuuccugcacugucaucuucaccucuu

SEQ ID NO: 15280 - RNA, 38 nt, Artificial Sequence
  Synthetic Oligonucleotide; GZMB exon 4; Set C
cacuuucgaucuuccugcacugucaucuucaccucuug

SEQ ID NO: 15281 - RNA, 35 nt, Artificial Sequence
  Synthetic Oligonucleotide; GZMB exon 4; Set C
acuuucgaucuuccugcacugucaucuucaccucu

SEQ ID NO: 15282 - RNA, 37 nt, Artificial Sequence
  Synthetic Oligonucleotide; GZMB exon 4; Set C
cacuuucgaucuuccugcacugucaucuucaccucuu

SEQ ID NO: 15283 - RNA, 36 nt, Artificial Sequence
  Synthetic Oligonucleotide; GZMB exon 4; Set C
cacuuucgaucuuccugcacugucaucuucaccucu

SEQ ID NO: 15284 - RNA, 20 nt, Artificial Sequence
  Synthetic Oligonucleotide; GZMB exon 4; Set C
uuucgaucuuccugcacugu

SEQ ID NO: 15285 - RNA, 22 nt, Artificial Sequence
  Synthetic Oligonucleotide; GZMB exon 4; Set A
ggcguaagucagauucgcacuu

SEQ ID NO: 15286 - RNA, 21 nt, Artificial Sequence
  Synthetic Oligonucleotide; GZMB exon 4; Set A
ggcguaagucagauucgcacu

SEQ ID NO: 15287 - RNA, 22 nt, Artificial Sequence
  Synthetic Oligonucleotide; GZMB exon 4; Set A
uggcguaagucagauucgcacu

SEQ ID NO: 15288 - RNA, 20 nt, Artificial Sequence
  Synthetic Oligonucleotide; GZMB exon 4; Set A
ggcguaagucagauucgcac

SEQ ID NO: 15289 - RNA, 21 nt, Artificial Sequence
  Synthetic Oligonucleotide; GZMB exon 4; Set A
uggcguaagucagauucgcac

SEQ ID NO: 15290 - RNA, 28 nt, Artificial Sequence
  Synthetic Oligonucleotide; GZMB exon 4; Set A
auaauggcguaagucagauucgcacuuu

SEQ ID NO: 15291 - RNA, 27 nt, Artificial Sequence
  Synthetic Oligonucleotide; GZMB exon 4; Set A
auaauggcguaagucagauucgcacuu

SEQ ID NO: 15292 - RNA, 26 nt, Artificial Sequence
  Synthetic Oligonucleotide; GZMB exon 4; Set A
auaauggcguaagucagauucgcacu

SEQ ID NO: 15293 - RNA, 40 nt, Artificial Sequence
  Synthetic Oligonucleotide; GZMB exon 4; Set C
ugguacugucguaauaauggcguaagucagauucgcacuu

SEQ ID NO: 15294 - RNA, 39 nt, Artificial Sequence
  Synthetic Oligonucleotide; GZMB exon 4; Set C
ugguacugucguaauaauggcguaagucagauucgcacu

SEQ ID NO: 15295 - RNA, 40 nt, Artificial Sequence
  Synthetic Oligonucleotide; GZMB exon 4; Set C
augguacugucguaauaauggcguaagucagauucgcacu

SEQ ID NO: 15296 - RNA, 38 nt, Artificial Sequence
  Synthetic Oligonucleotide; GZMB exon 4; Set C
ugguacugucguaauaauggcguaagucagauucgcac

SEQ ID NO: 15297 - RNA, 39 nt, Artificial Sequence
  Synthetic Oligonucleotide; GZMB exon 4; Set C
augguacugucguaauaauggcguaagucagauucgcac

SEQ ID NO: 15298 - RNA, 15 nt, Artificial Sequence
  Synthetic Oligonucleotide; GZMB exon 4; Set C
cguaauaauggcgua

SEQ ID NO: 15299 - RNA, 16 nt, Artificial Sequence
  Synthetic Oligonucleotide; GZMB exon 4; Set C
ucguaauaauggcgua

SEQ ID NO: 15300 - RNA, 17 nt, Artificial Sequence
  Synthetic Oligonucleotide; GZMB exon 4; Set C
gucguaauaauggcgua

SEQ ID NO: 15301 - RNA, 15 nt, Artificial Sequence
  Synthetic Oligonucleotide; GZMB exon 4; Set C
ucguaauaauggcgu

SEQ ID NO: 15302 - RNA, 18 nt, Artificial Sequence
  Synthetic Oligonucleotide; GZMB exon 4; Set C
ugucguaauaauggcgua

SEQ ID NO: 15303 - RNA, 16 nt, Artificial Sequence
  Synthetic Oligonucleotide; GZMB exon 4; Set C
gucguaauaauggcgu

SEQ ID NO: 15304 - RNA, 19 nt, Artificial Sequence
  Synthetic Oligonucleotide; GZMB exon 4; Set C
cugucguaauaauggcgua

SEQ ID NO: 15305 - RNA, 17 nt, Artificial Sequence
  Synthetic Oligonucleotide; GZMB exon 4; Set C
ugucguaauaauggcgu

SEQ ID NO: 15306 - RNA, 15 nt, Artificial Sequence
  Synthetic Oligonucleotide; GZMB exon 4; Set C
gucguaauaauggcg

SEQ ID NO: 15307 - RNA, 18 nt, Artificial Sequence
  Synthetic Oligonucleotide; GZMB exon 4; Set C
cugucguaauaauggcgu

SEQ ID NO: 15308 - RNA, 16 nt, Artificial Sequence
  Synthetic Oligonucleotide; GZMB exon 4; Set C
ugucguaauaauggcg

SEQ ID NO: 15309 - RNA, 17 nt, Artificial Sequence
  Synthetic Oligonucleotide; GZMB exon 4; Set C
cugucguaauaauggcg

SEQ ID NO: 15310 - RNA, 21 nt, Artificial Sequence
  Synthetic Oligonucleotide; GZMB exon 4; Set C
ugguacugucguaauaauggc

SEQ ID NO: 15311 - RNA, 22 nt, Artificial Sequence
  Synthetic Oligonucleotide; GZMB exon 4; Set C
augguacugucguaauaauggc

SEQ ID NO: 15312 - RNA, 20 nt, Artificial Sequence
  Synthetic Oligonucleotide; GZMB exon 4; Set C
ugguacugucguaauaaugg

SEQ ID NO: 15313 - RNA, 21 nt, Artificial Sequence
  Synthetic Oligonucleotide; GZMB exon 4; Set C
augguacugucguaauaaugg

SEQ ID NO: 15314 - RNA, 18 nt, Artificial Sequence
  Synthetic Oligonucleotide; GZMB exon 4; Set C
aaugguacugucguaaua

SEQ ID NO: 15315 - RNA, 32 nt, Artificial Sequence
  Synthetic Oligonucleotide; GZMB exon 4; Set C
uuaaucucugggucccccacgcacaacucaau

SEQ ID NO: 15316 - RNA, 39 nt, Artificial Sequence
  Synthetic Oligonucleotide; GZMB exon 4; Set C
agucuuuuuaaucucugggucccccacgcacaacucaau

SEQ ID NO: 15317 - RNA, 40 nt, Artificial Sequence
  Synthetic Oligonucleotide; GZMB exon 4; Set C
aagucuuuuuaaucucugggucccccacgcacaacucaau

SEQ ID NO: 15318 - RNA, 15 nt, Artificial Sequence
  Synthetic Oligonucleotide; GZMB exon 4; Set C
gaagucuuuuuaauc

SEQ ID NO: 15319 - RNA, 19 nt, Artificial Sequence
  Synthetic Oligonucleotide; GZMB exon 4; Set C
aaaggaagucuuuuuaauc

SEQ ID NO: 15320 - RNA, 20 nt, Artificial Sequence
  Synthetic Oligonucleotide; GZMB exon 4; Set C
uaaaggaagucuuuuuaauc

SEQ ID NO: 15321 - RNA, 21 nt, Artificial Sequence
  Synthetic Oligonucleotide; GZMB exon 4; Set C
uuaaaggaagucuuuuuaauc

SEQ ID NO: 15322 - RNA, 33 nt, Artificial Sequence
  Synthetic Oligonucleotide; GZMB exon 4; Set B
gcauagucuuaccuuaaaggaagucuuuuuaau

SEQ ID NO: 15323 - RNA, 32 nt, Artificial Sequence
  Synthetic Oligonucleotide; GZMB exon 4; Set B
gcauagucuuaccuuaaaggaagucuuuuuaa

SEQ ID NO: 15324 - RNA, 31 nt, Artificial Sequence
  Synthetic Oligonucleotide; GZMB exon 4; Set B
gcauagucuuaccuuaaaggaagucuuuuua

SEQ ID NO: 15325 - RNA, 24 nt, Artificial Sequence
  Synthetic Oligonucleotide; GZMB exon 4; Set C
gcauagucuuaccuuaaaggaagu

SEQ ID NO: 15326 - RNA, 40 nt, Artificial Sequence
  Synthetic Oligonucleotide; GZMB exon 4; Set C
caggcaggugcauagucuuaccuuaaaggaagucuuuuua

SEQ ID NO: 15327 - RNA, 33 nt, Artificial Sequence
  Synthetic Oligonucleotide; GZMB exon 4; Set C
caggcaggugcauagucuuaccuuaaaggaagu

SEQ ID NO: 15328 - RNA, 39 nt, Artificial Sequence
  Synthetic Oligonucleotide; GZMB exon 4; Set C
ccaauccaggcaggugcauagucuuaccuuaaaggaagu

SEQ ID NO: 15329 - RNA, 38 nt, Artificial Sequence
  Synthetic Oligonucleotide; GZMB exon 4; Set C
ccaauccaggcaggugcauagucuuaccuuaaaggaag

SEQ ID NO: 15330 - RNA, 37 nt, Artificial Sequence
  Synthetic Oligonucleotide; GZMB exon 4; Set C
ccaauccaggcaggugcauagucuuaccuuaaaggaa

SEQ ID NO: 15331 - RNA, 33 nt, Artificial Sequence
  Synthetic Oligonucleotide; GZMB exon 4; Set C
ccaauccaggcaggugcauagucuuaccuuaaa

SEQ ID NO: 15332 - RNA, 32 nt, Artificial Sequence
  Synthetic Oligonucleotide; GZMB exon 4; Set C
ccaauccaggcaggugcauagucuuaccuuaa

SEQ ID NO: 15333 - RNA, 31 nt, Artificial Sequence
  Synthetic Oligonucleotide; GZMB exon 4; Set C
ccaauccaggcaggugcauagucuuaccuua

SEQ ID NO: 15334 - RNA, 16 nt, Artificial Sequence
  Synthetic Oligonucleotide; GZMB exon 4; Set C
caggcaggugcauagu

SEQ ID NO: 15335 - RNA, 15 nt, Artificial Sequence
  Synthetic Oligonucleotide; GZMB exon 4; Set C
caggcaggugcauag

SEQ ID NO: 15336 - RNA, 39 nt, Artificial Sequence
  Synthetic Oligonucleotide; GZMB exon 4; Set C
caagagccaauccaggcaggugcauagucuuaccuuaaa

SEQ ID NO: 15337 - RNA, 40 nt, Artificial Sequence
  Synthetic Oligonucleotide; GZMB exon 4; Set C
ccaagagccaauccaggcaggugcauagucuuaccuuaaa

SEQ ID NO: 15338 - RNA, 38 nt, Artificial Sequence
  Synthetic Oligonucleotide; GZMB exon 4; Set C
caagagccaauccaggcaggugcauagucuuaccuuaa

SEQ ID NO: 15339 - RNA, 39 nt, Artificial Sequence
  Synthetic Oligonucleotide; GZMB exon 4; Set C
ccaagagccaauccaggcaggugcauagucuuaccuuaa

SEQ ID NO: 15340 - RNA, 37 nt, Artificial Sequence
  Synthetic Oligonucleotide; GZMB exon 4; Set C
caagagccaauccaggcaggugcauagucuuaccuua

SEQ ID NO: 15341 - RNA, 20 nt, Artificial Sequence
  Synthetic Oligonucleotide; GZMB exon 4; Set B
aauccaggcaggugcauagu

SEQ ID NO: 15342 - RNA, 38 nt, Artificial Sequence
  Synthetic Oligonucleotide; GZMB exon 4; Set C
ccaagagccaauccaggcaggugcauagucuuaccuua

SEQ ID NO: 15343 - RNA, 19 nt, Artificial Sequence
  Synthetic Oligonucleotide; GZMB exon 4; Set C
aauccaggcaggugcauag

SEQ ID NO: 15344 - RNA, 18 nt, Artificial Sequence
  Synthetic Oligonucleotide; GZMB exon 4; Set C
aauccaggcaggugcaua

SEQ ID NO: 15345 - RNA, 22 nt, Artificial Sequence
  Synthetic Oligonucleotide; GZMB exon 4; Set B
ccaauccaggcaggugcauagu

SEQ ID NO: 15346 - RNA, 21 nt, Artificial Sequence
  Synthetic Oligonucleotide; GZMB exon 4; Set B
ccaauccaggcaggugcauag

SEQ ID NO: 15347 - RNA, 20 nt, Artificial Sequence
  Synthetic Oligonucleotide; GZMB exon 4; Set B
ccaauccaggcaggugcaua

SEQ ID NO: 15348 - RNA, 19 nt, Artificial Sequence
  Synthetic Oligonucleotide; GZMB exon 4; Set B
ccaauccaggcaggugcau

SEQ ID NO: 15349 - RNA, 28 nt, Artificial Sequence
  Synthetic Oligonucleotide; GZMB exon 4; Set C
caagagccaauccaggcaggugcauagu

SEQ ID NO: 15350 - RNA, 27 nt, Artificial Sequence
  Synthetic Oligonucleotide; GZMB exon 4; Set C
caagagccaauccaggcaggugcauag

SEQ ID NO: 15351 - RNA, 26 nt, Artificial Sequence
  Synthetic Oligonucleotide; GZMB exon 4; Set C
caagagccaauccaggcaggugcaua

SEQ ID NO: 15352 - RNA, 27 nt, Artificial Sequence
  Synthetic Oligonucleotide; GZMB exon 4; Set C
ccaagagccaauccaggcaggugcaua

SEQ ID NO: 15353 - RNA, 25 nt, Artificial Sequence
  Synthetic Oligonucleotide; GZMB exon 4; Set C
caagagccaauccaggcaggugcau

SEQ ID NO: 15354 - RNA, 26 nt, Artificial Sequence
  Synthetic Oligonucleotide; GZMB exon 4; Set C
ccaagagccaauccaggcaggugcau

SEQ ID NO: 15355 - RNA, 38 nt, Artificial Sequence
  Synthetic Oligonucleotide; GZMB exon 4; Set C
aucuuucucccaagagccaauccaggcaggugcauagu

SEQ ID NO: 15356 - RNA, 37 nt, Artificial Sequence
  Synthetic Oligonucleotide; GZMB exon 4; Set C
aucuuucucccaagagccaauccaggcaggugcauag

SEQ ID NO: 15357 - RNA, 36 nt, Artificial Sequence
  Synthetic Oligonucleotide; GZMB exon 4; Set C
aucuuucucccaagagccaauccaggcaggugcaua

SEQ ID NO: 15358 - RNA, 35 nt, Artificial Sequence
  Synthetic Oligonucleotide; GZMB exon 4; Set C
aucuuucucccaagagccaauccaggcaggugcau

SEQ ID NO: 15359 - RNA, 40 nt, Artificial Sequence
  Synthetic Oligonucleotide; GZMB exon 4; Set C
aaacaucuuucucccaagagccaauccaggcaggugcaua

SEQ ID NO: 15360 - RNA, 39 nt, Artificial Sequence
  Synthetic Oligonucleotide; GZMB exon 4; Set C
aaacaucuuucucccaagagccaauccaggcaggugcau

SEQ ID NO: 15361 - RNA, 40 nt, Artificial Sequence
  Synthetic Oligonucleotide; GZMB exon 4; Set C
caaacaucuuucucccaagagccaauccaggcaggugcau

SEQ ID NO: 15362 - RNA, 15 nt, Artificial Sequence
  Synthetic Oligonucleotide; GZMB exon 4; Set C
uucucccaagagcca

SEQ ID NO: 15363 - RNA, 16 nt, Artificial Sequence
  Synthetic Oligonucleotide; GZMB exon 4; Set C
uuucucccaagagcca

SEQ ID NO: 15364 - RNA, 18 nt, Artificial Sequence
  Synthetic Oligonucleotide; GZMB exon 4; Set C
ucuuucucccaagagcca

SEQ ID NO: 15365 - RNA, 15 nt, Artificial Sequence
  Synthetic Oligonucleotide; PRF1 exon 2; Set C
acuugggcucuggga

SEQ ID NO: 15366 - RNA, 27 nt, Artificial Sequence
  Synthetic Oligonucleotide; PRF1 exon 2; Set C
uggagcugcagagacagggggcacuug

SEQ ID NO: 15367 - RNA, 28 nt, Artificial Sequence
  Synthetic Oligonucleotide; PRF1 exon 2; Set C
auggagcugcagagacagggggcacuug

SEQ ID NO: 15368 - RNA, 26 nt, Artificial Sequence
  Synthetic Oligonucleotide; PRF1 exon 2; Set C
uggagcugcagagacagggggcacuu

SEQ ID NO: 15369 - RNA, 25 nt, Artificial Sequence
  Synthetic Oligonucleotide; PRF1 exon 2; Set C
uggagcugcagagacagggggcacu

SEQ ID NO: 15370 - RNA, 27 nt, Artificial Sequence
  Synthetic Oligonucleotide; PRF1 exon 2; Set C
auggagcugcagagacagggggcacuu

SEQ ID NO: 15371 - RNA, 26 nt, Artificial Sequence
  Synthetic Oligonucleotide; PRF1 exon 2; Set C
auggagcugcagagacagggggcacu

SEQ ID NO: 15372 - RNA, 29 nt, Artificial Sequence
  Synthetic Oligonucleotide; PRF1 exon 2; Set C
uguagggcauuuucacagagggugcaggu

SEQ ID NO: 15373 - RNA, 18 nt, Artificial Sequence
  Synthetic Oligonucleotide; PRF1 exon 2; Set C
guagggcauuuucacaga

SEQ ID NO: 15374 - RNA, 19 nt, Artificial Sequence
  Synthetic Oligonucleotide; PRF1 exon 2; Set C
uguagggcauuuucacaga

SEQ ID NO: 15375 - RNA, 16 nt, Artificial Sequence
  Synthetic Oligonucleotide; PRF1 exon 2; Set C
guagggcauuuucaca

SEQ ID NO: 15376 - RNA, 15 nt, Artificial Sequence
  Synthetic Oligonucleotide; PRF1 exon 2; Set C
guagggcauuuucac

SEQ ID NO: 15377 - RNA, 17 nt, Artificial Sequence
  Synthetic Oligonucleotide; PRF1 exon 2; Set C
uguagggcauuuucaca

SEQ ID NO: 15378 - RNA, 16 nt, Artificial Sequence
  Synthetic Oligonucleotide; PRF1 exon 2; Set C
uguagggcauuuucac

SEQ ID NO: 15379 - RNA, 15 nt, Artificial Sequence
  Synthetic Oligonucleotide; PRF1 exon 2; Set C
uguagggcauuuuca

SEQ ID NO: 15380 - RNA, 37 nt, Artificial Sequence
  Synthetic Oligonucleotide; PRF1 exon 2; Set C
guacugguccuggugggucuucugggcugcaaaguug

SEQ ID NO: 15381 - RNA, 36 nt, Artificial Sequence
  Synthetic Oligonucleotide; PRF1 exon 2; Set C
guacugguccuggugggucuucugggcugcaaaguu

SEQ ID NO: 15382 - RNA, 15 nt, Artificial Sequence
  Synthetic Oligonucleotide; PRF1 exon 2; Set C
uggaggaugacugcu

SEQ ID NO: 15383 - RNA, 40 nt, Artificial Sequence
  Synthetic Oligonucleotide; PRF1 exon 2; Set C
uugggcucugggaagccauggguggagggauggaggauga

SEQ ID NO: 15384 - RNA, 39 nt, Artificial Sequence
  Synthetic Oligonucleotide; PRF1 exon 2; Set C
uugggcucugggaagccauggguggagggauggaggaug

SEQ ID NO: 15385 - RNA, 38 nt, Artificial Sequence
  Synthetic Oligonucleotide; PRF1 exon 2; Set C
uugggcucugggaagccauggguggagggauggaggau

SEQ ID NO: 15386 - RNA, 40 nt, Artificial Sequence
  Synthetic Oligonucleotide; PRF1 exon 2; Set C
cuugggcucugggaagccauggguggagggauggaggaug

SEQ ID NO: 15387 - RNA, 39 nt, Artificial Sequence
  Synthetic Oligonucleotide; PRF1 exon 2; Set C
cuugggcucugggaagccauggguggagggauggaggau

SEQ ID NO: 15388 - RNA, 40 nt, Artificial Sequence
  Synthetic Oligonucleotide; PRF1 exon 2; Set C
acuugggcucugggaagccauggguggagggauggaggau

SEQ ID NO: 15389 - RNA, 33 nt, Artificial Sequence
  Synthetic Oligonucleotide; PRF1 exon 2; Set C
uugggcucugggaagccauggguggagggaugg

SEQ ID NO: 15390 - RNA, 34 nt, Artificial Sequence
  Synthetic Oligonucleotide; PRF1 exon 2; Set C
cuugggcucugggaagccauggguggagggaugg

SEQ ID NO: 15391 - RNA, 35 nt, Artificial Sequence
  Synthetic Oligonucleotide; PRF1 exon 2; Set C
acuugggcucugggaagccauggguggagggaugg

SEQ ID NO: 15392 - RNA, 19 nt, Artificial Sequence
  Synthetic Oligonucleotide; PRF1 exon 2; Set A
uugggcucugggaagccau

SEQ ID NO: 15393 - RNA, 20 nt, Artificial Sequence
  Synthetic Oligonucleotide; PRF1 exon 2; Set A
cuugggcucugggaagccau

SEQ ID NO: 15394 - RNA, 21 nt, Artificial Sequence
  Synthetic Oligonucleotide; PRF1 exon 2; Set A
acuugggcucugggaagccau

SEQ ID NO: 15395 - RNA, 20 nt, Artificial Sequence
  Synthetic Oligonucleotide; PRF1 exon 2; Set C
ggggcacuugggcucuggga

SEQ ID NO: 15396 - RNA, 21 nt, Artificial Sequence
  Synthetic Oligonucleotide; PRF1 exon 2; Set C
gggggcacuugggcucuggga

SEQ ID NO: 15397 - RNA, 22 nt, Artificial Sequence
  Synthetic Oligonucleotide; PRF1 exon 2; Set C
agggggcacuugggcucuggga

SEQ ID NO: 15398 - RNA, 23 nt, Artificial Sequence
  Synthetic Oligonucleotide; PRF1 exon 2; Set C
cagggggcacuugggcucuggga

SEQ ID NO: 15399 - RNA, 27 nt, Artificial Sequence
  Synthetic Oligonucleotide; PRF1 exon 2; Set C
gagacagggggcacuugggcucuggga

SEQ ID NO: 15400 - RNA, 28 nt, Artificial Sequence
  Synthetic Oligonucleotide; PRF1 exon 2; Set C
agagacagggggcacuugggcucuggga

SEQ ID NO: 15401 - RNA, 35 nt, Artificial Sequence
  Synthetic Oligonucleotide; PRF1 exon 2; Set C
gagcugcagagacagggggcacuugggcucuggga

SEQ ID NO: 15402 - RNA, 36 nt, Artificial Sequence
  Synthetic Oligonucleotide; PRF1 exon 2; Set C
ggagcugcagagacagggggcacuugggcucuggga

SEQ ID NO: 15403 - RNA, 17 nt, Artificial Sequence
  Synthetic Oligonucleotide; PRF1 exon 2; Set A
gagacagggggcacuug

SEQ ID NO: 15404 - RNA, 37 nt, Artificial Sequence
  Synthetic Oligonucleotide; PRF1 exon 2; Set C
uggagcugcagagacagggggcacuugggcucuggga

SEQ ID NO: 15405 - RNA, 18 nt, Artificial Sequence
  Synthetic Oligonucleotide; PRF1 exon 2; Set A
agagacagggggcacuug

SEQ ID NO: 15406 - RNA, 16 nt, Artificial Sequence
  Synthetic Oligonucleotide; PRF1 exon 2; Set A
gagacagggggcacuu

SEQ ID NO: 15407 - RNA, 38 nt, Artificial Sequence
  Synthetic Oligonucleotide; PRF1 exon 2; Set C
auggagcugcagagacagggggcacuugggcucuggga

SEQ ID NO: 15408 - RNA, 36 nt, Artificial Sequence
  Synthetic Oligonucleotide; PRF1 exon 2; Set C
uggagcugcagagacagggggcacuugggcucuggg

SEQ ID NO: 15409 - RNA, 15 nt, Artificial Sequence
  Synthetic Oligonucleotide; PRF1 exon 2; Set C
gagacagggggcacu

SEQ ID NO: 15410 - RNA, 17 nt, Artificial Sequence
  Synthetic Oligonucleotide; PRF1 exon 2; Set A
agagacagggggcacuu

SEQ ID NO: 15411 - RNA, 37 nt, Artificial Sequence
  Synthetic Oligonucleotide; PRF1 exon 2; Set C
auggagcugcagagacagggggcacuugggcucuggg

SEQ ID NO: 15412 - RNA, 16 nt, Artificial Sequence
  Synthetic Oligonucleotide; PRF1 exon 2; Set C
agagacagggggcacu

SEQ ID NO: 15413 - RNA, 25 nt, Artificial Sequence
  Synthetic Oligonucleotide; PRF1 exon 2; Set C
gagcugcagagacagggggcacuug

SEQ ID NO: 15414 - RNA, 26 nt, Artificial Sequence
  Synthetic Oligonucleotide; PRF1 exon 2; Set C
ggagcugcagagacagggggcacuug

SEQ ID NO: 15415 - RNA, 24 nt, Artificial Sequence
  Synthetic Oligonucleotide; PRF1 exon 2; Set C
gagcugcagagacagggggcacuu

SEQ ID NO: 15416 - RNA, 28 nt, Artificial Sequence
  Synthetic Oligonucleotide; PRF1 exon 2; Set C
uggagcugcagagacagggggcacuugg

SEQ ID NO: 15417 - RNA, 25 nt, Artificial Sequence
  Synthetic Oligonucleotide; PRF1 exon 2; Set C
ggagcugcagagacagggggcacuu

SEQ ID NO: 15418 - RNA, 23 nt, Artificial Sequence
  Synthetic Oligonucleotide; PRF1 exon 2; Set C
gagcugcagagacagggggcacu

SEQ ID NO: 15419 - RNA, 29 nt, Artificial Sequence
  Synthetic Oligonucleotide; PRF1 exon 2; Set C
auggagcugcagagacagggggcacuugg

SEQ ID NO: 15420 - RNA, 24 nt, Artificial Sequence
  Synthetic Oligonucleotide; PRF1 exon 2; Set C
ggagcugcagagacagggggcacu

SEQ ID NO: 15421 - RNA, 18 nt, Artificial Sequence
  Synthetic Oligonucleotide; PRF1 exon 2; Set A
gagcugcagagacagggg

SEQ ID NO: 15422 - RNA, 17 nt, Artificial Sequence
  Synthetic Oligonucleotide; PRF1 exon 2; Set C
gagcugcagagacaggg

SEQ ID NO: 15423 - RNA, 19 nt, Artificial Sequence
  Synthetic Oligonucleotide; PRF1 exon 2; Set A
ggagcugcagagacagggg

SEQ ID NO: 15424 - RNA, 18 nt, Artificial Sequence
  Synthetic Oligonucleotide; PRF1 exon 2; Set A
ggagcugcagagacaggg

SEQ ID NO: 15425 - RNA, 16 nt, Artificial Sequence
  Synthetic Oligonucleotide; PRF1 exon 2; Set C
gagcugcagagacagg

SEQ ID NO: 15426 - RNA, 20 nt, Artificial Sequence
  Synthetic Oligonucleotide; PRF1 exon 2; Set A
uggagcugcagagacagggg

SEQ ID NO: 15427 - RNA, 19 nt, Artificial Sequence
  Synthetic Oligonucleotide; PRF1 exon 2; Set A
uggagcugcagagacaggg

SEQ ID NO: 15428 - RNA, 17 nt, Artificial Sequence
  Synthetic Oligonucleotide; PRF1 exon 2; Set C
ggagcugcagagacagg

SEQ ID NO: 15429 - RNA, 15 nt, Artificial Sequence
  Synthetic Oligonucleotide; PRF1 exon 2; Set C
gagcugcagagacag

SEQ ID NO: 15430 - RNA, 21 nt, Artificial Sequence
  Synthetic Oligonucleotide; PRF1 exon 2; Set A
auggagcugcagagacagggg

SEQ ID NO: 15431 - RNA, 20 nt, Artificial Sequence
  Synthetic Oligonucleotide; PRF1 exon 2; Set A
auggagcugcagagacaggg

SEQ ID NO: 15432 - RNA, 18 nt, Artificial Sequence
  Synthetic Oligonucleotide; PRF1 exon 2; Set A
uggagcugcagagacagg

SEQ ID NO: 15433 - RNA, 16 nt, Artificial Sequence
  Synthetic Oligonucleotide; PRF1 exon 2; Set C
ggagcugcagagacag

SEQ ID NO: 15434 - RNA, 19 nt, Artificial Sequence
  Synthetic Oligonucleotide; PRF1 exon 2; Set A
auggagcugcagagacagg

SEQ ID NO: 15435 - RNA, 17 nt, Artificial Sequence
  Synthetic Oligonucleotide; PRF1 exon 2; Set C
uggagcugcagagacag

SEQ ID NO: 15436 - RNA, 38 nt, Artificial Sequence
  Synthetic Oligonucleotide; PRF1 exon 2; Set C
acgggcugccauggagcugcagagacagggggcacuug

SEQ ID NO: 15437 - RNA, 18 nt, Artificial Sequence
  Synthetic Oligonucleotide; PRF1 exon 2; Set C
auggagcugcagagacag

SEQ ID NO: 15438 - RNA, 37 nt, Artificial Sequence
  Synthetic Oligonucleotide; PRF1 exon 2; Set C
acgggcugccauggagcugcagagacagggggcacuu

SEQ ID NO: 15439 - RNA, 36 nt, Artificial Sequence
  Synthetic Oligonucleotide; PRF1 exon 2; Set C
acgggcugccauggagcugcagagacagggggcacu

SEQ ID NO: 15440 - RNA, 31 nt, Artificial Sequence
  Synthetic Oligonucleotide; PRF1 exon 2; Set C
acgggcugccauggagcugcagagacagggg

SEQ ID NO: 15441 - RNA, 30 nt, Artificial Sequence
  Synthetic Oligonucleotide; PRF1 exon 2; Set C
acgggcugccauggagcugcagagacaggg

SEQ ID NO: 15442 - RNA, 29 nt, Artificial Sequence
  Synthetic Oligonucleotide; PRF1 exon 2; Set C
acgggcugccauggagcugcagagacagg

SEQ ID NO: 15443 - RNA, 28 nt, Artificial Sequence
  Synthetic Oligonucleotide; PRF1 exon 2; Set C
acgggcugccauggagcugcagagacag

SEQ ID NO: 15444 - RNA, 24 nt, Artificial Sequence
  Synthetic Oligonucleotide; PRF1 exon 2; Set C
acgggcugccauggagcugcagag

SEQ ID NO: 15445 - RNA, 23 nt, Artificial Sequence
  Synthetic Oligonucleotide; PRF1 exon 2; Set C
acgggcugccauggagcugcaga

SEQ ID NO: 15446 - RNA, 16 nt, Artificial Sequence
  Synthetic Oligonucleotide; PRF1 exon 2; Set A
acgggcugccauggag

SEQ ID NO: 15447 - RNA, 15 nt, Artificial Sequence
  Synthetic Oligonucleotide; PRF1 exon 2; Set A
acgggcugccaugga

SEQ ID NO: 15448 - RNA, 40 nt, Artificial Sequence
  Synthetic Oligonucleotide; PRF1 exon 2; Set C
augcccaggaggagcagacgggcugccauggagcugcaga

SEQ ID NO: 15449 - RNA, 32 nt, Artificial Sequence
  Synthetic Oligonucleotide; PRF1 exon 2; Set C
ugcccaggaggagcagacgggcugccauggag

SEQ ID NO: 15450 - RNA, 33 nt, Artificial Sequence
  Synthetic Oligonucleotide; PRF1 exon 2; Set C
augcccaggaggagcagacgggcugccauggag

SEQ ID NO: 15451 - RNA, 30 nt, Artificial Sequence
  Synthetic Oligonucleotide; PRF1 exon 2; Set C
ugcccaggaggagcagacgggcugccaugg

SEQ ID NO: 15452 - RNA, 32 nt, Artificial Sequence
  Synthetic Oligonucleotide; PRF1 exon 2; Set C
augcccaggaggagcagacgggcugccaugga

SEQ ID NO: 15453 - RNA, 34 nt, Artificial Sequence
  Synthetic Oligonucleotide; PRF1 exon 2; Set C
gaugcccaggaggagcagacgggcugccauggag

SEQ ID NO: 15454 - RNA, 31 nt, Artificial Sequence
  Synthetic Oligonucleotide; PRF1 exon 2; Set C
augcccaggaggagcagacgggcugccaugg

SEQ ID NO: 15455 - RNA, 29 nt, Artificial Sequence
  Synthetic Oligonucleotide; PRF1 exon 2; Set C
ugcccaggaggagcagacgggcugccaug

SEQ ID NO: 15456 - RNA, 33 nt, Artificial Sequence
  Synthetic Oligonucleotide; PRF1 exon 2; Set C
gaugcccaggaggagcagacgggcugccaugga

SEQ ID NO: 15457 - RNA, 32 nt, Artificial Sequence
  Synthetic Oligonucleotide; PRF1 exon 2; Set C
gaugcccaggaggagcagacgggcugccaugg

SEQ ID NO: 15458 - RNA, 30 nt, Artificial Sequence
  Synthetic Oligonucleotide; PRF1 exon 2; Set C
augcccaggaggagcagacgggcugccaug

SEQ ID NO: 15459 - RNA, 31 nt, Artificial Sequence
  Synthetic Oligonucleotide; PRF1 exon 2; Set C
gaugcccaggaggagcagacgggcugccaug

SEQ ID NO: 15460 - RNA, 40 nt, Artificial Sequence
  Synthetic Oligonucleotide; PRF1 exon 2; Set C
aggagaaggaugcccaggaggagcagacgggcugccaugg

SEQ ID NO: 15461 - RNA, 39 nt, Artificial Sequence
  Synthetic Oligonucleotide; PRF1 exon 2; Set C
aggagaaggaugcccaggaggagcagacgggcugccaug

SEQ ID NO: 15462 - RNA, 29 nt, Artificial Sequence
  Synthetic Oligonucleotide; PRF1 exon 2; Set C
aggagaaggaugcccaggaggagcagacg

SEQ ID NO: 15463 - RNA, 17 nt, Artificial Sequence
  Synthetic Oligonucleotide; PRF1 exon 2; Set C
uguguccacugggaagg

SEQ ID NO: 15464 - RNA, 18 nt, Artificial Sequence
  Synthetic Oligonucleotide; PRF1 exon 2; Set C
guguguccacugggaagg

SEQ ID NO: 15465 - RNA, 16 nt, Artificial Sequence
  Synthetic Oligonucleotide; PRF1 exon 2; Set C
uguguccacugggaag

SEQ ID NO: 15466 - RNA, 19 nt, Artificial Sequence
  Synthetic Oligonucleotide; PRF1 exon 2; Set A
uguguguccacugggaagg

SEQ ID NO: 15467 - RNA, 17 nt, Artificial Sequence
  Synthetic Oligonucleotide; PRF1 exon 2; Set C
guguguccacugggaag

SEQ ID NO: 15468 - RNA, 20 nt, Artificial Sequence
  Synthetic Oligonucleotide; PRF1 exon 2; Set A
uuguguguccacugggaagg

SEQ ID NO: 15469 - RNA, 18 nt, Artificial Sequence
  Synthetic Oligonucleotide; PRF1 exon 2; Set C
uguguguccacugggaag

SEQ ID NO: 15470 - RNA, 16 nt, Artificial Sequence
  Synthetic Oligonucleotide; PRF1 exon 2; Set C
guguguccacugggaa

SEQ ID NO: 15471 - RNA, 21 nt, Artificial Sequence
  Synthetic Oligonucleotide; PRF1 exon 2; Set A
uuuguguguccacugggaagg

SEQ ID NO: 15472 - RNA, 19 nt, Artificial Sequence
  Synthetic Oligonucleotide; PRF1 exon 2; Set C
uuguguguccacugggaag

SEQ ID NO: 15473 - RNA, 17 nt, Artificial Sequence
  Synthetic Oligonucleotide; PRF1 exon 2; Set C
uguguguccacugggaa

SEQ ID NO: 15474 - RNA, 22 nt, Artificial Sequence
  Synthetic Oligonucleotide; PRF1 exon 2; Set A
cuuuguguguccacugggaagg

SEQ ID NO: 15475 - RNA, 20 nt, Artificial Sequence
  Synthetic Oligonucleotide; PRF1 exon 2; Set C
uuuguguguccacugggaag

SEQ ID NO: 15476 - RNA, 18 nt, Artificial Sequence
  Synthetic Oligonucleotide; PRF1 exon 2; Set C
uuguguguccacugggaa

SEQ ID NO: 15477 - RNA, 16 nt, Artificial Sequence
  Synthetic Oligonucleotide; PRF1 exon 2; Set C
uguguguccacuggga

SEQ ID NO: 15478 - RNA, 21 nt, Artificial Sequence
  Synthetic Oligonucleotide; PRF1 exon 2; Set C
cuuuguguguccacugggaag

SEQ ID NO: 15479 - RNA, 19 nt, Artificial Sequence
  Synthetic Oligonucleotide; PRF1 exon 2; Set C
uuuguguguccacugggaa

SEQ ID NO: 15480 - RNA, 17 nt, Artificial Sequence
  Synthetic Oligonucleotide; PRF1 exon 2; Set C
uuguguguccacuggga

SEQ ID NO: 15481 - RNA, 20 nt, Artificial Sequence
  Synthetic Oligonucleotide; PRF1 exon 2; Set C
cuuuguguguccacugggaa

SEQ ID NO: 15482 - RNA, 18 nt, Artificial Sequence
  Synthetic Oligonucleotide; PRF1 exon 2; Set C
uuuguguguccacuggga

SEQ ID NO: 15483 - RNA, 19 nt, Artificial Sequence
  Synthetic Oligonucleotide; PRF1 exon 2; Set A
cuuuguguguccacuggga

SEQ ID NO: 15484 - RNA, 15 nt, Artificial Sequence
  Synthetic Oligonucleotide; PRF1 exon 2; Set C
acagagggugcaggu

SEQ ID NO: 15485 - RNA, 16 nt, Artificial Sequence
  Synthetic Oligonucleotide; PRF1 exon 2; Set C
cacagagggugcaggu

SEQ ID NO: 15486 - RNA, 17 nt, Artificial Sequence
  Synthetic Oligonucleotide; PRF1 exon 2; Set A
ucacagagggugcaggu

SEQ ID NO: 15487 - RNA, 15 nt, Artificial Sequence
  Synthetic Oligonucleotide; PRF1 exon 2; Set C
cacagagggugcagg

SEQ ID NO: 15488 - RNA, 18 nt, Artificial Sequence
  Synthetic Oligonucleotide; PRF1 exon 2; Set A
uucacagagggugcaggu

SEQ ID NO: 15489 - RNA, 16 nt, Artificial Sequence
  Synthetic Oligonucleotide; PRF1 exon 2; Set C
ucacagagggugcagg

SEQ ID NO: 15490 - RNA, 19 nt, Artificial Sequence
  Synthetic Oligonucleotide; PRF1 exon 2; Set A
uuucacagagggugcaggu

SEQ ID NO: 15491 - RNA, 17 nt, Artificial Sequence
  Synthetic Oligonucleotide; PRF1 exon 2; Set C
uucacagagggugcagg

SEQ ID NO: 15492 - RNA, 15 nt, Artificial Sequence
  Synthetic Oligonucleotide; PRF1 exon 2; Set C
ucacagagggugcag

SEQ ID NO: 15493 - RNA, 20 nt, Artificial Sequence
  Synthetic Oligonucleotide; PRF1 exon 2; Set A
uuuucacagagggugcaggu

SEQ ID NO: 15494 - RNA, 18 nt, Artificial Sequence
  Synthetic Oligonucleotide; PRF1 exon 2; Set C
uuucacagagggugcagg

SEQ ID NO: 15495 - RNA, 16 nt, Artificial Sequence
  Synthetic Oligonucleotide; PRF1 exon 2; Set C
uucacagagggugcag

SEQ ID NO: 15496 - RNA, 19 nt, Artificial Sequence
  Synthetic Oligonucleotide; PRF1 exon 2; Set C
uuuucacagagggugcagg

SEQ ID NO: 15497 - RNA, 17 nt, Artificial Sequence
  Synthetic Oligonucleotide; PRF1 exon 2; Set C
uuucacagagggugcag

SEQ ID NO: 15498 - RNA, 21 nt, Artificial Sequence
  Synthetic Oligonucleotide; PRF1 exon 2; Set A
auuuucacagagggugcaggu

SEQ ID NO: 15499 - RNA, 18 nt, Artificial Sequence
  Synthetic Oligonucleotide; PRF1 exon 2; Set C
uuuucacagagggugcag

SEQ ID NO: 15500 - RNA, 20 nt, Artificial Sequence
  Synthetic Oligonucleotide; PRF1 exon 2; Set C
auuuucacagagggugcagg

SEQ ID NO: 15501 - RNA, 19 nt, Artificial Sequence
  Synthetic Oligonucleotide; PRF1 exon 2; Set C
auuuucacagagggugcag

SEQ ID NO: 15502 - RNA, 27 nt, Artificial Sequence
  Synthetic Oligonucleotide; PRF1 exon 2; Set C
uagggcauuuucacagagggugcaggu

SEQ ID NO: 15503 - RNA, 28 nt, Artificial Sequence
  Synthetic Oligonucleotide; PRF1 exon 2; Set C
guagggcauuuucacagagggugcaggu

SEQ ID NO: 15504 - RNA, 26 nt, Artificial Sequence
  Synthetic Oligonucleotide; PRF1 exon 2; Set C
uagggcauuuucacagagggugcagg

SEQ ID NO: 15505 - RNA, 27 nt, Artificial Sequence
  Synthetic Oligonucleotide; PRF1 exon 2; Set C
guagggcauuuucacagagggugcagg

SEQ ID NO: 15506 - RNA, 25 nt, Artificial Sequence
  Synthetic Oligonucleotide; PRF1 exon 2; Set A
uagggcauuuucacagagggugcag

SEQ ID NO: 15507 - RNA, 28 nt, Artificial Sequence
  Synthetic Oligonucleotide; PRF1 exon 2; Set C
uguagggcauuuucacagagggugcagg

SEQ ID NO: 15508 - RNA, 26 nt, Artificial Sequence
  Synthetic Oligonucleotide; PRF1 exon 2; Set C
guagggcauuuucacagagggugcag

SEQ ID NO: 15509 - RNA, 27 nt, Artificial Sequence
  Synthetic Oligonucleotide; PRF1 exon 2; Set C
uguagggcauuuucacagagggugcag

SEQ ID NO: 15510 - RNA, 20 nt, Artificial Sequence
  Synthetic Oligonucleotide; PRF1 exon 2; Set C
guagggcauuuucacagagg

SEQ ID NO: 15511 - RNA, 37 nt, Artificial Sequence
  Synthetic Oligonucleotide; PRF1 exon 2; Set C
ugcccuccuguagggcauuuucacagagggugcaggu

SEQ ID NO: 15512 - RNA, 17 nt, Artificial Sequence
  Synthetic Oligonucleotide; PRF1 exon 2; Set C
uagggcauuuucacaga

SEQ ID NO: 15513 - RNA, 21 nt, Artificial Sequence
  Synthetic Oligonucleotide; PRF1 exon 2; Set C
uguagggcauuuucacagagg

SEQ ID NO: 15514 - RNA, 19 nt, Artificial Sequence
  Synthetic Oligonucleotide; PRF1 exon 2; Set C
guagggcauuuucacagag

SEQ ID NO: 15515 - RNA, 38 nt, Artificial Sequence
  Synthetic Oligonucleotide; PRF1 exon 2; Set C
gugcccuccuguagggcauuuucacagagggugcaggu

SEQ ID NO: 15516 - RNA, 36 nt, Artificial Sequence
  Synthetic Oligonucleotide; PRF1 exon 2; Set C
ugcccuccuguagggcauuuucacagagggugcagg

SEQ ID NO: 15517 - RNA, 16 nt, Artificial Sequence
  Synthetic Oligonucleotide; PRF1 exon 2; Set C
uagggcauuuucacag

SEQ ID NO: 15518 - RNA, 20 nt, Artificial Sequence
  Synthetic Oligonucleotide; PRF1 exon 2; Set C
uguagggcauuuucacagag

SEQ ID NO: 15519 - RNA, 37 nt, Artificial Sequence
  Synthetic Oligonucleotide; PRF1 exon 2; Set C
gugcccuccuguagggcauuuucacagagggugcagg

SEQ ID NO: 15520 - RNA, 35 nt, Artificial Sequence
  Synthetic Oligonucleotide; PRF1 exon 2; Set C
ugcccuccuguagggcauuuucacagagggugcag

SEQ ID NO: 15521 - RNA, 15 nt, Artificial Sequence
  Synthetic Oligonucleotide; PRF1 exon 2; Set C
uagggcauuuucaca

SEQ ID NO: 15522 - RNA, 17 nt, Artificial Sequence
  Synthetic Oligonucleotide; PRF1 exon 2; Set C
guagggcauuuucacag

SEQ ID NO: 15523 - RNA, 36 nt, Artificial Sequence
  Synthetic Oligonucleotide; PRF1 exon 2; Set C
gugcccuccuguagggcauuuucacagagggugcag

SEQ ID NO: 15524 - RNA, 18 nt, Artificial Sequence
  Synthetic Oligonucleotide; PRF1 exon 2; Set C
uguagggcauuuucacag

SEQ ID NO: 15525 - RNA, 28 nt, Artificial Sequence
  Synthetic Oligonucleotide; PRF1 exon 2; Set C
gugcccuccuguagggcauuuucacaga

SEQ ID NO: 15526 - RNA, 23 nt, Artificial Sequence
  Synthetic Oligonucleotide; PRF1 exon 2; Set C
ugcccuccuguagggcauuuuca

SEQ ID NO: 15527 - RNA, 22 nt, Artificial Sequence
  Synthetic Oligonucleotide; PRF1 exon 2; Set A
ugcccuccuguagggcauuuuc

SEQ ID NO: 15528 - RNA, 24 nt, Artificial Sequence
  Synthetic Oligonucleotide; PRF1 exon 2; Set C
gugcccuccuguagggcauuuuca

SEQ ID NO: 15529 - RNA, 23 nt, Artificial Sequence
  Synthetic Oligonucleotide; PRF1 exon 2; Set A
gugcccuccuguagggcauuuuc

SEQ ID NO: 15530 - RNA, 22 nt, Artificial Sequence
  Synthetic Oligonucleotide; PRF1 exon 2; Set A
gugcccuccuguagggcauuuu

SEQ ID NO: 15531 - RNA, 21 nt, Artificial Sequence
  Synthetic Oligonucleotide; PRF1 exon 2; Set A
gugcccuccuguagggcauuu

SEQ ID NO: 15532 - RNA, 20 nt, Artificial Sequence
  Synthetic Oligonucleotide; PRF1 exon 2; Set A
cguugcggaugcuacgagcc

SEQ ID NO: 15533 - RNA, 21 nt, Artificial Sequence
  Synthetic Oligonucleotide; PRF1 exon 2; Set A
ucguugcggaugcuacgagcc

SEQ ID NO: 15534 - RNA, 22 nt, Artificial Sequence
  Synthetic Oligonucleotide; PRF1 exon 2; Set C
gucguugcggaugcuacgagcc

SEQ ID NO: 15535 - RNA, 21 nt, Artificial Sequence
  Synthetic Oligonucleotide; PRF1 exon 2; Set A
gucguugcggaugcuacgagc

SEQ ID NO: 15536 - RNA, 20 nt, Artificial Sequence
  Synthetic Oligonucleotide; PRF1 exon 2; Set A
gucguugcggaugcuacgag

SEQ ID NO: 15537 - RNA, 17 nt, Artificial Sequence
  Synthetic Oligonucleotide; PRF1 exon 2; Set C
ucugggcugcaaaguug

SEQ ID NO: 15538 - RNA, 16 nt, Artificial Sequence
  Synthetic Oligonucleotide; PRF1 exon 2; Set C
ucugggcugcaaaguu

SEQ ID NO: 15539 - RNA, 18 nt, Artificial Sequence
  Synthetic Oligonucleotide; PRF1 exon 2; Set C
uucugggcugcaaaguug

SEQ ID NO: 15540 - RNA, 17 nt, Artificial Sequence
  Synthetic Oligonucleotide; PRF1 exon 2; Set C
uucugggcugcaaaguu

SEQ ID NO: 15541 - RNA, 19 nt, Artificial Sequence
  Synthetic Oligonucleotide; PRF1 exon 2; Set C
cuucugggcugcaaaguug

SEQ ID NO: 15542 - RNA, 15 nt, Artificial Sequence
  Synthetic Oligonucleotide; PRF1 exon 2; Set C
ucugggcugcaaagu

SEQ ID NO: 15543 - RNA, 18 nt, Artificial Sequence
  Synthetic Oligonucleotide; PRF1 exon 2; Set C
cuucugggcugcaaaguu

SEQ ID NO: 15544 - RNA, 20 nt, Artificial Sequence
  Synthetic Oligonucleotide; PRF1 exon 2; Set C
ucuucugggcugcaaaguug

SEQ ID NO: 15545 - RNA, 16 nt, Artificial Sequence
  Synthetic Oligonucleotide; PRF1 exon 2; Set C
uucugggcugcaaagu

SEQ ID NO: 15546 - RNA, 19 nt, Artificial Sequence
  Synthetic Oligonucleotide; PRF1 exon 2; Set C
ucuucugggcugcaaaguu

SEQ ID NO: 15547 - RNA, 17 nt, Artificial Sequence
  Synthetic Oligonucleotide; PRF1 exon 2; Set C
cuucugggcugcaaagu

SEQ ID NO: 15548 - RNA, 18 nt, Artificial Sequence
  Synthetic Oligonucleotide; PRF1 exon 2; Set C
ucuucugggcugcaaagu

SEQ ID NO: 15549 - RNA, 17 nt, Artificial Sequence
  Synthetic Oligonucleotide; PRF1 exon 2; Set C
ucuucugggcugcaaag

SEQ ID NO: 15550 - RNA, 35 nt, Artificial Sequence
  Synthetic Oligonucleotide; PRF1 exon 2; Set C
acugguccuggugggucuucugggcugcaaaguug

SEQ ID NO: 15551 - RNA, 34 nt, Artificial Sequence
  Synthetic Oligonucleotide; PRF1 exon 2; Set C
acugguccuggugggucuucugggcugcaaaguu

SEQ ID NO: 15552 - RNA, 36 nt, Artificial Sequence
  Synthetic Oligonucleotide; PRF1 exon 2; Set C
uacugguccuggugggucuucugggcugcaaaguug

SEQ ID NO: 15553 - RNA, 35 nt, Artificial Sequence
  Synthetic Oligonucleotide; PRF1 exon 2; Set C
uacugguccuggugggucuucugggcugcaaaguu

SEQ ID NO: 15554 - RNA, 33 nt, Artificial Sequence
  Synthetic Oligonucleotide; PRF1 exon 2; Set C
acugguccuggugggucuucugggcugcaaagu

SEQ ID NO: 15555 - RNA, 38 nt, Artificial Sequence
  Synthetic Oligonucleotide; PRF1 exon 2; Set C
uguacugguccuggugggucuucugggcugcaaaguug

SEQ ID NO: 15556 - RNA, 34 nt, Artificial Sequence
  Synthetic Oligonucleotide; PRF1 exon 2; Set C
uacugguccuggugggucuucugggcugcaaagu

SEQ ID NO: 15557 - RNA, 32 nt, Artificial Sequence
  Synthetic Oligonucleotide; PRF1 exon 2; Set C
acugguccuggugggucuucugggcugcaaag

SEQ ID NO: 15558 - RNA, 37 nt, Artificial Sequence
  Synthetic Oligonucleotide; PRF1 exon 2; Set C
uguacugguccuggugggucuucugggcugcaaaguu

SEQ ID NO: 15559 - RNA, 35 nt, Artificial Sequence
  Synthetic Oligonucleotide; PRF1 exon 2; Set C
guacugguccuggugggucuucugggcugcaaagu

SEQ ID NO: 15560 - RNA, 33 nt, Artificial Sequence
  Synthetic Oligonucleotide; PRF1 exon 2; Set C
uacugguccuggugggucuucugggcugcaaag

SEQ ID NO: 15561 - RNA, 31 nt, Artificial Sequence
  Synthetic Oligonucleotide; PRF1 exon 2; Set C
acugguccuggugggucuucugggcugcaaa

SEQ ID NO: 15562 - RNA, 36 nt, Artificial Sequence
  Synthetic Oligonucleotide; PRF1 exon 2; Set C
uguacugguccuggugggucuucugggcugcaaagu

SEQ ID NO: 15563 - RNA, 34 nt, Artificial Sequence
  Synthetic Oligonucleotide; PRF1 exon 2; Set C
guacugguccuggugggucuucugggcugcaaag

SEQ ID NO: 15564 - RNA, 32 nt, Artificial Sequence
  Synthetic Oligonucleotide; PRF1 exon 2; Set C
uacugguccuggugggucuucugggcugcaaa

SEQ ID NO: 15565 - RNA, 33 nt, Artificial Sequence
  Synthetic Oligonucleotide; PRF1 exon 2; Set C
guacugguccuggugggucuucugggcugcaaa

SEQ ID NO: 15566 - RNA, 35 nt, Artificial Sequence
  Synthetic Oligonucleotide; PRF1 exon 2; Set C
uguacugguccuggugggucuucugggcugcaaag

SEQ ID NO: 15567 - RNA, 34 nt, Artificial Sequence
  Synthetic Oligonucleotide; PRF1 exon 2; Set C
uguacugguccuggugggucuucugggcugcaaa

SEQ ID NO: 15568 - RNA, 21 nt, Artificial Sequence
  Synthetic Oligonucleotide; PRF1 exon 2; Set B
acugguccuggugggucuucu

SEQ ID NO: 15569 - RNA, 22 nt, Artificial Sequence
  Synthetic Oligonucleotide; PRF1 exon 2; Set B
uacugguccuggugggucuucu

SEQ ID NO: 15570 - RNA, 20 nt, Artificial Sequence
  Synthetic Oligonucleotide; PRF1 exon 2; Set B
acugguccuggugggucuuc

SEQ ID NO: 15571 - RNA, 23 nt, Artificial Sequence
  Synthetic Oligonucleotide; PRF1 exon 2; Set C
guacugguccuggugggucuucu

SEQ ID NO: 15572 - RNA, 21 nt, Artificial Sequence
  Synthetic Oligonucleotide; PRF1 exon 2; Set B
uacugguccuggugggucuuc

SEQ ID NO: 15573 - RNA, 19 nt, Artificial Sequence
  Synthetic Oligonucleotide; PRF1 exon 2; Set B
acugguccuggugggucuu

SEQ ID NO: 15574 - RNA, 22 nt, Artificial Sequence
  Synthetic Oligonucleotide; PRF1 exon 2; Set B
guacugguccuggugggucuuc

SEQ ID NO: 15575 - RNA, 24 nt, Artificial Sequence
  Synthetic Oligonucleotide; PRF1 exon 2; Set C
uguacugguccuggugggucuucu

SEQ ID NO: 15576 - RNA, 18 nt, Artificial Sequence
  Synthetic Oligonucleotide; PRF1 exon 2; Set B
acugguccuggugggucu

SEQ ID NO: 15577 - RNA, 20 nt, Artificial Sequence
  Synthetic Oligonucleotide; PRF1 exon 2; Set B
uacugguccuggugggucuu

SEQ ID NO: 15578 - RNA, 23 nt, Artificial Sequence
  Synthetic Oligonucleotide; PRF1 exon 2; Set B
uguacugguccuggugggucuuc

SEQ ID NO: 15579 - RNA, 19 nt, Artificial Sequence
  Synthetic Oligonucleotide; PRF1 exon 2; Set B
uacugguccuggugggucu

SEQ ID NO: 15580 - RNA, 21 nt, Artificial Sequence
  Synthetic Oligonucleotide; PRF1 exon 2; Set B
guacugguccuggugggucuu

SEQ ID NO: 15581 - RNA, 20 nt, Artificial Sequence
  Synthetic Oligonucleotide; PRF1 exon 2; Set B
guacugguccuggugggucu

SEQ ID NO: 15582 - RNA, 22 nt, Artificial Sequence
  Synthetic Oligonucleotide; PRF1 exon 2; Set B
uguacugguccuggugggucuu

SEQ ID NO: 15583 - RNA, 21 nt, Artificial Sequence
  Synthetic Oligonucleotide; PRF1 exon 2; Set B
uguacugguccuggugggucu

SEQ ID NO: 15584 - RNA, 29 nt, Artificial Sequence
  Synthetic Oligonucleotide; PRF1 exon 2; Set C
cauggguggagggauggaggaugacugcu

SEQ ID NO: 15585 - RNA, 24 nt, Artificial Sequence
  Synthetic Oligonucleotide; PRF1 exon 2; Set C
cauggguggagggauggaggauga

SEQ ID NO: 15586 - RNA, 23 nt, Artificial Sequence
  Synthetic Oligonucleotide; PRF1 exon 2; Set A
cauggguggagggauggaggaug

SEQ ID NO: 15587 - RNA, 35 nt, Artificial Sequence
  Synthetic Oligonucleotide; PRF1 exon 2; Set C
ggaagccauggguggagggauggaggaugacugcu

SEQ ID NO: 15588 - RNA, 22 nt, Artificial Sequence
  Synthetic Oligonucleotide; PRF1 exon 2; Set A
cauggguggagggauggaggau

SEQ ID NO: 15589 - RNA, 34 nt, Artificial Sequence
  Synthetic Oligonucleotide; PRF1 exon 2; Set C
ggaagccauggguggagggauggaggaugacugc

SEQ ID NO: 15590 - RNA, 30 nt, Artificial Sequence
  Synthetic Oligonucleotide; PRF1 exon 2; Set C
ggaagccauggguggagggauggaggauga

SEQ ID NO: 15591 - RNA, 29 nt, Artificial Sequence
  Synthetic Oligonucleotide; PRF1 exon 2; Set C
ggaagccauggguggagggauggaggaug

SEQ ID NO: 15592 - RNA, 17 nt, Artificial Sequence
  Synthetic Oligonucleotide; PRF1 exon 2; Set C
cauggguggagggaugg

SEQ ID NO: 15593 - RNA, 28 nt, Artificial Sequence
  Synthetic Oligonucleotide; PRF1 exon 2; Set C
ggaagccauggguggagggauggaggau

SEQ ID NO: 15594 - RNA, 23 nt, Artificial Sequence
  Synthetic Oligonucleotide; PRF1 exon 2; Set C
ggaagccauggguggagggaugg

SEQ ID NO: 15595 - RNA, 39 nt, Artificial Sequence
  Synthetic Oligonucleotide; PRF1 exon 2; Set C
ugggcucugggaagccauggguggagggauggaggauga

SEQ ID NO: 15596 - RNA, 38 nt, Artificial Sequence
  Synthetic Oligonucleotide; PRF1 exon 2; Set C
ugggcucugggaagccauggguggagggauggaggaug

SEQ ID NO: 15597 - RNA, 37 nt, Artificial Sequence
  Synthetic Oligonucleotide; PRF1 exon 2; Set C
ugggcucugggaagccauggguggagggauggaggau

SEQ ID NO: 15598 - RNA, 32 nt, Artificial Sequence
  Synthetic Oligonucleotide; PRF1 exon 2; Set C
ugggcucugggaagccauggguggagggaugg

SEQ ID NO: 15599 - RNA, 40 nt, Artificial Sequence
  Synthetic Oligonucleotide; PRF1 exon 2; Set C
ggggcacuugggcucugggaagccauggguggagggaugg

SEQ ID NO: 15600 - RNA, 26 nt, Artificial Sequence
  Synthetic Oligonucleotide; PRF1 exon 2; Set C
ggggcacuugggcucugggaagccau

SEQ ID NO: 15601 - RNA, 27 nt, Artificial Sequence
  Synthetic Oligonucleotide; PRF1 exon 2; Set C
gggggcacuugggcucugggaagccau

SEQ ID NO: 15602 - RNA, 28 nt, Artificial Sequence
  Synthetic Oligonucleotide; PRF1 exon 2; Set C
agggggcacuugggcucugggaagccau

SEQ ID NO: 15603 - RNA, 29 nt, Artificial Sequence
  Synthetic Oligonucleotide; PRF1 exon 2; Set C
cagggggcacuugggcucugggaagccau

SEQ ID NO: 15604 - RNA, 33 nt, Artificial Sequence
  Synthetic Oligonucleotide; PRF1 exon 2; Set C
gagacagggggcacuugggcucugggaagccau

SEQ ID NO: 15605 - RNA, 19 nt, Artificial Sequence
  Synthetic Oligonucleotide; PRF1 exon 2; Set C
ggggcacuugggcucuggg

SEQ ID NO: 15606 - RNA, 34 nt, Artificial Sequence
  Synthetic Oligonucleotide; PRF1 exon 2; Set C
agagacagggggcacuugggcucugggaagccau

SEQ ID NO: 15607 - RNA, 20 nt, Artificial Sequence
  Synthetic Oligonucleotide; PRF1 exon 2; Set C
gggggcacuugggcucuggg

SEQ ID NO: 15608 - RNA, 18 nt, Artificial Sequence
  Synthetic Oligonucleotide; PRF1 exon 2; Set A
ggggcacuugggcucugg

SEQ ID NO: 15609 - RNA, 19 nt, Artificial Sequence
  Synthetic Oligonucleotide; PRF1 exon 2; Set C
gggggcacuugggcucugg

SEQ ID NO: 15610 - RNA, 21 nt, Artificial Sequence
  Synthetic Oligonucleotide; PRF1 exon 2; Set C
agggggcacuugggcucuggg

SEQ ID NO: 15611 - RNA, 20 nt, Artificial Sequence
  Synthetic Oligonucleotide; PRF1 exon 2; Set C
agggggcacuugggcucugg

SEQ ID NO: 15612 - RNA, 22 nt, Artificial Sequence
  Synthetic Oligonucleotide; PRF1 exon 2; Set C
cagggggcacuugggcucuggg

SEQ ID NO: 15613 - RNA, 21 nt, Artificial Sequence
  Synthetic Oligonucleotide; PRF1 exon 2; Set C
cagggggcacuugggcucugg

SEQ ID NO: 15614 - RNA, 26 nt, Artificial Sequence
  Synthetic Oligonucleotide; PRF1 exon 2; Set C
gagacagggggcacuugggcucuggg

SEQ ID NO: 15615 - RNA, 25 nt, Artificial Sequence
  Synthetic Oligonucleotide; PRF1 exon 2; Set C
gagacagggggcacuugggcucugg

SEQ ID NO: 15616 - RNA, 27 nt, Artificial Sequence
  Synthetic Oligonucleotide; PRF1 exon 2; Set C
agagacagggggcacuugggcucuggg

SEQ ID NO: 15617 - RNA, 15 nt, Artificial Sequence
  Synthetic Oligonucleotide; PRF1 exon 2; Set A
agggggcacuugggc

SEQ ID NO: 15618 - RNA, 26 nt, Artificial Sequence
  Synthetic Oligonucleotide; PRF1 exon 2; Set C
agagacagggggcacuugggcucugg

SEQ ID NO: 15619 - RNA, 16 nt, Artificial Sequence
  Synthetic Oligonucleotide; PRF1 exon 2; Set A
cagggggcacuugggc

SEQ ID NO: 15620 - RNA, 31 nt, Artificial Sequence
  Synthetic Oligonucleotide; PRF1 exon 2; Set C
ugcagagacagggggcacuugggcucuggga

SEQ ID NO: 15621 - RNA, 15 nt, Artificial Sequence
  Synthetic Oligonucleotide; PRF1 exon 2; Set A
cagggggcacuuggg

SEQ ID NO: 15622 - RNA, 20 nt, Artificial Sequence
  Synthetic Oligonucleotide; PRF1 exon 2; Set C
gagacagggggcacuugggc

SEQ ID NO: 15623 - RNA, 19 nt, Artificial Sequence
  Synthetic Oligonucleotide; PRF1 exon 2; Set A
gagacagggggcacuuggg

SEQ ID NO: 15624 - RNA, 21 nt, Artificial Sequence
  Synthetic Oligonucleotide; PRF1 exon 2; Set C
agagacagggggcacuugggc

SEQ ID NO: 15625 - RNA, 18 nt, Artificial Sequence
  Synthetic Oligonucleotide; PRF1 exon 2; Set A
gagacagggggcacuugg

SEQ ID NO: 15626 - RNA, 34 nt, Artificial Sequence
  Synthetic Oligonucleotide; PRF1 exon 2; Set C
gagcugcagagacagggggcacuugggcucuggg

SEQ ID NO: 15627 - RNA, 20 nt, Artificial Sequence
  Synthetic Oligonucleotide; PRF1 exon 2; Set A
agagacagggggcacuuggg

SEQ ID NO: 15628 - RNA, 19 nt, Artificial Sequence
  Synthetic Oligonucleotide; PRF1 exon 2; Set A
agagacagggggcacuugg

SEQ ID NO: 15629 - RNA, 35 nt, Artificial Sequence
  Synthetic Oligonucleotide; PRF1 exon 2; Set C
ggagcugcagagacagggggcacuugggcucuggg

SEQ ID NO: 15630 - RNA, 33 nt, Artificial Sequence
  Synthetic Oligonucleotide; PRF1 exon 2; Set C
gagcugcagagacagggggcacuugggcucugg

SEQ ID NO: 15631 - RNA, 34 nt, Artificial Sequence
  Synthetic Oligonucleotide; PRF1 exon 2; Set C
ggagcugcagagacagggggcacuugggcucugg

SEQ ID NO: 15632 - RNA, 19 nt, Artificial Sequence
  Synthetic Oligonucleotide; PRF1 exon 2; Set A
cagagacagggggcacuug

SEQ ID NO: 15633 - RNA, 39 nt, Artificial Sequence
  Synthetic Oligonucleotide; PRF1 exon 2; Set C
cauggagcugcagagacagggggcacuugggcucuggga

SEQ ID NO: 15634 - RNA, 35 nt, Artificial Sequence
  Synthetic Oligonucleotide; PRF1 exon 2; Set C
uggagcugcagagacagggggcacuugggcucugg

SEQ ID NO: 15635 - RNA, 20 nt, Artificial Sequence
  Synthetic Oligonucleotide; PRF1 exon 2; Set A
gcagagacagggggcacuug

SEQ ID NO: 15636 - RNA, 18 nt, Artificial Sequence
  Synthetic Oligonucleotide; PRF1 exon 2; Set A
cagagacagggggcacuu

SEQ ID NO: 15637 - RNA, 36 nt, Artificial Sequence
  Synthetic Oligonucleotide; PRF1 exon 2; Set C
auggagcugcagagacagggggcacuugggcucugg

SEQ ID NO: 15638 - RNA, 21 nt, Artificial Sequence
  Synthetic Oligonucleotide; PRF1 exon 2; Set A
ugcagagacagggggcacuug

SEQ ID NO: 15639 - RNA, 19 nt, Artificial Sequence
  Synthetic Oligonucleotide; PRF1 exon 2; Set A
gcagagacagggggcacuu

SEQ ID NO: 15640 - RNA, 17 nt, Artificial Sequence
  Synthetic Oligonucleotide; PRF1 exon 2; Set A
cagagacagggggcacu

SEQ ID NO: 15641 - RNA, 20 nt, Artificial Sequence
  Synthetic Oligonucleotide; PRF1 exon 2; Set A
ugcagagacagggggcacuu

SEQ ID NO: 15642 - RNA, 18 nt, Artificial Sequence
  Synthetic Oligonucleotide; PRF1 exon 2; Set A
gcagagacagggggcacu

SEQ ID NO: 15643 - RNA, 28 nt, Artificial Sequence
  Synthetic Oligonucleotide; PRF1 exon 2; Set C
gagcugcagagacagggggcacuugggc

SEQ ID NO: 15644 - RNA, 19 nt, Artificial Sequence
  Synthetic Oligonucleotide; PRF1 exon 2; Set A
ugcagagacagggggcacu

SEQ ID NO: 15645 - RNA, 27 nt, Artificial Sequence
  Synthetic Oligonucleotide; PRF1 exon 2; Set C
gagcugcagagacagggggcacuuggg

SEQ ID NO: 15646 - RNA, 29 nt, Artificial Sequence
  Synthetic Oligonucleotide; PRF1 exon 2; Set C
ggagcugcagagacagggggcacuugggc

SEQ ID NO: 15647 - RNA, 26 nt, Artificial Sequence
  Synthetic Oligonucleotide; PRF1 exon 2; Set C
gagcugcagagacagggggcacuugg

SEQ ID NO: 15648 - RNA, 28 nt, Artificial Sequence
  Synthetic Oligonucleotide; PRF1 exon 2; Set C
ggagcugcagagacagggggcacuuggg

SEQ ID NO: 15649 - RNA, 30 nt, Artificial Sequence
  Synthetic Oligonucleotide; PRF1 exon 2; Set C
uggagcugcagagacagggggcacuugggc

SEQ ID NO: 15650 - RNA, 27 nt, Artificial Sequence
  Synthetic Oligonucleotide; PRF1 exon 2; Set C
ggagcugcagagacagggggcacuugg

SEQ ID NO: 15651 - RNA, 29 nt, Artificial Sequence
  Synthetic Oligonucleotide; PRF1 exon 2; Set C
uggagcugcagagacagggggcacuuggg

SEQ ID NO: 15652 - RNA, 31 nt, Artificial Sequence
  Synthetic Oligonucleotide; PRF1 exon 2; Set C
auggagcugcagagacagggggcacuugggc

SEQ ID NO: 15653 - RNA, 30 nt, Artificial Sequence
  Synthetic Oligonucleotide; PRF1 exon 2; Set C
auggagcugcagagacagggggcacuuggg

SEQ ID NO: 15654 - RNA, 29 nt, Artificial Sequence
  Synthetic Oligonucleotide; PRF1 exon 2; Set C
cauggagcugcagagacagggggcacuug

SEQ ID NO: 15655 - RNA, 28 nt, Artificial Sequence
  Synthetic Oligonucleotide; PRF1 exon 2; Set C
cauggagcugcagagacagggggcacuu

SEQ ID NO: 15656 - RNA, 27 nt, Artificial Sequence
  Synthetic Oligonucleotide; PRF1 exon 2; Set C
cauggagcugcagagacagggggcacu

SEQ ID NO: 15657 - RNA, 36 nt, Artificial Sequence
  Synthetic Oligonucleotide; PRF1 exon 2; Set C
gggcugccauggagcugcagagacagggggcacuug

SEQ ID NO: 15658 - RNA, 40 nt, Artificial Sequence
  Synthetic Oligonucleotide; PRF1 exon 2; Set C
acgggcugccauggagcugcagagacagggggcacuuggg

SEQ ID NO: 15659 - RNA, 37 nt, Artificial Sequence
  Synthetic Oligonucleotide; PRF1 exon 2; Set C
cgggcugccauggagcugcagagacagggggcacuug

SEQ ID NO: 15660 - RNA, 35 nt, Artificial Sequence
  Synthetic Oligonucleotide; PRF1 exon 2; Set C
gggcugccauggagcugcagagacagggggcacuu

SEQ ID NO: 15661 - RNA, 39 nt, Artificial Sequence
  Synthetic Oligonucleotide; PRF1 exon 2; Set C
acgggcugccauggagcugcagagacagggggcacuugg

SEQ ID NO: 15662 - RNA, 36 nt, Artificial Sequence
  Synthetic Oligonucleotide; PRF1 exon 2; Set C
cgggcugccauggagcugcagagacagggggcacuu

SEQ ID NO: 15663 - RNA, 34 nt, Artificial Sequence
  Synthetic Oligonucleotide; PRF1 exon 2; Set C
gggcugccauggagcugcagagacagggggcacu

SEQ ID NO: 15664 - RNA, 35 nt, Artificial Sequence
  Synthetic Oligonucleotide; PRF1 exon 2; Set C
cgggcugccauggagcugcagagacagggggcacu

SEQ ID NO: 15665 - RNA, 29 nt, Artificial Sequence
  Synthetic Oligonucleotide; PRF1 exon 2; Set C
cgggcugccauggagcugcagagacaggg

SEQ ID NO: 15666 - RNA, 15 nt, Artificial Sequence
  Synthetic Oligonucleotide; PRF1 exon 2; Set C
cgggcugccauggag

SEQ ID NO: 15667 - RNA, 40 nt, Artificial Sequence
  Synthetic Oligonucleotide; PRF1 exon 2; Set C
ugcccaggaggagcagacgggcugccauggagcugcagag

SEQ ID NO: 15668 - RNA, 39 nt, Artificial Sequence
  Synthetic Oligonucleotide; PRF1 exon 2; Set C
ugcccaggaggagcagacgggcugccauggagcugcaga

SEQ ID NO: 15669 - RNA, 31 nt, Artificial Sequence
  Synthetic Oligonucleotide; PRF1 exon 2; Set C
ugcccaggaggagcagacgggcugccaugga

SEQ ID NO: 15670 - RNA, 35 nt, Artificial Sequence
  Synthetic Oligonucleotide; PRF1 exon 2; Set C
ggaugcccaggaggagcagacgggcugccauggag

SEQ ID NO: 15671 - RNA, 34 nt, Artificial Sequence
  Synthetic Oligonucleotide; PRF1 exon 2; Set C
ggaugcccaggaggagcagacgggcugccaugga

SEQ ID NO: 15672 - RNA, 33 nt, Artificial Sequence
  Synthetic Oligonucleotide; PRF1 exon 2; Set C
ggaugcccaggaggagcagacgggcugccaugg

SEQ ID NO: 15673 - RNA, 32 nt, Artificial Sequence
  Synthetic Oligonucleotide; PRF1 exon 2; Set C
ggaugcccaggaggagcagacgggcugccaug

SEQ ID NO: 15674 - RNA, 38 nt, Artificial Sequence
  Synthetic Oligonucleotide; PRF1 exon 2; Set C
gaaggaugcccaggaggagcagacgggcugccauggag

SEQ ID NO: 15675 - RNA, 36 nt, Artificial Sequence
  Synthetic Oligonucleotide; PRF1 exon 2; Set C
gaaggaugcccaggaggagcagacgggcugccaugg

SEQ ID NO: 15676 - RNA, 35 nt, Artificial Sequence
  Synthetic Oligonucleotide; PRF1 exon 2; Set C
gaaggaugcccaggaggagcagacgggcugccaug

SEQ ID NO: 15677 - RNA, 40 nt, Artificial Sequence
  Synthetic Oligonucleotide; PRF1 exon 2; Set C
ggagaaggaugcccaggaggagcagacgggcugccaugga

SEQ ID NO: 15678 - RNA, 39 nt, Artificial Sequence
  Synthetic Oligonucleotide; PRF1 exon 2; Set C
ggagaaggaugcccaggaggagcagacgggcugccaugg

SEQ ID NO: 15679 - RNA, 38 nt, Artificial Sequence
  Synthetic Oligonucleotide; PRF1 exon 2; Set C
ggagaaggaugcccaggaggagcagacgggcugccaug

SEQ ID NO: 15680 - RNA, 19 nt, Artificial Sequence
  Synthetic Oligonucleotide; PRF1 exon 2; Set A
ugcccaggaggagcagacg

SEQ ID NO: 15681 - RNA, 20 nt, Artificial Sequence
  Synthetic Oligonucleotide; PRF1 exon 2; Set A
augcccaggaggagcagacg

SEQ ID NO: 15682 - RNA, 21 nt, Artificial Sequence
  Synthetic Oligonucleotide; PRF1 exon 2; Set A
gaugcccaggaggagcagacg

SEQ ID NO: 15683 - RNA, 22 nt, Artificial Sequence
  Synthetic Oligonucleotide; PRF1 exon 2; Set C
ggaugcccaggaggagcagacg

SEQ ID NO: 15684 - RNA, 28 nt, Artificial Sequence
  Synthetic Oligonucleotide; PRF1 exon 2; Set C
ggagaaggaugcccaggaggagcagacg

SEQ ID NO: 15685 - RNA, 39 nt, Artificial Sequence
  Synthetic Oligonucleotide; PRF1 exon 2; Set C
guguggcacggggcagggacgggcaggggcagcagcagg

SEQ ID NO: 15686 - RNA, 40 nt, Artificial Sequence
  Synthetic Oligonucleotide; PRF1 exon 2; Set C
uguguggcacggggcagggacgggcaggggcagcagcagg

SEQ ID NO: 15687 - RNA, 15 nt, Artificial Sequence
  Synthetic Oligonucleotide; PRF1 exon 2; Set A
gagcgugcggcugug

SEQ ID NO: 15688 - RNA, 16 nt, Artificial Sequence
  Synthetic Oligonucleotide; PRF1 exon 2; Set A
ugagcgugcggcugug

SEQ ID NO: 15689 - RNA, 17 nt, Artificial Sequence
  Synthetic Oligonucleotide; PRF1 exon 2; Set A
cugagcgugcggcugug

SEQ ID NO: 15690 - RNA, 15 nt, Artificial Sequence
  Synthetic Oligonucleotide; PRF1 exon 2; Set A
ugagcgugcggcugu

SEQ ID NO: 15691 - RNA, 18 nt, Artificial Sequence
  Synthetic Oligonucleotide; PRF1 exon 2; Set A
ucugagcgugcggcugug

SEQ ID NO: 15692 - RNA, 16 nt, Artificial Sequence
  Synthetic Oligonucleotide; PRF1 exon 2; Set A
cugagcgugcggcugu

SEQ ID NO: 15693 - RNA, 17 nt, Artificial Sequence
  Synthetic Oligonucleotide; PRF1 exon 2; Set A
ucugagcgugcggcugu

SEQ ID NO: 15694 - RNA, 38 nt, Artificial Sequence
  Synthetic Oligonucleotide; PRF1 exon 2; Set C
acuuguggcugcgcuugcacucugagcgugcggcugug

SEQ ID NO: 15695 - RNA, 39 nt, Artificial Sequence
  Synthetic Oligonucleotide; PRF1 exon 2; Set C
aacuuguggcugcgcuugcacucugagcgugcggcugug

SEQ ID NO: 15696 - RNA, 40 nt, Artificial Sequence
  Synthetic Oligonucleotide; PRF1 exon 2; Set C
gaacuuguggcugcgcuugcacucugagcgugcggcugug

SEQ ID NO: 15697 - RNA, 38 nt, Artificial Sequence
  Synthetic Oligonucleotide; PRF1 exon 2; Set C
aacuuguggcugcgcuugcacucugagcgugcggcugu

SEQ ID NO: 15698 - RNA, 39 nt, Artificial Sequence
  Synthetic Oligonucleotide; PRF1 exon 2; Set C
gaacuuguggcugcgcuugcacucugagcgugcggcugu

SEQ ID NO: 15699 - RNA, 26 nt, Artificial Sequence
  Synthetic Oligonucleotide; PRF1 exon 2; Set C
cuuguggcugcgcuugcacucugagc

SEQ ID NO: 15700 - RNA, 27 nt, Artificial Sequence
  Synthetic Oligonucleotide; PRF1 exon 2; Set C
acuuguggcugcgcuugcacucugagc

SEQ ID NO: 15701 - RNA, 26 nt, Artificial Sequence
  Synthetic Oligonucleotide; PRF1 exon 2; Set C
acuuguggcugcgcuugcacucugag

SEQ ID NO: 15702 - RNA, 28 nt, Artificial Sequence
  Synthetic Oligonucleotide; PRF1 exon 2; Set C
aacuuguggcugcgcuugcacucugagc

SEQ ID NO: 15703 - RNA, 25 nt, Artificial Sequence
  Synthetic Oligonucleotide; PRF1 exon 2; Set C
acuuguggcugcgcuugcacucuga

SEQ ID NO: 15704 - RNA, 27 nt, Artificial Sequence
  Synthetic Oligonucleotide; PRF1 exon 2; Set C
aacuuguggcugcgcuugcacucugag

SEQ ID NO: 15705 - RNA, 29 nt, Artificial Sequence
  Synthetic Oligonucleotide; PRF1 exon 2; Set C
gaacuuguggcugcgcuugcacucugagc

SEQ ID NO: 15706 - RNA, 26 nt, Artificial Sequence
  Synthetic Oligonucleotide; PRF1 exon 2; Set C
aacuuguggcugcgcuugcacucuga

SEQ ID NO: 15707 - RNA, 28 nt, Artificial Sequence
  Synthetic Oligonucleotide; PRF1 exon 2; Set C
gaacuuguggcugcgcuugcacucugag

SEQ ID NO: 15708 - RNA, 27 nt, Artificial Sequence
  Synthetic Oligonucleotide; PRF1 exon 2; Set C
gaacuuguggcugcgcuugcacucuga

SEQ ID NO: 15709 - RNA, 26 nt, Artificial Sequence
  Synthetic Oligonucleotide; PRF1 exon 2; Set C
gaacuuguggcugcgcuugcacucug

SEQ ID NO: 15710 - RNA, 40 nt, Artificial Sequence
  Synthetic Oligonucleotide; PRF1 exon 2; Set C
uguguccacugggaaggagcccgagcggcggaggcugguc

SEQ ID NO: 15711 - RNA, 39 nt, Artificial Sequence
  Synthetic Oligonucleotide; PRF1 exon 2; Set C
uguguccacugggaaggagcccgagcggcggaggcuggu

SEQ ID NO: 15712 - RNA, 38 nt, Artificial Sequence
  Synthetic Oligonucleotide; PRF1 exon 2; Set C
uguguccacugggaaggagcccgagcggcggaggcugg

SEQ ID NO: 15713 - RNA, 40 nt, Artificial Sequence
  Synthetic Oligonucleotide; PRF1 exon 2; Set C
guguguccacugggaaggagcccgagcggcggaggcuggu

SEQ ID NO: 15714 - RNA, 39 nt, Artificial Sequence
  Synthetic Oligonucleotide; PRF1 exon 2; Set C
guguguccacugggaaggagcccgagcggcggaggcugg

SEQ ID NO: 15715 - RNA, 40 nt, Artificial Sequence
  Synthetic Oligonucleotide; PRF1 exon 2; Set C
uguguguccacugggaaggagcccgagcggcggaggcugg

SEQ ID NO: 15716 - RNA, 36 nt, Artificial Sequence
  Synthetic Oligonucleotide; PRF1 exon 2; Set C
uuguguguccacugggaaggagcccgagcggcggag

SEQ ID NO: 15717 - RNA, 37 nt, Artificial Sequence
  Synthetic Oligonucleotide; PRF1 exon 2; Set C
uuuguguguccacugggaaggagcccgagcggcggag

SEQ ID NO: 15718 - RNA, 36 nt, Artificial Sequence
  Synthetic Oligonucleotide; PRF1 exon 2; Set C
uuuguguguccacugggaaggagcccgagcggcgga

SEQ ID NO: 15719 - RNA, 38 nt, Artificial Sequence
  Synthetic Oligonucleotide; PRF1 exon 2; Set C
cuuuguguguccacugggaaggagcccgagcggcggag

SEQ ID NO: 15720 - RNA, 37 nt, Artificial Sequence
  Synthetic Oligonucleotide; PRF1 exon 2; Set C
cuuuguguguccacugggaaggagcccgagcggcgga

SEQ ID NO: 15721 - RNA, 18 nt, Artificial Sequence
  Synthetic Oligonucleotide; PRF1 exon 2; Set C
uguguccacugggaagga

SEQ ID NO: 15722 - RNA, 19 nt, Artificial Sequence
  Synthetic Oligonucleotide; PRF1 exon 2; Set A
guguguccacugggaagga

SEQ ID NO: 15723 - RNA, 20 nt, Artificial Sequence
  Synthetic Oligonucleotide; PRF1 exon 2; Set A
uguguguccacugggaagga

SEQ ID NO: 15724 - RNA, 15 nt, Artificial Sequence
  Synthetic Oligonucleotide; PRF1 exon 2; Set C
uguguccacugggaa

SEQ ID NO: 15725 - RNA, 21 nt, Artificial Sequence
  Synthetic Oligonucleotide; PRF1 exon 2; Set A
uuguguguccacugggaagga

SEQ ID NO: 15726 - RNA, 22 nt, Artificial Sequence
  Synthetic Oligonucleotide; PRF1 exon 2; Set A
uuuguguguccacugggaagga

SEQ ID NO: 15727 - RNA, 15 nt, Artificial Sequence
  Synthetic Oligonucleotide; PRF1 exon 2; Set C
guguguccacuggga

SEQ ID NO: 15728 - RNA, 23 nt, Artificial Sequence
  Synthetic Oligonucleotide; PRF1 exon 2; Set A
cuuuguguguccacugggaagga

SEQ ID NO: 15729 - RNA, 40 nt, Artificial Sequence
  Synthetic Oligonucleotide; PRF1 exon 2; Set C
ucacagagggugcaggugccgucgggccgcaggaaccuuu

SEQ ID NO: 15730 - RNA, 39 nt, Artificial Sequence
  Synthetic Oligonucleotide; PRF1 exon 2; Set C
ucacagagggugcaggugccgucgggccgcaggaaccuu

SEQ ID NO: 15731 - RNA, 40 nt, Artificial Sequence
  Synthetic Oligonucleotide; PRF1 exon 2; Set C
uucacagagggugcaggugccgucgggccgcaggaaccuu

SEQ ID NO: 15732 - RNA, 22 nt, Artificial Sequence
  Synthetic Oligonucleotide; PRF1 exon 2; Set A
cauuuucacagagggugcaggu

SEQ ID NO: 15733 - RNA, 21 nt, Artificial Sequence
  Synthetic Oligonucleotide; PRF1 exon 2; Set A
cauuuucacagagggugcagg

SEQ ID NO: 15734 - RNA, 23 nt, Artificial Sequence
  Synthetic Oligonucleotide; PRF1 exon 2; Set A
gcauuuucacagagggugcaggu

SEQ ID NO: 15735 - RNA, 20 nt, Artificial Sequence
  Synthetic Oligonucleotide; PRF1 exon 2; Set C
cauuuucacagagggugcag

SEQ ID NO: 15736 - RNA, 22 nt, Artificial Sequence
  Synthetic Oligonucleotide; PRF1 exon 2; Set A
gcauuuucacagagggugcagg

SEQ ID NO: 15737 - RNA, 24 nt, Artificial Sequence
  Synthetic Oligonucleotide; PRF1 exon 2; Set C
ggcauuuucacagagggugcaggu

SEQ ID NO: 15738 - RNA, 21 nt, Artificial Sequence
  Synthetic Oligonucleotide; PRF1 exon 2; Set A
gcauuuucacagagggugcag

SEQ ID NO: 15739 - RNA, 23 nt, Artificial Sequence
  Synthetic Oligonucleotide; PRF1 exon 2; Set A
ggcauuuucacagagggugcagg

SEQ ID NO: 15740 - RNA, 25 nt, Artificial Sequence
  Synthetic Oligonucleotide; PRF1 exon 2; Set C
gggcauuuucacagagggugcaggu

SEQ ID NO: 15741 - RNA, 26 nt, Artificial Sequence
  Synthetic Oligonucleotide; PRF1 exon 2; Set C
agggcauuuucacagagggugcaggu

SEQ ID NO: 15742 - RNA, 22 nt, Artificial Sequence
  Synthetic Oligonucleotide; PRF1 exon 2; Set A
ggcauuuucacagagggugcag

SEQ ID NO: 15743 - RNA, 24 nt, Artificial Sequence
  Synthetic Oligonucleotide; PRF1 exon 2; Set C
gggcauuuucacagagggugcagg

SEQ ID NO: 15744 - RNA, 25 nt, Artificial Sequence
  Synthetic Oligonucleotide; PRF1 exon 2; Set C
agggcauuuucacagagggugcagg

SEQ ID NO: 15745 - RNA, 23 nt, Artificial Sequence
  Synthetic Oligonucleotide; PRF1 exon 2; Set A
gggcauuuucacagagggugcag

SEQ ID NO: 15746 - RNA, 24 nt, Artificial Sequence
  Synthetic Oligonucleotide; PRF1 exon 2; Set A
agggcauuuucacagagggugcag

SEQ ID NO: 15747 - RNA, 15 nt, Artificial Sequence
  Synthetic Oligonucleotide; PRF1 exon 2; Set C
gcauuuucacagagg

SEQ ID NO: 15748 - RNA, 16 nt, Artificial Sequence
  Synthetic Oligonucleotide; PRF1 exon 2; Set C
ggcauuuucacagagg

SEQ ID NO: 15749 - RNA, 17 nt, Artificial Sequence
  Synthetic Oligonucleotide; PRF1 exon 2; Set C
gggcauuuucacagagg

SEQ ID NO: 15750 - RNA, 15 nt, Artificial Sequence
  Synthetic Oligonucleotide; PRF1 exon 2; Set C
ggcauuuucacagag

SEQ ID NO: 15751 - RNA, 18 nt, Artificial Sequence
  Synthetic Oligonucleotide; PRF1 exon 2; Set C
agggcauuuucacagagg

SEQ ID NO: 15752 - RNA, 16 nt, Artificial Sequence
  Synthetic Oligonucleotide; PRF1 exon 2; Set C
gggcauuuucacagag

SEQ ID NO: 15753 - RNA, 15 nt, Artificial Sequence
  Synthetic Oligonucleotide; PRF1 exon 2; Set C
gggcauuuucacaga

SEQ ID NO: 15754 - RNA, 19 nt, Artificial Sequence
  Synthetic Oligonucleotide; PRF1 exon 2; Set C
uagggcauuuucacagagg

SEQ ID NO: 15755 - RNA, 17 nt, Artificial Sequence
  Synthetic Oligonucleotide; PRF1 exon 2; Set C
agggcauuuucacagag

SEQ ID NO: 15756 - RNA, 21 nt, Artificial Sequence
  Synthetic Oligonucleotide; PRF1 exon 2; Set A
guagggcauuuucacagaggg

SEQ ID NO: 15757 - RNA, 16 nt, Artificial Sequence
  Synthetic Oligonucleotide; PRF1 exon 2; Set C
agggcauuuucacaga

SEQ ID NO: 15758 - RNA, 18 nt, Artificial Sequence
  Synthetic Oligonucleotide; PRF1 exon 2; Set C
uagggcauuuucacagag

SEQ ID NO: 15759 - RNA, 22 nt, Artificial Sequence
  Synthetic Oligonucleotide; PRF1 exon 2; Set A
uguagggcauuuucacagaggg

SEQ ID NO: 15760 - RNA, 15 nt, Artificial Sequence
  Synthetic Oligonucleotide; PRF1 exon 2; Set C
agggcauuuucacag

SEQ ID NO: 15761 - RNA, 29 nt, Artificial Sequence
  Synthetic Oligonucleotide; PRF1 exon 2; Set C
ugcccuccuguagggcauuuucacagagg

SEQ ID NO: 15762 - RNA, 30 nt, Artificial Sequence
  Synthetic Oligonucleotide; PRF1 exon 2; Set C
gugcccuccuguagggcauuuucacagagg

SEQ ID NO: 15763 - RNA, 28 nt, Artificial Sequence
  Synthetic Oligonucleotide; PRF1 exon 2; Set C
ugcccuccuguagggcauuuucacagag

SEQ ID NO: 15764 - RNA, 27 nt, Artificial Sequence
  Synthetic Oligonucleotide; PRF1 exon 2; Set C
ugcccuccuguagggcauuuucacaga

SEQ ID NO: 15765 - RNA, 29 nt, Artificial Sequence
  Synthetic Oligonucleotide; PRF1 exon 2; Set C
gugcccuccuguagggcauuuucacagag

SEQ ID NO: 15766 - RNA, 26 nt, Artificial Sequence
  Synthetic Oligonucleotide; PRF1 exon 2; Set C
ugcccuccuguagggcauuuucacag

SEQ ID NO: 15767 - RNA, 25 nt, Artificial Sequence
  Synthetic Oligonucleotide; PRF1 exon 2; Set C
ugcccuccuguagggcauuuucaca

SEQ ID NO: 15768 - RNA, 27 nt, Artificial Sequence
  Synthetic Oligonucleotide; PRF1 exon 2; Set C
gugcccuccuguagggcauuuucacag

SEQ ID NO: 15769 - RNA, 24 nt, Artificial Sequence
  Synthetic Oligonucleotide; PRF1 exon 2; Set C
ugcccuccuguagggcauuuucac

SEQ ID NO: 15770 - RNA, 26 nt, Artificial Sequence
  Synthetic Oligonucleotide; PRF1 exon 2; Set C
gugcccuccuguagggcauuuucaca

SEQ ID NO: 15771 - RNA, 25 nt, Artificial Sequence
  Synthetic Oligonucleotide; PRF1 exon 2; Set C
gugcccuccuguagggcauuuucac

SEQ ID NO: 15772 - RNA, 21 nt, Artificial Sequence
  Synthetic Oligonucleotide; PRF1 exon 2; Set A
ugcccuccuguagggcauuuu

SEQ ID NO: 15773 - RNA, 20 nt, Artificial Sequence
  Synthetic Oligonucleotide; PRF1 exon 2; Set A
ugcccuccuguagggcauuu

SEQ ID NO: 15774 - RNA, 38 nt, Artificial Sequence
  Synthetic Oligonucleotide; PRF1 exon 2; Set C
gcuggagggugcccuccuguagggcauuuucacagagg

SEQ ID NO: 15775 - RNA, 19 nt, Artificial Sequence
  Synthetic Oligonucleotide; PRF1 exon 2; Set A
ugcccuccuguagggcauu

SEQ ID NO: 15776 - RNA, 37 nt, Artificial Sequence
  Synthetic Oligonucleotide; PRF1 exon 2; Set C
gcuggagggugcccuccuguagggcauuuucacagag

SEQ ID NO: 15777 - RNA, 20 nt, Artificial Sequence
  Synthetic Oligonucleotide; PRF1 exon 2; Set A
gugcccuccuguagggcauu

SEQ ID NO: 15778 - RNA, 36 nt, Artificial Sequence
  Synthetic Oligonucleotide; PRF1 exon 2; Set C
gcuggagggugcccuccuguagggcauuuucacaga

SEQ ID NO: 15779 - RNA, 35 nt, Artificial Sequence
  Synthetic Oligonucleotide; PRF1 exon 2; Set C
gcuggagggugcccuccuguagggcauuuucacag

SEQ ID NO: 15780 - RNA, 34 nt, Artificial Sequence
  Synthetic Oligonucleotide; PRF1 exon 2; Set C
gcuggagggugcccuccuguagggcauuuucaca

SEQ ID NO: 15781 - RNA, 33 nt, Artificial Sequence
  Synthetic Oligonucleotide; PRF1 exon 2; Set C
gcuggagggugcccuccuguagggcauuuucac

SEQ ID NO: 15782 - RNA, 32 nt, Artificial Sequence
  Synthetic Oligonucleotide; PRF1 exon 2; Set C
gcuggagggugcccuccuguagggcauuuuca

SEQ ID NO: 15783 - RNA, 31 nt, Artificial Sequence
  Synthetic Oligonucleotide; PRF1 exon 2; Set C
gcuggagggugcccuccuguagggcauuuuc

SEQ ID NO: 15784 - RNA, 30 nt, Artificial Sequence
  Synthetic Oligonucleotide; PRF1 exon 2; Set C
gcuggagggugcccuccuguagggcauuuu

SEQ ID NO: 15785 - RNA, 29 nt, Artificial Sequence
  Synthetic Oligonucleotide; PRF1 exon 2; Set C
gcuggagggugcccuccuguagggcauuu

SEQ ID NO: 15786 - RNA, 28 nt, Artificial Sequence
  Synthetic Oligonucleotide; PRF1 exon 2; Set C
gcuggagggugcccuccuguagggcauu

SEQ ID NO: 15787 - RNA, 40 nt, Artificial Sequence
  Synthetic Oligonucleotide; PRF1 exon 2; Set C
aggcaggcgcuggagggugcccuccuguagggcauuuuca

SEQ ID NO: 15788 - RNA, 39 nt, Artificial Sequence
  Synthetic Oligonucleotide; PRF1 exon 2; Set C
aggcaggcgcuggagggugcccuccuguagggcauuuuc

SEQ ID NO: 15789 - RNA, 40 nt, Artificial Sequence
  Synthetic Oligonucleotide; PRF1 exon 2; Set C
gaggcaggcgcuggagggugcccuccuguagggcauuuuc

SEQ ID NO: 15790 - RNA, 39 nt, Artificial Sequence
  Synthetic Oligonucleotide; PRF1 exon 2; Set C
gaggcaggcgcuggagggugcccuccuguagggcauuuu

SEQ ID NO: 15791 - RNA, 21 nt, Artificial Sequence
  Synthetic Oligonucleotide; PRF1 exon 2; Set C
gcuggagggugcccuccugua

SEQ ID NO: 15792 - RNA, 38 nt, Artificial Sequence
  Synthetic Oligonucleotide; PRF1 exon 2; Set C
gaggcaggcgcuggagggugcccuccuguagggcauuu

SEQ ID NO: 15793 - RNA, 20 nt, Artificial Sequence
  Synthetic Oligonucleotide; PRF1 exon 2; Set C
gcuggagggugcccuccugu

SEQ ID NO: 15794 - RNA, 40 nt, Artificial Sequence
  Synthetic Oligonucleotide; PRF1 exon 2; Set C
agaggcaggcgcuggagggugcccuccuguagggcauuuu

SEQ ID NO: 15795 - RNA, 39 nt, Artificial Sequence
  Synthetic Oligonucleotide; PRF1 exon 2; Set C
agaggcaggcgcuggagggugcccuccuguagggcauuu

SEQ ID NO: 15796 - RNA, 21 nt, Artificial Sequence
  Synthetic Oligonucleotide; PRF1 exon 2; Set C
gaggcaggcgcuggagggugc

SEQ ID NO: 15797 - RNA, 39 nt, Artificial Sequence
  Synthetic Oligonucleotide; PRF1 exon 2; Set C
ugagcgccagaggcaggcgcuggagggugcccuccugua

SEQ ID NO: 15798 - RNA, 38 nt, Artificial Sequence
  Synthetic Oligonucleotide; PRF1 exon 2; Set C
ugagcgccagaggcaggcgcuggagggugcccuccugu

SEQ ID NO: 15799 - RNA, 22 nt, Artificial Sequence
  Synthetic Oligonucleotide; PRF1 exon 2; Set C
agaggcaggcgcuggagggugc

SEQ ID NO: 15800 - RNA, 27 nt, Artificial Sequence
  Synthetic Oligonucleotide; PRF1 exon 2; Set C
gcgccagaggcaggcgcuggagggugc

SEQ ID NO: 15801 - RNA, 26 nt, Artificial Sequence
  Synthetic Oligonucleotide; PRF1 exon 2; Set C
gcgccagaggcaggcgcuggagggug

SEQ ID NO: 15802 - RNA, 28 nt, Artificial Sequence
  Synthetic Oligonucleotide; PRF1 exon 2; Set C
agcgccagaggcaggcgcuggagggugc

SEQ ID NO: 15803 - RNA, 27 nt, Artificial Sequence
  Synthetic Oligonucleotide; PRF1 exon 2; Set C
agcgccagaggcaggcgcuggagggug

SEQ ID NO: 15804 - RNA, 29 nt, Artificial Sequence
  Synthetic Oligonucleotide; PRF1 exon 2; Set C
gagcgccagaggcaggcgcuggagggugc

SEQ ID NO: 15805 - RNA, 28 nt, Artificial Sequence
  Synthetic Oligonucleotide; PRF1 exon 2; Set C
gagcgccagaggcaggcgcuggagggug

SEQ ID NO: 15806 - RNA, 30 nt, Artificial Sequence
  Synthetic Oligonucleotide; PRF1 exon 2; Set C
ugagcgccagaggcaggcgcuggagggugc

SEQ ID NO: 15807 - RNA, 29 nt, Artificial Sequence
  Synthetic Oligonucleotide; PRF1 exon 2; Set C
ugagcgccagaggcaggcgcuggagggug

SEQ ID NO: 15808 - RNA, 35 nt, Artificial Sequence
  Synthetic Oligonucleotide; PRF1 exon 2; Set C
guuggugagcgccagaggcaggcgcuggagggugc

SEQ ID NO: 15809 - RNA, 34 nt, Artificial Sequence
  Synthetic Oligonucleotide; PRF1 exon 2; Set C
guuggugagcgccagaggcaggcgcuggagggug

SEQ ID NO: 15810 - RNA, 36 nt, Artificial Sequence
  Synthetic Oligonucleotide; PRF1 exon 2; Set C
aguuggugagcgccagaggcaggcgcuggagggugc

SEQ ID NO: 15811 - RNA, 35 nt, Artificial Sequence
  Synthetic Oligonucleotide; PRF1 exon 2; Set C
aguuggugagcgccagaggcaggcgcuggagggug

SEQ ID NO: 15812 - RNA, 20 nt, Artificial Sequence
  Synthetic Oligonucleotide; PRF1 exon 2; Set C
gagcgccagaggcaggcgcu

SEQ ID NO: 15813 - RNA, 21 nt, Artificial Sequence
  Synthetic Oligonucleotide; PRF1 exon 2; Set C
ugagcgccagaggcaggcgcu

SEQ ID NO: 15814 - RNA, 26 nt, Artificial Sequence
  Synthetic Oligonucleotide; PRF1 exon 2; Set C
guuggugagcgccagaggcaggcgcu

SEQ ID NO: 15815 - RNA, 27 nt, Artificial Sequence
  Synthetic Oligonucleotide; PRF1 exon 2; Set C
aguuggugagcgccagaggcaggcgcu

SEQ ID NO: 15816 - RNA, 15 nt, Artificial Sequence
  Synthetic Oligonucleotide; PRF1 exon 2; Set A
ugagcgccagaggca

SEQ ID NO: 15817 - RNA, 20 nt, Artificial Sequence
  Synthetic Oligonucleotide; PRF1 exon 2; Set C
guuggugagcgccagaggca

SEQ ID NO: 15818 - RNA, 19 nt, Artificial Sequence
  Synthetic Oligonucleotide; PRF1 exon 2; Set A
guuggugagcgccagaggc

SEQ ID NO: 15819 - RNA, 21 nt, Artificial Sequence
  Synthetic Oligonucleotide; PRF1 exon 2; Set C
aguuggugagcgccagaggca

SEQ ID NO: 15820 - RNA, 18 nt, Artificial Sequence
  Synthetic Oligonucleotide; PRF1 exon 2; Set A
guuggugagcgccagagg

SEQ ID NO: 15821 - RNA, 20 nt, Artificial Sequence
  Synthetic Oligonucleotide; PRF1 exon 2; Set A
aguuggugagcgccagaggc

SEQ ID NO: 15822 - RNA, 17 nt, Artificial Sequence
  Synthetic Oligonucleotide; PRF1 exon 2; Set A
guuggugagcgccagag

SEQ ID NO: 15823 - RNA, 19 nt, Artificial Sequence
  Synthetic Oligonucleotide; PRF1 exon 2; Set A
aguuggugagcgccagagg

SEQ ID NO: 15824 - RNA, 18 nt, Artificial Sequence
  Synthetic Oligonucleotide; PRF1 exon 2; Set A
aguuggugagcgccagag

SEQ ID NO: 15825 - RNA, 16 nt, Artificial Sequence
  Synthetic Oligonucleotide; PRF1 exon 2; Set A
guuggugagcgccaga

SEQ ID NO: 15826 - RNA, 17 nt, Artificial Sequence
  Synthetic Oligonucleotide; PRF1 exon 2; Set A
aguuggugagcgccaga

SEQ ID NO: 15827 - RNA, 15 nt, Artificial Sequence
  Synthetic Oligonucleotide; PRF1 exon 2; Set C
caguggagcugacuu

SEQ ID NO: 15828 - RNA, 16 nt, Artificial Sequence
  Synthetic Oligonucleotide; PRF1 exon 2; Set C
ucaguggagcugacuu

SEQ ID NO: 15829 - RNA, 15 nt, Artificial Sequence
  Synthetic Oligonucleotide; PRF1 exon 2; Set C
ucaguggagcugacu

SEQ ID NO: 15830 - RNA, 17 nt, Artificial Sequence
  Synthetic Oligonucleotide; PRF1 exon 2; Set A
ugcggaugcuacgagcc

SEQ ID NO: 15831 - RNA, 18 nt, Artificial Sequence
  Synthetic Oligonucleotide; PRF1 exon 2; Set A
uugcggaugcuacgagcc

SEQ ID NO: 15832 - RNA, 16 nt, Artificial Sequence
  Synthetic Oligonucleotide; PRF1 exon 2; Set C
ugcggaugcuacgagc

SEQ ID NO: 15833 - RNA, 19 nt, Artificial Sequence
  Synthetic Oligonucleotide; PRF1 exon 2; Set A
guugcggaugcuacgagcc

SEQ ID NO: 15834 - RNA, 15 nt, Artificial Sequence
  Synthetic Oligonucleotide; PRF1 exon 2; Set C
ugcggaugcuacgag

SEQ ID NO: 15835 - RNA, 17 nt, Artificial Sequence
  Synthetic Oligonucleotide; PRF1 exon 2; Set C
uugcggaugcuacgagc

SEQ ID NO: 15836 - RNA, 16 nt, Artificial Sequence
  Synthetic Oligonucleotide; PRF1 exon 2; Set C
uugcggaugcuacgag

SEQ ID NO: 15837 - RNA, 18 nt, Artificial Sequence
  Synthetic Oligonucleotide; PRF1 exon 2; Set A
guugcggaugcuacgagc

SEQ ID NO: 15838 - RNA, 17 nt, Artificial Sequence
  Synthetic Oligonucleotide; PRF1 exon 2; Set C
guugcggaugcuacgag

SEQ ID NO: 15839 - RNA, 19 nt, Artificial Sequence
  Synthetic Oligonucleotide; PRF1 exon 2; Set A
cguugcggaugcuacgagc

SEQ ID NO: 15840 - RNA, 15 nt, Artificial Sequence
  Synthetic Oligonucleotide; PRF1 exon 2; Set C
uugcggaugcuacga

SEQ ID NO: 15841 - RNA, 18 nt, Artificial Sequence
  Synthetic Oligonucleotide; PRF1 exon 2; Set A
cguugcggaugcuacgag

SEQ ID NO: 15842 - RNA, 20 nt, Artificial Sequence
  Synthetic Oligonucleotide; PRF1 exon 2; Set A
ucguugcggaugcuacgagc

SEQ ID NO: 15843 - RNA, 16 nt, Artificial Sequence
  Synthetic Oligonucleotide; PRF1 exon 2; Set C
guugcggaugcuacga

SEQ ID NO: 15844 - RNA, 19 nt, Artificial Sequence
  Synthetic Oligonucleotide; PRF1 exon 2; Set A
ucguugcggaugcuacgag

SEQ ID NO: 15845 - RNA, 17 nt, Artificial Sequence
  Synthetic Oligonucleotide; PRF1 exon 2; Set A
cguugcggaugcuacga

SEQ ID NO: 15846 - RNA, 15 nt, Artificial Sequence
  Synthetic Oligonucleotide; PRF1 exon 2; Set C
guugcggaugcuacg

SEQ ID NO: 15847 - RNA, 18 nt, Artificial Sequence
  Synthetic Oligonucleotide; PRF1 exon 2; Set A
ucguugcggaugcuacga

SEQ ID NO: 15848 - RNA, 16 nt, Artificial Sequence
  Synthetic Oligonucleotide; PRF1 exon 2; Set C
cguugcggaugcuacg

SEQ ID NO: 15849 - RNA, 19 nt, Artificial Sequence
  Synthetic Oligonucleotide; PRF1 exon 2; Set A
gucguugcggaugcuacga

SEQ ID NO: 15850 - RNA, 15 nt, Artificial Sequence
  Synthetic Oligonucleotide; PRF1 exon 2; Set C
cguugcggaugcuac

SEQ ID NO: 15851 - RNA, 17 nt, Artificial Sequence
  Synthetic Oligonucleotide; PRF1 exon 2; Set C
ucguugcggaugcuacg

SEQ ID NO: 15852 - RNA, 18 nt, Artificial Sequence
  Synthetic Oligonucleotide; PRF1 exon 2; Set B
gucguugcggaugcuacg

SEQ ID NO: 15853 - RNA, 16 nt, Artificial Sequence
  Synthetic Oligonucleotide; PRF1 exon 2; Set C
ucguugcggaugcuac

SEQ ID NO: 15854 - RNA, 17 nt, Artificial Sequence
  Synthetic Oligonucleotide; PRF1 exon 2; Set C
gucguugcggaugcuac

SEQ ID NO: 15855 - RNA, 25 nt, Artificial Sequence
  Synthetic Oligonucleotide; PRF1 exon 2; Set C
uuggcugccugugagugugagccgg

SEQ ID NO: 15856 - RNA, 24 nt, Artificial Sequence
  Synthetic Oligonucleotide; PRF1 exon 2; Set C
uuggcugccugugagugugagccg

SEQ ID NO: 15857 - RNA, 26 nt, Artificial Sequence
  Synthetic Oligonucleotide; PRF1 exon 2; Set C
guuggcugccugugagugugagccgg

SEQ ID NO: 15858 - RNA, 25 nt, Artificial Sequence
  Synthetic Oligonucleotide; PRF1 exon 2; Set C
guuggcugccugugagugugagccg

SEQ ID NO: 15859 - RNA, 27 nt, Artificial Sequence
  Synthetic Oligonucleotide; PRF1 exon 2; Set C
aguuggcugccugugagugugagccgg

SEQ ID NO: 15860 - RNA, 26 nt, Artificial Sequence
  Synthetic Oligonucleotide; PRF1 exon 2; Set C
aguuggcugccugugagugugagccg

SEQ ID NO: 15861 - RNA, 28 nt, Artificial Sequence
  Synthetic Oligonucleotide; PRF1 exon 2; Set C
aaguuggcugccugugagugugagccgg

SEQ ID NO: 15862 - RNA, 27 nt, Artificial Sequence
  Synthetic Oligonucleotide; PRF1 exon 2; Set C
aaguuggcugccugugagugugagccg

SEQ ID NO: 15863 - RNA, 29 nt, Artificial Sequence
  Synthetic Oligonucleotide; PRF1 exon 2; Set C
aaaguuggcugccugugagugugagccgg

SEQ ID NO: 15864 - RNA, 28 nt, Artificial Sequence
  Synthetic Oligonucleotide; PRF1 exon 2; Set C
aaaguuggcugccugugagugugagccg

SEQ ID NO: 15865 - RNA, 39 nt, Artificial Sequence
  Synthetic Oligonucleotide; PRF1 exon 2; Set C
ucugggcugcaaaguuggcugccugugagugugagccgg

SEQ ID NO: 15866 - RNA, 38 nt, Artificial Sequence
  Synthetic Oligonucleotide; PRF1 exon 2; Set C
ucugggcugcaaaguuggcugccugugagugugagccg

SEQ ID NO: 15867 - RNA, 40 nt, Artificial Sequence
  Synthetic Oligonucleotide; PRF1 exon 2; Set C
uucugggcugcaaaguuggcugccugugagugugagccgg

SEQ ID NO: 15868 - RNA, 39 nt, Artificial Sequence
  Synthetic Oligonucleotide; PRF1 exon 2; Set C
uucugggcugcaaaguuggcugccugugagugugagccg

SEQ ID NO: 15869 - RNA, 40 nt, Artificial Sequence
  Synthetic Oligonucleotide; PRF1 exon 2; Set C
cuucugggcugcaaaguuggcugccugugagugugagccg

SEQ ID NO: 15870 - RNA, 18 nt, Artificial Sequence
  Synthetic Oligonucleotide; PRF1 exon 2; Set C
ucugggcugcaaaguugg

SEQ ID NO: 15871 - RNA, 19 nt, Artificial Sequence
  Synthetic Oligonucleotide; PRF1 exon 2; Set C
uucugggcugcaaaguugg

SEQ ID NO: 15872 - RNA, 20 nt, Artificial Sequence
  Synthetic Oligonucleotide; PRF1 exon 2; Set C
cuucugggcugcaaaguugg

SEQ ID NO: 15873 - RNA, 21 nt, Artificial Sequence
  Synthetic Oligonucleotide; PRF1 exon 2; Set B
ucuucugggcugcaaaguugg

SEQ ID NO: 15874 - RNA, 21 nt, Artificial Sequence
  Synthetic Oligonucleotide; PRF1 exon 2; Set B
gucuucugggcugcaaaguug

SEQ ID NO: 15875 - RNA, 15 nt, Artificial Sequence
  Synthetic Oligonucleotide; PRF1 exon 2; Set C
uucugggcugcaaag

SEQ ID NO: 15876 - RNA, 20 nt, Artificial Sequence
  Synthetic Oligonucleotide; PRF1 exon 2; Set C
gucuucugggcugcaaaguu

SEQ ID NO: 15877 - RNA, 22 nt, Artificial Sequence
  Synthetic Oligonucleotide; PRF1 exon 2; Set B
ggucuucugggcugcaaaguug

SEQ ID NO: 15878 - RNA, 16 nt, Artificial Sequence
  Synthetic Oligonucleotide; PRF1 exon 2; Set C
cuucugggcugcaaag

SEQ ID NO: 15879 - RNA, 21 nt, Artificial Sequence
  Synthetic Oligonucleotide; PRF1 exon 2; Set B
ggucuucugggcugcaaaguu

SEQ ID NO: 15880 - RNA, 23 nt, Artificial Sequence
  Synthetic Oligonucleotide; PRF1 exon 2; Set B
gggucuucugggcugcaaaguug

SEQ ID NO: 15881 - RNA, 19 nt, Artificial Sequence
  Synthetic Oligonucleotide; PRF1 exon 2; Set C
gucuucugggcugcaaagu

SEQ ID NO: 15882 - RNA, 15 nt, Artificial Sequence
  Synthetic Oligonucleotide; PRF1 exon 2; Set C
cuucugggcugcaaa

SEQ ID NO: 15883 - RNA, 22 nt, Artificial Sequence
  Synthetic Oligonucleotide; PRF1 exon 2; Set B
gggucuucugggcugcaaaguu

SEQ ID NO: 15884 - RNA, 24 nt, Artificial Sequence
  Synthetic Oligonucleotide; PRF1 exon 2; Set B
ugggucuucugggcugcaaaguug

SEQ ID NO: 15885 - RNA, 20 nt, Artificial Sequence
  Synthetic Oligonucleotide; PRF1 exon 2; Set B
ggucuucugggcugcaaagu

SEQ ID NO: 15886 - RNA, 16 nt, Artificial Sequence
  Synthetic Oligonucleotide; PRF1 exon 2; Set C
ucuucugggcugcaaa

SEQ ID NO: 15887 - RNA, 18 nt, Artificial Sequence
  Synthetic Oligonucleotide; PRF1 exon 2; Set C
gucuucugggcugcaaag

SEQ ID NO: 15888 - RNA, 23 nt, Artificial Sequence
  Synthetic Oligonucleotide; PRF1 exon 2; Set B
ugggucuucugggcugcaaaguu

SEQ ID NO: 15889 - RNA, 25 nt, Artificial Sequence
  Synthetic Oligonucleotide; PRF1 exon 2; Set B
gugggucuucugggcugcaaaguug

SEQ ID NO: 15890 - RNA, 21 nt, Artificial Sequence
  Synthetic Oligonucleotide; PRF1 exon 2; Set B
gggucuucugggcugcaaagu

SEQ ID NO: 15891 - RNA, 17 nt, Artificial Sequence
  Synthetic Oligonucleotide; PRF1 exon 2; Set C
gucuucugggcugcaaa

SEQ ID NO: 15892 - RNA, 19 nt, Artificial Sequence
  Synthetic Oligonucleotide; PRF1 exon 2; Set C
ggucuucugggcugcaaag

SEQ ID NO: 15893 - RNA, 24 nt, Artificial Sequence
  Synthetic Oligonucleotide; PRF1 exon 2; Set B
gugggucuucugggcugcaaaguu

SEQ ID NO: 15894 - RNA, 26 nt, Artificial Sequence
  Synthetic Oligonucleotide; PRF1 exon 2; Set C
ggugggucuucugggcugcaaaguug

SEQ ID NO: 15895 - RNA, 22 nt, Artificial Sequence
  Synthetic Oligonucleotide; PRF1 exon 2; Set B
ugggucuucugggcugcaaagu

SEQ ID NO: 15896 - RNA, 20 nt, Artificial Sequence
  Synthetic Oligonucleotide; PRF1 exon 2; Set B
gggucuucugggcugcaaag

SEQ ID NO: 15897 - RNA, 25 nt, Artificial Sequence
  Synthetic Oligonucleotide; PRF1 exon 2; Set C
ggugggucuucugggcugcaaaguu

SEQ ID NO: 15898 - RNA, 23 nt, Artificial Sequence
  Synthetic Oligonucleotide; PRF1 exon 2; Set B
gugggucuucugggcugcaaagu

SEQ ID NO: 15899 - RNA, 21 nt, Artificial Sequence
  Synthetic Oligonucleotide; PRF1 exon 2; Set B
ugggucuucugggcugcaaag

SEQ ID NO: 15900 - RNA, 24 nt, Artificial Sequence
  Synthetic Oligonucleotide; PRF1 exon 2; Set C
ggugggucuucugggcugcaaagu

SEQ ID NO: 15901 - RNA, 22 nt, Artificial Sequence
  Synthetic Oligonucleotide; PRF1 exon 2; Set B
gugggucuucugggcugcaaag

SEQ ID NO: 15902 - RNA, 20 nt, Artificial Sequence
  Synthetic Oligonucleotide; PRF1 exon 2; Set B
ugggucuucugggcugcaaa

SEQ ID NO: 15903 - RNA, 29 nt, Artificial Sequence
  Synthetic Oligonucleotide; PRF1 exon 2; Set C
ccuggugggucuucugggcugcaaaguug

SEQ ID NO: 15904 - RNA, 23 nt, Artificial Sequence
  Synthetic Oligonucleotide; PRF1 exon 2; Set B
ggugggucuucugggcugcaaag

SEQ ID NO: 15905 - RNA, 21 nt, Artificial Sequence
  Synthetic Oligonucleotide; PRF1 exon 2; Set B
gugggucuucugggcugcaaa

SEQ ID NO: 15906 - RNA, 28 nt, Artificial Sequence
  Synthetic Oligonucleotide; PRF1 exon 2; Set C
ccuggugggucuucugggcugcaaaguu

SEQ ID NO: 15907 - RNA, 30 nt, Artificial Sequence
  Synthetic Oligonucleotide; PRF1 exon 2; Set C
uccuggugggucuucugggcugcaaaguug

SEQ ID NO: 15908 - RNA, 22 nt, Artificial Sequence
  Synthetic Oligonucleotide; PRF1 exon 2; Set B
ggugggucuucugggcugcaaa

SEQ ID NO: 15909 - RNA, 29 nt, Artificial Sequence
  Synthetic Oligonucleotide; PRF1 exon 2; Set C
uccuggugggucuucugggcugcaaaguu

SEQ ID NO: 15910 - RNA, 27 nt, Artificial Sequence
  Synthetic Oligonucleotide; PRF1 exon 2; Set C
ccuggugggucuucugggcugcaaagu

SEQ ID NO: 15911 - RNA, 28 nt, Artificial Sequence
  Synthetic Oligonucleotide; PRF1 exon 2; Set C
uccuggugggucuucugggcugcaaagu

SEQ ID NO: 15912 - RNA, 33 nt, Artificial Sequence
  Synthetic Oligonucleotide; PRF1 exon 2; Set C
ugguccuggugggucuucugggcugcaaaguug

SEQ ID NO: 15913 - RNA, 32 nt, Artificial Sequence
  Synthetic Oligonucleotide; PRF1 exon 2; Set C
ugguccuggugggucuucugggcugcaaaguu

SEQ ID NO: 15914 - RNA, 34 nt, Artificial Sequence
  Synthetic Oligonucleotide; PRF1 exon 2; Set C
cugguccuggugggucuucugggcugcaaaguug

SEQ ID NO: 15915 - RNA, 36 nt, Artificial Sequence
  Synthetic Oligonucleotide; PRF1 exon 2; Set C
acugguccuggugggucuucugggcugcaaaguugg

SEQ ID NO: 15916 - RNA, 33 nt, Artificial Sequence
  Synthetic Oligonucleotide; PRF1 exon 2; Set C
cugguccuggugggucuucugggcugcaaaguu

SEQ ID NO: 15917 - RNA, 31 nt, Artificial Sequence
  Synthetic Oligonucleotide; PRF1 exon 2; Set C
ugguccuggugggucuucugggcugcaaagu

SEQ ID NO: 15918 - RNA, 37 nt, Artificial Sequence
  Synthetic Oligonucleotide; PRF1 exon 2; Set C
uacugguccuggugggucuucugggcugcaaaguugg

SEQ ID NO: 15919 - RNA, 32 nt, Artificial Sequence
  Synthetic Oligonucleotide; PRF1 exon 2; Set C
cugguccuggugggucuucugggcugcaaagu

SEQ ID NO: 15920 - RNA, 38 nt, Artificial Sequence
  Synthetic Oligonucleotide; PRF1 exon 2; Set C
guacugguccuggugggucuucugggcugcaaaguugg

SEQ ID NO: 15921 - RNA, 31 nt, Artificial Sequence
  Synthetic Oligonucleotide; PRF1 exon 2; Set C
cugguccuggugggucuucugggcugcaaag

SEQ ID NO: 15922 - RNA, 39 nt, Artificial Sequence
  Synthetic Oligonucleotide; PRF1 exon 2; Set C
uguacugguccuggugggucuucugggcugcaaaguugg

SEQ ID NO: 15923 - RNA, 30 nt, Artificial Sequence
  Synthetic Oligonucleotide; PRF1 exon 2; Set C
cugguccuggugggucuucugggcugcaaa

SEQ ID NO: 15924 - RNA, 30 nt, Artificial Sequence
  Synthetic Oligonucleotide; PRF1 exon 2; Set C
acugguccuggugggucuucugggcugcaa

SEQ ID NO: 15925 - RNA, 31 nt, Artificial Sequence
  Synthetic Oligonucleotide; PRF1 exon 2; Set C
uacugguccuggugggucuucugggcugcaa

SEQ ID NO: 15926 - RNA, 32 nt, Artificial Sequence
  Synthetic Oligonucleotide; PRF1 exon 2; Set C
guacugguccuggugggucuucugggcugcaa

SEQ ID NO: 15927 - RNA, 15 nt, Artificial Sequence
  Synthetic Oligonucleotide; PRF1 exon 2; Set C
ccuggugggucuucu

SEQ ID NO: 15928 - RNA, 16 nt, Artificial Sequence
  Synthetic Oligonucleotide; PRF1 exon 2; Set C
uccuggugggucuucu

SEQ ID NO: 15929 - RNA, 15 nt, Artificial Sequence
  Synthetic Oligonucleotide; PRF1 exon 2; Set C
uccuggugggucuuc

SEQ ID NO: 15930 - RNA, 40 nt, Artificial Sequence
  Synthetic Oligonucleotide; PRF1 exon 2; Set C
gaagcuguacugguccuggugggucuucugggcugcaaag

SEQ ID NO: 15931 - RNA, 39 nt, Artificial Sequence
  Synthetic Oligonucleotide; PRF1 exon 2; Set C
gaagcuguacugguccuggugggucuucugggcugcaaa

SEQ ID NO: 15932 - RNA, 19 nt, Artificial Sequence
  Synthetic Oligonucleotide; PRF1 exon 2; Set B
ugguccuggugggucuucu

SEQ ID NO: 15933 - RNA, 40 nt, Artificial Sequence
  Synthetic Oligonucleotide; PRF1 exon 2; Set C
ugaagcuguacugguccuggugggucuucugggcugcaaa

SEQ ID NO: 15934 - RNA, 20 nt, Artificial Sequence
  Synthetic Oligonucleotide; PRF1 exon 2; Set B
cugguccuggugggucuucu

SEQ ID NO: 15935 - RNA, 18 nt, Artificial Sequence
  Synthetic Oligonucleotide; PRF1 exon 2; Set B
ugguccuggugggucuuc

SEQ ID NO: 15936 - RNA, 22 nt, Artificial Sequence
  Synthetic Oligonucleotide; PRF1 exon 2; Set B
acugguccuggugggucuucug

SEQ ID NO: 15937 - RNA, 19 nt, Artificial Sequence
  Synthetic Oligonucleotide; PRF1 exon 2; Set B
cugguccuggugggucuuc

SEQ ID NO: 15938 - RNA, 23 nt, Artificial Sequence
  Synthetic Oligonucleotide; PRF1 exon 2; Set B
uacugguccuggugggucuucug

SEQ ID NO: 15939 - RNA, 18 nt, Artificial Sequence
  Synthetic Oligonucleotide; PRF1 exon 2; Set B
cugguccuggugggucuu

SEQ ID NO: 15940 - RNA, 24 nt, Artificial Sequence
  Synthetic Oligonucleotide; PRF1 exon 2; Set C
guacugguccuggugggucuucug

SEQ ID NO: 15941 - RNA, 17 nt, Artificial Sequence
  Synthetic Oligonucleotide; PRF1 exon 2; Set B
cugguccuggugggucu

SEQ ID NO: 15942 - RNA, 17 nt, Artificial Sequence
  Synthetic Oligonucleotide; PRF1 exon 2; Set B
acugguccugguggguc

SEQ ID NO: 15943 - RNA, 18 nt, Artificial Sequence
  Synthetic Oligonucleotide; PRF1 exon 2; Set B
uacugguccugguggguc

SEQ ID NO: 15944 - RNA, 16 nt, Artificial Sequence
  Synthetic Oligonucleotide; PRF1 exon 2; Set B
acugguccuggugggu

SEQ ID NO: 15945 - RNA, 19 nt, Artificial Sequence
  Synthetic Oligonucleotide; PRF1 exon 2; Set B
guacugguccugguggguc

SEQ ID NO: 15946 - RNA, 17 nt, Artificial Sequence
  Synthetic Oligonucleotide; PRF1 exon 2; Set B
uacugguccuggugggu

SEQ ID NO: 15947 - RNA, 15 nt, Artificial Sequence
  Synthetic Oligonucleotide; PRF1 exon 2; Set C
acugguccugguggg

SEQ ID NO: 15948 - RNA, 20 nt, Artificial Sequence
  Synthetic Oligonucleotide; PRF1 exon 2; Set B
uguacugguccugguggguc

SEQ ID NO: 15949 - RNA, 18 nt, Artificial Sequence
  Synthetic Oligonucleotide; PRF1 exon 2; Set B
guacugguccuggugggu

SEQ ID NO: 15950 - RNA, 16 nt, Artificial Sequence
  Synthetic Oligonucleotide; PRF1 exon 2; Set C
uacugguccugguggg

SEQ ID NO: 15951 - RNA, 29 nt, Artificial Sequence
  Synthetic Oligonucleotide; PRF1 exon 2; Set C
gaagcuguacugguccuggugggucuucu

SEQ ID NO: 15952 - RNA, 19 nt, Artificial Sequence
  Synthetic Oligonucleotide; PRF1 exon 2; Set B
uguacugguccuggugggu

SEQ ID NO: 15953 - RNA, 17 nt, Artificial Sequence
  Synthetic Oligonucleotide; PRF1 exon 2; Set B
guacugguccugguggg

SEQ ID NO: 15954 - RNA, 15 nt, Artificial Sequence
  Synthetic Oligonucleotide; PRF1 exon 2; Set C
uacugguccuggugg

SEQ ID NO: 15955 - RNA, 28 nt, Artificial Sequence
  Synthetic Oligonucleotide; PRF1 exon 2; Set C
gaagcuguacugguccuggugggucuuc

SEQ ID NO: 15956 - RNA, 30 nt, Artificial Sequence
  Synthetic Oligonucleotide; PRF1 exon 2; Set C
ugaagcuguacugguccuggugggucuucu

SEQ ID NO: 15957 - RNA, 18 nt, Artificial Sequence
  Synthetic Oligonucleotide; PRF1 exon 2; Set B
uguacugguccugguggg

SEQ ID NO: 15958 - RNA, 16 nt, Artificial Sequence
  Synthetic Oligonucleotide; PRF1 exon 2; Set C
guacugguccuggugg

SEQ ID NO: 15959 - RNA, 29 nt, Artificial Sequence
  Synthetic Oligonucleotide; PRF1 exon 2; Set C
ugaagcuguacugguccuggugggucuuc

SEQ ID NO: 15960 - RNA, 27 nt, Artificial Sequence
  Synthetic Oligonucleotide; PRF1 exon 2; Set C
gaagcuguacugguccuggugggucuu

SEQ ID NO: 15961 - RNA, 15 nt, Artificial Sequence
  Synthetic Oligonucleotide; PRF1 exon 2; Set C
guacugguccuggug

SEQ ID NO: 15962 - RNA, 17 nt, Artificial Sequence
  Synthetic Oligonucleotide; PRF1 exon 2; Set C
uguacugguccuggugg

SEQ ID NO: 15963 - RNA, 26 nt, Artificial Sequence
  Synthetic Oligonucleotide; PRF1 exon 2; Set C
gaagcuguacugguccuggugggucu

SEQ ID NO: 15964 - RNA, 28 nt, Artificial Sequence
  Synthetic Oligonucleotide; PRF1 exon 2; Set C
ugaagcuguacugguccuggugggucuu

SEQ ID NO: 15965 - RNA, 16 nt, Artificial Sequence
  Synthetic Oligonucleotide; PRF1 exon 2; Set C
uguacugguccuggug

SEQ ID NO: 15966 - RNA, 27 nt, Artificial Sequence
  Synthetic Oligonucleotide; PRF1 exon 2; Set C
ugaagcuguacugguccuggugggucu

SEQ ID NO: 15967 - RNA, 15 nt, Artificial Sequence
  Synthetic Oligonucleotide; PRF1 exon 2; Set C
uguacugguccuggu

SEQ ID NO: 15968 - RNA, 38 nt, Artificial Sequence
  Synthetic Oligonucleotide; PRF1 exon 2; Set C
gucagugcugaagcuguacugguccuggugggucuucu

SEQ ID NO: 15969 - RNA, 39 nt, Artificial Sequence
  Synthetic Oligonucleotide; PRF1 exon 2; Set C
ugucagugcugaagcuguacugguccuggugggucuucu

SEQ ID NO: 15970 - RNA, 37 nt, Artificial Sequence
  Synthetic Oligonucleotide; PRF1 exon 2; Set C
gucagugcugaagcuguacugguccuggugggucuuc

SEQ ID NO: 15971 - RNA, 40 nt, Artificial Sequence
  Synthetic Oligonucleotide; PRF1 exon 2; Set C
gugucagugcugaagcuguacugguccuggugggucuucu

SEQ ID NO: 15972 - RNA, 38 nt, Artificial Sequence
  Synthetic Oligonucleotide; PRF1 exon 2; Set C
ugucagugcugaagcuguacugguccuggugggucuuc

SEQ ID NO: 15973 - RNA, 39 nt, Artificial Sequence
  Synthetic Oligonucleotide; PRF1 exon 2; Set C
gugucagugcugaagcuguacugguccuggugggucuuc

SEQ ID NO: 15974 - RNA, 37 nt, Artificial Sequence
  Synthetic Oligonucleotide; PRF1 exon 2; Set C
ugucagugcugaagcuguacugguccuggugggucuu

SEQ ID NO: 15975 - RNA, 40 nt, Artificial Sequence
  Synthetic Oligonucleotide; PRF1 exon 2; Set C
cgugucagugcugaagcuguacugguccuggugggucuuc

SEQ ID NO: 15976 - RNA, 36 nt, Artificial Sequence
  Synthetic Oligonucleotide; PRF1 exon 2; Set C
ugucagugcugaagcuguacugguccuggugggucu

SEQ ID NO: 15977 - RNA, 38 nt, Artificial Sequence
  Synthetic Oligonucleotide; PRF1 exon 2; Set C
gugucagugcugaagcuguacugguccuggugggucuu

SEQ ID NO: 15978 - RNA, 37 nt, Artificial Sequence
  Synthetic Oligonucleotide; PRF1 exon 2; Set C
gugucagugcugaagcuguacugguccuggugggucu

SEQ ID NO: 15979 - RNA, 39 nt, Artificial Sequence
  Synthetic Oligonucleotide; PRF1 exon 2; Set C
cgugucagugcugaagcuguacugguccuggugggucuu

SEQ ID NO: 15980 - RNA, 38 nt, Artificial Sequence
  Synthetic Oligonucleotide; PRF1 exon 2; Set C
cgugucagugcugaagcuguacugguccuggugggucu

SEQ ID NO: 15981 - RNA, 22 nt, Artificial Sequence
  Synthetic Oligonucleotide; PRF1 exon 2; Set B
gugucagugcugaagcuguacu

SEQ ID NO: 15982 - RNA, 23 nt, Artificial Sequence
  Synthetic Oligonucleotide; PRF1 exon 2; Set B
cgugucagugcugaagcuguacu

SEQ ID NO: 15983 - RNA, 21 nt, Artificial Sequence
  Synthetic Oligonucleotide; PRF1 exon 2; Set B
gugucagugcugaagcuguac

SEQ ID NO: 15984 - RNA, 20 nt, Artificial Sequence
  Synthetic Oligonucleotide; PRF1 exon 2; Set B
gugucagugcugaagcugua

SEQ ID NO: 15985 - RNA, 22 nt, Artificial Sequence
  Synthetic Oligonucleotide; PRF1 exon 2; Set B
cgugucagugcugaagcuguac

SEQ ID NO: 15986 - RNA, 21 nt, Artificial Sequence
  Synthetic Oligonucleotide; PRF1 exon 2; Set B
cgugucagugcugaagcugua

SEQ ID NO: 15987 - RNA, 20 nt, Artificial Sequence
  Synthetic Oligonucleotide; PRF1 exon 2; Set B
cgugucagugcugaagcugu

SEQ ID NO: 15988 - RNA, 32 nt, Artificial Sequence
  Synthetic Oligonucleotide; PRF1 exon 2; Set C
gcacuccaccgugucagugcugaagcuguacu

SEQ ID NO: 15989 - RNA, 33 nt, Artificial Sequence
  Synthetic Oligonucleotide; PRF1 exon 2; Set C
ggcacuccaccgugucagugcugaagcuguacu

SEQ ID NO: 15990 - RNA, 31 nt, Artificial Sequence
  Synthetic Oligonucleotide; PRF1 exon 2; Set C
gcacuccaccgugucagugcugaagcuguac

SEQ ID NO: 15991 - RNA, 30 nt, Artificial Sequence
  Synthetic Oligonucleotide; PRF1 exon 2; Set C
gcacuccaccgugucagugcugaagcugua

SEQ ID NO: 15992 - RNA, 32 nt, Artificial Sequence
  Synthetic Oligonucleotide; PRF1 exon 2; Set C
ggcacuccaccgugucagugcugaagcuguac

SEQ ID NO: 15993 - RNA, 34 nt, Artificial Sequence
  Synthetic Oligonucleotide; PRF1 exon 2; Set C
cggcacuccaccgugucagugcugaagcuguacu

SEQ ID NO: 15994 - RNA, 31 nt, Artificial Sequence
  Synthetic Oligonucleotide; PRF1 exon 2; Set C
ggcacuccaccgugucagugcugaagcugua

SEQ ID NO: 15995 - RNA, 35 nt, Artificial Sequence
  Synthetic Oligonucleotide; PRF1 exon 2; Set C
gcggcacuccaccgugucagugcugaagcuguacu

SEQ ID NO: 15996 - RNA, 33 nt, Artificial Sequence
  Synthetic Oligonucleotide; PRF1 exon 2; Set C
cggcacuccaccgugucagugcugaagcuguac

SEQ ID NO: 15997 - RNA, 32 nt, Artificial Sequence
  Synthetic Oligonucleotide; PRF1 exon 2; Set C
cggcacuccaccgugucagugcugaagcugua

SEQ ID NO: 15998 - RNA, 34 nt, Artificial Sequence
  Synthetic Oligonucleotide; PRF1 exon 2; Set C
gcggcacuccaccgugucagugcugaagcuguac

SEQ ID NO: 15999 - RNA, 33 nt, Artificial Sequence
  Synthetic Oligonucleotide; PRF1 exon 2; Set C
gcggcacuccaccgugucagugcugaagcugua

SEQ ID NO: 16000 - RNA, 32 nt, Artificial Sequence
  Synthetic Oligonucleotide; PRF1 exon 2; Set C
gcggcacuccaccgugucagugcugaagcugu

SEQ ID NO: 16001 - RNA, 17 nt, Artificial Sequence
  Synthetic Oligonucleotide; PRF1 exon 2; Set B
cggcacuccaccguguc

SEQ ID NO: 16002 - RNA, 16 nt, Artificial Sequence
  Synthetic Oligonucleotide; PRF1 exon 2; Set B
cggcacuccaccgugu

SEQ ID NO: 16003 - RNA, 18 nt, Artificial Sequence
  Synthetic Oligonucleotide; PRF1 exon 2; Set C
gcggcacuccaccguguc

SEQ ID NO: 16004 - RNA, 15 nt, Artificial Sequence
  Synthetic Oligonucleotide; PRF1 exon 2; Set B
cggcacuccaccgug

SEQ ID NO: 16005 - RNA, 17 nt, Artificial Sequence
  Synthetic Oligonucleotide; PRF1 exon 2; Set C
gcggcacuccaccgugu

SEQ ID NO: 16006 - RNA, 16 nt, Artificial Sequence
  Synthetic Oligonucleotide; PRF1 exon 2; Set B
gcggcacuccaccgug

SEQ ID NO: 16007 - RNA, 15 nt, Artificial Sequence
  Synthetic Oligonucleotide; PRF1 exon 2; Set B
gcggcacuccaccgu

SEQ ID NO: 16008 - RNA, 15 nt, Artificial Sequence
  Synthetic Oligonucleotide; PRF1 exon 2; Set C
uuucccgcgccuuuu

SEQ ID NO: 16009 - RNA, 16 nt, Artificial Sequence
  Synthetic Oligonucleotide; PRF1 exon 2; Set C
guuucccgcgccuuuu

SEQ ID NO: 16010 - RNA, 15 nt, Artificial Sequence
  Synthetic Oligonucleotide; PRF1 exon 2; Set C
guuucccgcgccuuu

SEQ ID NO: 16011 - RNA, 17 nt, Artificial Sequence
  Synthetic Oligonucleotide; PRF1 exon 2; Set C
aguuucccgcgccuuuu

SEQ ID NO: 16012 - RNA, 16 nt, Artificial Sequence
  Synthetic Oligonucleotide; PRF1 exon 2; Set C
aguuucccgcgccuuu

SEQ ID NO: 16013 - RNA, 18 nt, Artificial Sequence
  Synthetic Oligonucleotide; PRF1 exon 2; Set B
gaguuucccgcgccuuuu

SEQ ID NO: 16014 - RNA, 17 nt, Artificial Sequence
  Synthetic Oligonucleotide; PRF1 exon 2; Set B
gaguuucccgcgccuuu

SEQ ID NO: 16015 - RNA, 16 nt, Artificial Sequence
  Synthetic Oligonucleotide; PRF1 exon 2; Set C
auggaggaugacugcu

SEQ ID NO: 16016 - RNA, 15 nt, Artificial Sequence
  Synthetic Oligonucleotide; PRF1 exon 2; Set C
auggaggaugacugc

SEQ ID NO: 16017 - RNA, 28 nt, Artificial Sequence
  Synthetic Oligonucleotide; PRF1 exon 2; Set C
cauggguggagggauggaggaugacugc

SEQ ID NO: 16018 - RNA, 36 nt, Artificial Sequence
  Synthetic Oligonucleotide; PRF1 exon 2; Set C
gggaagccauggguggagggauggaggaugacugcu

SEQ ID NO: 16019 - RNA, 37 nt, Artificial Sequence
  Synthetic Oligonucleotide; PRF1 exon 2; Set C
ugggaagccauggguggagggauggaggaugacugcu

SEQ ID NO: 16020 - RNA, 35 nt, Artificial Sequence
  Synthetic Oligonucleotide; PRF1 exon 2; Set C
gggaagccauggguggagggauggaggaugacugc

SEQ ID NO: 16021 - RNA, 36 nt, Artificial Sequence
  Synthetic Oligonucleotide; PRF1 exon 2; Set C
ugggaagccauggguggagggauggaggaugacugc

SEQ ID NO: 16022 - RNA, 31 nt, Artificial Sequence
  Synthetic Oligonucleotide; PRF1 exon 2; Set C
gggaagccauggguggagggauggaggauga

SEQ ID NO: 16023 - RNA, 30 nt, Artificial Sequence
  Synthetic Oligonucleotide; PRF1 exon 2; Set C
gggaagccauggguggagggauggaggaug

SEQ ID NO: 16024 - RNA, 32 nt, Artificial Sequence
  Synthetic Oligonucleotide; PRF1 exon 2; Set C
ugggaagccauggguggagggauggaggauga

SEQ ID NO: 16025 - RNA, 31 nt, Artificial Sequence
  Synthetic Oligonucleotide; PRF1 exon 2; Set C
ugggaagccauggguggagggauggaggaug

SEQ ID NO: 16026 - RNA, 29 nt, Artificial Sequence
  Synthetic Oligonucleotide; PRF1 exon 2; Set C
gggaagccauggguggagggauggaggau

SEQ ID NO: 16027 - RNA, 30 nt, Artificial Sequence
  Synthetic Oligonucleotide; PRF1 exon 2; Set C
ugggaagccauggguggagggauggaggau

SEQ ID NO: 16028 - RNA, 37 nt, Artificial Sequence
  Synthetic Oligonucleotide; PRF1 exon 2; Set C
ggcucugggaagccauggguggagggauggaggauga

SEQ ID NO: 16029 - RNA, 36 nt, Artificial Sequence
  Synthetic Oligonucleotide; PRF1 exon 2; Set C
ggcucugggaagccauggguggagggauggaggaug

SEQ ID NO: 16030 - RNA, 38 nt, Artificial Sequence
  Synthetic Oligonucleotide; PRF1 exon 2; Set C
gggcucugggaagccauggguggagggauggaggauga

SEQ ID NO: 16031 - RNA, 24 nt, Artificial Sequence
  Synthetic Oligonucleotide; PRF1 exon 2; Set C
gggaagccauggguggagggaugg

SEQ ID NO: 16032 - RNA, 37 nt, Artificial Sequence
  Synthetic Oligonucleotide; PRF1 exon 2; Set C
gggcucugggaagccauggguggagggauggaggaug

SEQ ID NO: 16033 - RNA, 35 nt, Artificial Sequence
  Synthetic Oligonucleotide; PRF1 exon 2; Set C
ggcucugggaagccauggguggagggauggaggau

SEQ ID NO: 16034 - RNA, 25 nt, Artificial Sequence
  Synthetic Oligonucleotide; PRF1 exon 2; Set C
ugggaagccauggguggagggaugg

SEQ ID NO: 16035 - RNA, 36 nt, Artificial Sequence
  Synthetic Oligonucleotide; PRF1 exon 2; Set C
gggcucugggaagccauggguggagggauggaggau

SEQ ID NO: 16036 - RNA, 30 nt, Artificial Sequence
  Synthetic Oligonucleotide; PRF1 exon 2; Set C
ggcucugggaagccauggguggagggaugg

SEQ ID NO: 16037 - RNA, 31 nt, Artificial Sequence
  Synthetic Oligonucleotide; PRF1 exon 2; Set C
gggcucugggaagccauggguggagggaugg

SEQ ID NO: 16038 - RNA, 32 nt, Artificial Sequence
  Synthetic Oligonucleotide; PRF1 exon 2; Set C
uugggcucugggaagccauggguggagggaug

SEQ ID NO: 16039 - RNA, 33 nt, Artificial Sequence
  Synthetic Oligonucleotide; PRF1 exon 2; Set C
cuugggcucugggaagccauggguggagggaug

SEQ ID NO: 16040 - RNA, 34 nt, Artificial Sequence
  Synthetic Oligonucleotide; PRF1 exon 2; Set C
acuugggcucugggaagccauggguggagggaug

SEQ ID NO: 16041 - RNA, 40 nt, Artificial Sequence
  Synthetic Oligonucleotide; PRF1 exon 2; Set C
gggggcacuugggcucugggaagccauggguggagggaug

SEQ ID NO: 16042 - RNA, 16 nt, Artificial Sequence
  Synthetic Oligonucleotide; PRF1 exon 2; Set C
ggcucugggaagccau

SEQ ID NO: 16043 - RNA, 17 nt, Artificial Sequence
  Synthetic Oligonucleotide; PRF1 exon 2; Set A
gggcucugggaagccau

SEQ ID NO: 16044 - RNA, 18 nt, Artificial Sequence
  Synthetic Oligonucleotide; PRF1 exon 2; Set A
ugggcucugggaagccau

SEQ ID NO: 16045 - RNA, 20 nt, Artificial Sequence
  Synthetic Oligonucleotide; PRF1 exon 2; Set A
uugggcucugggaagccaug

SEQ ID NO: 16046 - RNA, 21 nt, Artificial Sequence
  Synthetic Oligonucleotide; PRF1 exon 2; Set A
cuugggcucugggaagccaug

SEQ ID NO: 16047 - RNA, 22 nt, Artificial Sequence
  Synthetic Oligonucleotide; PRF1 exon 2; Set A
acuugggcucugggaagccaug

SEQ ID NO: 16048 - RNA, 19 nt, Artificial Sequence
  Synthetic Oligonucleotide; PRF1 exon 2; Set C
gggcacuugggcucuggga

SEQ ID NO: 16049 - RNA, 34 nt, Artificial Sequence
  Synthetic Oligonucleotide; PRF1 exon 2; Set C
gagacagggggcacuugggcucugggaagccaug

SEQ ID NO: 16050 - RNA, 35 nt, Artificial Sequence
  Synthetic Oligonucleotide; PRF1 exon 2; Set C
agagacagggggcacuugggcucugggaagccaug

SEQ ID NO: 16051 - RNA, 35 nt, Artificial Sequence
  Synthetic Oligonucleotide; PRF1 exon 2; Set C
cagagacagggggcacuugggcucugggaagccau

SEQ ID NO: 16052 - RNA, 36 nt, Artificial Sequence
  Synthetic Oligonucleotide; PRF1 exon 2; Set C
gcagagacagggggcacuugggcucugggaagccau

SEQ ID NO: 16053 - RNA, 37 nt, Artificial Sequence
  Synthetic Oligonucleotide; PRF1 exon 2; Set C
ugcagagacagggggcacuugggcucugggaagccau

SEQ ID NO: 16054 - RNA, 29 nt, Artificial Sequence
  Synthetic Oligonucleotide; PRF1 exon 2; Set C
cagagacagggggcacuugggcucuggga

SEQ ID NO: 16055 - RNA, 30 nt, Artificial Sequence
  Synthetic Oligonucleotide; PRF1 exon 2; Set C
gcagagacagggggcacuugggcucuggga

SEQ ID NO: 16056 - RNA, 28 nt, Artificial Sequence
  Synthetic Oligonucleotide; PRF1 exon 2; Set C
cagagacagggggcacuugggcucuggg

SEQ ID NO: 16057 - RNA, 29 nt, Artificial Sequence
  Synthetic Oligonucleotide; PRF1 exon 2; Set C
gcagagacagggggcacuugggcucuggg

SEQ ID NO: 16058 - RNA, 30 nt, Artificial Sequence
  Synthetic Oligonucleotide; PRF1 exon 2; Set C
ugcagagacagggggcacuugggcucuggg

SEQ ID NO: 16059 - RNA, 28 nt, Artificial Sequence
  Synthetic Oligonucleotide; PRF1 exon 2; Set C
gcagagacagggggcacuugggcucugg

SEQ ID NO: 16060 - RNA, 29 nt, Artificial Sequence
  Synthetic Oligonucleotide; PRF1 exon 2; Set C
ugcagagacagggggcacuugggcucugg

SEQ ID NO: 16061 - RNA, 20 nt, Artificial Sequence
  Synthetic Oligonucleotide; PRF1 exon 2; Set A
cagagacagggggcacuugg

SEQ ID NO: 16062 - RNA, 22 nt, Artificial Sequence
  Synthetic Oligonucleotide; PRF1 exon 2; Set C
gcagagacagggggcacuuggg

SEQ ID NO: 16063 - RNA, 24 nt, Artificial Sequence
  Synthetic Oligonucleotide; PRF1 exon 2; Set C
ugcagagacagggggcacuugggc

SEQ ID NO: 16064 - RNA, 21 nt, Artificial Sequence
  Synthetic Oligonucleotide; PRF1 exon 2; Set C
gcagagacagggggcacuugg

SEQ ID NO: 16065 - RNA, 23 nt, Artificial Sequence
  Synthetic Oligonucleotide; PRF1 exon 2; Set C
ugcagagacagggggcacuuggg

SEQ ID NO: 16066 - RNA, 22 nt, Artificial Sequence
  Synthetic Oligonucleotide; PRF1 exon 2; Set C
ugcagagacagggggcacuugg

SEQ ID NO: 16067 - RNA, 38 nt, Artificial Sequence
  Synthetic Oligonucleotide; PRF1 exon 2; Set C
cauggagcugcagagacagggggcacuugggcucuggg

SEQ ID NO: 16068 - RNA, 37 nt, Artificial Sequence
  Synthetic Oligonucleotide; PRF1 exon 2; Set C
cauggagcugcagagacagggggcacuugggcucugg

SEQ ID NO: 16069 - RNA, 31 nt, Artificial Sequence
  Synthetic Oligonucleotide; PRF1 exon 2; Set C
cauggagcugcagagacagggggcacuuggg

SEQ ID NO: 16070 - RNA, 30 nt, Artificial Sequence
  Synthetic Oligonucleotide; PRF1 exon 2; Set C
cauggagcugcagagacagggggcacuugg

SEQ ID NO: 16071 - RNA, 20 nt, Artificial Sequence
  Synthetic Oligonucleotide; PRF1 exon 2; Set A
ggagcugcagagacaggggg

SEQ ID NO: 16072 - RNA, 21 nt, Artificial Sequence
  Synthetic Oligonucleotide; PRF1 exon 2; Set C
uggagcugcagagacaggggg

SEQ ID NO: 16073 - RNA, 34 nt, Artificial Sequence
  Synthetic Oligonucleotide; PRF1 exon 2; Set C
gcugccauggagcugcagagacagggggcacuug

SEQ ID NO: 16074 - RNA, 40 nt, Artificial Sequence
  Synthetic Oligonucleotide; PRF1 exon 2; Set C
cgggcugccauggagcugcagagacagggggcacuugggc

SEQ ID NO: 16075 - RNA, 22 nt, Artificial Sequence
  Synthetic Oligonucleotide; PRF1 exon 2; Set A
auggagcugcagagacaggggg

SEQ ID NO: 16076 - RNA, 37 nt, Artificial Sequence
  Synthetic Oligonucleotide; PRF1 exon 2; Set C
gggcugccauggagcugcagagacagggggcacuugg

SEQ ID NO: 16077 - RNA, 39 nt, Artificial Sequence
  Synthetic Oligonucleotide; PRF1 exon 2; Set C
cgggcugccauggagcugcagagacagggggcacuuggg

SEQ ID NO: 16078 - RNA, 22 nt, Artificial Sequence
  Synthetic Oligonucleotide; PRF1 exon 2; Set A
cauggagcugcagagacagggg

SEQ ID NO: 16079 - RNA, 38 nt, Artificial Sequence
  Synthetic Oligonucleotide; PRF1 exon 2; Set C
cgggcugccauggagcugcagagacagggggcacuugg

SEQ ID NO: 16080 - RNA, 21 nt, Artificial Sequence
  Synthetic Oligonucleotide; PRF1 exon 2; Set A
cauggagcugcagagacaggg

SEQ ID NO: 16081 - RNA, 20 nt, Artificial Sequence
  Synthetic Oligonucleotide; PRF1 exon 2; Set A
cauggagcugcagagacagg

SEQ ID NO: 16082 - RNA, 19 nt, Artificial Sequence
  Synthetic Oligonucleotide; PRF1 exon 2; Set C
cauggagcugcagagacag

SEQ ID NO: 16083 - RNA, 15 nt, Artificial Sequence
  Synthetic Oligonucleotide; PRF1 exon 2; Set C
cauggagcugcagag

SEQ ID NO: 16084 - RNA, 29 nt, Artificial Sequence
  Synthetic Oligonucleotide; PRF1 exon 2; Set C
gggcugccauggagcugcagagacagggg

SEQ ID NO: 16085 - RNA, 28 nt, Artificial Sequence
  Synthetic Oligonucleotide; PRF1 exon 2; Set C
gggcugccauggagcugcagagacaggg

SEQ ID NO: 16086 - RNA, 30 nt, Artificial Sequence
  Synthetic Oligonucleotide; PRF1 exon 2; Set C
cgggcugccauggagcugcagagacagggg

SEQ ID NO: 16087 - RNA, 27 nt, Artificial Sequence
  Synthetic Oligonucleotide; PRF1 exon 2; Set C
gggcugccauggagcugcagagacagg

SEQ ID NO: 16088 - RNA, 28 nt, Artificial Sequence
  Synthetic Oligonucleotide; PRF1 exon 2; Set C
cgggcugccauggagcugcagagacagg

SEQ ID NO: 16089 - RNA, 26 nt, Artificial Sequence
  Synthetic Oligonucleotide; PRF1 exon 2; Set C
gggcugccauggagcugcagagacag

SEQ ID NO: 16090 - RNA, 27 nt, Artificial Sequence
  Synthetic Oligonucleotide; PRF1 exon 2; Set C
cgggcugccauggagcugcagagacag

SEQ ID NO: 16091 - RNA, 22 nt, Artificial Sequence
  Synthetic Oligonucleotide; PRF1 exon 2; Set C
gggcugccauggagcugcagag

SEQ ID NO: 16092 - RNA, 23 nt, Artificial Sequence
  Synthetic Oligonucleotide; PRF1 exon 2; Set C
cgggcugccauggagcugcagag

SEQ ID NO: 16093 - RNA, 21 nt, Artificial Sequence
  Synthetic Oligonucleotide; PRF1 exon 2; Set C
gggcugccauggagcugcaga

SEQ ID NO: 16094 - RNA, 37 nt, Artificial Sequence
  Synthetic Oligonucleotide; PRF1 exon 2; Set C
gagcagacgggcugccauggagcugcagagacagggg

SEQ ID NO: 16095 - RNA, 22 nt, Artificial Sequence
  Synthetic Oligonucleotide; PRF1 exon 2; Set C
cgggcugccauggagcugcaga

SEQ ID NO: 16096 - RNA, 36 nt, Artificial Sequence
  Synthetic Oligonucleotide; PRF1 exon 2; Set C
gagcagacgggcugccauggagcugcagagacaggg

SEQ ID NO: 16097 - RNA, 37 nt, Artificial Sequence
  Synthetic Oligonucleotide; PRF1 exon 2; Set C
ggagcagacgggcugccauggagcugcagagacaggg

SEQ ID NO: 16098 - RNA, 35 nt, Artificial Sequence
  Synthetic Oligonucleotide; PRF1 exon 2; Set C
gagcagacgggcugccauggagcugcagagacagg

SEQ ID NO: 16099 - RNA, 36 nt, Artificial Sequence
  Synthetic Oligonucleotide; PRF1 exon 2; Set C
ggagcagacgggcugccauggagcugcagagacagg

SEQ ID NO: 16100 - RNA, 34 nt, Artificial Sequence
  Synthetic Oligonucleotide; PRF1 exon 2; Set C
gagcagacgggcugccauggagcugcagagacag

SEQ ID NO: 16101 - RNA, 22 nt, Artificial Sequence
  Synthetic Oligonucleotide; PRF1 exon 2; Set C
acgggcugccauggagcugcag

SEQ ID NO: 16102 - RNA, 21 nt, Artificial Sequence
  Synthetic Oligonucleotide; PRF1 exon 2; Set C
acgggcugccauggagcugca

SEQ ID NO: 16103 - RNA, 40 nt, Artificial Sequence
  Synthetic Oligonucleotide; PRF1 exon 2; Set C
ggaggagcagacgggcugccauggagcugcagagacaggg

SEQ ID NO: 16104 - RNA, 20 nt, Artificial Sequence
  Synthetic Oligonucleotide; PRF1 exon 2; Set C
acgggcugccauggagcugc

SEQ ID NO: 16105 - RNA, 39 nt, Artificial Sequence
  Synthetic Oligonucleotide; PRF1 exon 2; Set C
ggaggagcagacgggcugccauggagcugcagagacagg

SEQ ID NO: 16106 - RNA, 30 nt, Artificial Sequence
  Synthetic Oligonucleotide; PRF1 exon 2; Set C
gagcagacgggcugccauggagcugcagag

SEQ ID NO: 16107 - RNA, 38 nt, Artificial Sequence
  Synthetic Oligonucleotide; PRF1 exon 2; Set C
ggaggagcagacgggcugccauggagcugcagagacag

SEQ ID NO: 16108 - RNA, 31 nt, Artificial Sequence
  Synthetic Oligonucleotide; PRF1 exon 2; Set C
ggagcagacgggcugccauggagcugcagag

SEQ ID NO: 16109 - RNA, 29 nt, Artificial Sequence
  Synthetic Oligonucleotide; PRF1 exon 2; Set C
gagcagacgggcugccauggagcugcaga

SEQ ID NO: 16110 - RNA, 30 nt, Artificial Sequence
  Synthetic Oligonucleotide; PRF1 exon 2; Set C
ggagcagacgggcugccauggagcugcaga

SEQ ID NO: 16111 - RNA, 34 nt, Artificial Sequence
  Synthetic Oligonucleotide; PRF1 exon 2; Set C
ggaggagcagacgggcugccauggagcugcagag

SEQ ID NO: 16112 - RNA, 33 nt, Artificial Sequence
  Synthetic Oligonucleotide; PRF1 exon 2; Set C
ggaggagcagacgggcugccauggagcugcaga

SEQ ID NO: 16113 - RNA, 22 nt, Artificial Sequence
  Synthetic Oligonucleotide; PRF1 exon 2; Set C
gagcagacgggcugccauggag

SEQ ID NO: 16114 - RNA, 21 nt, Artificial Sequence
  Synthetic Oligonucleotide; PRF1 exon 2; Set C
gagcagacgggcugccaugga

SEQ ID NO: 16115 - RNA, 23 nt, Artificial Sequence
  Synthetic Oligonucleotide; PRF1 exon 2; Set C
ggagcagacgggcugccauggag

SEQ ID NO: 16116 - RNA, 20 nt, Artificial Sequence
  Synthetic Oligonucleotide; PRF1 exon 2; Set C
gagcagacgggcugccaugg

SEQ ID NO: 16117 - RNA, 22 nt, Artificial Sequence
  Synthetic Oligonucleotide; PRF1 exon 2; Set C
ggagcagacgggcugccaugga

SEQ ID NO: 16118 - RNA, 21 nt, Artificial Sequence
  Synthetic Oligonucleotide; PRF1 exon 2; Set C
ggagcagacgggcugccaugg

SEQ ID NO: 16119 - RNA, 19 nt, Artificial Sequence
  Synthetic Oligonucleotide; PRF1 exon 2; Set A
gagcagacgggcugccaug

SEQ ID NO: 16120 - RNA, 20 nt, Artificial Sequence
  Synthetic Oligonucleotide; PRF1 exon 2; Set C
ggagcagacgggcugccaug

SEQ ID NO: 16121 - RNA, 26 nt, Artificial Sequence
  Synthetic Oligonucleotide; PRF1 exon 2; Set C
ggaggagcagacgggcugccauggag

SEQ ID NO: 16122 - RNA, 38 nt, Artificial Sequence
  Synthetic Oligonucleotide; PRF1 exon 2; Set C
ugcccaggaggagcagacgggcugccauggagcugcag

SEQ ID NO: 16123 - RNA, 25 nt, Artificial Sequence
  Synthetic Oligonucleotide; PRF1 exon 2; Set C
ggaggagcagacgggcugccaugga

SEQ ID NO: 16124 - RNA, 27 nt, Artificial Sequence
  Synthetic Oligonucleotide; PRF1 exon 2; Set C
aggaggagcagacgggcugccauggag

SEQ ID NO: 16125 - RNA, 37 nt, Artificial Sequence
  Synthetic Oligonucleotide; PRF1 exon 2; Set C
ugcccaggaggagcagacgggcugccauggagcugca

SEQ ID NO: 16126 - RNA, 39 nt, Artificial Sequence
  Synthetic Oligonucleotide; PRF1 exon 2; Set C
augcccaggaggagcagacgggcugccauggagcugcag

SEQ ID NO: 16127 - RNA, 24 nt, Artificial Sequence
  Synthetic Oligonucleotide; PRF1 exon 2; Set C
ggaggagcagacgggcugccaugg

SEQ ID NO: 16128 - RNA, 26 nt, Artificial Sequence
  Synthetic Oligonucleotide; PRF1 exon 2; Set C
aggaggagcagacgggcugccaugga

SEQ ID NO: 16129 - RNA, 36 nt, Artificial Sequence
  Synthetic Oligonucleotide; PRF1 exon 2; Set C
ugcccaggaggagcagacgggcugccauggagcugc

SEQ ID NO: 16130 - RNA, 38 nt, Artificial Sequence
  Synthetic Oligonucleotide; PRF1 exon 2; Set C
augcccaggaggagcagacgggcugccauggagcugca

SEQ ID NO: 16131 - RNA, 40 nt, Artificial Sequence
  Synthetic Oligonucleotide; PRF1 exon 2; Set C
gaugcccaggaggagcagacgggcugccauggagcugcag

SEQ ID NO: 16132 - RNA, 25 nt, Artificial Sequence
  Synthetic Oligonucleotide; PRF1 exon 2; Set C
aggaggagcagacgggcugccaugg

SEQ ID NO: 16133 - RNA, 23 nt, Artificial Sequence
  Synthetic Oligonucleotide; PRF1 exon 2; Set C
ggaggagcagacgggcugccaug

SEQ ID NO: 16134 - RNA, 37 nt, Artificial Sequence
  Synthetic Oligonucleotide; PRF1 exon 2; Set C
augcccaggaggagcagacgggcugccauggagcugc

SEQ ID NO: 16135 - RNA, 39 nt, Artificial Sequence
  Synthetic Oligonucleotide; PRF1 exon 2; Set C
gaugcccaggaggagcagacgggcugccauggagcugca

SEQ ID NO: 16136 - RNA, 24 nt, Artificial Sequence
  Synthetic Oligonucleotide; PRF1 exon 2; Set C
aggaggagcagacgggcugccaug

SEQ ID NO: 16137 - RNA, 38 nt, Artificial Sequence
  Synthetic Oligonucleotide; PRF1 exon 2; Set C
gaugcccaggaggagcagacgggcugccauggagcugc

SEQ ID NO: 16138 - RNA, 39 nt, Artificial Sequence
  Synthetic Oligonucleotide; PRF1 exon 2; Set C
ggaugcccaggaggagcagacgggcugccauggagcugc

SEQ ID NO: 16139 - RNA, 36 nt, Artificial Sequence
  Synthetic Oligonucleotide; PRF1 exon 2; Set C
aggaugcccaggaggagcagacgggcugccauggag

SEQ ID NO: 16140 - RNA, 28 nt, Artificial Sequence
  Synthetic Oligonucleotide; PRF1 exon 2; Set C
ugcccaggaggagcagacgggcugccau

SEQ ID NO: 16141 - RNA, 35 nt, Artificial Sequence
  Synthetic Oligonucleotide; PRF1 exon 2; Set C
aggaugcccaggaggagcagacgggcugccaugga

SEQ ID NO: 16142 - RNA, 37 nt, Artificial Sequence
  Synthetic Oligonucleotide; PRF1 exon 2; Set C
aaggaugcccaggaggagcagacgggcugccauggag

SEQ ID NO: 16143 - RNA, 29 nt, Artificial Sequence
  Synthetic Oligonucleotide; PRF1 exon 2; Set C
augcccaggaggagcagacgggcugccau

SEQ ID NO: 16144 - RNA, 34 nt, Artificial Sequence
  Synthetic Oligonucleotide; PRF1 exon 2; Set C
aggaugcccaggaggagcagacgggcugccaugg

SEQ ID NO: 16145 - RNA, 36 nt, Artificial Sequence
  Synthetic Oligonucleotide; PRF1 exon 2; Set C
aaggaugcccaggaggagcagacgggcugccaugga

SEQ ID NO: 16146 - RNA, 30 nt, Artificial Sequence
  Synthetic Oligonucleotide; PRF1 exon 2; Set C
gaugcccaggaggagcagacgggcugccau

SEQ ID NO: 16147 - RNA, 35 nt, Artificial Sequence
  Synthetic Oligonucleotide; PRF1 exon 2; Set C
aaggaugcccaggaggagcagacgggcugccaugg

SEQ ID NO: 16148 - RNA, 33 nt, Artificial Sequence
  Synthetic Oligonucleotide; PRF1 exon 2; Set C
aggaugcccaggaggagcagacgggcugccaug

SEQ ID NO: 16149 - RNA, 37 nt, Artificial Sequence
  Synthetic Oligonucleotide; PRF1 exon 2; Set C
gaaggaugcccaggaggagcagacgggcugccaugga

SEQ ID NO: 16150 - RNA, 39 nt, Artificial Sequence
  Synthetic Oligonucleotide; PRF1 exon 2; Set C
agaaggaugcccaggaggagcagacgggcugccauggag

SEQ ID NO: 16151 - RNA, 34 nt, Artificial Sequence
  Synthetic Oligonucleotide; PRF1 exon 2; Set C
aaggaugcccaggaggagcagacgggcugccaug

SEQ ID NO: 16152 - RNA, 38 nt, Artificial Sequence
  Synthetic Oligonucleotide; PRF1 exon 2; Set C
agaaggaugcccaggaggagcagacgggcugccaugga

SEQ ID NO: 16153 - RNA, 40 nt, Artificial Sequence
  Synthetic Oligonucleotide; PRF1 exon 2; Set C
gagaaggaugcccaggaggagcagacgggcugccauggag

SEQ ID NO: 16154 - RNA, 37 nt, Artificial Sequence
  Synthetic Oligonucleotide; PRF1 exon 2; Set C
agaaggaugcccaggaggagcagacgggcugccaugg

SEQ ID NO: 16155 - RNA, 39 nt, Artificial Sequence
  Synthetic Oligonucleotide; PRF1 exon 2; Set C
gagaaggaugcccaggaggagcagacgggcugccaugga

SEQ ID NO: 16156 - RNA, 38 nt, Artificial Sequence
  Synthetic Oligonucleotide; PRF1 exon 2; Set C
gagaaggaugcccaggaggagcagacgggcugccaugg

SEQ ID NO: 16157 - RNA, 36 nt, Artificial Sequence
  Synthetic Oligonucleotide; PRF1 exon 2; Set C
agaaggaugcccaggaggagcagacgggcugccaug

SEQ ID NO: 16158 - RNA, 37 nt, Artificial Sequence
  Synthetic Oligonucleotide; PRF1 exon 2; Set C
gagaaggaugcccaggaggagcagacgggcugccaug

SEQ ID NO: 16159 - RNA, 21 nt, Artificial Sequence
  Synthetic Oligonucleotide; PRF1 exon 2; Set C
ugcccaggaggagcagacggg

SEQ ID NO: 16160 - RNA, 20 nt, Artificial Sequence
  Synthetic Oligonucleotide; PRF1 exon 2; Set C
ugcccaggaggagcagacgg

SEQ ID NO: 16161 - RNA, 22 nt, Artificial Sequence
  Synthetic Oligonucleotide; PRF1 exon 2; Set C
augcccaggaggagcagacggg

SEQ ID NO: 16162 - RNA, 21 nt, Artificial Sequence
  Synthetic Oligonucleotide; PRF1 exon 2; Set C
augcccaggaggagcagacgg

SEQ ID NO: 16163 - RNA, 23 nt, Artificial Sequence
  Synthetic Oligonucleotide; PRF1 exon 2; Set C
gaugcccaggaggagcagacggg

SEQ ID NO: 16164 - RNA, 22 nt, Artificial Sequence
  Synthetic Oligonucleotide; PRF1 exon 2; Set C
gaugcccaggaggagcagacgg

SEQ ID NO: 16165 - RNA, 38 nt, Artificial Sequence
  Synthetic Oligonucleotide; PRF1 exon 2; Set C
aggagaaggaugcccaggaggagcagacgggcugccau

SEQ ID NO: 16166 - RNA, 23 nt, Artificial Sequence
  Synthetic Oligonucleotide; PRF1 exon 2; Set C
ggaugcccaggaggagcagacgg

SEQ ID NO: 16167 - RNA, 23 nt, Artificial Sequence
  Synthetic Oligonucleotide; PRF1 exon 2; Set C
aggaugcccaggaggagcagacg

SEQ ID NO: 16168 - RNA, 24 nt, Artificial Sequence
  Synthetic Oligonucleotide; PRF1 exon 2; Set C
aaggaugcccaggaggagcagacg

SEQ ID NO: 16169 - RNA, 25 nt, Artificial Sequence
  Synthetic Oligonucleotide; PRF1 exon 2; Set C
gaaggaugcccaggaggagcagacg

SEQ ID NO: 16170 - RNA, 26 nt, Artificial Sequence
  Synthetic Oligonucleotide; PRF1 exon 2; Set C
agaaggaugcccaggaggagcagacg

SEQ ID NO: 16171 - RNA, 27 nt, Artificial Sequence
  Synthetic Oligonucleotide; PRF1 exon 2; Set C
gagaaggaugcccaggaggagcagacg

SEQ ID NO: 16172 - RNA, 29 nt, Artificial Sequence
  Synthetic Oligonucleotide; PRF1 exon 2; Set C
ggagaaggaugcccaggaggagcagacgg

SEQ ID NO: 16173 - RNA, 31 nt, Artificial Sequence
  Synthetic Oligonucleotide; PRF1 exon 2; Set C
aggagaaggaugcccaggaggagcagacggg

SEQ ID NO: 16174 - RNA, 30 nt, Artificial Sequence
  Synthetic Oligonucleotide; PRF1 exon 2; Set C
aggagaaggaugcccaggaggagcagacgg

SEQ ID NO: 16175 - RNA, 23 nt, Artificial Sequence
  Synthetic Oligonucleotide; PRF1 exon 2; Set A
aggagaaggaugcccaggaggag

SEQ ID NO: 16176 - RNA, 22 nt, Artificial Sequence
  Synthetic Oligonucleotide; PRF1 exon 2; Set A
aggagaaggaugcccaggagga

SEQ ID NO: 16177 - RNA, 39 nt, Artificial Sequence
  Synthetic Oligonucleotide; PRF1 exon 2; Set C
gggcagcagcaggagaaggaugcccaggaggagcagacg

SEQ ID NO: 16178 - RNA, 19 nt, Artificial Sequence
  Synthetic Oligonucleotide; PRF1 exon 2; Set A
aggagaaggaugcccagga

SEQ ID NO: 16179 - RNA, 40 nt, Artificial Sequence
  Synthetic Oligonucleotide; PRF1 exon 2; Set C
ggggcagcagcaggagaaggaugcccaggaggagcagacg

SEQ ID NO: 16180 - RNA, 21 nt, Artificial Sequence
  Synthetic Oligonucleotide; PRF1 exon 2; Set A
gcagcagcaggagaaggaugc

SEQ ID NO: 16181 - RNA, 20 nt, Artificial Sequence
  Synthetic Oligonucleotide; PRF1 exon 2; Set A
gcagcagcaggagaaggaug

SEQ ID NO: 16182 - RNA, 22 nt, Artificial Sequence
  Synthetic Oligonucleotide; PRF1 exon 2; Set A
ggcagcagcaggagaaggaugc

SEQ ID NO: 16183 - RNA, 19 nt, Artificial Sequence
  Synthetic Oligonucleotide; PRF1 exon 2; Set A
gcagcagcaggagaaggau

SEQ ID NO: 16184 - RNA, 21 nt, Artificial Sequence
  Synthetic Oligonucleotide; PRF1 exon 2; Set A
ggcagcagcaggagaaggaug

SEQ ID NO: 16185 - RNA, 23 nt, Artificial Sequence
  Synthetic Oligonucleotide; PRF1 exon 2; Set C
gggcagcagcaggagaaggaugc

SEQ ID NO: 16186 - RNA, 20 nt, Artificial Sequence
  Synthetic Oligonucleotide; PRF1 exon 2; Set A
ggcagcagcaggagaaggau

SEQ ID NO: 16187 - RNA, 22 nt, Artificial Sequence
  Synthetic Oligonucleotide; PRF1 exon 2; Set A
gggcagcagcaggagaaggaug

SEQ ID NO: 16188 - RNA, 24 nt, Artificial Sequence
  Synthetic Oligonucleotide; PRF1 exon 2; Set C
ggggcagcagcaggagaaggaugc

SEQ ID NO: 16189 - RNA, 21 nt, Artificial Sequence
  Synthetic Oligonucleotide; PRF1 exon 2; Set A
gggcagcagcaggagaaggau

SEQ ID NO: 16190 - RNA, 23 nt, Artificial Sequence
  Synthetic Oligonucleotide; PRF1 exon 2; Set C
ggggcagcagcaggagaaggaug

SEQ ID NO: 16191 - RNA, 25 nt, Artificial Sequence
  Synthetic Oligonucleotide; PRF1 exon 2; Set C
aggggcagcagcaggagaaggaugc

SEQ ID NO: 16192 - RNA, 22 nt, Artificial Sequence
  Synthetic Oligonucleotide; PRF1 exon 2; Set C
ggggcagcagcaggagaaggau

SEQ ID NO: 16193 - RNA, 24 nt, Artificial Sequence
  Synthetic Oligonucleotide; PRF1 exon 2; Set C
aggggcagcagcaggagaaggaug

SEQ ID NO: 16194 - RNA, 20 nt, Artificial Sequence
  Synthetic Oligonucleotide; PRF1 exon 2; Set A
gggcagcagcaggagaagga

SEQ ID NO: 16195 - RNA, 23 nt, Artificial Sequence
  Synthetic Oligonucleotide; PRF1 exon 2; Set C
aggggcagcagcaggagaaggau

SEQ ID NO: 16196 - RNA, 21 nt, Artificial Sequence
  Synthetic Oligonucleotide; PRF1 exon 2; Set C
ggggcagcagcaggagaagga

SEQ ID NO: 16197 - RNA, 31 nt, Artificial Sequence
  Synthetic Oligonucleotide; PRF1 exon 2; Set C
acgggcaggggcagcagcaggagaaggaugc

SEQ ID NO: 16198 - RNA, 30 nt, Artificial Sequence
  Synthetic Oligonucleotide; PRF1 exon 2; Set C
acgggcaggggcagcagcaggagaaggaug

SEQ ID NO: 16199 - RNA, 29 nt, Artificial Sequence
  Synthetic Oligonucleotide; PRF1 exon 2; Set C
acgggcaggggcagcagcaggagaaggau

SEQ ID NO: 16200 - RNA, 28 nt, Artificial Sequence
  Synthetic Oligonucleotide; PRF1 exon 2; Set C
acgggcaggggcagcagcaggagaagga

SEQ ID NO: 16201 - RNA, 35 nt, Artificial Sequence
  Synthetic Oligonucleotide; PRF1 exon 2; Set C
agggacgggcaggggcagcagcaggagaaggaugc

SEQ ID NO: 16202 - RNA, 34 nt, Artificial Sequence
  Synthetic Oligonucleotide; PRF1 exon 2; Set C
agggacgggcaggggcagcagcaggagaaggaug

SEQ ID NO: 16203 - RNA, 36 nt, Artificial Sequence
  Synthetic Oligonucleotide; PRF1 exon 2; Set C
cagggacgggcaggggcagcagcaggagaaggaugc

SEQ ID NO: 16204 - RNA, 33 nt, Artificial Sequence
  Synthetic Oligonucleotide; PRF1 exon 2; Set C
agggacgggcaggggcagcagcaggagaaggau

SEQ ID NO: 16205 - RNA, 35 nt, Artificial Sequence
  Synthetic Oligonucleotide; PRF1 exon 2; Set C
cagggacgggcaggggcagcagcaggagaaggaug

SEQ ID NO: 16206 - RNA, 34 nt, Artificial Sequence
  Synthetic Oligonucleotide; PRF1 exon 2; Set C
cagggacgggcaggggcagcagcaggagaaggau

SEQ ID NO: 16207 - RNA, 21 nt, Artificial Sequence
  Synthetic Oligonucleotide; PRF1 exon 2; Set C
acgggcaggggcagcagcagg

SEQ ID NO: 16208 - RNA, 26 nt, Artificial Sequence
  Synthetic Oligonucleotide; PRF1 exon 2; Set C
cagggacgggcaggggcagcagcagg

SEQ ID NO: 16209 - RNA, 40 nt, Artificial Sequence
  Synthetic Oligonucleotide; PRF1 exon 2; Set C
guguggcacggggcagggacgggcaggggcagcagcagga

SEQ ID NO: 16210 - RNA, 21 nt, Artificial Sequence
  Synthetic Oligonucleotide; PRF1 exon 2; Set C
guguggcacggggcagggacg

SEQ ID NO: 16211 - RNA, 22 nt, Artificial Sequence
  Synthetic Oligonucleotide; PRF1 exon 2; Set C
uguguggcacggggcagggacg

SEQ ID NO: 16212 - RNA, 33 nt, Artificial Sequence
  Synthetic Oligonucleotide; PRF1 exon 2; Set C
gagcgugcggcuguguggcacggggcagggacg

SEQ ID NO: 16213 - RNA, 34 nt, Artificial Sequence
  Synthetic Oligonucleotide; PRF1 exon 2; Set C
ugagcgugcggcuguguggcacggggcagggacg

SEQ ID NO: 16214 - RNA, 35 nt, Artificial Sequence
  Synthetic Oligonucleotide; PRF1 exon 2; Set C
cugagcgugcggcuguguggcacggggcagggacg

SEQ ID NO: 16215 - RNA, 36 nt, Artificial Sequence
  Synthetic Oligonucleotide; PRF1 exon 2; Set C
ucugagcgugcggcuguguggcacggggcagggacg

SEQ ID NO: 16216 - RNA, 17 nt, Artificial Sequence
  Synthetic Oligonucleotide; PRF1 exon 2; Set A
ugagcgugcggcugugu

SEQ ID NO: 16217 - RNA, 18 nt, Artificial Sequence
  Synthetic Oligonucleotide; PRF1 exon 2; Set A
cugagcgugcggcugugu

SEQ ID NO: 16218 - RNA, 19 nt, Artificial Sequence
  Synthetic Oligonucleotide; PRF1 exon 2; Set A
ucugagcgugcggcugugu

SEQ ID NO: 16219 - RNA, 37 nt, Artificial Sequence
  Synthetic Oligonucleotide; PRF1 exon 2; Set C
cuuguggcugcgcuugcacucugagcgugcggcugug

SEQ ID NO: 16220 - RNA, 36 nt, Artificial Sequence
  Synthetic Oligonucleotide; PRF1 exon 2; Set C
cuuguggcugcgcuugcacucugagcgugcggcugu

SEQ ID NO: 16221 - RNA, 37 nt, Artificial Sequence
  Synthetic Oligonucleotide; PRF1 exon 2; Set C
acuuguggcugcgcuugcacucugagcgugcggcugu

SEQ ID NO: 16222 - RNA, 25 nt, Artificial Sequence
  Synthetic Oligonucleotide; PRF1 exon 2; Set C
cuuguggcugcgcuugcacucugag

SEQ ID NO: 16223 - RNA, 24 nt, Artificial Sequence
  Synthetic Oligonucleotide; PRF1 exon 2; Set C
cuuguggcugcgcuugcacucuga

SEQ ID NO: 16224 - RNA, 23 nt, Artificial Sequence
  Synthetic Oligonucleotide; PRF1 exon 2; Set C
cuuguggcugcgcuugcacucug

SEQ ID NO: 16225 - RNA, 22 nt, Artificial Sequence
  Synthetic Oligonucleotide; PRF1 exon 2; Set C
cuuguggcugcgcuugcacucu

SEQ ID NO: 16226 - RNA, 24 nt, Artificial Sequence
  Synthetic Oligonucleotide; PRF1 exon 2; Set C
acuuguggcugcgcuugcacucug

SEQ ID NO: 16227 - RNA, 30 nt, Artificial Sequence
  Synthetic Oligonucleotide; PRF1 exon 2; Set C
cgaacuuguggcugcgcuugcacucugagc

SEQ ID NO: 16228 - RNA, 23 nt, Artificial Sequence
  Synthetic Oligonucleotide; PRF1 exon 2; Set C
acuuguggcugcgcuugcacucu

SEQ ID NO: 16229 - RNA, 25 nt, Artificial Sequence
  Synthetic Oligonucleotide; PRF1 exon 2; Set C
aacuuguggcugcgcuugcacucug

SEQ ID NO: 16230 - RNA, 24 nt, Artificial Sequence
  Synthetic Oligonucleotide; PRF1 exon 2; Set C
aacuuguggcugcgcuugcacucu

SEQ ID NO: 16231 - RNA, 25 nt, Artificial Sequence
  Synthetic Oligonucleotide; PRF1 exon 2; Set C
gaacuuguggcugcgcuugcacucu

SEQ ID NO: 16232 - RNA, 27 nt, Artificial Sequence
  Synthetic Oligonucleotide; PRF1 exon 2; Set C
aggagcccgagcggcggaggcugguca

SEQ ID NO: 16233 - RNA, 26 nt, Artificial Sequence
  Synthetic Oligonucleotide; PRF1 exon 2; Set C
aggagcccgagcggcggaggcugguc

SEQ ID NO: 16234 - RNA, 28 nt, Artificial Sequence
  Synthetic Oligonucleotide; PRF1 exon 2; Set C
aaggagcccgagcggcggaggcugguca

SEQ ID NO: 16235 - RNA, 25 nt, Artificial Sequence
  Synthetic Oligonucleotide; PRF1 exon 2; Set C
aggagcccgagcggcggaggcuggu

SEQ ID NO: 16236 - RNA, 27 nt, Artificial Sequence
  Synthetic Oligonucleotide; PRF1 exon 2; Set C
aaggagcccgagcggcggaggcugguc

SEQ ID NO: 16237 - RNA, 29 nt, Artificial Sequence
  Synthetic Oligonucleotide; PRF1 exon 2; Set C
gaaggagcccgagcggcggaggcugguca

SEQ ID NO: 16238 - RNA, 24 nt, Artificial Sequence
  Synthetic Oligonucleotide; PRF1 exon 2; Set C
aggagcccgagcggcggaggcugg

SEQ ID NO: 16239 - RNA, 26 nt, Artificial Sequence
  Synthetic Oligonucleotide; PRF1 exon 2; Set C
aaggagcccgagcggcggaggcuggu

SEQ ID NO: 16240 - RNA, 28 nt, Artificial Sequence
  Synthetic Oligonucleotide; PRF1 exon 2; Set C
gaaggagcccgagcggcggaggcugguc

SEQ ID NO: 16241 - RNA, 30 nt, Artificial Sequence
  Synthetic Oligonucleotide; PRF1 exon 2; Set C
ggaaggagcccgagcggcggaggcugguca

SEQ ID NO: 16242 - RNA, 25 nt, Artificial Sequence
  Synthetic Oligonucleotide; PRF1 exon 2; Set C
aaggagcccgagcggcggaggcugg

SEQ ID NO: 16243 - RNA, 27 nt, Artificial Sequence
  Synthetic Oligonucleotide; PRF1 exon 2; Set C
gaaggagcccgagcggcggaggcuggu

SEQ ID NO: 16244 - RNA, 29 nt, Artificial Sequence
  Synthetic Oligonucleotide; PRF1 exon 2; Set C
ggaaggagcccgagcggcggaggcugguc

SEQ ID NO: 16245 - RNA, 26 nt, Artificial Sequence
  Synthetic Oligonucleotide; PRF1 exon 2; Set C
gaaggagcccgagcggcggaggcugg

SEQ ID NO: 16246 - RNA, 28 nt, Artificial Sequence
  Synthetic Oligonucleotide; PRF1 exon 2; Set C
ggaaggagcccgagcggcggaggcuggu

SEQ ID NO: 16247 - RNA, 27 nt, Artificial Sequence
  Synthetic Oligonucleotide; PRF1 exon 2; Set C
ggaaggagcccgagcggcggaggcugg

SEQ ID NO: 16248 - RNA, 20 nt, Artificial Sequence
  Synthetic Oligonucleotide; PRF1 exon 2; Set C
aaggagcccgagcggcggag

SEQ ID NO: 16249 - RNA, 21 nt, Artificial Sequence
  Synthetic Oligonucleotide; PRF1 exon 2; Set C
gaaggagcccgagcggcggag

SEQ ID NO: 16250 - RNA, 20 nt, Artificial Sequence
  Synthetic Oligonucleotide; PRF1 exon 2; Set C
gaaggagcccgagcggcgga

SEQ ID NO: 16251 - RNA, 22 nt, Artificial Sequence
  Synthetic Oligonucleotide; PRF1 exon 2; Set C
ggaaggagcccgagcggcggag

SEQ ID NO: 16252 - RNA, 21 nt, Artificial Sequence
  Synthetic Oligonucleotide; PRF1 exon 2; Set C
ggaaggagcccgagcggcgga

SEQ ID NO: 16253 - RNA, 33 nt, Artificial Sequence
  Synthetic Oligonucleotide; PRF1 exon 2; Set C
uguguccacugggaaggagcccgagcggcggag

SEQ ID NO: 16254 - RNA, 32 nt, Artificial Sequence
  Synthetic Oligonucleotide; PRF1 exon 2; Set C
uguguccacugggaaggagcccgagcggcgga

SEQ ID NO: 16255 - RNA, 34 nt, Artificial Sequence
  Synthetic Oligonucleotide; PRF1 exon 2; Set C
guguguccacugggaaggagcccgagcggcggag

SEQ ID NO: 16256 - RNA, 33 nt, Artificial Sequence
  Synthetic Oligonucleotide; PRF1 exon 2; Set C
guguguccacugggaaggagcccgagcggcgga

SEQ ID NO: 16257 - RNA, 35 nt, Artificial Sequence
  Synthetic Oligonucleotide; PRF1 exon 2; Set C
uguguguccacugggaaggagcccgagcggcggag

SEQ ID NO: 16258 - RNA, 34 nt, Artificial Sequence
  Synthetic Oligonucleotide; PRF1 exon 2; Set C
uguguguccacugggaaggagcccgagcggcgga

SEQ ID NO: 16259 - RNA, 35 nt, Artificial Sequence
  Synthetic Oligonucleotide; PRF1 exon 2; Set C
uuguguguccacugggaaggagcccgagcggcgga

SEQ ID NO: 16260 - RNA, 16 nt, Artificial Sequence
  Synthetic Oligonucleotide; PRF1 exon 2; Set C
guguccacugggaagg

SEQ ID NO: 16261 - RNA, 15 nt, Artificial Sequence
  Synthetic Oligonucleotide; PRF1 exon 2; Set C
guguccacugggaag

SEQ ID NO: 16262 - RNA, 15 nt, Artificial Sequence
  Synthetic Oligonucleotide; PRF1 exon 2; Set C
uguguguccacuggg

SEQ ID NO: 16263 - RNA, 16 nt, Artificial Sequence
  Synthetic Oligonucleotide; PRF1 exon 2; Set C
uuguguguccacuggg

SEQ ID NO: 16264 - RNA, 15 nt, Artificial Sequence
  Synthetic Oligonucleotide; PRF1 exon 2; Set C
uuguguguccacugg

SEQ ID NO: 16265 - RNA, 17 nt, Artificial Sequence
  Synthetic Oligonucleotide; PRF1 exon 2; Set C
uuuguguguccacuggg

SEQ ID NO: 16266 - RNA, 16 nt, Artificial Sequence
  Synthetic Oligonucleotide; PRF1 exon 2; Set C
uuuguguguccacugg

SEQ ID NO: 16267 - RNA, 18 nt, Artificial Sequence
  Synthetic Oligonucleotide; PRF1 exon 2; Set C
cuuuguguguccacuggg

SEQ ID NO: 16268 - RNA, 17 nt, Artificial Sequence
  Synthetic Oligonucleotide; PRF1 exon 2; Set C
cuuuguguguccacugg

SEQ ID NO: 16269 - RNA, 30 nt, Artificial Sequence
  Synthetic Oligonucleotide; PRF1 exon 2; Set C
ggugccgucgggccgcaggaaccuuugugu

SEQ ID NO: 16270 - RNA, 31 nt, Artificial Sequence
  Synthetic Oligonucleotide; PRF1 exon 2; Set C
aggugccgucgggccgcaggaaccuuugugu

SEQ ID NO: 16271 - RNA, 29 nt, Artificial Sequence
  Synthetic Oligonucleotide; PRF1 exon 2; Set C
ggugccgucgggccgcaggaaccuuugug

SEQ ID NO: 16272 - RNA, 28 nt, Artificial Sequence
  Synthetic Oligonucleotide; PRF1 exon 2; Set C
ggugccgucgggccgcaggaaccuuugu

SEQ ID NO: 16273 - RNA, 32 nt, Artificial Sequence
  Synthetic Oligonucleotide; PRF1 exon 2; Set C
caggugccgucgggccgcaggaaccuuugugu

SEQ ID NO: 16274 - RNA, 30 nt, Artificial Sequence
  Synthetic Oligonucleotide; PRF1 exon 2; Set C
aggugccgucgggccgcaggaaccuuugug

SEQ ID NO: 16275 - RNA, 29 nt, Artificial Sequence
  Synthetic Oligonucleotide; PRF1 exon 2; Set C
aggugccgucgggccgcaggaaccuuugu

SEQ ID NO: 16276 - RNA, 27 nt, Artificial Sequence
  Synthetic Oligonucleotide; PRF1 exon 2; Set C
ggugccgucgggccgcaggaaccuuug

SEQ ID NO: 16277 - RNA, 31 nt, Artificial Sequence
  Synthetic Oligonucleotide; PRF1 exon 2; Set C
caggugccgucgggccgcaggaaccuuugug

SEQ ID NO: 16278 - RNA, 30 nt, Artificial Sequence
  Synthetic Oligonucleotide; PRF1 exon 2; Set C
caggugccgucgggccgcaggaaccuuugu

SEQ ID NO: 16279 - RNA, 28 nt, Artificial Sequence
  Synthetic Oligonucleotide; PRF1 exon 2; Set C
aggugccgucgggccgcaggaaccuuug

SEQ ID NO: 16280 - RNA, 29 nt, Artificial Sequence
  Synthetic Oligonucleotide; PRF1 exon 2; Set C
caggugccgucgggccgcaggaaccuuug

SEQ ID NO: 16281 - RNA, 27 nt, Artificial Sequence
  Synthetic Oligonucleotide; PRF1 exon 2; Set C
aggugccgucgggccgcaggaaccuuu

SEQ ID NO: 16282 - RNA, 28 nt, Artificial Sequence
  Synthetic Oligonucleotide; PRF1 exon 2; Set C
caggugccgucgggccgcaggaaccuuu

SEQ ID NO: 16283 - RNA, 27 nt, Artificial Sequence
  Synthetic Oligonucleotide; PRF1 exon 2; Set C
caggugccgucgggccgcaggaaccuu

SEQ ID NO: 16284 - RNA, 38 nt, Artificial Sequence
  Synthetic Oligonucleotide; PRF1 exon 2; Set C
agggugcaggugccgucgggccgcaggaaccuuugugu

SEQ ID NO: 16285 - RNA, 39 nt, Artificial Sequence
  Synthetic Oligonucleotide; PRF1 exon 2; Set C
gagggugcaggugccgucgggccgcaggaaccuuugugu

SEQ ID NO: 16286 - RNA, 40 nt, Artificial Sequence
  Synthetic Oligonucleotide; PRF1 exon 2; Set C
agagggugcaggugccgucgggccgcaggaaccuuugugu

SEQ ID NO: 16287 - RNA, 38 nt, Artificial Sequence
  Synthetic Oligonucleotide; PRF1 exon 2; Set C
gagggugcaggugccgucgggccgcaggaaccuuugug

SEQ ID NO: 16288 - RNA, 39 nt, Artificial Sequence
  Synthetic Oligonucleotide; PRF1 exon 2; Set C
agagggugcaggugccgucgggccgcaggaaccuuugug

SEQ ID NO: 16289 - RNA, 38 nt, Artificial Sequence
  Synthetic Oligonucleotide; PRF1 exon 2; Set C
agagggugcaggugccgucgggccgcaggaaccuuugu

SEQ ID NO: 16290 - RNA, 40 nt, Artificial Sequence
  Synthetic Oligonucleotide; PRF1 exon 2; Set C
cagagggugcaggugccgucgggccgcaggaaccuuugug

SEQ ID NO: 16291 - RNA, 37 nt, Artificial Sequence
  Synthetic Oligonucleotide; PRF1 exon 2; Set C
agagggugcaggugccgucgggccgcaggaaccuuug

SEQ ID NO: 16292 - RNA, 39 nt, Artificial Sequence
  Synthetic Oligonucleotide; PRF1 exon 2; Set C
cagagggugcaggugccgucgggccgcaggaaccuuugu

SEQ ID NO: 16293 - RNA, 40 nt, Artificial Sequence
  Synthetic Oligonucleotide; PRF1 exon 2; Set C
acagagggugcaggugccgucgggccgcaggaaccuuugu

SEQ ID NO: 16294 - RNA, 38 nt, Artificial Sequence
  Synthetic Oligonucleotide; PRF1 exon 2; Set C
cagagggugcaggugccgucgggccgcaggaaccuuug

SEQ ID NO: 16295 - RNA, 36 nt, Artificial Sequence
  Synthetic Oligonucleotide; PRF1 exon 2; Set C
agagggugcaggugccgucgggccgcaggaaccuuu

SEQ ID NO: 16296 - RNA, 39 nt, Artificial Sequence
  Synthetic Oligonucleotide; PRF1 exon 2; Set C
acagagggugcaggugccgucgggccgcaggaaccuuug

SEQ ID NO: 16297 - RNA, 37 nt, Artificial Sequence
  Synthetic Oligonucleotide; PRF1 exon 2; Set C
cagagggugcaggugccgucgggccgcaggaaccuuu

SEQ ID NO: 16298 - RNA, 35 nt, Artificial Sequence
  Synthetic Oligonucleotide; PRF1 exon 2; Set C
agagggugcaggugccgucgggccgcaggaaccuu

SEQ ID NO: 16299 - RNA, 40 nt, Artificial Sequence
  Synthetic Oligonucleotide; PRF1 exon 2; Set C
cacagagggugcaggugccgucgggccgcaggaaccuuug

SEQ ID NO: 16300 - RNA, 38 nt, Artificial Sequence
  Synthetic Oligonucleotide; PRF1 exon 2; Set C
acagagggugcaggugccgucgggccgcaggaaccuuu

SEQ ID NO: 16301 - RNA, 36 nt, Artificial Sequence
  Synthetic Oligonucleotide; PRF1 exon 2; Set C
cagagggugcaggugccgucgggccgcaggaaccuu

SEQ ID NO: 16302 - RNA, 39 nt, Artificial Sequence
  Synthetic Oligonucleotide; PRF1 exon 2; Set C
cacagagggugcaggugccgucgggccgcaggaaccuuu

SEQ ID NO: 16303 - RNA, 37 nt, Artificial Sequence
  Synthetic Oligonucleotide; PRF1 exon 2; Set C
acagagggugcaggugccgucgggccgcaggaaccuu

SEQ ID NO: 16304 - RNA, 38 nt, Artificial Sequence
  Synthetic Oligonucleotide; PRF1 exon 2; Set C
cacagagggugcaggugccgucgggccgcaggaaccuu

SEQ ID NO: 16305 - RNA, 15 nt, Artificial Sequence
  Synthetic Oligonucleotide; PRF1 exon 2; Set C
cauuuucacagaggg

SEQ ID NO: 16306 - RNA, 16 nt, Artificial Sequence
  Synthetic Oligonucleotide; PRF1 exon 2; Set C
gcauuuucacagaggg

SEQ ID NO: 16307 - RNA, 20 nt, Artificial Sequence
  Synthetic Oligonucleotide; PRF1 exon 2; Set C
uagggcauuuucacagaggg

SEQ ID NO: 16308 - RNA, 39 nt, Artificial Sequence
  Synthetic Oligonucleotide; PRF1 exon 2; Set C
ggugcccuccuguagggcauuuucacagagggugcaggu

SEQ ID NO: 16309 - RNA, 40 nt, Artificial Sequence
  Synthetic Oligonucleotide; PRF1 exon 2; Set C
gggugcccuccuguagggcauuuucacagagggugcaggu

SEQ ID NO: 16310 - RNA, 38 nt, Artificial Sequence
  Synthetic Oligonucleotide; PRF1 exon 2; Set C
ggugcccuccuguagggcauuuucacagagggugcagg

SEQ ID NO: 16311 - RNA, 39 nt, Artificial Sequence
  Synthetic Oligonucleotide; PRF1 exon 2; Set C
gggugcccuccuguagggcauuuucacagagggugcagg

SEQ ID NO: 16312 - RNA, 37 nt, Artificial Sequence
  Synthetic Oligonucleotide; PRF1 exon 2; Set C
ggugcccuccuguagggcauuuucacagagggugcag

SEQ ID NO: 16313 - RNA, 38 nt, Artificial Sequence
  Synthetic Oligonucleotide; PRF1 exon 2; Set C
gggugcccuccuguagggcauuuucacagagggugcag

SEQ ID NO: 16314 - RNA, 30 nt, Artificial Sequence
  Synthetic Oligonucleotide; PRF1 exon 2; Set C
ugcccuccuguagggcauuuucacagaggg

SEQ ID NO: 16315 - RNA, 31 nt, Artificial Sequence
  Synthetic Oligonucleotide; PRF1 exon 2; Set C
gugcccuccuguagggcauuuucacagaggg

SEQ ID NO: 16316 - RNA, 25 nt, Artificial Sequence
  Synthetic Oligonucleotide; PRF1 exon 2; Set C
ggugcccuccuguagggcauuuuca

SEQ ID NO: 16317 - RNA, 24 nt, Artificial Sequence
  Synthetic Oligonucleotide; PRF1 exon 2; Set C
ggugcccuccuguagggcauuuuc

SEQ ID NO: 16318 - RNA, 26 nt, Artificial Sequence
  Synthetic Oligonucleotide; PRF1 exon 2; Set C
gggugcccuccuguagggcauuuuca

SEQ ID NO: 16319 - RNA, 23 nt, Artificial Sequence
  Synthetic Oligonucleotide; PRF1 exon 2; Set C
ggugcccuccuguagggcauuuu

SEQ ID NO: 16320 - RNA, 25 nt, Artificial Sequence
  Synthetic Oligonucleotide; PRF1 exon 2; Set C
gggugcccuccuguagggcauuuuc

SEQ ID NO: 16321 - RNA, 24 nt, Artificial Sequence
  Synthetic Oligonucleotide; PRF1 exon 2; Set C
gggugcccuccuguagggcauuuu

SEQ ID NO: 16322 - RNA, 18 nt, Artificial Sequence
  Synthetic Oligonucleotide; PRF1 exon 2; Set A
ugcccuccuguagggcau

SEQ ID NO: 16323 - RNA, 23 nt, Artificial Sequence
  Synthetic Oligonucleotide; PRF1 exon 2; Set C
gggugcccuccuguagggcauuu

SEQ ID NO: 16324 - RNA, 19 nt, Artificial Sequence
  Synthetic Oligonucleotide; PRF1 exon 2; Set A
gugcccuccuguagggcau

SEQ ID NO: 16325 - RNA, 17 nt, Artificial Sequence
  Synthetic Oligonucleotide; PRF1 exon 2; Set A
ugcccuccuguagggca

SEQ ID NO: 16326 - RNA, 18 nt, Artificial Sequence
  Synthetic Oligonucleotide; PRF1 exon 2; Set A
gugcccuccuguagggca

SEQ ID NO: 16327 - RNA, 17 nt, Artificial Sequence
  Synthetic Oligonucleotide; PRF1 exon 2; Set A
gugcccuccuguagggc

SEQ ID NO: 16328 - RNA, 16 nt, Artificial Sequence
  Synthetic Oligonucleotide; PRF1 exon 2; Set A
gugcccuccuguaggg

SEQ ID NO: 16329 - RNA, 40 nt, Artificial Sequence
  Synthetic Oligonucleotide; PRF1 exon 2; Set C
gcaggcgcuggagggugcccuccuguagggcauuuucaca

SEQ ID NO: 16330 - RNA, 39 nt, Artificial Sequence
  Synthetic Oligonucleotide; PRF1 exon 2; Set C
gcaggcgcuggagggugcccuccuguagggcauuuucac

SEQ ID NO: 16331 - RNA, 27 nt, Artificial Sequence
  Synthetic Oligonucleotide; PRF1 exon 2; Set C
gcuggagggugcccuccuguagggcau

SEQ ID NO: 16332 - RNA, 38 nt, Artificial Sequence
  Synthetic Oligonucleotide; PRF1 exon 2; Set C
gcaggcgcuggagggugcccuccuguagggcauuuuca

SEQ ID NO: 16333 - RNA, 40 nt, Artificial Sequence
  Synthetic Oligonucleotide; PRF1 exon 2; Set C
ggcaggcgcuggagggugcccuccuguagggcauuuucac

SEQ ID NO: 16334 - RNA, 26 nt, Artificial Sequence
  Synthetic Oligonucleotide; PRF1 exon 2; Set C
gcuggagggugcccuccuguagggca

SEQ ID NO: 16335 - RNA, 37 nt, Artificial Sequence
  Synthetic Oligonucleotide; PRF1 exon 2; Set C
gcaggcgcuggagggugcccuccuguagggcauuuuc

SEQ ID NO: 16336 - RNA, 39 nt, Artificial Sequence
  Synthetic Oligonucleotide; PRF1 exon 2; Set C
ggcaggcgcuggagggugcccuccuguagggcauuuuca

SEQ ID NO: 16337 - RNA, 36 nt, Artificial Sequence
  Synthetic Oligonucleotide; PRF1 exon 2; Set C
gcaggcgcuggagggugcccuccuguagggcauuuu

SEQ ID NO: 16338 - RNA, 38 nt, Artificial Sequence
  Synthetic Oligonucleotide; PRF1 exon 2; Set C
ggcaggcgcuggagggugcccuccuguagggcauuuuc

SEQ ID NO: 16339 - RNA, 35 nt, Artificial Sequence
  Synthetic Oligonucleotide; PRF1 exon 2; Set C
gcaggcgcuggagggugcccuccuguagggcauuu

SEQ ID NO: 16340 - RNA, 37 nt, Artificial Sequence
  Synthetic Oligonucleotide; PRF1 exon 2; Set C
ggcaggcgcuggagggugcccuccuguagggcauuuu

SEQ ID NO: 16341 - RNA, 36 nt, Artificial Sequence
  Synthetic Oligonucleotide; PRF1 exon 2; Set C
ggcaggcgcuggagggugcccuccuguagggcauuu

SEQ ID NO: 16342 - RNA, 38 nt, Artificial Sequence
  Synthetic Oligonucleotide; PRF1 exon 2; Set C
aggcaggcgcuggagggugcccuccuguagggcauuuu

SEQ ID NO: 16343 - RNA, 34 nt, Artificial Sequence
  Synthetic Oligonucleotide; PRF1 exon 2; Set C
gcaggcgcuggagggugcccuccuguagggcauu

SEQ ID NO: 16344 - RNA, 22 nt, Artificial Sequence
  Synthetic Oligonucleotide; PRF1 exon 2; Set C
gcuggagggugcccuccuguag

SEQ ID NO: 16345 - RNA, 37 nt, Artificial Sequence
  Synthetic Oligonucleotide; PRF1 exon 2; Set C
aggcaggcgcuggagggugcccuccuguagggcauuu

SEQ ID NO: 16346 - RNA, 35 nt, Artificial Sequence
  Synthetic Oligonucleotide; PRF1 exon 2; Set C
ggcaggcgcuggagggugcccuccuguagggcauu

SEQ ID NO: 16347 - RNA, 36 nt, Artificial Sequence
  Synthetic Oligonucleotide; PRF1 exon 2; Set C
aggcaggcgcuggagggugcccuccuguagggcauu

SEQ ID NO: 16348 - RNA, 37 nt, Artificial Sequence
  Synthetic Oligonucleotide; PRF1 exon 2; Set C
gaggcaggcgcuggagggugcccuccuguagggcauu

SEQ ID NO: 16349 - RNA, 38 nt, Artificial Sequence
  Synthetic Oligonucleotide; PRF1 exon 2; Set C
agaggcaggcgcuggagggugcccuccuguagggcauu

SEQ ID NO: 16350 - RNA, 26 nt, Artificial Sequence
  Synthetic Oligonucleotide; PRF1 exon 2; Set C
gcaggcgcuggagggugcccuccugu

SEQ ID NO: 16351 - RNA, 28 nt, Artificial Sequence
  Synthetic Oligonucleotide; PRF1 exon 2; Set C
ggcaggcgcuggagggugcccuccugua

SEQ ID NO: 16352 - RNA, 27 nt, Artificial Sequence
  Synthetic Oligonucleotide; PRF1 exon 2; Set C
ggcaggcgcuggagggugcccuccugu

SEQ ID NO: 16353 - RNA, 29 nt, Artificial Sequence
  Synthetic Oligonucleotide; PRF1 exon 2; Set C
aggcaggcgcuggagggugcccuccugua

SEQ ID NO: 16354 - RNA, 28 nt, Artificial Sequence
  Synthetic Oligonucleotide; PRF1 exon 2; Set C
aggcaggcgcuggagggugcccuccugu

SEQ ID NO: 16355 - RNA, 30 nt, Artificial Sequence
  Synthetic Oligonucleotide; PRF1 exon 2; Set C
gaggcaggcgcuggagggugcccuccugua

SEQ ID NO: 16356 - RNA, 29 nt, Artificial Sequence
  Synthetic Oligonucleotide; PRF1 exon 2; Set C
gaggcaggcgcuggagggugcccuccugu

SEQ ID NO: 16357 - RNA, 31 nt, Artificial Sequence
  Synthetic Oligonucleotide; PRF1 exon 2; Set C
agaggcaggcgcuggagggugcccuccugua

SEQ ID NO: 16358 - RNA, 30 nt, Artificial Sequence
  Synthetic Oligonucleotide; PRF1 exon 2; Set C
agaggcaggcgcuggagggugcccuccugu

SEQ ID NO: 16359 - RNA, 18 nt, Artificial Sequence
  Synthetic Oligonucleotide; PRF1 exon 2; Set C
gcaggcgcuggagggugc

SEQ ID NO: 16360 - RNA, 36 nt, Artificial Sequence
  Synthetic Oligonucleotide; PRF1 exon 2; Set C
gcgccagaggcaggcgcuggagggugcccuccugua

SEQ ID NO: 16361 - RNA, 38 nt, Artificial Sequence
  Synthetic Oligonucleotide; PRF1 exon 2; Set C
agcgccagaggcaggcgcuggagggugcccuccuguag

SEQ ID NO: 16362 - RNA, 35 nt, Artificial Sequence
  Synthetic Oligonucleotide; PRF1 exon 2; Set C
gcgccagaggcaggcgcuggagggugcccuccugu

SEQ ID NO: 16363 - RNA, 17 nt, Artificial Sequence
  Synthetic Oligonucleotide; PRF1 exon 2; Set A
gcaggcgcuggagggug

SEQ ID NO: 16364 - RNA, 19 nt, Artificial Sequence
  Synthetic Oligonucleotide; PRF1 exon 2; Set C
ggcaggcgcuggagggugc

SEQ ID NO: 16365 - RNA, 37 nt, Artificial Sequence
  Synthetic Oligonucleotide; PRF1 exon 2; Set C
agcgccagaggcaggcgcuggagggugcccuccugua

SEQ ID NO: 16366 - RNA, 39 nt, Artificial Sequence
  Synthetic Oligonucleotide; PRF1 exon 2; Set C
gagcgccagaggcaggcgcuggagggugcccuccuguag

SEQ ID NO: 16367 - RNA, 36 nt, Artificial Sequence
  Synthetic Oligonucleotide; PRF1 exon 2; Set C
agcgccagaggcaggcgcuggagggugcccuccugu

SEQ ID NO: 16368 - RNA, 18 nt, Artificial Sequence
  Synthetic Oligonucleotide; PRF1 exon 2; Set C
ggcaggcgcuggagggug

SEQ ID NO: 16369 - RNA, 20 nt, Artificial Sequence
  Synthetic Oligonucleotide; PRF1 exon 2; Set C
aggcaggcgcuggagggugc

SEQ ID NO: 16370 - RNA, 38 nt, Artificial Sequence
  Synthetic Oligonucleotide; PRF1 exon 2; Set C
gagcgccagaggcaggcgcuggagggugcccuccugua

SEQ ID NO: 16371 - RNA, 40 nt, Artificial Sequence
  Synthetic Oligonucleotide; PRF1 exon 2; Set C
ugagcgccagaggcaggcgcuggagggugcccuccuguag

SEQ ID NO: 16372 - RNA, 37 nt, Artificial Sequence
  Synthetic Oligonucleotide; PRF1 exon 2; Set C
gagcgccagaggcaggcgcuggagggugcccuccugu

SEQ ID NO: 16373 - RNA, 19 nt, Artificial Sequence
  Synthetic Oligonucleotide; PRF1 exon 2; Set C
aggcaggcgcuggagggug

SEQ ID NO: 16374 - RNA, 20 nt, Artificial Sequence
  Synthetic Oligonucleotide; PRF1 exon 2; Set C
gaggcaggcgcuggagggug

SEQ ID NO: 16375 - RNA, 21 nt, Artificial Sequence
  Synthetic Oligonucleotide; PRF1 exon 2; Set C
agaggcaggcgcuggagggug

SEQ ID NO: 16376 - RNA, 34 nt, Artificial Sequence
  Synthetic Oligonucleotide; PRF1 exon 2; Set C
uuggugagcgccagaggcaggcgcuggagggugc

SEQ ID NO: 16377 - RNA, 33 nt, Artificial Sequence
  Synthetic Oligonucleotide; PRF1 exon 2; Set C
uuggugagcgccagaggcaggcgcuggagggug

SEQ ID NO: 16378 - RNA, 18 nt, Artificial Sequence
  Synthetic Oligonucleotide; PRF1 exon 2; Set C
gcgccagaggcaggcgcu

SEQ ID NO: 16379 - RNA, 19 nt, Artificial Sequence
  Synthetic Oligonucleotide; PRF1 exon 2; Set C
agcgccagaggcaggcgcu

SEQ ID NO: 16380 - RNA, 25 nt, Artificial Sequence
  Synthetic Oligonucleotide; PRF1 exon 2; Set C
uuggugagcgccagaggcaggcgcu

SEQ ID NO: 16381 - RNA, 19 nt, Artificial Sequence
  Synthetic Oligonucleotide; PRF1 exon 2; Set A
uuggugagcgccagaggca

SEQ ID NO: 16382 - RNA, 18 nt, Artificial Sequence
  Synthetic Oligonucleotide; PRF1 exon 2; Set A
uuggugagcgccagaggc

SEQ ID NO: 16383 - RNA, 17 nt, Artificial Sequence
  Synthetic Oligonucleotide; PRF1 exon 2; Set A
uuggugagcgccagagg

SEQ ID NO: 16384 - RNA, 16 nt, Artificial Sequence
  Synthetic Oligonucleotide; PRF1 exon 2; Set C
uuggugagcgccagag

SEQ ID NO: 16385 - RNA, 15 nt, Artificial Sequence
  Synthetic Oligonucleotide; PRF1 exon 2; Set C
uuggugagcgccaga

SEQ ID NO: 16386 - RNA, 37 nt, Artificial Sequence
  Synthetic Oligonucleotide; PRF1 exon 2; Set C
ugggcccgccaguuggugagcgccagaggcaggcgcu

SEQ ID NO: 16387 - RNA, 22 nt, Artificial Sequence
  Synthetic Oligonucleotide; PRF1 exon 2; Set C
ugggcccgccaguuggugagcg

SEQ ID NO: 16388 - RNA, 21 nt, Artificial Sequence
  Synthetic Oligonucleotide; PRF1 exon 2; Set C
ugggcccgccaguuggugagc

SEQ ID NO: 16389 - RNA, 20 nt, Artificial Sequence
  Synthetic Oligonucleotide; PRF1 exon 2; Set A
acuuuggcccugguuacaug

SEQ ID NO: 16390 - RNA, 32 nt, Artificial Sequence
  Synthetic Oligonucleotide; PRF1 exon 2; Set C
ucaguggagcugacuuuggcccugguuacaug

SEQ ID NO: 16391 - RNA, 24 nt, Artificial Sequence
  Synthetic Oligonucleotide; PRF1 exon 2; Set C
uggcugccugugagugugagccgg

SEQ ID NO: 16392 - RNA, 33 nt, Artificial Sequence
  Synthetic Oligonucleotide; PRF1 exon 2; Set C
ucuucugggcugcaaaguuggcugccugugagu

SEQ ID NO: 16393 - RNA, 15 nt, Artificial Sequence
  Synthetic Oligonucleotide; PRF1 exon 2; Set C
ugggcugcaaaguug

SEQ ID NO: 16394 - RNA, 16 nt, Artificial Sequence
  Synthetic Oligonucleotide; PRF1 exon 2; Set C
cugggcugcaaaguug

SEQ ID NO: 16395 - RNA, 15 nt, Artificial Sequence
  Synthetic Oligonucleotide; PRF1 exon 2; Set C
cugggcugcaaaguu

SEQ ID NO: 16396 - RNA, 22 nt, Artificial Sequence
  Synthetic Oligonucleotide; PRF1 exon 2; Set B
gucuucugggcugcaaaguugg

SEQ ID NO: 16397 - RNA, 23 nt, Artificial Sequence
  Synthetic Oligonucleotide; PRF1 exon 2; Set B
ggucuucugggcugcaaaguugg

SEQ ID NO: 16398 - RNA, 24 nt, Artificial Sequence
  Synthetic Oligonucleotide; PRF1 exon 2; Set B
gggucuucugggcugcaaaguugg

SEQ ID NO: 16399 - RNA, 25 nt, Artificial Sequence
  Synthetic Oligonucleotide; PRF1 exon 2; Set B
ugggucuucugggcugcaaaguugg

SEQ ID NO: 16400 - RNA, 26 nt, Artificial Sequence
  Synthetic Oligonucleotide; PRF1 exon 2; Set C
gugggucuucugggcugcaaaguugg

SEQ ID NO: 16401 - RNA, 27 nt, Artificial Sequence
  Synthetic Oligonucleotide; PRF1 exon 2; Set C
ggugggucuucugggcugcaaaguugg

SEQ ID NO: 16402 - RNA, 15 nt, Artificial Sequence
  Synthetic Oligonucleotide; PRF1 exon 2; Set C
ucuucugggcugcaa

SEQ ID NO: 16403 - RNA, 18 nt, Artificial Sequence
  Synthetic Oligonucleotide; PRF1 exon 2; Set C
ggucuucugggcugcaaa

SEQ ID NO: 16404 - RNA, 27 nt, Artificial Sequence
  Synthetic Oligonucleotide; PRF1 exon 2; Set C
uggugggucuucugggcugcaaaguug

SEQ ID NO: 16405 - RNA, 19 nt, Artificial Sequence
  Synthetic Oligonucleotide; PRF1 exon 2; Set B
gggucuucugggcugcaaa

SEQ ID NO: 16406 - RNA, 26 nt, Artificial Sequence
  Synthetic Oligonucleotide; PRF1 exon 2; Set C
uggugggucuucugggcugcaaaguu

SEQ ID NO: 16407 - RNA, 28 nt, Artificial Sequence
  Synthetic Oligonucleotide; PRF1 exon 2; Set C
cuggugggucuucugggcugcaaaguug

SEQ ID NO: 16408 - RNA, 30 nt, Artificial Sequence
  Synthetic Oligonucleotide; PRF1 exon 2; Set C
ccuggugggucuucugggcugcaaaguugg

SEQ ID NO: 16409 - RNA, 27 nt, Artificial Sequence
  Synthetic Oligonucleotide; PRF1 exon 2; Set C
cuggugggucuucugggcugcaaaguu

SEQ ID NO: 16410 - RNA, 25 nt, Artificial Sequence
  Synthetic Oligonucleotide; PRF1 exon 2; Set C
uggugggucuucugggcugcaaagu

SEQ ID NO: 16411 - RNA, 31 nt, Artificial Sequence
  Synthetic Oligonucleotide; PRF1 exon 2; Set C
uccuggugggucuucugggcugcaaaguugg

SEQ ID NO: 16412 - RNA, 24 nt, Artificial Sequence
  Synthetic Oligonucleotide; PRF1 exon 2; Set B
uggugggucuucugggcugcaaag

SEQ ID NO: 16413 - RNA, 31 nt, Artificial Sequence
  Synthetic Oligonucleotide; PRF1 exon 2; Set C
guccuggugggucuucugggcugcaaaguug

SEQ ID NO: 16414 - RNA, 23 nt, Artificial Sequence
  Synthetic Oligonucleotide; PRF1 exon 2; Set B
uggugggucuucugggcugcaaa

SEQ ID NO: 16415 - RNA, 30 nt, Artificial Sequence
  Synthetic Oligonucleotide; PRF1 exon 2; Set C
guccuggugggucuucugggcugcaaaguu

SEQ ID NO: 16416 - RNA, 32 nt, Artificial Sequence
  Synthetic Oligonucleotide; PRF1 exon 2; Set C
gguccuggugggucuucugggcugcaaaguug

SEQ ID NO: 16417 - RNA, 26 nt, Artificial Sequence
  Synthetic Oligonucleotide; PRF1 exon 2; Set C
ccuggugggucuucugggcugcaaag

SEQ ID NO: 16418 - RNA, 34 nt, Artificial Sequence
  Synthetic Oligonucleotide; PRF1 exon 2; Set C
ugguccuggugggucuucugggcugcaaaguugg

SEQ ID NO: 16419 - RNA, 31 nt, Artificial Sequence
  Synthetic Oligonucleotide; PRF1 exon 2; Set C
gguccuggugggucuucugggcugcaaaguu

SEQ ID NO: 16420 - RNA, 29 nt, Artificial Sequence
  Synthetic Oligonucleotide; PRF1 exon 2; Set C
guccuggugggucuucugggcugcaaagu

SEQ ID NO: 16421 - RNA, 27 nt, Artificial Sequence
  Synthetic Oligonucleotide; PRF1 exon 2; Set C
uccuggugggucuucugggcugcaaag

SEQ ID NO: 16422 - RNA, 25 nt, Artificial Sequence
  Synthetic Oligonucleotide; PRF1 exon 2; Set C
ccuggugggucuucugggcugcaaa

SEQ ID NO: 16423 - RNA, 35 nt, Artificial Sequence
  Synthetic Oligonucleotide; PRF1 exon 2; Set C
cugguccuggugggucuucugggcugcaaaguugg

SEQ ID NO: 16424 - RNA, 30 nt, Artificial Sequence
  Synthetic Oligonucleotide; PRF1 exon 2; Set C
gguccuggugggucuucugggcugcaaagu

SEQ ID NO: 16425 - RNA, 26 nt, Artificial Sequence
  Synthetic Oligonucleotide; PRF1 exon 2; Set C
uccuggugggucuucugggcugcaaa

SEQ ID NO: 16426 - RNA, 28 nt, Artificial Sequence
  Synthetic Oligonucleotide; PRF1 exon 2; Set C
guccuggugggucuucugggcugcaaag

SEQ ID NO: 16427 - RNA, 27 nt, Artificial Sequence
  Synthetic Oligonucleotide; PRF1 exon 2; Set C
guccuggugggucuucugggcugcaaa

SEQ ID NO: 16428 - RNA, 30 nt, Artificial Sequence
  Synthetic Oligonucleotide; PRF1 exon 2; Set C
ugguccuggugggucuucugggcugcaaag

SEQ ID NO: 16429 - RNA, 29 nt, Artificial Sequence
  Synthetic Oligonucleotide; PRF1 exon 2; Set C
ugguccuggugggucuucugggcugcaaa

SEQ ID NO: 16430 - RNA, 33 nt, Artificial Sequence
  Synthetic Oligonucleotide; PRF1 exon 2; Set C
uguacugguccuggugggucuucugggcugcaa

SEQ ID NO: 16431 - RNA, 17 nt, Artificial Sequence
  Synthetic Oligonucleotide; PRF1 exon 2; Set C
guccuggugggucuucu

SEQ ID NO: 16432 - RNA, 16 nt, Artificial Sequence
  Synthetic Oligonucleotide; PRF1 exon 2; Set C
guccuggugggucuuc

SEQ ID NO: 16433 - RNA, 18 nt, Artificial Sequence
  Synthetic Oligonucleotide; PRF1 exon 2; Set B
gguccuggugggucuucu

SEQ ID NO: 16434 - RNA, 17 nt, Artificial Sequence
  Synthetic Oligonucleotide; PRF1 exon 2; Set B
gguccuggugggucuuc

SEQ ID NO: 16435 - RNA, 15 nt, Artificial Sequence
  Synthetic Oligonucleotide; PRF1 exon 2; Set C
guccuggugggucuu

SEQ ID NO: 16436 - RNA, 23 nt, Artificial Sequence
  Synthetic Oligonucleotide; PRF1 exon 2; Set C
acugguccuggugggucuucugg

SEQ ID NO: 16437 - RNA, 38 nt, Artificial Sequence
  Synthetic Oligonucleotide; PRF1 exon 2; Set C
gaagcuguacugguccuggugggucuucugggcugcaa

SEQ ID NO: 16438 - RNA, 24 nt, Artificial Sequence
  Synthetic Oligonucleotide; PRF1 exon 2; Set C
uacugguccuggugggucuucugg

SEQ ID NO: 16439 - RNA, 17 nt, Artificial Sequence
  Synthetic Oligonucleotide; PRF1 exon 2; Set B
ugguccuggugggucuu

SEQ ID NO: 16440 - RNA, 39 nt, Artificial Sequence
  Synthetic Oligonucleotide; PRF1 exon 2; Set C
ugaagcuguacugguccuggugggucuucugggcugcaa

SEQ ID NO: 16441 - RNA, 25 nt, Artificial Sequence
  Synthetic Oligonucleotide; PRF1 exon 2; Set C
guacugguccuggugggucuucugg

SEQ ID NO: 16442 - RNA, 16 nt, Artificial Sequence
  Synthetic Oligonucleotide; PRF1 exon 2; Set B
ugguccuggugggucu

SEQ ID NO: 16443 - RNA, 26 nt, Artificial Sequence
  Synthetic Oligonucleotide; PRF1 exon 2; Set C
uguacugguccuggugggucuucugg

SEQ ID NO: 16444 - RNA, 15 nt, Artificial Sequence
  Synthetic Oligonucleotide; PRF1 exon 2; Set C
ugguccugguggguc

SEQ ID NO: 16445 - RNA, 25 nt, Artificial Sequence
  Synthetic Oligonucleotide; PRF1 exon 2; Set C
uguacugguccuggugggucuucug

SEQ ID NO: 16446 - RNA, 16 nt, Artificial Sequence
  Synthetic Oligonucleotide; PRF1 exon 2; Set C
cugguccugguggguc

SEQ ID NO: 16447 - RNA, 15 nt, Artificial Sequence
  Synthetic Oligonucleotide; PRF1 exon 2; Set C
cugguccuggugggu

SEQ ID NO: 16448 - RNA, 30 nt, Artificial Sequence
  Synthetic Oligonucleotide; PRF1 exon 2; Set C
gaagcuguacugguccuggugggucuucug

SEQ ID NO: 16449 - RNA, 31 nt, Artificial Sequence
  Synthetic Oligonucleotide; PRF1 exon 2; Set C
ugaagcuguacugguccuggugggucuucug

SEQ ID NO: 16450 - RNA, 25 nt, Artificial Sequence
  Synthetic Oligonucleotide; PRF1 exon 2; Set C
gaagcuguacugguccugguggguc

SEQ ID NO: 16451 - RNA, 26 nt, Artificial Sequence
  Synthetic Oligonucleotide; PRF1 exon 2; Set C
ugaagcuguacugguccugguggguc

SEQ ID NO: 16452 - RNA, 24 nt, Artificial Sequence
  Synthetic Oligonucleotide; PRF1 exon 2; Set C
gaagcuguacugguccuggugggu

SEQ ID NO: 16453 - RNA, 25 nt, Artificial Sequence
  Synthetic Oligonucleotide; PRF1 exon 2; Set C
ugaagcuguacugguccuggugggu

SEQ ID NO: 16454 - RNA, 23 nt, Artificial Sequence
  Synthetic Oligonucleotide; PRF1 exon 2; Set B
gaagcuguacugguccugguggg

SEQ ID NO: 16455 - RNA, 24 nt, Artificial Sequence
  Synthetic Oligonucleotide; PRF1 exon 2; Set B
ugaagcuguacugguccugguggg

SEQ ID NO: 16456 - RNA, 22 nt, Artificial Sequence
  Synthetic Oligonucleotide; PRF1 exon 2; Set B
gaagcuguacugguccuggugg

SEQ ID NO: 16457 - RNA, 21 nt, Artificial Sequence
  Synthetic Oligonucleotide; PRF1 exon 2; Set B
gaagcuguacugguccuggug

SEQ ID NO: 16458 - RNA, 23 nt, Artificial Sequence
  Synthetic Oligonucleotide; PRF1 exon 2; Set B
ugaagcuguacugguccuggugg

SEQ ID NO: 16459 - RNA, 20 nt, Artificial Sequence
  Synthetic Oligonucleotide; PRF1 exon 2; Set B
gaagcuguacugguccuggu

SEQ ID NO: 16460 - RNA, 22 nt, Artificial Sequence
  Synthetic Oligonucleotide; PRF1 exon 2; Set B
ugaagcuguacugguccuggug

SEQ ID NO: 16461 - RNA, 21 nt, Artificial Sequence
  Synthetic Oligonucleotide; PRF1 exon 2; Set B
ugaagcuguacugguccuggu

SEQ ID NO: 16462 - RNA, 19 nt, Artificial Sequence
  Synthetic Oligonucleotide; PRF1 exon 2; Set B
gaagcuguacugguccugg

SEQ ID NO: 16463 - RNA, 36 nt, Artificial Sequence
  Synthetic Oligonucleotide; PRF1 exon 2; Set C
gucagugcugaagcuguacugguccuggugggucuu

SEQ ID NO: 16464 - RNA, 35 nt, Artificial Sequence
  Synthetic Oligonucleotide; PRF1 exon 2; Set C
gucagugcugaagcuguacugguccuggugggucu

SEQ ID NO: 16465 - RNA, 17 nt, Artificial Sequence
  Synthetic Oligonucleotide; PRF1 exon 2; Set C
gaagcuguacugguccu

SEQ ID NO: 16466 - RNA, 34 nt, Artificial Sequence
  Synthetic Oligonucleotide; PRF1 exon 2; Set C
gucagugcugaagcuguacugguccugguggguc

SEQ ID NO: 16467 - RNA, 16 nt, Artificial Sequence
  Synthetic Oligonucleotide; PRF1 exon 2; Set C
gaagcuguacuggucc

SEQ ID NO: 16468 - RNA, 18 nt, Artificial Sequence
  Synthetic Oligonucleotide; PRF1 exon 2; Set C
ugaagcuguacugguccu

SEQ ID NO: 16469 - RNA, 35 nt, Artificial Sequence
  Synthetic Oligonucleotide; PRF1 exon 2; Set C
ugucagugcugaagcuguacugguccugguggguc

SEQ ID NO: 16470 - RNA, 17 nt, Artificial Sequence
  Synthetic Oligonucleotide; PRF1 exon 2; Set C
ugaagcuguacuggucc

SEQ ID NO: 16471 - RNA, 36 nt, Artificial Sequence
  Synthetic Oligonucleotide; PRF1 exon 2; Set C
gugucagugcugaagcuguacugguccugguggguc

SEQ ID NO: 16472 - RNA, 34 nt, Artificial Sequence
  Synthetic Oligonucleotide; PRF1 exon 2; Set C
ugucagugcugaagcuguacugguccuggugggu

SEQ ID NO: 16473 - RNA, 37 nt, Artificial Sequence
  Synthetic Oligonucleotide; PRF1 exon 2; Set C
cgugucagugcugaagcuguacugguccugguggguc

SEQ ID NO: 16474 - RNA, 35 nt, Artificial Sequence
  Synthetic Oligonucleotide; PRF1 exon 2; Set C
gugucagugcugaagcuguacugguccuggugggu

SEQ ID NO: 16475 - RNA, 33 nt, Artificial Sequence
  Synthetic Oligonucleotide; PRF1 exon 2; Set C
ugucagugcugaagcuguacugguccugguggg

SEQ ID NO: 16476 - RNA, 36 nt, Artificial Sequence
  Synthetic Oligonucleotide; PRF1 exon 2; Set C
cgugucagugcugaagcuguacugguccuggugggu

SEQ ID NO: 16477 - RNA, 34 nt, Artificial Sequence
  Synthetic Oligonucleotide; PRF1 exon 2; Set C
gugucagugcugaagcuguacugguccugguggg

SEQ ID NO: 16478 - RNA, 31 nt, Artificial Sequence
  Synthetic Oligonucleotide; PRF1 exon 2; Set C
ugucagugcugaagcuguacugguccuggug

SEQ ID NO: 16479 - RNA, 35 nt, Artificial Sequence
  Synthetic Oligonucleotide; PRF1 exon 2; Set C
cgugucagugcugaagcuguacugguccugguggg

SEQ ID NO: 16480 - RNA, 33 nt, Artificial Sequence
  Synthetic Oligonucleotide; PRF1 exon 2; Set C
gugucagugcugaagcuguacugguccuggugg

SEQ ID NO: 16481 - RNA, 30 nt, Artificial Sequence
  Synthetic Oligonucleotide; PRF1 exon 2; Set C
ugucagugcugaagcuguacugguccuggu

SEQ ID NO: 16482 - RNA, 32 nt, Artificial Sequence
  Synthetic Oligonucleotide; PRF1 exon 2; Set C
gugucagugcugaagcuguacugguccuggug

SEQ ID NO: 16483 - RNA, 34 nt, Artificial Sequence
  Synthetic Oligonucleotide; PRF1 exon 2; Set C
cgugucagugcugaagcuguacugguccuggugg

SEQ ID NO: 16484 - RNA, 31 nt, Artificial Sequence
  Synthetic Oligonucleotide; PRF1 exon 2; Set C
gugucagugcugaagcuguacugguccuggu

SEQ ID NO: 16485 - RNA, 33 nt, Artificial Sequence
  Synthetic Oligonucleotide; PRF1 exon 2; Set C
cgugucagugcugaagcuguacugguccuggug

SEQ ID NO: 16486 - RNA, 32 nt, Artificial Sequence
  Synthetic Oligonucleotide; PRF1 exon 2; Set C
cgugucagugcugaagcuguacugguccuggu

SEQ ID NO: 16487 - RNA, 29 nt, Artificial Sequence
  Synthetic Oligonucleotide; PRF1 exon 2; Set C
cgugucagugcugaagcuguacugguccu

SEQ ID NO: 16488 - RNA, 28 nt, Artificial Sequence
  Synthetic Oligonucleotide; PRF1 exon 2; Set C
cgugucagugcugaagcuguacuggucc

SEQ ID NO: 16489 - RNA, 20 nt, Artificial Sequence
  Synthetic Oligonucleotide; PRF1 exon 2; Set B
gucagugcugaagcuguacu

SEQ ID NO: 16490 - RNA, 21 nt, Artificial Sequence
  Synthetic Oligonucleotide; PRF1 exon 2; Set B
ugucagugcugaagcuguacu

SEQ ID NO: 16491 - RNA, 19 nt, Artificial Sequence
  Synthetic Oligonucleotide; PRF1 exon 2; Set C
gucagugcugaagcuguac

SEQ ID NO: 16492 - RNA, 23 nt, Artificial Sequence
  Synthetic Oligonucleotide; PRF1 exon 2; Set B
gugucagugcugaagcuguacug

SEQ ID NO: 16493 - RNA, 25 nt, Artificial Sequence
  Synthetic Oligonucleotide; PRF1 exon 2; Set B
cgugucagugcugaagcuguacugg

SEQ ID NO: 16494 - RNA, 18 nt, Artificial Sequence
  Synthetic Oligonucleotide; PRF1 exon 2; Set C
gucagugcugaagcugua

SEQ ID NO: 16495 - RNA, 20 nt, Artificial Sequence
  Synthetic Oligonucleotide; PRF1 exon 2; Set C
ugucagugcugaagcuguac

SEQ ID NO: 16496 - RNA, 24 nt, Artificial Sequence
  Synthetic Oligonucleotide; PRF1 exon 2; Set B
cgugucagugcugaagcuguacug

SEQ ID NO: 16497 - RNA, 19 nt, Artificial Sequence
  Synthetic Oligonucleotide; PRF1 exon 2; Set C
ugucagugcugaagcugua

SEQ ID NO: 16498 - RNA, 17 nt, Artificial Sequence
  Synthetic Oligonucleotide; PRF1 exon 2; Set C
gucagugcugaagcugu

SEQ ID NO: 16499 - RNA, 18 nt, Artificial Sequence
  Synthetic Oligonucleotide; PRF1 exon 2; Set C
ugucagugcugaagcugu

SEQ ID NO: 16500 - RNA, 19 nt, Artificial Sequence
  Synthetic Oligonucleotide; PRF1 exon 2; Set C
gugucagugcugaagcugu

SEQ ID NO: 16501 - RNA, 38 nt, Artificial Sequence
  Synthetic Oligonucleotide; PRF1 exon 2; Set C
gcacuccaccgugucagugcugaagcuguacugguccu

SEQ ID NO: 16502 - RNA, 39 nt, Artificial Sequence
  Synthetic Oligonucleotide; PRF1 exon 2; Set C
ggcacuccaccgugucagugcugaagcuguacugguccu

SEQ ID NO: 16503 - RNA, 37 nt, Artificial Sequence
  Synthetic Oligonucleotide; PRF1 exon 2; Set C
gcacuccaccgugucagugcugaagcuguacuggucc

SEQ ID NO: 16504 - RNA, 38 nt, Artificial Sequence
  Synthetic Oligonucleotide; PRF1 exon 2; Set C
ggcacuccaccgugucagugcugaagcuguacuggucc

SEQ ID NO: 16505 - RNA, 40 nt, Artificial Sequence
  Synthetic Oligonucleotide; PRF1 exon 2; Set C
cggcacuccaccgugucagugcugaagcuguacugguccu

SEQ ID NO: 16506 - RNA, 39 nt, Artificial Sequence
  Synthetic Oligonucleotide; PRF1 exon 2; Set C
cggcacuccaccgugucagugcugaagcuguacuggucc

SEQ ID NO: 16507 - RNA, 40 nt, Artificial Sequence
  Synthetic Oligonucleotide; PRF1 exon 2; Set C
gcggcacuccaccgugucagugcugaagcuguacuggucc

SEQ ID NO: 16508 - RNA, 15 nt, Artificial Sequence
  Synthetic Oligonucleotide; PRF1 exon 2; Set C
cgugucagugcugaa

SEQ ID NO: 16509 - RNA, 33 nt, Artificial Sequence
  Synthetic Oligonucleotide; PRF1 exon 2; Set C
gcacuccaccgugucagugcugaagcuguacug

SEQ ID NO: 16510 - RNA, 34 nt, Artificial Sequence
  Synthetic Oligonucleotide; PRF1 exon 2; Set C
ggcacuccaccgugucagugcugaagcuguacug

SEQ ID NO: 16511 - RNA, 35 nt, Artificial Sequence
  Synthetic Oligonucleotide; PRF1 exon 2; Set C
cggcacuccaccgugucagugcugaagcuguacug

SEQ ID NO: 16512 - RNA, 37 nt, Artificial Sequence
  Synthetic Oligonucleotide; PRF1 exon 2; Set C
gcggcacuccaccgugucagugcugaagcuguacugg

SEQ ID NO: 16513 - RNA, 36 nt, Artificial Sequence
  Synthetic Oligonucleotide; PRF1 exon 2; Set C
gcggcacuccaccgugucagugcugaagcuguacug

SEQ ID NO: 16514 - RNA, 29 nt, Artificial Sequence
  Synthetic Oligonucleotide; PRF1 exon 2; Set C
gcacuccaccgugucagugcugaagcugu

SEQ ID NO: 16515 - RNA, 30 nt, Artificial Sequence
  Synthetic Oligonucleotide; PRF1 exon 2; Set C
ggcacuccaccgugucagugcugaagcugu

SEQ ID NO: 16516 - RNA, 31 nt, Artificial Sequence
  Synthetic Oligonucleotide; PRF1 exon 2; Set C
cggcacuccaccgugucagugcugaagcugu

SEQ ID NO: 16517 - RNA, 39 nt, Artificial Sequence
  Synthetic Oligonucleotide; PRF1 exon 2; Set C
agaagcggcacuccaccgugucagugcugaagcuguacu

SEQ ID NO: 16518 - RNA, 40 nt, Artificial Sequence
  Synthetic Oligonucleotide; PRF1 exon 2; Set C
uagaagcggcacuccaccgugucagugcugaagcuguacu

SEQ ID NO: 16519 - RNA, 38 nt, Artificial Sequence
  Synthetic Oligonucleotide; PRF1 exon 2; Set C
agaagcggcacuccaccgugucagugcugaagcuguac

SEQ ID NO: 16520 - RNA, 24 nt, Artificial Sequence
  Synthetic Oligonucleotide; PRF1 exon 2; Set C
gcacuccaccgugucagugcugaa

SEQ ID NO: 16521 - RNA, 37 nt, Artificial Sequence
  Synthetic Oligonucleotide; PRF1 exon 2; Set C
agaagcggcacuccaccgugucagugcugaagcugua

SEQ ID NO: 16522 - RNA, 39 nt, Artificial Sequence
  Synthetic Oligonucleotide; PRF1 exon 2; Set C
uagaagcggcacuccaccgugucagugcugaagcuguac

SEQ ID NO: 16523 - RNA, 25 nt, Artificial Sequence
  Synthetic Oligonucleotide; PRF1 exon 2; Set C
ggcacuccaccgugucagugcugaa

SEQ ID NO: 16524 - RNA, 23 nt, Artificial Sequence
  Synthetic Oligonucleotide; PRF1 exon 2; Set C
gcacuccaccgugucagugcuga

SEQ ID NO: 16525 - RNA, 38 nt, Artificial Sequence
  Synthetic Oligonucleotide; PRF1 exon 2; Set C
uagaagcggcacuccaccgugucagugcugaagcugua

SEQ ID NO: 16526 - RNA, 36 nt, Artificial Sequence
  Synthetic Oligonucleotide; PRF1 exon 2; Set C
agaagcggcacuccaccgugucagugcugaagcugu

SEQ ID NO: 16527 - RNA, 26 nt, Artificial Sequence
  Synthetic Oligonucleotide; PRF1 exon 2; Set C
cggcacuccaccgugucagugcugaa

SEQ ID NO: 16528 - RNA, 24 nt, Artificial Sequence
  Synthetic Oligonucleotide; PRF1 exon 2; Set C
ggcacuccaccgugucagugcuga

SEQ ID NO: 16529 - RNA, 37 nt, Artificial Sequence
  Synthetic Oligonucleotide; PRF1 exon 2; Set C
uagaagcggcacuccaccgugucagugcugaagcugu

SEQ ID NO: 16530 - RNA, 27 nt, Artificial Sequence
  Synthetic Oligonucleotide; PRF1 exon 2; Set C
gcggcacuccaccgugucagugcugaa

SEQ ID NO: 16531 - RNA, 25 nt, Artificial Sequence
  Synthetic Oligonucleotide; PRF1 exon 2; Set C
cggcacuccaccgugucagugcuga

SEQ ID NO: 16532 - RNA, 26 nt, Artificial Sequence
  Synthetic Oligonucleotide; PRF1 exon 2; Set C
gcggcacuccaccgugucagugcuga

SEQ ID NO: 16533 - RNA, 15 nt, Artificial Sequence
  Synthetic Oligonucleotide; PRF1 exon 2; Set C
gcacuccaccguguc

SEQ ID NO: 16534 - RNA, 16 nt, Artificial Sequence
  Synthetic Oligonucleotide; PRF1 exon 2; Set B
ggcacuccaccguguc

SEQ ID NO: 16535 - RNA, 15 nt, Artificial Sequence
  Synthetic Oligonucleotide; PRF1 exon 2; Set B
ggcacuccaccgugu

SEQ ID NO: 16536 - RNA, 22 nt, Artificial Sequence
  Synthetic Oligonucleotide; PRF1 exon 2; Set C
agaagcggcacuccaccguguc

SEQ ID NO: 16537 - RNA, 21 nt, Artificial Sequence
  Synthetic Oligonucleotide; PRF1 exon 2; Set C
agaagcggcacuccaccgugu

SEQ ID NO: 16538 - RNA, 23 nt, Artificial Sequence
  Synthetic Oligonucleotide; PRF1 exon 2; Set C
uagaagcggcacuccaccguguc

SEQ ID NO: 16539 - RNA, 20 nt, Artificial Sequence
  Synthetic Oligonucleotide; PRF1 exon 2; Set B
agaagcggcacuccaccgug

SEQ ID NO: 16540 - RNA, 22 nt, Artificial Sequence
  Synthetic Oligonucleotide; PRF1 exon 2; Set C
uagaagcggcacuccaccgugu

SEQ ID NO: 16541 - RNA, 19 nt, Artificial Sequence
  Synthetic Oligonucleotide; PRF1 exon 2; Set B
agaagcggcacuccaccgu

SEQ ID NO: 16542 - RNA, 21 nt, Artificial Sequence
  Synthetic Oligonucleotide; PRF1 exon 2; Set B
uagaagcggcacuccaccgug

SEQ ID NO: 16543 - RNA, 20 nt, Artificial Sequence
  Synthetic Oligonucleotide; PRF1 exon 2; Set B
uagaagcggcacuccaccgu

SEQ ID NO: 16544 - RNA, 31 nt, Artificial Sequence
  Synthetic Oligonucleotide; PRF1 exon 2; Set C
cuagccccagcucucaccuguagaagcggca

SEQ ID NO: 16545 - RNA, 30 nt, Artificial Sequence
  Synthetic Oligonucleotide; PRF1 exon 2; Set C
cuagccccagcucucaccuguagaagcggc

SEQ ID NO: 16546 - RNA, 29 nt, Artificial Sequence
  Synthetic Oligonucleotide; PRF1 exon 2; Set C
cuagccccagcucucaccuguagaagcgg

SEQ ID NO: 16547 - RNA, 16 nt, Artificial Sequence
  Synthetic Oligonucleotide; PRF1 exon 2; Set C
uuucccgcgccuuuuc

SEQ ID NO: 16548 - RNA, 17 nt, Artificial Sequence
  Synthetic Oligonucleotide; PRF1 exon 2; Set C
guuucccgcgccuuuuc

SEQ ID NO: 16549 - RNA, 18 nt, Artificial Sequence
  Synthetic Oligonucleotide; PRF1 exon 2; Set C
aguuucccgcgccuuuuc

SEQ ID NO: 16550 - RNA, 19 nt, Artificial Sequence
  Synthetic Oligonucleotide; PRF1 exon 2; Set B
gaguuucccgcgccuuuuc

SEQ ID NO: 16551 - RNA, 20 nt, Artificial Sequence
  Synthetic Oligonucleotide; PRF1 exon 2; Set B
agaguuucccgcgccuuuuc

SEQ ID NO: 16552 - RNA, 19 nt, Artificial Sequence
  Synthetic Oligonucleotide; PRF1 exon 2; Set B
agaguuucccgcgccuuuu

SEQ ID NO: 16553 - RNA, 18 nt, Artificial Sequence
  Synthetic Oligonucleotide; PRF1 exon 2; Set B
agaguuucccgcgccuuu

SEQ ID NO: 16554 - RNA, 20 nt, Artificial Sequence
  Synthetic Oligonucleotide; PRF1 exon 2; Set C
ugacugcucccuucccccac

SEQ ID NO: 16555 - RNA, 21 nt, Artificial Sequence
  Synthetic Oligonucleotide; PRF1 exon 2; Set C
augacugcucccuucccccac

SEQ ID NO: 16556 - RNA, 22 nt, Artificial Sequence
  Synthetic Oligonucleotide; PRF1 exon 2; Set C
gaugacugcucccuucccccac

SEQ ID NO: 16557 - RNA, 27 nt, Artificial Sequence
  Synthetic Oligonucleotide; PRF1 exon 2; Set C
uggaggaugacugcucccuucccccac

SEQ ID NO: 16558 - RNA, 15 nt, Artificial Sequence
  Synthetic Oligonucleotide; PRF1 exon 2; Set C
gaugacugcucccuu

SEQ ID NO: 16559 - RNA, 20 nt, Artificial Sequence
  Synthetic Oligonucleotide; PRF1 exon 2; Set A
uggaggaugacugcucccuu

SEQ ID NO: 16560 - RNA, 15 nt, Artificial Sequence
  Synthetic Oligonucleotide; PRF1 exon 2; Set C
agggauggaggauga

SEQ ID NO: 16561 - RNA, 27 nt, Artificial Sequence
  Synthetic Oligonucleotide; PRF1 exon 2; Set C
uggguggagggauggaggaugacugcu

SEQ ID NO: 16562 - RNA, 28 nt, Artificial Sequence
  Synthetic Oligonucleotide; PRF1 exon 2; Set C
auggguggagggauggaggaugacugcu

SEQ ID NO: 16563 - RNA, 27 nt, Artificial Sequence
  Synthetic Oligonucleotide; PRF1 exon 2; Set C
auggguggagggauggaggaugacugc

SEQ ID NO: 16564 - RNA, 27 nt, Artificial Sequence
  Synthetic Oligonucleotide; PRF1 exon 2; Set C
cauggguggagggauggaggaugacug

SEQ ID NO: 16565 - RNA, 22 nt, Artificial Sequence
  Synthetic Oligonucleotide; PRF1 exon 2; Set A
uggguggagggauggaggauga

SEQ ID NO: 16566 - RNA, 26 nt, Artificial Sequence
  Synthetic Oligonucleotide; PRF1 exon 2; Set C
cauggguggagggauggaggaugacu

SEQ ID NO: 16567 - RNA, 21 nt, Artificial Sequence
  Synthetic Oligonucleotide; PRF1 exon 2; Set A
uggguggagggauggaggaug

SEQ ID NO: 16568 - RNA, 23 nt, Artificial Sequence
  Synthetic Oligonucleotide; PRF1 exon 2; Set A
auggguggagggauggaggauga

SEQ ID NO: 16569 - RNA, 25 nt, Artificial Sequence
  Synthetic Oligonucleotide; PRF1 exon 2; Set C
cauggguggagggauggaggaugac

SEQ ID NO: 16570 - RNA, 22 nt, Artificial Sequence
  Synthetic Oligonucleotide; PRF1 exon 2; Set A
auggguggagggauggaggaug

SEQ ID NO: 16571 - RNA, 20 nt, Artificial Sequence
  Synthetic Oligonucleotide; PRF1 exon 2; Set A
uggguggagggauggaggau

SEQ ID NO: 16572 - RNA, 21 nt, Artificial Sequence
  Synthetic Oligonucleotide; PRF1 exon 2; Set A
auggguggagggauggaggau

SEQ ID NO: 16573 - RNA, 33 nt, Artificial Sequence
  Synthetic Oligonucleotide; PRF1 exon 2; Set C
ggaagccauggguggagggauggaggaugacug

SEQ ID NO: 16574 - RNA, 32 nt, Artificial Sequence
  Synthetic Oligonucleotide; PRF1 exon 2; Set C
ggaagccauggguggagggauggaggaugacu

SEQ ID NO: 16575 - RNA, 15 nt, Artificial Sequence
  Synthetic Oligonucleotide; PRF1 exon 2; Set C
uggguggagggaugg

SEQ ID NO: 16576 - RNA, 31 nt, Artificial Sequence
  Synthetic Oligonucleotide; PRF1 exon 2; Set C
ggaagccauggguggagggauggaggaugac

SEQ ID NO: 16577 - RNA, 35 nt, Artificial Sequence
  Synthetic Oligonucleotide; PRF1 exon 2; Set C
ugggaagccauggguggagggauggaggaugacug

SEQ ID NO: 16578 - RNA, 16 nt, Artificial Sequence
  Synthetic Oligonucleotide; PRF1 exon 2; Set C
auggguggagggaugg

SEQ ID NO: 16579 - RNA, 16 nt, Artificial Sequence
  Synthetic Oligonucleotide; PRF1 exon 2; Set C
cauggguggagggaug

SEQ ID NO: 16580 - RNA, 22 nt, Artificial Sequence
  Synthetic Oligonucleotide; PRF1 exon 2; Set A
ggaagccauggguggagggaug

SEQ ID NO: 16581 - RNA, 40 nt, Artificial Sequence
  Synthetic Oligonucleotide; PRF1 exon 2; Set C
ugggcucugggaagccauggguggagggauggaggaugac

SEQ ID NO: 16582 - RNA, 31 nt, Artificial Sequence
  Synthetic Oligonucleotide; PRF1 exon 2; Set C
ugggcucugggaagccauggguggagggaug

SEQ ID NO: 16583 - RNA, 39 nt, Artificial Sequence
  Synthetic Oligonucleotide; PRF1 exon 2; Set C
gggcacuugggcucugggaagccauggguggagggaugg

SEQ ID NO: 16584 - RNA, 39 nt, Artificial Sequence
  Synthetic Oligonucleotide; PRF1 exon 2; Set C
ggggcacuugggcucugggaagccauggguggagggaug

SEQ ID NO: 16585 - RNA, 19 nt, Artificial Sequence
  Synthetic Oligonucleotide; PRF1 exon 2; Set A
ugggcucugggaagccaug

SEQ ID NO: 16586 - RNA, 21 nt, Artificial Sequence
  Synthetic Oligonucleotide; PRF1 exon 2; Set A
uugggcucugggaagccaugg

SEQ ID NO: 16587 - RNA, 22 nt, Artificial Sequence
  Synthetic Oligonucleotide; PRF1 exon 2; Set A
cuugggcucugggaagccaugg

SEQ ID NO: 16588 - RNA, 23 nt, Artificial Sequence
  Synthetic Oligonucleotide; PRF1 exon 2; Set C
acuugggcucugggaagccaugg

SEQ ID NO: 16589 - RNA, 28 nt, Artificial Sequence
  Synthetic Oligonucleotide; PRF1 exon 2; Set C
ggggcacuugggcucugggaagccaugg

SEQ ID NO: 16590 - RNA, 25 nt, Artificial Sequence
  Synthetic Oligonucleotide; PRF1 exon 2; Set C
gggcacuugggcucugggaagccau

SEQ ID NO: 16591 - RNA, 27 nt, Artificial Sequence
  Synthetic Oligonucleotide; PRF1 exon 2; Set C
ggggcacuugggcucugggaagccaug

SEQ ID NO: 16592 - RNA, 29 nt, Artificial Sequence
  Synthetic Oligonucleotide; PRF1 exon 2; Set C
gggggcacuugggcucugggaagccaugg

SEQ ID NO: 16593 - RNA, 15 nt, Artificial Sequence
  Synthetic Oligonucleotide; PRF1 exon 2; Set C
cuugggcucugggaa

SEQ ID NO: 16594 - RNA, 28 nt, Artificial Sequence
  Synthetic Oligonucleotide; PRF1 exon 2; Set C
gggggcacuugggcucugggaagccaug

SEQ ID NO: 16595 - RNA, 30 nt, Artificial Sequence
  Synthetic Oligonucleotide; PRF1 exon 2; Set C
agggggcacuugggcucugggaagccaugg

SEQ ID NO: 16596 - RNA, 16 nt, Artificial Sequence
  Synthetic Oligonucleotide; PRF1 exon 2; Set C
acuugggcucugggaa

SEQ ID NO: 16597 - RNA, 29 nt, Artificial Sequence
  Synthetic Oligonucleotide; PRF1 exon 2; Set C
agggggcacuugggcucugggaagccaug

SEQ ID NO: 16598 - RNA, 31 nt, Artificial Sequence
  Synthetic Oligonucleotide; PRF1 exon 2; Set C
cagggggcacuugggcucugggaagccaugg

SEQ ID NO: 16599 - RNA, 16 nt, Artificial Sequence
  Synthetic Oligonucleotide; PRF1 exon 2; Set C
cacuugggcucuggga

SEQ ID NO: 16600 - RNA, 30 nt, Artificial Sequence
  Synthetic Oligonucleotide; PRF1 exon 2; Set C
cagggggcacuugggcucugggaagccaug

SEQ ID NO: 16601 - RNA, 35 nt, Artificial Sequence
  Synthetic Oligonucleotide; PRF1 exon 2; Set C
gagacagggggcacuugggcucugggaagccaugg

SEQ ID NO: 16602 - RNA, 18 nt, Artificial Sequence
  Synthetic Oligonucleotide; PRF1 exon 2; Set A
gggcacuugggcucuggg

SEQ ID NO: 16603 - RNA, 36 nt, Artificial Sequence
  Synthetic Oligonucleotide; PRF1 exon 2; Set C
agagacagggggcacuugggcucugggaagccaugg

SEQ ID NO: 16604 - RNA, 17 nt, Artificial Sequence
  Synthetic Oligonucleotide; PRF1 exon 2; Set A
gggcacuugggcucugg

SEQ ID NO: 16605 - RNA, 28 nt, Artificial Sequence
  Synthetic Oligonucleotide; PRF1 exon 2; Set C
gagacagggggcacuugggcucugggaa

SEQ ID NO: 16606 - RNA, 15 nt, Artificial Sequence
  Synthetic Oligonucleotide; PRF1 exon 2; Set A
gggggcacuugggcu

SEQ ID NO: 16607 - RNA, 29 nt, Artificial Sequence
  Synthetic Oligonucleotide; PRF1 exon 2; Set C
agagacagggggcacuugggcucugggaa

SEQ ID NO: 16608 - RNA, 16 nt, Artificial Sequence
  Synthetic Oligonucleotide; PRF1 exon 2; Set A
agggggcacuugggcu

SEQ ID NO: 16609 - RNA, 17 nt, Artificial Sequence
  Synthetic Oligonucleotide; PRF1 exon 2; Set A
cagggggcacuugggcu

SEQ ID NO: 16610 - RNA, 27 nt, Artificial Sequence
  Synthetic Oligonucleotide; PRF1 exon 2; Set C
cagagacagggggcacuugggcucugg

SEQ ID NO: 16611 - RNA, 21 nt, Artificial Sequence
  Synthetic Oligonucleotide; PRF1 exon 2; Set C
gagacagggggcacuugggcu

SEQ ID NO: 16612 - RNA, 22 nt, Artificial Sequence
  Synthetic Oligonucleotide; PRF1 exon 2; Set C
agagacagggggcacuugggcu

SEQ ID NO: 16613 - RNA, 36 nt, Artificial Sequence
  Synthetic Oligonucleotide; PRF1 exon 2; Set C
gagcugcagagacagggggcacuugggcucugggaa

SEQ ID NO: 16614 - RNA, 15 nt, Artificial Sequence
  Synthetic Oligonucleotide; PRF1 exon 2; Set C
gacagggggcacuug

SEQ ID NO: 16615 - RNA, 37 nt, Artificial Sequence
  Synthetic Oligonucleotide; PRF1 exon 2; Set C
ggagcugcagagacagggggcacuugggcucugggaa

SEQ ID NO: 16616 - RNA, 16 nt, Artificial Sequence
  Synthetic Oligonucleotide; PRF1 exon 2; Set C
agacagggggcacuug

SEQ ID NO: 16617 - RNA, 22 nt, Artificial Sequence
  Synthetic Oligonucleotide; PRF1 exon 2; Set C
cagagacagggggcacuugggc

SEQ ID NO: 16618 - RNA, 38 nt, Artificial Sequence
  Synthetic Oligonucleotide; PRF1 exon 2; Set C
uggagcugcagagacagggggcacuugggcucugggaa

SEQ ID NO: 16619 - RNA, 15 nt, Artificial Sequence
  Synthetic Oligonucleotide; PRF1 exon 2; Set C
agacagggggcacuu

SEQ ID NO: 16620 - RNA, 21 nt, Artificial Sequence
  Synthetic Oligonucleotide; PRF1 exon 2; Set C
cagagacagggggcacuuggg

SEQ ID NO: 16621 - RNA, 23 nt, Artificial Sequence
  Synthetic Oligonucleotide; PRF1 exon 2; Set C
gcagagacagggggcacuugggc

SEQ ID NO: 16622 - RNA, 39 nt, Artificial Sequence
  Synthetic Oligonucleotide; PRF1 exon 2; Set C
auggagcugcagagacagggggcacuugggcucugggaa

SEQ ID NO: 16623 - RNA, 29 nt, Artificial Sequence
  Synthetic Oligonucleotide; PRF1 exon 2; Set C
gagcugcagagacagggggcacuugggcu

SEQ ID NO: 16624 - RNA, 30 nt, Artificial Sequence
  Synthetic Oligonucleotide; PRF1 exon 2; Set C
ggagcugcagagacagggggcacuugggcu

SEQ ID NO: 16625 - RNA, 31 nt, Artificial Sequence
  Synthetic Oligonucleotide; PRF1 exon 2; Set C
uggagcugcagagacagggggcacuugggcu

SEQ ID NO: 16626 - RNA, 32 nt, Artificial Sequence
  Synthetic Oligonucleotide; PRF1 exon 2; Set C
auggagcugcagagacagggggcacuugggcu

SEQ ID NO: 16627 - RNA, 32 nt, Artificial Sequence
  Synthetic Oligonucleotide; PRF1 exon 2; Set C
cauggagcugcagagacagggggcacuugggc

SEQ ID NO: 16628 - RNA, 23 nt, Artificial Sequence
  Synthetic Oligonucleotide; PRF1 exon 2; Set C
ggagcugcagagacagggggcac

SEQ ID NO: 16629 - RNA, 30 nt, Artificial Sequence
  Synthetic Oligonucleotide; PRF1 exon 2; Set C
ccauggagcugcagagacagggggcacuug

SEQ ID NO: 16630 - RNA, 24 nt, Artificial Sequence
  Synthetic Oligonucleotide; PRF1 exon 2; Set C
uggagcugcagagacagggggcac

SEQ ID NO: 16631 - RNA, 19 nt, Artificial Sequence
  Synthetic Oligonucleotide; PRF1 exon 2; Set A
gagcugcagagacaggggg

SEQ ID NO: 16632 - RNA, 25 nt, Artificial Sequence
  Synthetic Oligonucleotide; PRF1 exon 2; Set C
auggagcugcagagacagggggcac

SEQ ID NO: 16633 - RNA, 35 nt, Artificial Sequence
  Synthetic Oligonucleotide; PRF1 exon 2; Set C
gcugccauggagcugcagagacagggggcacuugg

SEQ ID NO: 16634 - RNA, 39 nt, Artificial Sequence
  Synthetic Oligonucleotide; PRF1 exon 2; Set C
gggcugccauggagcugcagagacagggggcacuugggc

SEQ ID NO: 16635 - RNA, 38 nt, Artificial Sequence
  Synthetic Oligonucleotide; PRF1 exon 2; Set C
gggcugccauggagcugcagagacagggggcacuuggg

SEQ ID NO: 16636 - RNA, 35 nt, Artificial Sequence
  Synthetic Oligonucleotide; PRF1 exon 2; Set C
ggcugccauggagcugcagagacagggggcacuug

SEQ ID NO: 16637 - RNA, 33 nt, Artificial Sequence
  Synthetic Oligonucleotide; PRF1 exon 2; Set C
gcugccauggagcugcagagacagggggcacuu

SEQ ID NO: 16638 - RNA, 32 nt, Artificial Sequence
  Synthetic Oligonucleotide; PRF1 exon 2; Set C
gcugccauggagcugcagagacagggggcacu

SEQ ID NO: 16639 - RNA, 34 nt, Artificial Sequence
  Synthetic Oligonucleotide; PRF1 exon 2; Set C
ggcugccauggagcugcagagacagggggcacuu

SEQ ID NO: 16640 - RNA, 33 nt, Artificial Sequence
  Synthetic Oligonucleotide; PRF1 exon 2; Set C
ggcugccauggagcugcagagacagggggcacu

SEQ ID NO: 16641 - RNA, 16 nt, Artificial Sequence
  Synthetic Oligonucleotide; PRF1 exon 2; Set C
uggagcugcagagaca

SEQ ID NO: 16642 - RNA, 17 nt, Artificial Sequence
  Synthetic Oligonucleotide; PRF1 exon 2; Set C
auggagcugcagagaca

SEQ ID NO: 16643 - RNA, 15 nt, Artificial Sequence
  Synthetic Oligonucleotide; PRF1 exon 2; Set C
uggagcugcagagac

SEQ ID NO: 16644 - RNA, 16 nt, Artificial Sequence
  Synthetic Oligonucleotide; PRF1 exon 2; Set C
auggagcugcagagac

SEQ ID NO: 16645 - RNA, 27 nt, Artificial Sequence
  Synthetic Oligonucleotide; PRF1 exon 2; Set C
gcugccauggagcugcagagacagggg

SEQ ID NO: 16646 - RNA, 15 nt, Artificial Sequence
  Synthetic Oligonucleotide; PRF1 exon 2; Set C
auggagcugcagaga

SEQ ID NO: 16647 - RNA, 26 nt, Artificial Sequence
  Synthetic Oligonucleotide; PRF1 exon 2; Set C
gcugccauggagcugcagagacaggg

SEQ ID NO: 16648 - RNA, 28 nt, Artificial Sequence
  Synthetic Oligonucleotide; PRF1 exon 2; Set C
ggcugccauggagcugcagagacagggg

SEQ ID NO: 16649 - RNA, 27 nt, Artificial Sequence
  Synthetic Oligonucleotide; PRF1 exon 2; Set C
ggcugccauggagcugcagagacaggg

SEQ ID NO: 16650 - RNA, 25 nt, Artificial Sequence
  Synthetic Oligonucleotide; PRF1 exon 2; Set C
gcugccauggagcugcagagacagg

SEQ ID NO: 16651 - RNA, 40 nt, Artificial Sequence
  Synthetic Oligonucleotide; PRF1 exon 2; Set C
gcagacgggcugccauggagcugcagagacagggggcacu

SEQ ID NO: 16652 - RNA, 26 nt, Artificial Sequence
  Synthetic Oligonucleotide; PRF1 exon 2; Set C
ggcugccauggagcugcagagacagg

SEQ ID NO: 16653 - RNA, 24 nt, Artificial Sequence
  Synthetic Oligonucleotide; PRF1 exon 2; Set C
gcugccauggagcugcagagacag

SEQ ID NO: 16654 - RNA, 32 nt, Artificial Sequence
  Synthetic Oligonucleotide; PRF1 exon 2; Set C
acgggcugccauggagcugcagagacaggggg

SEQ ID NO: 16655 - RNA, 25 nt, Artificial Sequence
  Synthetic Oligonucleotide; PRF1 exon 2; Set C
ggcugccauggagcugcagagacag

SEQ ID NO: 16656 - RNA, 20 nt, Artificial Sequence
  Synthetic Oligonucleotide; PRF1 exon 2; Set A
gcugccauggagcugcagag

SEQ ID NO: 16657 - RNA, 21 nt, Artificial Sequence
  Synthetic Oligonucleotide; PRF1 exon 2; Set C
ggcugccauggagcugcagag

SEQ ID NO: 16658 - RNA, 19 nt, Artificial Sequence
  Synthetic Oligonucleotide; PRF1 exon 2; Set A
gcugccauggagcugcaga

SEQ ID NO: 16659 - RNA, 20 nt, Artificial Sequence
  Synthetic Oligonucleotide; PRF1 exon 2; Set C
ggcugccauggagcugcaga

SEQ ID NO: 16660 - RNA, 34 nt, Artificial Sequence
  Synthetic Oligonucleotide; PRF1 exon 2; Set C
gcagacgggcugccauggagcugcagagacaggg

SEQ ID NO: 16661 - RNA, 36 nt, Artificial Sequence
  Synthetic Oligonucleotide; PRF1 exon 2; Set C
agcagacgggcugccauggagcugcagagacagggg

SEQ ID NO: 16662 - RNA, 35 nt, Artificial Sequence
  Synthetic Oligonucleotide; PRF1 exon 2; Set C
agcagacgggcugccauggagcugcagagacaggg

SEQ ID NO: 16663 - RNA, 33 nt, Artificial Sequence
  Synthetic Oligonucleotide; PRF1 exon 2; Set C
gcagacgggcugccauggagcugcagagacagg

SEQ ID NO: 16664 - RNA, 34 nt, Artificial Sequence
  Synthetic Oligonucleotide; PRF1 exon 2; Set C
agcagacgggcugccauggagcugcagagacagg

SEQ ID NO: 16665 - RNA, 32 nt, Artificial Sequence
  Synthetic Oligonucleotide; PRF1 exon 2; Set C
gcagacgggcugccauggagcugcagagacag

SEQ ID NO: 16666 - RNA, 38 nt, Artificial Sequence
  Synthetic Oligonucleotide; PRF1 exon 2; Set C
ggagcagacgggcugccauggagcugcagagacagggg

SEQ ID NO: 16667 - RNA, 33 nt, Artificial Sequence
  Synthetic Oligonucleotide; PRF1 exon 2; Set C
agcagacgggcugccauggagcugcagagacag

SEQ ID NO: 16668 - RNA, 39 nt, Artificial Sequence
  Synthetic Oligonucleotide; PRF1 exon 2; Set C
aggagcagacgggcugccauggagcugcagagacagggg

SEQ ID NO: 16669 - RNA, 21 nt, Artificial Sequence
  Synthetic Oligonucleotide; PRF1 exon 2; Set C
cgggcugccauggagcugcag

SEQ ID NO: 16670 - RNA, 38 nt, Artificial Sequence
  Synthetic Oligonucleotide; PRF1 exon 2; Set C
aggagcagacgggcugccauggagcugcagagacaggg

SEQ ID NO: 16671 - RNA, 40 nt, Artificial Sequence
  Synthetic Oligonucleotide; PRF1 exon 2; Set C
gaggagcagacgggcugccauggagcugcagagacagggg

SEQ ID NO: 16672 - RNA, 18 nt, Artificial Sequence
  Synthetic Oligonucleotide; PRF1 exon 2; Set C
gggcugccauggagcugc

SEQ ID NO: 16673 - RNA, 20 nt, Artificial Sequence
  Synthetic Oligonucleotide; PRF1 exon 2; Set C
cgggcugccauggagcugca

SEQ ID NO: 16674 - RNA, 39 nt, Artificial Sequence
  Synthetic Oligonucleotide; PRF1 exon 2; Set C
gaggagcagacgggcugccauggagcugcagagacaggg

SEQ ID NO: 16675 - RNA, 37 nt, Artificial Sequence
  Synthetic Oligonucleotide; PRF1 exon 2; Set C
aggagcagacgggcugccauggagcugcagagacagg

SEQ ID NO: 16676 - RNA, 35 nt, Artificial Sequence
  Synthetic Oligonucleotide; PRF1 exon 2; Set C
ggagcagacgggcugccauggagcugcagagacag

SEQ ID NO: 16677 - RNA, 19 nt, Artificial Sequence
  Synthetic Oligonucleotide; PRF1 exon 2; Set C
cgggcugccauggagcugc

SEQ ID NO: 16678 - RNA, 28 nt, Artificial Sequence
  Synthetic Oligonucleotide; PRF1 exon 2; Set C
gcagacgggcugccauggagcugcagag

SEQ ID NO: 16679 - RNA, 38 nt, Artificial Sequence
  Synthetic Oligonucleotide; PRF1 exon 2; Set C
gaggagcagacgggcugccauggagcugcagagacagg

SEQ ID NO: 16680 - RNA, 36 nt, Artificial Sequence
  Synthetic Oligonucleotide; PRF1 exon 2; Set C
aggagcagacgggcugccauggagcugcagagacag

SEQ ID NO: 16681 - RNA, 29 nt, Artificial Sequence
  Synthetic Oligonucleotide; PRF1 exon 2; Set C
agcagacgggcugccauggagcugcagag

SEQ ID NO: 16682 - RNA, 27 nt, Artificial Sequence
  Synthetic Oligonucleotide; PRF1 exon 2; Set C
gcagacgggcugccauggagcugcaga

SEQ ID NO: 16683 - RNA, 37 nt, Artificial Sequence
  Synthetic Oligonucleotide; PRF1 exon 2; Set C
gaggagcagacgggcugccauggagcugcagagacag

SEQ ID NO: 16684 - RNA, 28 nt, Artificial Sequence
  Synthetic Oligonucleotide; PRF1 exon 2; Set C
agcagacgggcugccauggagcugcaga

SEQ ID NO: 16685 - RNA, 40 nt, Artificial Sequence
  Synthetic Oligonucleotide; PRF1 exon 2; Set C
aggaggagcagacgggcugccauggagcugcagagacagg

SEQ ID NO: 16686 - RNA, 39 nt, Artificial Sequence
  Synthetic Oligonucleotide; PRF1 exon 2; Set C
aggaggagcagacgggcugccauggagcugcagagacag

SEQ ID NO: 16687 - RNA, 32 nt, Artificial Sequence
  Synthetic Oligonucleotide; PRF1 exon 2; Set C
aggagcagacgggcugccauggagcugcagag

SEQ ID NO: 16688 - RNA, 33 nt, Artificial Sequence
  Synthetic Oligonucleotide; PRF1 exon 2; Set C
gaggagcagacgggcugccauggagcugcagag

SEQ ID NO: 16689 - RNA, 31 nt, Artificial Sequence
  Synthetic Oligonucleotide; PRF1 exon 2; Set C
aggagcagacgggcugccauggagcugcaga

SEQ ID NO: 16690 - RNA, 32 nt, Artificial Sequence
  Synthetic Oligonucleotide; PRF1 exon 2; Set C
gaggagcagacgggcugccauggagcugcaga

SEQ ID NO: 16691 - RNA, 35 nt, Artificial Sequence
  Synthetic Oligonucleotide; PRF1 exon 2; Set C
aggaggagcagacgggcugccauggagcugcagag

SEQ ID NO: 16692 - RNA, 20 nt, Artificial Sequence
  Synthetic Oligonucleotide; PRF1 exon 2; Set C
gcagacgggcugccauggag

SEQ ID NO: 16693 - RNA, 34 nt, Artificial Sequence
  Synthetic Oligonucleotide; PRF1 exon 2; Set C
aggaggagcagacgggcugccauggagcugcaga

SEQ ID NO: 16694 - RNA, 19 nt, Artificial Sequence
  Synthetic Oligonucleotide; PRF1 exon 2; Set C
gcagacgggcugccaugga

SEQ ID NO: 16695 - RNA, 21 nt, Artificial Sequence
  Synthetic Oligonucleotide; PRF1 exon 2; Set C
agcagacgggcugccauggag

SEQ ID NO: 16696 - RNA, 18 nt, Artificial Sequence
  Synthetic Oligonucleotide; PRF1 exon 2; Set A
gcagacgggcugccaugg

SEQ ID NO: 16697 - RNA, 20 nt, Artificial Sequence
  Synthetic Oligonucleotide; PRF1 exon 2; Set C
agcagacgggcugccaugga

SEQ ID NO: 16698 - RNA, 19 nt, Artificial Sequence
  Synthetic Oligonucleotide; PRF1 exon 2; Set A
agcagacgggcugccaugg

SEQ ID NO: 16699 - RNA, 17 nt, Artificial Sequence
  Synthetic Oligonucleotide; PRF1 exon 2; Set A
gcagacgggcugccaug

SEQ ID NO: 16700 - RNA, 18 nt, Artificial Sequence
  Synthetic Oligonucleotide; PRF1 exon 2; Set A
agcagacgggcugccaug

SEQ ID NO: 16701 - RNA, 24 nt, Artificial Sequence
  Synthetic Oligonucleotide; PRF1 exon 2; Set C
aggagcagacgggcugccauggag

SEQ ID NO: 16702 - RNA, 23 nt, Artificial Sequence
  Synthetic Oligonucleotide; PRF1 exon 2; Set C
aggagcagacgggcugccaugga

SEQ ID NO: 16703 - RNA, 25 nt, Artificial Sequence
  Synthetic Oligonucleotide; PRF1 exon 2; Set C
gaggagcagacgggcugccauggag

SEQ ID NO: 16704 - RNA, 22 nt, Artificial Sequence
  Synthetic Oligonucleotide; PRF1 exon 2; Set C
aggagcagacgggcugccaugg

SEQ ID NO: 16705 - RNA, 24 nt, Artificial Sequence
  Synthetic Oligonucleotide; PRF1 exon 2; Set C
gaggagcagacgggcugccaugga

SEQ ID NO: 16706 - RNA, 23 nt, Artificial Sequence
  Synthetic Oligonucleotide; PRF1 exon 2; Set C
gaggagcagacgggcugccaugg

SEQ ID NO: 16707 - RNA, 21 nt, Artificial Sequence
  Synthetic Oligonucleotide; PRF1 exon 2; Set C
aggagcagacgggcugccaug

SEQ ID NO: 16708 - RNA, 22 nt, Artificial Sequence
  Synthetic Oligonucleotide; PRF1 exon 2; Set C
gaggagcagacgggcugccaug

SEQ ID NO: 16709 - RNA, 40 nt, Artificial Sequence
  Synthetic Oligonucleotide; PRF1 exon 2; Set C
ggaugcccaggaggagcagacgggcugccauggagcugca

SEQ ID NO: 16710 - RNA, 40 nt, Artificial Sequence
  Synthetic Oligonucleotide; PRF1 exon 2; Set C
aggaugcccaggaggagcagacgggcugccauggagcugc

SEQ ID NO: 16711 - RNA, 31 nt, Artificial Sequence
  Synthetic Oligonucleotide; PRF1 exon 2; Set C
ggaugcccaggaggagcagacgggcugccau

SEQ ID NO: 16712 - RNA, 23 nt, Artificial Sequence
  Synthetic Oligonucleotide; PRF1 exon 2; Set C
ugcccaggaggagcagacgggcu

SEQ ID NO: 16713 - RNA, 34 nt, Artificial Sequence
  Synthetic Oligonucleotide; PRF1 exon 2; Set C
gaaggaugcccaggaggagcagacgggcugccau

SEQ ID NO: 16714 - RNA, 24 nt, Artificial Sequence
  Synthetic Oligonucleotide; PRF1 exon 2; Set C
augcccaggaggagcagacgggcu

SEQ ID NO: 16715 - RNA, 25 nt, Artificial Sequence
  Synthetic Oligonucleotide; PRF1 exon 2; Set C
gaugcccaggaggagcagacgggcu

SEQ ID NO: 16716 - RNA, 37 nt, Artificial Sequence
  Synthetic Oligonucleotide; PRF1 exon 2; Set C
ggagaaggaugcccaggaggagcagacgggcugccau

SEQ ID NO: 16717 - RNA, 40 nt, Artificial Sequence
  Synthetic Oligonucleotide; PRF1 exon 2; Set C
caggagaaggaugcccaggaggagcagacgggcugccaug

SEQ ID NO: 16718 - RNA, 24 nt, Artificial Sequence
  Synthetic Oligonucleotide; PRF1 exon 2; Set C
ggaugcccaggaggagcagacggg

SEQ ID NO: 16719 - RNA, 24 nt, Artificial Sequence
  Synthetic Oligonucleotide; PRF1 exon 2; Set C
aggaugcccaggaggagcagacgg

SEQ ID NO: 16720 - RNA, 25 nt, Artificial Sequence
  Synthetic Oligonucleotide; PRF1 exon 2; Set C
aaggaugcccaggaggagcagacgg

SEQ ID NO: 16721 - RNA, 27 nt, Artificial Sequence
  Synthetic Oligonucleotide; PRF1 exon 2; Set C
gaaggaugcccaggaggagcagacggg

SEQ ID NO: 16722 - RNA, 26 nt, Artificial Sequence
  Synthetic Oligonucleotide; PRF1 exon 2; Set C
gaaggaugcccaggaggagcagacgg

SEQ ID NO: 16723 - RNA, 27 nt, Artificial Sequence
  Synthetic Oligonucleotide; PRF1 exon 2; Set C
agaaggaugcccaggaggagcagacgg

SEQ ID NO: 16724 - RNA, 15 nt, Artificial Sequence
  Synthetic Oligonucleotide; PRF1 exon 2; Set C
augcccaggaggagc

SEQ ID NO: 16725 - RNA, 33 nt, Artificial Sequence
  Synthetic Oligonucleotide; PRF1 exon 2; Set C
aggagaaggaugcccaggaggagcagacgggcu

SEQ ID NO: 16726 - RNA, 28 nt, Artificial Sequence
  Synthetic Oligonucleotide; PRF1 exon 2; Set C
gagaaggaugcccaggaggagcagacgg

SEQ ID NO: 16727 - RNA, 30 nt, Artificial Sequence
  Synthetic Oligonucleotide; PRF1 exon 2; Set C
ggagaaggaugcccaggaggagcagacggg

SEQ ID NO: 16728 - RNA, 16 nt, Artificial Sequence
  Synthetic Oligonucleotide; PRF1 exon 2; Set A
gaugcccaggaggagc

SEQ ID NO: 16729 - RNA, 32 nt, Artificial Sequence
  Synthetic Oligonucleotide; PRF1 exon 2; Set C
aggagaaggaugcccaggaggagcagacgggc

SEQ ID NO: 16730 - RNA, 15 nt, Artificial Sequence
  Synthetic Oligonucleotide; PRF1 exon 2; Set C
gaugcccaggaggag

SEQ ID NO: 16731 - RNA, 16 nt, Artificial Sequence
  Synthetic Oligonucleotide; PRF1 exon 2; Set C
ggaugcccaggaggag

SEQ ID NO: 16732 - RNA, 15 nt, Artificial Sequence
  Synthetic Oligonucleotide; PRF1 exon 2; Set C
ggaugcccaggagga

SEQ ID NO: 16733 - RNA, 30 nt, Artificial Sequence
  Synthetic Oligonucleotide; PRF1 exon 2; Set C
caggagaaggaugcccaggaggagcagacg

SEQ ID NO: 16734 - RNA, 25 nt, Artificial Sequence
  Synthetic Oligonucleotide; PRF1 exon 2; Set C
aggagaaggaugcccaggaggagca

SEQ ID NO: 16735 - RNA, 22 nt, Artificial Sequence
  Synthetic Oligonucleotide; PRF1 exon 2; Set A
ggagaaggaugcccaggaggag

SEQ ID NO: 16736 - RNA, 24 nt, Artificial Sequence
  Synthetic Oligonucleotide; PRF1 exon 2; Set C
aggagaaggaugcccaggaggagc

SEQ ID NO: 16737 - RNA, 21 nt, Artificial Sequence
  Synthetic Oligonucleotide; PRF1 exon 2; Set A
ggagaaggaugcccaggagga

SEQ ID NO: 16738 - RNA, 37 nt, Artificial Sequence
  Synthetic Oligonucleotide; PRF1 exon 2; Set C
gcagcagcaggagaaggaugcccaggaggagcagacg

SEQ ID NO: 16739 - RNA, 21 nt, Artificial Sequence
  Synthetic Oligonucleotide; PRF1 exon 2; Set A
aggagaaggaugcccaggagg

SEQ ID NO: 16740 - RNA, 38 nt, Artificial Sequence
  Synthetic Oligonucleotide; PRF1 exon 2; Set C
ggcagcagcaggagaaggaugcccaggaggagcagacg

SEQ ID NO: 16741 - RNA, 18 nt, Artificial Sequence
  Synthetic Oligonucleotide; PRF1 exon 2; Set A
ggagaaggaugcccagga

SEQ ID NO: 16742 - RNA, 20 nt, Artificial Sequence
  Synthetic Oligonucleotide; PRF1 exon 2; Set A
aggagaaggaugcccaggag

SEQ ID NO: 16743 - RNA, 18 nt, Artificial Sequence
  Synthetic Oligonucleotide; PRF1 exon 2; Set C
aggagaaggaugcccagg

SEQ ID NO: 16744 - RNA, 18 nt, Artificial Sequence
  Synthetic Oligonucleotide; PRF1 exon 2; Set A
gcagcagcaggagaagga

SEQ ID NO: 16745 - RNA, 19 nt, Artificial Sequence
  Synthetic Oligonucleotide; PRF1 exon 2; Set A
ggcagcagcaggagaagga

SEQ ID NO: 16746 - RNA, 22 nt, Artificial Sequence
  Synthetic Oligonucleotide; PRF1 exon 2; Set C
aggggcagcagcaggagaagga

SEQ ID NO: 16747 - RNA, 20 nt, Artificial Sequence
  Synthetic Oligonucleotide; PRF1 exon 2; Set A
ggggcagcagcaggagaagg

SEQ ID NO: 16748 - RNA, 17 nt, Artificial Sequence
  Synthetic Oligonucleotide; PRF1 exon 2; Set A
gggcagcagcaggagaa

SEQ ID NO: 16749 - RNA, 19 nt, Artificial Sequence
  Synthetic Oligonucleotide; PRF1 exon 2; Set A
ggggcagcagcaggagaag

SEQ ID NO: 16750 - RNA, 18 nt, Artificial Sequence
  Synthetic Oligonucleotide; PRF1 exon 2; Set A
ggggcagcagcaggagaa

SEQ ID NO: 16751 - RNA, 32 nt, Artificial Sequence
  Synthetic Oligonucleotide; PRF1 exon 2; Set C
gacgggcaggggcagcagcaggagaaggaugc

SEQ ID NO: 16752 - RNA, 31 nt, Artificial Sequence
  Synthetic Oligonucleotide; PRF1 exon 2; Set C
gacgggcaggggcagcagcaggagaaggaug

SEQ ID NO: 16753 - RNA, 33 nt, Artificial Sequence
  Synthetic Oligonucleotide; PRF1 exon 2; Set C
ggacgggcaggggcagcagcaggagaaggaugc

SEQ ID NO: 16754 - RNA, 15 nt, Artificial Sequence
  Synthetic Oligonucleotide; PRF1 exon 2; Set A
ggggcagcagcagga

SEQ ID NO: 16755 - RNA, 30 nt, Artificial Sequence
  Synthetic Oligonucleotide; PRF1 exon 2; Set C
gacgggcaggggcagcagcaggagaaggau

SEQ ID NO: 16756 - RNA, 32 nt, Artificial Sequence
  Synthetic Oligonucleotide; PRF1 exon 2; Set C
ggacgggcaggggcagcagcaggagaaggaug

SEQ ID NO: 16757 - RNA, 34 nt, Artificial Sequence
  Synthetic Oligonucleotide; PRF1 exon 2; Set C
gggacgggcaggggcagcagcaggagaaggaugc

SEQ ID NO: 16758 - RNA, 31 nt, Artificial Sequence
  Synthetic Oligonucleotide; PRF1 exon 2; Set C
ggacgggcaggggcagcagcaggagaaggau

SEQ ID NO: 16759 - RNA, 33 nt, Artificial Sequence
  Synthetic Oligonucleotide; PRF1 exon 2; Set C
gggacgggcaggggcagcagcaggagaaggaug

SEQ ID NO: 16760 - RNA, 15 nt, Artificial Sequence
  Synthetic Oligonucleotide; PRF1 exon 2; Set A
aggggcagcagcagg

SEQ ID NO: 16761 - RNA, 27 nt, Artificial Sequence
  Synthetic Oligonucleotide; PRF1 exon 2; Set C
acgggcaggggcagcagcaggagaagg

SEQ ID NO: 16762 - RNA, 32 nt, Artificial Sequence
  Synthetic Oligonucleotide; PRF1 exon 2; Set C
gggacgggcaggggcagcagcaggagaaggau

SEQ ID NO: 16763 - RNA, 26 nt, Artificial Sequence
  Synthetic Oligonucleotide; PRF1 exon 2; Set C
acgggcaggggcagcagcaggagaag

SEQ ID NO: 16764 - RNA, 37 nt, Artificial Sequence
  Synthetic Oligonucleotide; PRF1 exon 2; Set C
gcagggacgggcaggggcagcagcaggagaaggaugc

SEQ ID NO: 16765 - RNA, 25 nt, Artificial Sequence
  Synthetic Oligonucleotide; PRF1 exon 2; Set C
acgggcaggggcagcagcaggagaa

SEQ ID NO: 16766 - RNA, 36 nt, Artificial Sequence
  Synthetic Oligonucleotide; PRF1 exon 2; Set C
gcagggacgggcaggggcagcagcaggagaaggaug

SEQ ID NO: 16767 - RNA, 32 nt, Artificial Sequence
  Synthetic Oligonucleotide; PRF1 exon 2; Set C
agggacgggcaggggcagcagcaggagaagga

SEQ ID NO: 16768 - RNA, 35 nt, Artificial Sequence
  Synthetic Oligonucleotide; PRF1 exon 2; Set C
gcagggacgggcaggggcagcagcaggagaaggau

SEQ ID NO: 16769 - RNA, 33 nt, Artificial Sequence
  Synthetic Oligonucleotide; PRF1 exon 2; Set C
cagggacgggcaggggcagcagcaggagaagga

SEQ ID NO: 16770 - RNA, 34 nt, Artificial Sequence
  Synthetic Oligonucleotide; PRF1 exon 2; Set C
gcagggacgggcaggggcagcagcaggagaagga

SEQ ID NO: 16771 - RNA, 22 nt, Artificial Sequence
  Synthetic Oligonucleotide; PRF1 exon 2; Set C
acgggcaggggcagcagcagga

SEQ ID NO: 16772 - RNA, 22 nt, Artificial Sequence
  Synthetic Oligonucleotide; PRF1 exon 2; Set C
gacgggcaggggcagcagcagg

SEQ ID NO: 16773 - RNA, 23 nt, Artificial Sequence
  Synthetic Oligonucleotide; PRF1 exon 2; Set C
ggacgggcaggggcagcagcagg

SEQ ID NO: 16774 - RNA, 24 nt, Artificial Sequence
  Synthetic Oligonucleotide; PRF1 exon 2; Set C
gggacgggcaggggcagcagcagg

SEQ ID NO: 16775 - RNA, 26 nt, Artificial Sequence
  Synthetic Oligonucleotide; PRF1 exon 2; Set C
agggacgggcaggggcagcagcagga

SEQ ID NO: 16776 - RNA, 25 nt, Artificial Sequence
  Synthetic Oligonucleotide; PRF1 exon 2; Set C
agggacgggcaggggcagcagcagg

SEQ ID NO: 16777 - RNA, 27 nt, Artificial Sequence
  Synthetic Oligonucleotide; PRF1 exon 2; Set C
cagggacgggcaggggcagcagcagga

SEQ ID NO: 16778 - RNA, 27 nt, Artificial Sequence
  Synthetic Oligonucleotide; PRF1 exon 2; Set C
gcagggacgggcaggggcagcagcagg

SEQ ID NO: 16779 - RNA, 39 nt, Artificial Sequence
  Synthetic Oligonucleotide; PRF1 exon 2; Set C
uguggcacggggcagggacgggcaggggcagcagcagga

SEQ ID NO: 16780 - RNA, 38 nt, Artificial Sequence
  Synthetic Oligonucleotide; PRF1 exon 2; Set C
uguggcacggggcagggacgggcaggggcagcagcagg

SEQ ID NO: 16781 - RNA, 31 nt, Artificial Sequence
  Synthetic Oligonucleotide; PRF1 exon 2; Set C
guguggcacggggcagggacgggcaggggca

SEQ ID NO: 16782 - RNA, 30 nt, Artificial Sequence
  Synthetic Oligonucleotide; PRF1 exon 2; Set C
guguggcacggggcagggacgggcaggggc

SEQ ID NO: 16783 - RNA, 32 nt, Artificial Sequence
  Synthetic Oligonucleotide; PRF1 exon 2; Set C
uguguggcacggggcagggacgggcaggggca

SEQ ID NO: 16784 - RNA, 29 nt, Artificial Sequence
  Synthetic Oligonucleotide; PRF1 exon 2; Set C
guguggcacggggcagggacgggcagggg

SEQ ID NO: 16785 - RNA, 31 nt, Artificial Sequence
  Synthetic Oligonucleotide; PRF1 exon 2; Set C
uguguggcacggggcagggacgggcaggggc

SEQ ID NO: 16786 - RNA, 28 nt, Artificial Sequence
  Synthetic Oligonucleotide; PRF1 exon 2; Set C
guguggcacggggcagggacgggcaggg

SEQ ID NO: 16787 - RNA, 30 nt, Artificial Sequence
  Synthetic Oligonucleotide; PRF1 exon 2; Set C
uguguggcacggggcagggacgggcagggg

SEQ ID NO: 16788 - RNA, 29 nt, Artificial Sequence
  Synthetic Oligonucleotide; PRF1 exon 2; Set C
uguguggcacggggcagggacgggcaggg

SEQ ID NO: 16789 - RNA, 27 nt, Artificial Sequence
  Synthetic Oligonucleotide; PRF1 exon 2; Set C
guguggcacggggcagggacgggcagg

SEQ ID NO: 16790 - RNA, 28 nt, Artificial Sequence
  Synthetic Oligonucleotide; PRF1 exon 2; Set C
uguguggcacggggcagggacgggcagg

SEQ ID NO: 16791 - RNA, 20 nt, Artificial Sequence
  Synthetic Oligonucleotide; PRF1 exon 2; Set C
guguggcacggggcagggac

SEQ ID NO: 16792 - RNA, 21 nt, Artificial Sequence
  Synthetic Oligonucleotide; PRF1 exon 2; Set C
uguguggcacggggcagggac

SEQ ID NO: 16793 - RNA, 40 nt, Artificial Sequence
  Synthetic Oligonucleotide; PRF1 exon 2; Set C
agcgugcggcuguguggcacggggcagggacgggcagggg

SEQ ID NO: 16794 - RNA, 20 nt, Artificial Sequence
  Synthetic Oligonucleotide; PRF1 exon 2; Set C
uguguggcacggggcaggga

SEQ ID NO: 16795 - RNA, 39 nt, Artificial Sequence
  Synthetic Oligonucleotide; PRF1 exon 2; Set C
agcgugcggcuguguggcacggggcagggacgggcaggg

SEQ ID NO: 16796 - RNA, 17 nt, Artificial Sequence
  Synthetic Oligonucleotide; PRF1 exon 2; Set A
guguggcacggggcagg

SEQ ID NO: 16797 - RNA, 40 nt, Artificial Sequence
  Synthetic Oligonucleotide; PRF1 exon 2; Set C
gagcgugcggcuguguggcacggggcagggacgggcaggg

SEQ ID NO: 16798 - RNA, 16 nt, Artificial Sequence
  Synthetic Oligonucleotide; PRF1 exon 2; Set A
guguggcacggggcag

SEQ ID NO: 16799 - RNA, 18 nt, Artificial Sequence
  Synthetic Oligonucleotide; PRF1 exon 2; Set A
uguguggcacggggcagg

SEQ ID NO: 16800 - RNA, 17 nt, Artificial Sequence
  Synthetic Oligonucleotide; PRF1 exon 2; Set A
uguguggcacggggcag

SEQ ID NO: 16801 - RNA, 40 nt, Artificial Sequence
  Synthetic Oligonucleotide; PRF1 exon 2; Set C
ugagcgugcggcuguguggcacggggcagggacgggcagg

SEQ ID NO: 16802 - RNA, 32 nt, Artificial Sequence
  Synthetic Oligonucleotide; PRF1 exon 2; Set C
agcgugcggcuguguggcacggggcagggacg

SEQ ID NO: 16803 - RNA, 28 nt, Artificial Sequence
  Synthetic Oligonucleotide; PRF1 exon 2; Set C
agcgugcggcuguguggcacggggcagg

SEQ ID NO: 16804 - RNA, 27 nt, Artificial Sequence
  Synthetic Oligonucleotide; PRF1 exon 2; Set C
agcgugcggcuguguggcacggggcag

SEQ ID NO: 16805 - RNA, 29 nt, Artificial Sequence
  Synthetic Oligonucleotide; PRF1 exon 2; Set C
gagcgugcggcuguguggcacggggcagg

SEQ ID NO: 16806 - RNA, 28 nt, Artificial Sequence
  Synthetic Oligonucleotide; PRF1 exon 2; Set C
gagcgugcggcuguguggcacggggcag

SEQ ID NO: 16807 - RNA, 30 nt, Artificial Sequence
  Synthetic Oligonucleotide; PRF1 exon 2; Set C
ugagcgugcggcuguguggcacggggcagg

SEQ ID NO: 16808 - RNA, 29 nt, Artificial Sequence
  Synthetic Oligonucleotide; PRF1 exon 2; Set C
ugagcgugcggcuguguggcacggggcag

SEQ ID NO: 16809 - RNA, 31 nt, Artificial Sequence
  Synthetic Oligonucleotide; PRF1 exon 2; Set C
cugagcgugcggcuguguggcacggggcagg

SEQ ID NO: 16810 - RNA, 30 nt, Artificial Sequence
  Synthetic Oligonucleotide; PRF1 exon 2; Set C
cugagcgugcggcuguguggcacggggcag

SEQ ID NO: 16811 - RNA, 32 nt, Artificial Sequence
  Synthetic Oligonucleotide; PRF1 exon 2; Set C
ucugagcgugcggcuguguggcacggggcagg

SEQ ID NO: 16812 - RNA, 31 nt, Artificial Sequence
  Synthetic Oligonucleotide; PRF1 exon 2; Set C
ucugagcgugcggcuguguggcacggggcag

SEQ ID NO: 16813 - RNA, 15 nt, Artificial Sequence
  Synthetic Oligonucleotide; PRF1 exon 2; Set A
agcgugcggcugugu

SEQ ID NO: 16814 - RNA, 16 nt, Artificial Sequence
  Synthetic Oligonucleotide; PRF1 exon 2; Set A
gagcgugcggcugugu

SEQ ID NO: 16815 - RNA, 36 nt, Artificial Sequence
  Synthetic Oligonucleotide; PRF1 exon 2; Set C
uuguggcugcgcuugcacucugagcgugcggcugug

SEQ ID NO: 16816 - RNA, 38 nt, Artificial Sequence
  Synthetic Oligonucleotide; PRF1 exon 2; Set C
cuuguggcugcgcuugcacucugagcgugcggcugugu

SEQ ID NO: 16817 - RNA, 35 nt, Artificial Sequence
  Synthetic Oligonucleotide; PRF1 exon 2; Set C
uuguggcugcgcuugcacucugagcgugcggcugu

SEQ ID NO: 16818 - RNA, 39 nt, Artificial Sequence
  Synthetic Oligonucleotide; PRF1 exon 2; Set C
acuuguggcugcgcuugcacucugagcgugcggcugugu

SEQ ID NO: 16819 - RNA, 40 nt, Artificial Sequence
  Synthetic Oligonucleotide; PRF1 exon 2; Set C
aacuuguggcugcgcuugcacucugagcgugcggcugugu

SEQ ID NO: 16820 - RNA, 40 nt, Artificial Sequence
  Synthetic Oligonucleotide; PRF1 exon 2; Set C
cgaacuuguggcugcgcuugcacucugagcgugcggcugu

SEQ ID NO: 16821 - RNA, 25 nt, Artificial Sequence
  Synthetic Oligonucleotide; PRF1 exon 2; Set C
uuguggcugcgcuugcacucugagc

SEQ ID NO: 16822 - RNA, 24 nt, Artificial Sequence
  Synthetic Oligonucleotide; PRF1 exon 2; Set C
uuguggcugcgcuugcacucugag

SEQ ID NO: 16823 - RNA, 23 nt, Artificial Sequence
  Synthetic Oligonucleotide; PRF1 exon 2; Set C
uuguggcugcgcuugcacucuga

SEQ ID NO: 16824 - RNA, 22 nt, Artificial Sequence
  Synthetic Oligonucleotide; PRF1 exon 2; Set C
uuguggcugcgcuugcacucug

SEQ ID NO: 16825 - RNA, 21 nt, Artificial Sequence
  Synthetic Oligonucleotide; PRF1 exon 2; Set C
uuguggcugcgcuugcacucu

SEQ ID NO: 16826 - RNA, 29 nt, Artificial Sequence
  Synthetic Oligonucleotide; PRF1 exon 2; Set C
cgaacuuguggcugcgcuugcacucugag

SEQ ID NO: 16827 - RNA, 28 nt, Artificial Sequence
  Synthetic Oligonucleotide; PRF1 exon 2; Set C
cgaacuuguggcugcgcuugcacucuga

SEQ ID NO: 16828 - RNA, 27 nt, Artificial Sequence
  Synthetic Oligonucleotide; PRF1 exon 2; Set C
cgaacuuguggcugcgcuugcacucug

SEQ ID NO: 16829 - RNA, 26 nt, Artificial Sequence
  Synthetic Oligonucleotide; PRF1 exon 2; Set C
cgaacuuguggcugcgcuugcacucu

SEQ ID NO: 16830 - RNA, 25 nt, Artificial Sequence
  Synthetic Oligonucleotide; PRF1 exon 2; Set C
ggagcccgagcggcggaggcugguc

SEQ ID NO: 16831 - RNA, 24 nt, Artificial Sequence
  Synthetic Oligonucleotide; PRF1 exon 2; Set C
ggagcccgagcggcggaggcuggu

SEQ ID NO: 16832 - RNA, 23 nt, Artificial Sequence
  Synthetic Oligonucleotide; PRF1 exon 2; Set C
ggagcccgagcggcggaggcugg

SEQ ID NO: 16833 - RNA, 31 nt, Artificial Sequence
  Synthetic Oligonucleotide; PRF1 exon 2; Set C
ugggaaggagcccgagcggcggaggcugguc

SEQ ID NO: 16834 - RNA, 19 nt, Artificial Sequence
  Synthetic Oligonucleotide; PRF1 exon 2; Set C
aggagcccgagcggcggag

SEQ ID NO: 16835 - RNA, 18 nt, Artificial Sequence
  Synthetic Oligonucleotide; PRF1 exon 2; Set C
aggagcccgagcggcgga

SEQ ID NO: 16836 - RNA, 19 nt, Artificial Sequence
  Synthetic Oligonucleotide; PRF1 exon 2; Set C
aaggagcccgagcggcgga

SEQ ID NO: 16837 - RNA, 39 nt, Artificial Sequence
  Synthetic Oligonucleotide; PRF1 exon 2; Set C
guguccacugggaaggagcccgagcggcggaggcugguc

SEQ ID NO: 16838 - RNA, 38 nt, Artificial Sequence
  Synthetic Oligonucleotide; PRF1 exon 2; Set C
guguccacugggaaggagcccgagcggcggaggcuggu

SEQ ID NO: 16839 - RNA, 37 nt, Artificial Sequence
  Synthetic Oligonucleotide; PRF1 exon 2; Set C
guguccacugggaaggagcccgagcggcggaggcugg

SEQ ID NO: 16840 - RNA, 26 nt, Artificial Sequence
  Synthetic Oligonucleotide; PRF1 exon 2; Set C
guguguccacugggaaggagcccgag

SEQ ID NO: 16841 - RNA, 27 nt, Artificial Sequence
  Synthetic Oligonucleotide; PRF1 exon 2; Set C
uguguguccacugggaaggagcccgag

SEQ ID NO: 16842 - RNA, 28 nt, Artificial Sequence
  Synthetic Oligonucleotide; PRF1 exon 2; Set C
uuguguguccacugggaaggagcccgag

SEQ ID NO: 16843 - RNA, 29 nt, Artificial Sequence
  Synthetic Oligonucleotide; PRF1 exon 2; Set C
uuuguguguccacugggaaggagcccgag

SEQ ID NO: 16844 - RNA, 30 nt, Artificial Sequence
  Synthetic Oligonucleotide; PRF1 exon 2; Set C
cuuuguguguccacugggaaggagcccgag

SEQ ID NO: 16845 - RNA, 15 nt, Artificial Sequence
  Synthetic Oligonucleotide; PRF1 exon 2; Set C
uguccacugggaagg

SEQ ID NO: 16846 - RNA, 17 nt, Artificial Sequence
  Synthetic Oligonucleotide; PRF1 exon 2; Set C
guguccacugggaagga

SEQ ID NO: 16847 - RNA, 19 nt, Artificial Sequence
  Synthetic Oligonucleotide; PRF1 exon 2; Set C
uguguccacugggaaggag

SEQ ID NO: 16848 - RNA, 20 nt, Artificial Sequence
  Synthetic Oligonucleotide; PRF1 exon 2; Set A
guguguccacugggaaggag

SEQ ID NO: 16849 - RNA, 21 nt, Artificial Sequence
  Synthetic Oligonucleotide; PRF1 exon 2; Set A
uguguguccacugggaaggag

SEQ ID NO: 16850 - RNA, 22 nt, Artificial Sequence
  Synthetic Oligonucleotide; PRF1 exon 2; Set A
uuguguguccacugggaaggag

SEQ ID NO: 16851 - RNA, 23 nt, Artificial Sequence
  Synthetic Oligonucleotide; PRF1 exon 2; Set A
uuuguguguccacugggaaggag

SEQ ID NO: 16852 - RNA, 24 nt, Artificial Sequence
  Synthetic Oligonucleotide; PRF1 exon 2; Set A
cuuuguguguccacugggaaggag

SEQ ID NO: 16853 - RNA, 33 nt, Artificial Sequence
  Synthetic Oligonucleotide; PRF1 exon 2; Set C
caggugccgucgggccgcaggaaccuuugugug

SEQ ID NO: 16854 - RNA, 26 nt, Artificial Sequence
  Synthetic Oligonucleotide; PRF1 exon 2; Set C
ggugccgucgggccgcaggaaccuuu

SEQ ID NO: 16855 - RNA, 25 nt, Artificial Sequence
  Synthetic Oligonucleotide; PRF1 exon 2; Set C
ggugccgucgggccgcaggaaccuu

SEQ ID NO: 16856 - RNA, 26 nt, Artificial Sequence
  Synthetic Oligonucleotide; PRF1 exon 2; Set C
aggugccgucgggccgcaggaaccuu

SEQ ID NO: 16857 - RNA, 37 nt, Artificial Sequence
  Synthetic Oligonucleotide; PRF1 exon 2; Set C
agggugcaggugccgucgggccgcaggaaccuuugug

SEQ ID NO: 16858 - RNA, 36 nt, Artificial Sequence
  Synthetic Oligonucleotide; PRF1 exon 2; Set C
agggugcaggugccgucgggccgcaggaaccuuugu

SEQ ID NO: 16859 - RNA, 35 nt, Artificial Sequence
  Synthetic Oligonucleotide; PRF1 exon 2; Set C
agggugcaggugccgucgggccgcaggaaccuuug

SEQ ID NO: 16860 - RNA, 37 nt, Artificial Sequence
  Synthetic Oligonucleotide; PRF1 exon 2; Set C
gagggugcaggugccgucgggccgcaggaaccuuugu

SEQ ID NO: 16861 - RNA, 36 nt, Artificial Sequence
  Synthetic Oligonucleotide; PRF1 exon 2; Set C
gagggugcaggugccgucgggccgcaggaaccuuug

SEQ ID NO: 16862 - RNA, 34 nt, Artificial Sequence
  Synthetic Oligonucleotide; PRF1 exon 2; Set C
agggugcaggugccgucgggccgcaggaaccuuu

SEQ ID NO: 16863 - RNA, 35 nt, Artificial Sequence
  Synthetic Oligonucleotide; PRF1 exon 2; Set C
gagggugcaggugccgucgggccgcaggaaccuuu

SEQ ID NO: 16864 - RNA, 33 nt, Artificial Sequence
  Synthetic Oligonucleotide; PRF1 exon 2; Set C
agggugcaggugccgucgggccgcaggaaccuu

SEQ ID NO: 16865 - RNA, 34 nt, Artificial Sequence
  Synthetic Oligonucleotide; PRF1 exon 2; Set C
gagggugcaggugccgucgggccgcaggaaccuu

SEQ ID NO: 16866 - RNA, 23 nt, Artificial Sequence
  Synthetic Oligonucleotide; PRF1 exon 2; Set C
cacagagggugcaggugccgucg

SEQ ID NO: 16867 - RNA, 24 nt, Artificial Sequence
  Synthetic Oligonucleotide; PRF1 exon 2; Set C
ucacagagggugcaggugccgucg

SEQ ID NO: 16868 - RNA, 25 nt, Artificial Sequence
  Synthetic Oligonucleotide; PRF1 exon 2; Set C
uucacagagggugcaggugccgucg

SEQ ID NO: 16869 - RNA, 23 nt, Artificial Sequence
  Synthetic Oligonucleotide; PRF1 exon 2; Set C
ucacagagggugcaggugccguc

SEQ ID NO: 16870 - RNA, 26 nt, Artificial Sequence
  Synthetic Oligonucleotide; PRF1 exon 2; Set C
uuucacagagggugcaggugccgucg

SEQ ID NO: 16871 - RNA, 24 nt, Artificial Sequence
  Synthetic Oligonucleotide; PRF1 exon 2; Set C
uucacagagggugcaggugccguc

SEQ ID NO: 16872 - RNA, 27 nt, Artificial Sequence
  Synthetic Oligonucleotide; PRF1 exon 2; Set C
uuuucacagagggugcaggugccgucg

SEQ ID NO: 16873 - RNA, 25 nt, Artificial Sequence
  Synthetic Oligonucleotide; PRF1 exon 2; Set C
uuucacagagggugcaggugccguc

SEQ ID NO: 16874 - RNA, 28 nt, Artificial Sequence
  Synthetic Oligonucleotide; PRF1 exon 2; Set C
auuuucacagagggugcaggugccgucg

SEQ ID NO: 16875 - RNA, 26 nt, Artificial Sequence
  Synthetic Oligonucleotide; PRF1 exon 2; Set C
uuuucacagagggugcaggugccguc

SEQ ID NO: 16876 - RNA, 27 nt, Artificial Sequence
  Synthetic Oligonucleotide; PRF1 exon 2; Set C
auuuucacagagggugcaggugccguc

SEQ ID NO: 16877 - RNA, 34 nt, Artificial Sequence
  Synthetic Oligonucleotide; PRF1 exon 2; Set C
uagggcauuuucacagagggugcaggugccgucg

SEQ ID NO: 16878 - RNA, 35 nt, Artificial Sequence
  Synthetic Oligonucleotide; PRF1 exon 2; Set C
guagggcauuuucacagagggugcaggugccgucg

SEQ ID NO: 16879 - RNA, 37 nt, Artificial Sequence
  Synthetic Oligonucleotide; PRF1 exon 2; Set C
uguagggcauuuucacagagggugcaggugccgucgg

SEQ ID NO: 16880 - RNA, 36 nt, Artificial Sequence
  Synthetic Oligonucleotide; PRF1 exon 2; Set C
uguagggcauuuucacagagggugcaggugccgucg

SEQ ID NO: 16881 - RNA, 34 nt, Artificial Sequence
  Synthetic Oligonucleotide; PRF1 exon 2; Set C
guagggcauuuucacagagggugcaggugccguc

SEQ ID NO: 16882 - RNA, 35 nt, Artificial Sequence
  Synthetic Oligonucleotide; PRF1 exon 2; Set C
uguagggcauuuucacagagggugcaggugccguc

SEQ ID NO: 16883 - RNA, 17 nt, Artificial Sequence
  Synthetic Oligonucleotide; PRF1 exon 2; Set C
ggcauuuucacagaggg

SEQ ID NO: 16884 - RNA, 18 nt, Artificial Sequence
  Synthetic Oligonucleotide; PRF1 exon 2; Set C
gggcauuuucacagaggg

SEQ ID NO: 16885 - RNA, 19 nt, Artificial Sequence
  Synthetic Oligonucleotide; PRF1 exon 2; Set C
agggcauuuucacagaggg

SEQ ID NO: 16886 - RNA, 31 nt, Artificial Sequence
  Synthetic Oligonucleotide; PRF1 exon 2; Set C
ggugcccuccuguagggcauuuucacagagg

SEQ ID NO: 16887 - RNA, 32 nt, Artificial Sequence
  Synthetic Oligonucleotide; PRF1 exon 2; Set C
gggugcccuccuguagggcauuuucacagagg

SEQ ID NO: 16888 - RNA, 30 nt, Artificial Sequence
  Synthetic Oligonucleotide; PRF1 exon 2; Set C
ggugcccuccuguagggcauuuucacagag

SEQ ID NO: 16889 - RNA, 29 nt, Artificial Sequence
  Synthetic Oligonucleotide; PRF1 exon 2; Set C
ggugcccuccuguagggcauuuucacaga

SEQ ID NO: 16890 - RNA, 31 nt, Artificial Sequence
  Synthetic Oligonucleotide; PRF1 exon 2; Set C
gggugcccuccuguagggcauuuucacagag

SEQ ID NO: 16891 - RNA, 30 nt, Artificial Sequence
  Synthetic Oligonucleotide; PRF1 exon 2; Set C
gggugcccuccuguagggcauuuucacaga

SEQ ID NO: 16892 - RNA, 28 nt, Artificial Sequence
  Synthetic Oligonucleotide; PRF1 exon 2; Set C
ggugcccuccuguagggcauuuucacag

SEQ ID NO: 16893 - RNA, 27 nt, Artificial Sequence
  Synthetic Oligonucleotide; PRF1 exon 2; Set C
ggugcccuccuguagggcauuuucaca

SEQ ID NO: 16894 - RNA, 29 nt, Artificial Sequence
  Synthetic Oligonucleotide; PRF1 exon 2; Set C
gggugcccuccuguagggcauuuucacag

SEQ ID NO: 16895 - RNA, 26 nt, Artificial Sequence
  Synthetic Oligonucleotide; PRF1 exon 2; Set C
ggugcccuccuguagggcauuuucac

SEQ ID NO: 16896 - RNA, 28 nt, Artificial Sequence
  Synthetic Oligonucleotide; PRF1 exon 2; Set C
gggugcccuccuguagggcauuuucaca

SEQ ID NO: 16897 - RNA, 27 nt, Artificial Sequence
  Synthetic Oligonucleotide; PRF1 exon 2; Set C
gggugcccuccuguagggcauuuucac

SEQ ID NO: 16898 - RNA, 39 nt, Artificial Sequence
  Synthetic Oligonucleotide; PRF1 exon 2; Set C
gcuggagggugcccuccuguagggcauuuucacagaggg

SEQ ID NO: 16899 - RNA, 22 nt, Artificial Sequence
  Synthetic Oligonucleotide; PRF1 exon 2; Set C
ggugcccuccuguagggcauuu

SEQ ID NO: 16900 - RNA, 21 nt, Artificial Sequence
  Synthetic Oligonucleotide; PRF1 exon 2; Set C
ggugcccuccuguagggcauu

SEQ ID NO: 16901 - RNA, 22 nt, Artificial Sequence
  Synthetic Oligonucleotide; PRF1 exon 2; Set C
gggugcccuccuguagggcauu

SEQ ID NO: 16902 - RNA, 16 nt, Artificial Sequence
  Synthetic Oligonucleotide; PRF1 exon 2; Set A
ugcccuccuguagggc

SEQ ID NO: 16903 - RNA, 15 nt, Artificial Sequence
  Synthetic Oligonucleotide; PRF1 exon 2; Set C
ugcccuccuguaggg

SEQ ID NO: 16904 - RNA, 15 nt, Artificial Sequence
  Synthetic Oligonucleotide; PRF1 exon 2; Set C
gugcccuccuguagg

SEQ ID NO: 16905 - RNA, 15 nt, Artificial Sequence
  Synthetic Oligonucleotide; PRF1 exon 2; Set A
gggugcccuccugua

SEQ ID NO: 16906 - RNA, 25 nt, Artificial Sequence
  Synthetic Oligonucleotide; PRF1 exon 2; Set C
gcuggagggugcccuccuguagggc

SEQ ID NO: 16907 - RNA, 24 nt, Artificial Sequence
  Synthetic Oligonucleotide; PRF1 exon 2; Set C
gcuggagggugcccuccuguaggg

SEQ ID NO: 16908 - RNA, 23 nt, Artificial Sequence
  Synthetic Oligonucleotide; PRF1 exon 2; Set C
gcuggagggugcccuccuguagg

SEQ ID NO: 16909 - RNA, 33 nt, Artificial Sequence
  Synthetic Oligonucleotide; PRF1 exon 2; Set C
gcaggcgcuggagggugcccuccuguagggcau

SEQ ID NO: 16910 - RNA, 34 nt, Artificial Sequence
  Synthetic Oligonucleotide; PRF1 exon 2; Set C
ggcaggcgcuggagggugcccuccuguagggcau

SEQ ID NO: 16911 - RNA, 32 nt, Artificial Sequence
  Synthetic Oligonucleotide; PRF1 exon 2; Set C
gcaggcgcuggagggugcccuccuguagggca

SEQ ID NO: 16912 - RNA, 35 nt, Artificial Sequence
  Synthetic Oligonucleotide; PRF1 exon 2; Set C
aggcaggcgcuggagggugcccuccuguagggcau

SEQ ID NO: 16913 - RNA, 33 nt, Artificial Sequence
  Synthetic Oligonucleotide; PRF1 exon 2; Set C
ggcaggcgcuggagggugcccuccuguagggca

SEQ ID NO: 16914 - RNA, 36 nt, Artificial Sequence
  Synthetic Oligonucleotide; PRF1 exon 2; Set C
gaggcaggcgcuggagggugcccuccuguagggcau

SEQ ID NO: 16915 - RNA, 34 nt, Artificial Sequence
  Synthetic Oligonucleotide; PRF1 exon 2; Set C
aggcaggcgcuggagggugcccuccuguagggca

SEQ ID NO: 16916 - RNA, 32 nt, Artificial Sequence
  Synthetic Oligonucleotide; PRF1 exon 2; Set C
ggcaggcgcuggagggugcccuccuguagggc

SEQ ID NO: 16917 - RNA, 37 nt, Artificial Sequence
  Synthetic Oligonucleotide; PRF1 exon 2; Set C
agaggcaggcgcuggagggugcccuccuguagggcau

SEQ ID NO: 16918 - RNA, 35 nt, Artificial Sequence
  Synthetic Oligonucleotide; PRF1 exon 2; Set C
gaggcaggcgcuggagggugcccuccuguagggca

SEQ ID NO: 16919 - RNA, 33 nt, Artificial Sequence
  Synthetic Oligonucleotide; PRF1 exon 2; Set C
aggcaggcgcuggagggugcccuccuguagggc

SEQ ID NO: 16920 - RNA, 28 nt, Artificial Sequence
  Synthetic Oligonucleotide; PRF1 exon 2; Set C
gcaggcgcuggagggugcccuccuguag

SEQ ID NO: 16921 - RNA, 36 nt, Artificial Sequence
  Synthetic Oligonucleotide; PRF1 exon 2; Set C
agaggcaggcgcuggagggugcccuccuguagggca

SEQ ID NO: 16922 - RNA, 34 nt, Artificial Sequence
  Synthetic Oligonucleotide; PRF1 exon 2; Set C
gaggcaggcgcuggagggugcccuccuguagggc

SEQ ID NO: 16923 - RNA, 32 nt, Artificial Sequence
  Synthetic Oligonucleotide; PRF1 exon 2; Set C
aggcaggcgcuggagggugcccuccuguaggg

SEQ ID NO: 16924 - RNA, 27 nt, Artificial Sequence
  Synthetic Oligonucleotide; PRF1 exon 2; Set C
gcaggcgcuggagggugcccuccugua

SEQ ID NO: 16925 - RNA, 29 nt, Artificial Sequence
  Synthetic Oligonucleotide; PRF1 exon 2; Set C
ggcaggcgcuggagggugcccuccuguag

SEQ ID NO: 16926 - RNA, 31 nt, Artificial Sequence
  Synthetic Oligonucleotide; PRF1 exon 2; Set C
aggcaggcgcuggagggugcccuccuguagg

SEQ ID NO: 16927 - RNA, 35 nt, Artificial Sequence
  Synthetic Oligonucleotide; PRF1 exon 2; Set C
agaggcaggcgcuggagggugcccuccuguagggc

SEQ ID NO: 16928 - RNA, 33 nt, Artificial Sequence
  Synthetic Oligonucleotide; PRF1 exon 2; Set C
gaggcaggcgcuggagggugcccuccuguaggg

SEQ ID NO: 16929 - RNA, 30 nt, Artificial Sequence
  Synthetic Oligonucleotide; PRF1 exon 2; Set C
aggcaggcgcuggagggugcccuccuguag

SEQ ID NO: 16930 - RNA, 32 nt, Artificial Sequence
  Synthetic Oligonucleotide; PRF1 exon 2; Set C
gaggcaggcgcuggagggugcccuccuguagg

SEQ ID NO: 16931 - RNA, 34 nt, Artificial Sequence
  Synthetic Oligonucleotide; PRF1 exon 2; Set C
agaggcaggcgcuggagggugcccuccuguaggg

SEQ ID NO: 16932 - RNA, 31 nt, Artificial Sequence
  Synthetic Oligonucleotide; PRF1 exon 2; Set C
gaggcaggcgcuggagggugcccuccuguag

SEQ ID NO: 16933 - RNA, 33 nt, Artificial Sequence
  Synthetic Oligonucleotide; PRF1 exon 2; Set C
agaggcaggcgcuggagggugcccuccuguagg

SEQ ID NO: 16934 - RNA, 32 nt, Artificial Sequence
  Synthetic Oligonucleotide; PRF1 exon 2; Set C
agaggcaggcgcuggagggugcccuccuguag

SEQ ID NO: 16935 - RNA, 40 nt, Artificial Sequence
  Synthetic Oligonucleotide; PRF1 exon 2; Set C
gcgccagaggcaggcgcuggagggugcccuccuguagggc

SEQ ID NO: 16936 - RNA, 39 nt, Artificial Sequence
  Synthetic Oligonucleotide; PRF1 exon 2; Set C
gcgccagaggcaggcgcuggagggugcccuccuguaggg

SEQ ID NO: 16937 - RNA, 38 nt, Artificial Sequence
  Synthetic Oligonucleotide; PRF1 exon 2; Set C
gcgccagaggcaggcgcuggagggugcccuccuguagg

SEQ ID NO: 16938 - RNA, 40 nt, Artificial Sequence
  Synthetic Oligonucleotide; PRF1 exon 2; Set C
agcgccagaggcaggcgcuggagggugcccuccuguaggg

SEQ ID NO: 16939 - RNA, 37 nt, Artificial Sequence
  Synthetic Oligonucleotide; PRF1 exon 2; Set C
gcgccagaggcaggcgcuggagggugcccuccuguag

SEQ ID NO: 16940 - RNA, 39 nt, Artificial Sequence
  Synthetic Oligonucleotide; PRF1 exon 2; Set C
agcgccagaggcaggcgcuggagggugcccuccuguagg

SEQ ID NO: 16941 - RNA, 40 nt, Artificial Sequence
  Synthetic Oligonucleotide; PRF1 exon 2; Set C
gagcgccagaggcaggcgcuggagggugcccuccuguagg

SEQ ID NO: 16942 - RNA, 26 nt, Artificial Sequence
  Synthetic Oligonucleotide; PRF1 exon 2; Set C
agcgccagaggcaggcgcuggagggu

SEQ ID NO: 16943 - RNA, 27 nt, Artificial Sequence
  Synthetic Oligonucleotide; PRF1 exon 2; Set C
gagcgccagaggcaggcgcuggagggu

SEQ ID NO: 16944 - RNA, 26 nt, Artificial Sequence
  Synthetic Oligonucleotide; PRF1 exon 2; Set C
gagcgccagaggcaggcgcuggaggg

SEQ ID NO: 16945 - RNA, 28 nt, Artificial Sequence
  Synthetic Oligonucleotide; PRF1 exon 2; Set C
ugagcgccagaggcaggcgcuggagggu

SEQ ID NO: 16946 - RNA, 27 nt, Artificial Sequence
  Synthetic Oligonucleotide; PRF1 exon 2; Set C
ugagcgccagaggcaggcgcuggaggg

SEQ ID NO: 16947 - RNA, 33 nt, Artificial Sequence
  Synthetic Oligonucleotide; PRF1 exon 2; Set C
guuggugagcgccagaggcaggcgcuggagggu

SEQ ID NO: 16948 - RNA, 32 nt, Artificial Sequence
  Synthetic Oligonucleotide; PRF1 exon 2; Set C
guuggugagcgccagaggcaggcgcuggaggg

SEQ ID NO: 16949 - RNA, 34 nt, Artificial Sequence
  Synthetic Oligonucleotide; PRF1 exon 2; Set C
aguuggugagcgccagaggcaggcgcuggagggu

SEQ ID NO: 16950 - RNA, 33 nt, Artificial Sequence
  Synthetic Oligonucleotide; PRF1 exon 2; Set C
aguuggugagcgccagaggcaggcgcuggaggg

SEQ ID NO: 16951 - RNA, 31 nt, Artificial Sequence
  Synthetic Oligonucleotide; PRF1 exon 2; Set C
ugggcccgccaguuggugagcgccagaggca

SEQ ID NO: 16952 - RNA, 30 nt, Artificial Sequence
  Synthetic Oligonucleotide; PRF1 exon 2; Set C
ugggcccgccaguuggugagcgccagaggc

SEQ ID NO: 16953 - RNA, 29 nt, Artificial Sequence
  Synthetic Oligonucleotide; PRF1 exon 2; Set C
ugggcccgccaguuggugagcgccagagg

SEQ ID NO: 16954 - RNA, 28 nt, Artificial Sequence
  Synthetic Oligonucleotide; PRF1 exon 2; Set C
ugggcccgccaguuggugagcgccagag

SEQ ID NO: 16955 - RNA, 27 nt, Artificial Sequence
  Synthetic Oligonucleotide; PRF1 exon 2; Set C
ugggcccgccaguuggugagcgccaga

SEQ ID NO: 16956 - RNA, 20 nt, Artificial Sequence
  Synthetic Oligonucleotide; PRF1 exon 2; Set C
ugggcccgccaguuggugag

SEQ ID NO: 16957 - RNA, 19 nt, Artificial Sequence
  Synthetic Oligonucleotide; PRF1 exon 2; Set C
ugggcccgccaguugguga

SEQ ID NO: 16958 - RNA, 19 nt, Artificial Sequence
  Synthetic Oligonucleotide; PRF1 exon 2; Set C
cuuuggcccugguuacaug

SEQ ID NO: 16959 - RNA, 28 nt, Artificial Sequence
  Synthetic Oligonucleotide; PRF1 exon 2; Set C
uggagcugacuuuggcccugguuacaug

SEQ ID NO: 16960 - RNA, 29 nt, Artificial Sequence
  Synthetic Oligonucleotide; PRF1 exon 2; Set C
guggagcugacuuuggcccugguuacaug

SEQ ID NO: 16961 - RNA, 30 nt, Artificial Sequence
  Synthetic Oligonucleotide; PRF1 exon 2; Set C
aguggagcugacuuuggcccugguuacaug

SEQ ID NO: 16962 - RNA, 31 nt, Artificial Sequence
  Synthetic Oligonucleotide; PRF1 exon 2; Set C
caguggagcugacuuuggcccugguuacaug

SEQ ID NO: 16963 - RNA, 37 nt, Artificial Sequence
  Synthetic Oligonucleotide; PRF1 exon 2; Set C
gccgcaucccgggccacagcuucaguggagcugacuu

SEQ ID NO: 16964 - RNA, 38 nt, Artificial Sequence
  Synthetic Oligonucleotide; PRF1 exon 2; Set C
agccgcaucccgggccacagcuucaguggagcugacuu

SEQ ID NO: 16965 - RNA, 36 nt, Artificial Sequence
  Synthetic Oligonucleotide; PRF1 exon 2; Set C
gccgcaucccgggccacagcuucaguggagcugacu

SEQ ID NO: 16966 - RNA, 39 nt, Artificial Sequence
  Synthetic Oligonucleotide; PRF1 exon 2; Set C
gagccgcaucccgggccacagcuucaguggagcugacuu

SEQ ID NO: 16967 - RNA, 37 nt, Artificial Sequence
  Synthetic Oligonucleotide; PRF1 exon 2; Set C
agccgcaucccgggccacagcuucaguggagcugacu

SEQ ID NO: 16968 - RNA, 40 nt, Artificial Sequence
  Synthetic Oligonucleotide; PRF1 exon 2; Set C
cgagccgcaucccgggccacagcuucaguggagcugacuu

SEQ ID NO: 16969 - RNA, 38 nt, Artificial Sequence
  Synthetic Oligonucleotide; PRF1 exon 2; Set C
gagccgcaucccgggccacagcuucaguggagcugacu

SEQ ID NO: 16970 - RNA, 39 nt, Artificial Sequence
  Synthetic Oligonucleotide; PRF1 exon 2; Set C
cgagccgcaucccgggccacagcuucaguggagcugacu

SEQ ID NO: 16971 - RNA, 40 nt, Artificial Sequence
  Synthetic Oligonucleotide; PRF1 exon 2; Set C
acgagccgcaucccgggccacagcuucaguggagcugacu

SEQ ID NO: 16972 - RNA, 28 nt, Artificial Sequence
  Synthetic Oligonucleotide; PRF1 exon 2; Set C
gccgcaucccgggccacagcuucagugg

SEQ ID NO: 16973 - RNA, 29 nt, Artificial Sequence
  Synthetic Oligonucleotide; PRF1 exon 2; Set C
agccgcaucccgggccacagcuucagugg

SEQ ID NO: 16974 - RNA, 30 nt, Artificial Sequence
  Synthetic Oligonucleotide; PRF1 exon 2; Set C
gagccgcaucccgggccacagcuucagugg

SEQ ID NO: 16975 - RNA, 28 nt, Artificial Sequence
  Synthetic Oligonucleotide; PRF1 exon 2; Set C
agccgcaucccgggccacagcuucagug

SEQ ID NO: 16976 - RNA, 31 nt, Artificial Sequence
  Synthetic Oligonucleotide; PRF1 exon 2; Set C
cgagccgcaucccgggccacagcuucagugg

SEQ ID NO: 16977 - RNA, 29 nt, Artificial Sequence
  Synthetic Oligonucleotide; PRF1 exon 2; Set C
gagccgcaucccgggccacagcuucagug

SEQ ID NO: 16978 - RNA, 32 nt, Artificial Sequence
  Synthetic Oligonucleotide; PRF1 exon 2; Set C
acgagccgcaucccgggccacagcuucagugg

SEQ ID NO: 16979 - RNA, 30 nt, Artificial Sequence
  Synthetic Oligonucleotide; PRF1 exon 2; Set C
cgagccgcaucccgggccacagcuucagug

SEQ ID NO: 16980 - RNA, 28 nt, Artificial Sequence
  Synthetic Oligonucleotide; PRF1 exon 2; Set C
gagccgcaucccgggccacagcuucagu

SEQ ID NO: 16981 - RNA, 33 nt, Artificial Sequence
  Synthetic Oligonucleotide; PRF1 exon 2; Set C
uacgagccgcaucccgggccacagcuucagugg

SEQ ID NO: 16982 - RNA, 31 nt, Artificial Sequence
  Synthetic Oligonucleotide; PRF1 exon 2; Set C
acgagccgcaucccgggccacagcuucagug

SEQ ID NO: 16983 - RNA, 29 nt, Artificial Sequence
  Synthetic Oligonucleotide; PRF1 exon 2; Set C
cgagccgcaucccgggccacagcuucagu

SEQ ID NO: 16984 - RNA, 32 nt, Artificial Sequence
  Synthetic Oligonucleotide; PRF1 exon 2; Set C
uacgagccgcaucccgggccacagcuucagug

SEQ ID NO: 16985 - RNA, 30 nt, Artificial Sequence
  Synthetic Oligonucleotide; PRF1 exon 2; Set C
acgagccgcaucccgggccacagcuucagu

SEQ ID NO: 16986 - RNA, 31 nt, Artificial Sequence
  Synthetic Oligonucleotide; PRF1 exon 2; Set C
uacgagccgcaucccgggccacagcuucagu

SEQ ID NO: 16987 - RNA, 29 nt, Artificial Sequence
  Synthetic Oligonucleotide; PRF1 exon 2; Set C
acgagccgcaucccgggccacagcuucag

SEQ ID NO: 16988 - RNA, 30 nt, Artificial Sequence
  Synthetic Oligonucleotide; PRF1 exon 2; Set C
uacgagccgcaucccgggccacagcuucag

SEQ ID NO: 16989 - RNA, 29 nt, Artificial Sequence
  Synthetic Oligonucleotide; PRF1 exon 2; Set C
uacgagccgcaucccgggccacagcuuca

SEQ ID NO: 16990 - RNA, 40 nt, Artificial Sequence
  Synthetic Oligonucleotide; PRF1 exon 2; Set C
ugcggaugcuacgagccgcaucccgggccacagcuucagu

SEQ ID NO: 16991 - RNA, 39 nt, Artificial Sequence
  Synthetic Oligonucleotide; PRF1 exon 2; Set C
ugcggaugcuacgagccgcaucccgggccacagcuucag

SEQ ID NO: 16992 - RNA, 38 nt, Artificial Sequence
  Synthetic Oligonucleotide; PRF1 exon 2; Set C
ugcggaugcuacgagccgcaucccgggccacagcuuca

SEQ ID NO: 16993 - RNA, 40 nt, Artificial Sequence
  Synthetic Oligonucleotide; PRF1 exon 2; Set C
uugcggaugcuacgagccgcaucccgggccacagcuucag

SEQ ID NO: 16994 - RNA, 39 nt, Artificial Sequence
  Synthetic Oligonucleotide; PRF1 exon 2; Set C
uugcggaugcuacgagccgcaucccgggccacagcuuca

SEQ ID NO: 16995 - RNA, 40 nt, Artificial Sequence
  Synthetic Oligonucleotide; PRF1 exon 2; Set C
guugcggaugcuacgagccgcaucccgggccacagcuuca

SEQ ID NO: 16996 - RNA, 40 nt, Artificial Sequence
  Synthetic Oligonucleotide; PRF1 exon 2; Set C
acguccagcccgaccuuccagucguugcggaugcuacgag

SEQ ID NO: 16997 - RNA, 39 nt, Artificial Sequence
  Synthetic Oligonucleotide; PRF1 exon 2; Set C
acguccagcccgaccuuccagucguugcggaugcuacga

SEQ ID NO: 16998 - RNA, 40 nt, Artificial Sequence
  Synthetic Oligonucleotide; PRF1 exon 2; Set C
cacguccagcccgaccuuccagucguugcggaugcuacga

SEQ ID NO: 16999 - RNA, 38 nt, Artificial Sequence
  Synthetic Oligonucleotide; PRF1 exon 2; Set C
acguccagcccgaccuuccagucguugcggaugcuacg

SEQ ID NO: 17000 - RNA, 39 nt, Artificial Sequence
  Synthetic Oligonucleotide; PRF1 exon 2; Set C
cacguccagcccgaccuuccagucguugcggaugcuacg

SEQ ID NO: 17001 - RNA, 37 nt, Artificial Sequence
  Synthetic Oligonucleotide; PRF1 exon 2; Set C
acguccagcccgaccuuccagucguugcggaugcuac

SEQ ID NO: 17002 - RNA, 40 nt, Artificial Sequence
  Synthetic Oligonucleotide; PRF1 exon 2; Set C
ucacguccagcccgaccuuccagucguugcggaugcuacg

SEQ ID NO: 17003 - RNA, 38 nt, Artificial Sequence
  Synthetic Oligonucleotide; PRF1 exon 2; Set C
cacguccagcccgaccuuccagucguugcggaugcuac

SEQ ID NO: 17004 - RNA, 39 nt, Artificial Sequence
  Synthetic Oligonucleotide; PRF1 exon 2; Set C
ucacguccagcccgaccuuccagucguugcggaugcuac

SEQ ID NO: 17005 - RNA, 40 nt, Artificial Sequence
  Synthetic Oligonucleotide; PRF1 exon 2; Set C
gucacguccagcccgaccuuccagucguugcggaugcuac

SEQ ID NO: 17006 - RNA, 28 nt, Artificial Sequence
  Synthetic Oligonucleotide; PRF1 exon 2; Set C
acguccagcccgaccuuccagucguugc

SEQ ID NO: 17007 - RNA, 27 nt, Artificial Sequence
  Synthetic Oligonucleotide; PRF1 exon 2; Set C
acguccagcccgaccuuccagucguug

SEQ ID NO: 17008 - RNA, 29 nt, Artificial Sequence
  Synthetic Oligonucleotide; PRF1 exon 2; Set C
cacguccagcccgaccuuccagucguugc

SEQ ID NO: 17009 - RNA, 28 nt, Artificial Sequence
  Synthetic Oligonucleotide; PRF1 exon 2; Set C
cacguccagcccgaccuuccagucguug

SEQ ID NO: 17010 - RNA, 30 nt, Artificial Sequence
  Synthetic Oligonucleotide; PRF1 exon 2; Set C
ucacguccagcccgaccuuccagucguugc

SEQ ID NO: 17011 - RNA, 29 nt, Artificial Sequence
  Synthetic Oligonucleotide; PRF1 exon 2; Set C
ucacguccagcccgaccuuccagucguug

SEQ ID NO: 17012 - RNA, 31 nt, Artificial Sequence
  Synthetic Oligonucleotide; PRF1 exon 2; Set C
gucacguccagcccgaccuuccagucguugc

SEQ ID NO: 17013 - RNA, 30 nt, Artificial Sequence
  Synthetic Oligonucleotide; PRF1 exon 2; Set C
gucacguccagcccgaccuuccagucguug

SEQ ID NO: 17014 - RNA, 28 nt, Artificial Sequence
  Synthetic Oligonucleotide; PRF1 exon 2; Set C
ucacguccagcccgaccuuccagucguu

SEQ ID NO: 17015 - RNA, 29 nt, Artificial Sequence
  Synthetic Oligonucleotide; PRF1 exon 2; Set C
gucacguccagcccgaccuuccagucguu

SEQ ID NO: 17016 - RNA, 28 nt, Artificial Sequence
  Synthetic Oligonucleotide; PRF1 exon 2; Set C
gucacguccagcccgaccuuccagucgu

SEQ ID NO: 17017 - RNA, 22 nt, Artificial Sequence
  Synthetic Oligonucleotide; PRF1 exon 2; Set C
cggccacagacacaugcacauu

SEQ ID NO: 17018 - RNA, 23 nt, Artificial Sequence
  Synthetic Oligonucleotide; PRF1 exon 2; Set C
ccggccacagacacaugcacauu

SEQ ID NO: 17019 - RNA, 15 nt, Artificial Sequence
  Synthetic Oligonucleotide; PRF1 exon 2; Set C
gugagugugagccgg

SEQ ID NO: 17020 - RNA, 16 nt, Artificial Sequence
  Synthetic Oligonucleotide; PRF1 exon 2; Set C
ugugagugugagccgg

SEQ ID NO: 17021 - RNA, 15 nt, Artificial Sequence
  Synthetic Oligonucleotide; PRF1 exon 2; Set C
ugugagugugagccg

SEQ ID NO: 17022 - RNA, 23 nt, Artificial Sequence
  Synthetic Oligonucleotide; PRF1 exon 2; Set C
uggcugccugugagugugagccg

SEQ ID NO: 17023 - RNA, 30 nt, Artificial Sequence
  Synthetic Oligonucleotide; PRF1 exon 2; Set C
caaaguuggcugccugugagugugagccgg

SEQ ID NO: 17024 - RNA, 29 nt, Artificial Sequence
  Synthetic Oligonucleotide; PRF1 exon 2; Set C
caaaguuggcugccugugagugugagccg

SEQ ID NO: 17025 - RNA, 16 nt, Artificial Sequence
  Synthetic Oligonucleotide; PRF1 exon 2; Set C
uuggcugccugugagu

SEQ ID NO: 17026 - RNA, 17 nt, Artificial Sequence
  Synthetic Oligonucleotide; PRF1 exon 2; Set B
guuggcugccugugagu

SEQ ID NO: 17027 - RNA, 18 nt, Artificial Sequence
  Synthetic Oligonucleotide; PRF1 exon 2; Set B
aguuggcugccugugagu

SEQ ID NO: 17028 - RNA, 37 nt, Artificial Sequence
  Synthetic Oligonucleotide; PRF1 exon 2; Set C
ugggcugcaaaguuggcugccugugagugugagccgg

SEQ ID NO: 17029 - RNA, 19 nt, Artificial Sequence
  Synthetic Oligonucleotide; PRF1 exon 2; Set B
aaguuggcugccugugagu

SEQ ID NO: 17030 - RNA, 36 nt, Artificial Sequence
  Synthetic Oligonucleotide; PRF1 exon 2; Set C
ugggcugcaaaguuggcugccugugagugugagccg

SEQ ID NO: 17031 - RNA, 38 nt, Artificial Sequence
  Synthetic Oligonucleotide; PRF1 exon 2; Set C
cugggcugcaaaguuggcugccugugagugugagccgg

SEQ ID NO: 17032 - RNA, 20 nt, Artificial Sequence
  Synthetic Oligonucleotide; PRF1 exon 2; Set C
aaaguuggcugccugugagu

SEQ ID NO: 17033 - RNA, 37 nt, Artificial Sequence
  Synthetic Oligonucleotide; PRF1 exon 2; Set C
cugggcugcaaaguuggcugccugugagugugagccg

SEQ ID NO: 17034 - RNA, 30 nt, Artificial Sequence
  Synthetic Oligonucleotide; PRF1 exon 2; Set C
ucugggcugcaaaguuggcugccugugagu

SEQ ID NO: 17035 - RNA, 31 nt, Artificial Sequence
  Synthetic Oligonucleotide; PRF1 exon 2; Set C
uucugggcugcaaaguuggcugccugugagu

SEQ ID NO: 17036 - RNA, 32 nt, Artificial Sequence
  Synthetic Oligonucleotide; PRF1 exon 2; Set C
cuucugggcugcaaaguuggcugccugugagu

SEQ ID NO: 17037 - RNA, 34 nt, Artificial Sequence
  Synthetic Oligonucleotide; PRF1 exon 2; Set C
gucuucugggcugcaaaguuggcugccugugagu

SEQ ID NO: 17038 - RNA, 35 nt, Artificial Sequence
  Synthetic Oligonucleotide; PRF1 exon 2; Set C
ggucuucugggcugcaaaguuggcugccugugagu

SEQ ID NO: 17039 - RNA, 36 nt, Artificial Sequence
  Synthetic Oligonucleotide; PRF1 exon 2; Set C
gggucuucugggcugcaaaguuggcugccugugagu

SEQ ID NO: 17040 - RNA, 37 nt, Artificial Sequence
  Synthetic Oligonucleotide; PRF1 exon 2; Set C
ugggucuucugggcugcaaaguuggcugccugugagu

SEQ ID NO: 17041 - RNA, 38 nt, Artificial Sequence
  Synthetic Oligonucleotide; PRF1 exon 2; Set C
gugggucuucugggcugcaaaguuggcugccugugagu

SEQ ID NO: 17042 - RNA, 39 nt, Artificial Sequence
  Synthetic Oligonucleotide; PRF1 exon 2; Set C
ggugggucuucugggcugcaaaguuggcugccugugagu

SEQ ID NO: 17043 - RNA, 16 nt, Artificial Sequence
  Synthetic Oligonucleotide; PRF1 exon 2; Set C
ugggcugcaaaguugg

SEQ ID NO: 17044 - RNA, 17 nt, Artificial Sequence
  Synthetic Oligonucleotide; PRF1 exon 2; Set C
cugggcugcaaaguugg

SEQ ID NO: 17045 - RNA, 28 nt, Artificial Sequence
  Synthetic Oligonucleotide; PRF1 exon 2; Set C
uggugggucuucugggcugcaaaguugg

SEQ ID NO: 17046 - RNA, 16 nt, Artificial Sequence
  Synthetic Oligonucleotide; PRF1 exon 2; Set C
gucuucugggcugcaa

SEQ ID NO: 17047 - RNA, 17 nt, Artificial Sequence
  Synthetic Oligonucleotide; PRF1 exon 2; Set B
ggucuucugggcugcaa

SEQ ID NO: 17048 - RNA, 18 nt, Artificial Sequence
  Synthetic Oligonucleotide; PRF1 exon 2; Set B
gggucuucugggcugcaa

SEQ ID NO: 17049 - RNA, 19 nt, Artificial Sequence
  Synthetic Oligonucleotide; PRF1 exon 2; Set B
ugggucuucugggcugcaa

SEQ ID NO: 17050 - RNA, 26 nt, Artificial Sequence
  Synthetic Oligonucleotide; PRF1 exon 2; Set C
cuggugggucuucugggcugcaaagu

SEQ ID NO: 17051 - RNA, 32 nt, Artificial Sequence
  Synthetic Oligonucleotide; PRF1 exon 2; Set C
guccuggugggucuucugggcugcaaaguugg

SEQ ID NO: 17052 - RNA, 20 nt, Artificial Sequence
  Synthetic Oligonucleotide; PRF1 exon 2; Set B
gugggucuucugggcugcaa

SEQ ID NO: 17053 - RNA, 25 nt, Artificial Sequence
  Synthetic Oligonucleotide; PRF1 exon 2; Set B
cuggugggucuucugggcugcaaag

SEQ ID NO: 17054 - RNA, 33 nt, Artificial Sequence
  Synthetic Oligonucleotide; PRF1 exon 2; Set C
gguccuggugggucuucugggcugcaaaguugg

SEQ ID NO: 17055 - RNA, 21 nt, Artificial Sequence
  Synthetic Oligonucleotide; PRF1 exon 2; Set C
ggugggucuucugggcugcaa

SEQ ID NO: 17056 - RNA, 24 nt, Artificial Sequence
  Synthetic Oligonucleotide; PRF1 exon 2; Set C
cuggugggucuucugggcugcaaa

SEQ ID NO: 17057 - RNA, 24 nt, Artificial Sequence
  Synthetic Oligonucleotide; PRF1 exon 2; Set C
ccuggugggucuucugggcugcaa

SEQ ID NO: 17058 - RNA, 29 nt, Artificial Sequence
  Synthetic Oligonucleotide; PRF1 exon 2; Set C
gguccuggugggucuucugggcugcaaag

SEQ ID NO: 17059 - RNA, 25 nt, Artificial Sequence
  Synthetic Oligonucleotide; PRF1 exon 2; Set C
uccuggugggucuucugggcugcaa

SEQ ID NO: 17060 - RNA, 28 nt, Artificial Sequence
  Synthetic Oligonucleotide; PRF1 exon 2; Set C
gguccuggugggucuucugggcugcaaa

SEQ ID NO: 17061 - RNA, 28 nt, Artificial Sequence
  Synthetic Oligonucleotide; PRF1 exon 2; Set C
ugguccuggugggucuucugggcugcaa

SEQ ID NO: 17062 - RNA, 29 nt, Artificial Sequence
  Synthetic Oligonucleotide; PRF1 exon 2; Set C
cugguccuggugggucuucugggcugcaa

SEQ ID NO: 17063 - RNA, 17 nt, Artificial Sequence
  Synthetic Oligonucleotide; PRF1 exon 2; Set C
ccuggugggucuucugg

SEQ ID NO: 17064 - RNA, 29 nt, Artificial Sequence
  Synthetic Oligonucleotide; PRF1 exon 2; Set C
acugguccuggugggucuucugggcugca

SEQ ID NO: 17065 - RNA, 16 nt, Artificial Sequence
  Synthetic Oligonucleotide; PRF1 exon 2; Set C
ccuggugggucuucug

SEQ ID NO: 17066 - RNA, 18 nt, Artificial Sequence
  Synthetic Oligonucleotide; PRF1 exon 2; Set B
uccuggugggucuucugg

SEQ ID NO: 17067 - RNA, 30 nt, Artificial Sequence
  Synthetic Oligonucleotide; PRF1 exon 2; Set C
uacugguccuggugggucuucugggcugca

SEQ ID NO: 17068 - RNA, 17 nt, Artificial Sequence
  Synthetic Oligonucleotide; PRF1 exon 2; Set C
uccuggugggucuucug

SEQ ID NO: 17069 - RNA, 31 nt, Artificial Sequence
  Synthetic Oligonucleotide; PRF1 exon 2; Set C
guacugguccuggugggucuucugggcugca

SEQ ID NO: 17070 - RNA, 29 nt, Artificial Sequence
  Synthetic Oligonucleotide; PRF1 exon 2; Set C
uacugguccuggugggucuucugggcugc

SEQ ID NO: 17071 - RNA, 32 nt, Artificial Sequence
  Synthetic Oligonucleotide; PRF1 exon 2; Set C
uguacugguccuggugggucuucugggcugca

SEQ ID NO: 17072 - RNA, 30 nt, Artificial Sequence
  Synthetic Oligonucleotide; PRF1 exon 2; Set C
guacugguccuggugggucuucugggcugc

SEQ ID NO: 17073 - RNA, 21 nt, Artificial Sequence
  Synthetic Oligonucleotide; PRF1 exon 2; Set B
ugguccuggugggucuucugg

SEQ ID NO: 17074 - RNA, 20 nt, Artificial Sequence
  Synthetic Oligonucleotide; PRF1 exon 2; Set B
ugguccuggugggucuucug

SEQ ID NO: 17075 - RNA, 22 nt, Artificial Sequence
  Synthetic Oligonucleotide; PRF1 exon 2; Set B
cugguccuggugggucuucugg

SEQ ID NO: 17076 - RNA, 24 nt, Artificial Sequence
  Synthetic Oligonucleotide; PRF1 exon 2; Set C
acugguccuggugggucuucuggg

SEQ ID NO: 17077 - RNA, 21 nt, Artificial Sequence
  Synthetic Oligonucleotide; PRF1 exon 2; Set B
cugguccuggugggucuucug

SEQ ID NO: 17078 - RNA, 25 nt, Artificial Sequence
  Synthetic Oligonucleotide; PRF1 exon 2; Set C
uacugguccuggugggucuucuggg

SEQ ID NO: 17079 - RNA, 16 nt, Artificial Sequence
  Synthetic Oligonucleotide; PRF1 exon 2; Set C
gguccuggugggucuu

SEQ ID NO: 17080 - RNA, 26 nt, Artificial Sequence
  Synthetic Oligonucleotide; PRF1 exon 2; Set C
guacugguccuggugggucuucuggg

SEQ ID NO: 17081 - RNA, 15 nt, Artificial Sequence
  Synthetic Oligonucleotide; PRF1 exon 2; Set C
gguccuggugggucu

SEQ ID NO: 17082 - RNA, 31 nt, Artificial Sequence
  Synthetic Oligonucleotide; PRF1 exon 2; Set C
gaagcuguacugguccuggugggucuucugg

SEQ ID NO: 17083 - RNA, 32 nt, Artificial Sequence
  Synthetic Oligonucleotide; PRF1 exon 2; Set C
ugaagcuguacugguccuggugggucuucugg

SEQ ID NO: 17084 - RNA, 40 nt, Artificial Sequence
  Synthetic Oligonucleotide; PRF1 exon 2; Set C
gucagugcugaagcuguacugguccuggugggucuucugg

SEQ ID NO: 17085 - RNA, 39 nt, Artificial Sequence
  Synthetic Oligonucleotide; PRF1 exon 2; Set C
gucagugcugaagcuguacugguccuggugggucuucug

SEQ ID NO: 17086 - RNA, 40 nt, Artificial Sequence
  Synthetic Oligonucleotide; PRF1 exon 2; Set C
ugucagugcugaagcuguacugguccuggugggucuucug

SEQ ID NO: 17087 - RNA, 20 nt, Artificial Sequence
  Synthetic Oligonucleotide; PRF1 exon 2; Set B
ugaagcuguacugguccugg

SEQ ID NO: 17088 - RNA, 18 nt, Artificial Sequence
  Synthetic Oligonucleotide; PRF1 exon 2; Set C
gaagcuguacugguccug

SEQ ID NO: 17089 - RNA, 19 nt, Artificial Sequence
  Synthetic Oligonucleotide; PRF1 exon 2; Set C
ugaagcuguacugguccug

SEQ ID NO: 17090 - RNA, 33 nt, Artificial Sequence
  Synthetic Oligonucleotide; PRF1 exon 2; Set C
gucagugcugaagcuguacugguccuggugggu

SEQ ID NO: 17091 - RNA, 15 nt, Artificial Sequence
  Synthetic Oligonucleotide; PRF1 exon 2; Set C
gaagcuguacugguc

SEQ ID NO: 17092 - RNA, 32 nt, Artificial Sequence
  Synthetic Oligonucleotide; PRF1 exon 2; Set C
gucagugcugaagcuguacugguccugguggg

SEQ ID NO: 17093 - RNA, 16 nt, Artificial Sequence
  Synthetic Oligonucleotide; PRF1 exon 2; Set C
ugaagcuguacugguc

SEQ ID NO: 17094 - RNA, 31 nt, Artificial Sequence
  Synthetic Oligonucleotide; PRF1 exon 2; Set C
gucagugcugaagcuguacugguccuggugg

SEQ ID NO: 17095 - RNA, 15 nt, Artificial Sequence
  Synthetic Oligonucleotide; PRF1 exon 2; Set C
ugaagcuguacuggu

SEQ ID NO: 17096 - RNA, 30 nt, Artificial Sequence
  Synthetic Oligonucleotide; PRF1 exon 2; Set C
gucagugcugaagcuguacugguccuggug

SEQ ID NO: 17097 - RNA, 32 nt, Artificial Sequence
  Synthetic Oligonucleotide; PRF1 exon 2; Set C
ugucagugcugaagcuguacugguccuggugg

SEQ ID NO: 17098 - RNA, 29 nt, Artificial Sequence
  Synthetic Oligonucleotide; PRF1 exon 2; Set C
gucagugcugaagcuguacugguccuggu

SEQ ID NO: 17099 - RNA, 28 nt, Artificial Sequence
  Synthetic Oligonucleotide; PRF1 exon 2; Set C
gucagugcugaagcuguacugguccugg

SEQ ID NO: 17100 - RNA, 29 nt, Artificial Sequence
  Synthetic Oligonucleotide; PRF1 exon 2; Set C
ugucagugcugaagcuguacugguccugg

SEQ ID NO: 17101 - RNA, 26 nt, Artificial Sequence
  Synthetic Oligonucleotide; PRF1 exon 2; Set C
gucagugcugaagcuguacugguccu

SEQ ID NO: 17102 - RNA, 30 nt, Artificial Sequence
  Synthetic Oligonucleotide; PRF1 exon 2; Set C
gugucagugcugaagcuguacugguccugg

SEQ ID NO: 17103 - RNA, 27 nt, Artificial Sequence
  Synthetic Oligonucleotide; PRF1 exon 2; Set C
ugucagugcugaagcuguacugguccu

SEQ ID NO: 17104 - RNA, 25 nt, Artificial Sequence
  Synthetic Oligonucleotide; PRF1 exon 2; Set B
gucagugcugaagcuguacuggucc

SEQ ID NO: 17105 - RNA, 31 nt, Artificial Sequence
  Synthetic Oligonucleotide; PRF1 exon 2; Set C
cgugucagugcugaagcuguacugguccugg

SEQ ID NO: 17106 - RNA, 28 nt, Artificial Sequence
  Synthetic Oligonucleotide; PRF1 exon 2; Set C
gugucagugcugaagcuguacugguccu

SEQ ID NO: 17107 - RNA, 26 nt, Artificial Sequence
  Synthetic Oligonucleotide; PRF1 exon 2; Set C
ugucagugcugaagcuguacuggucc

SEQ ID NO: 17108 - RNA, 30 nt, Artificial Sequence
  Synthetic Oligonucleotide; PRF1 exon 2; Set C
cgugucagugcugaagcuguacugguccug

SEQ ID NO: 17109 - RNA, 27 nt, Artificial Sequence
  Synthetic Oligonucleotide; PRF1 exon 2; Set C
gugucagugcugaagcuguacuggucc

SEQ ID NO: 17110 - RNA, 22 nt, Artificial Sequence
  Synthetic Oligonucleotide; PRF1 exon 2; Set B
gucagugcugaagcuguacugg

SEQ ID NO: 17111 - RNA, 26 nt, Artificial Sequence
  Synthetic Oligonucleotide; PRF1 exon 2; Set B
gugucagugcugaagcuguacugguc

SEQ ID NO: 17112 - RNA, 21 nt, Artificial Sequence
  Synthetic Oligonucleotide; PRF1 exon 2; Set B
gucagugcugaagcuguacug

SEQ ID NO: 17113 - RNA, 23 nt, Artificial Sequence
  Synthetic Oligonucleotide; PRF1 exon 2; Set B
ugucagugcugaagcuguacugg

SEQ ID NO: 17114 - RNA, 27 nt, Artificial Sequence
  Synthetic Oligonucleotide; PRF1 exon 2; Set C
cgugucagugcugaagcuguacugguc

SEQ ID NO: 17115 - RNA, 22 nt, Artificial Sequence
  Synthetic Oligonucleotide; PRF1 exon 2; Set B
ugucagugcugaagcuguacug

SEQ ID NO: 17116 - RNA, 24 nt, Artificial Sequence
  Synthetic Oligonucleotide; PRF1 exon 2; Set B
gugucagugcugaagcuguacugg

SEQ ID NO: 17117 - RNA, 26 nt, Artificial Sequence
  Synthetic Oligonucleotide; PRF1 exon 2; Set C
cgugucagugcugaagcuguacuggu

SEQ ID NO: 17118 - RNA, 40 nt, Artificial Sequence
  Synthetic Oligonucleotide; PRF1 exon 2; Set C
gcacuccaccgugucagugcugaagcuguacugguccugg

SEQ ID NO: 17119 - RNA, 36 nt, Artificial Sequence
  Synthetic Oligonucleotide; PRF1 exon 2; Set C
gcacuccaccgugucagugcugaagcuguacugguc

SEQ ID NO: 17120 - RNA, 37 nt, Artificial Sequence
  Synthetic Oligonucleotide; PRF1 exon 2; Set C
ggcacuccaccgugucagugcugaagcuguacugguc

SEQ ID NO: 17121 - RNA, 30 nt, Artificial Sequence
  Synthetic Oligonucleotide; PRF1 exon 2; Set C
acuccaccgugucagugcugaagcuguacu

SEQ ID NO: 17122 - RNA, 34 nt, Artificial Sequence
  Synthetic Oligonucleotide; PRF1 exon 2; Set C
gcacuccaccgugucagugcugaagcuguacugg

SEQ ID NO: 17123 - RNA, 38 nt, Artificial Sequence
  Synthetic Oligonucleotide; PRF1 exon 2; Set C
cggcacuccaccgugucagugcugaagcuguacugguc

SEQ ID NO: 17124 - RNA, 31 nt, Artificial Sequence
  Synthetic Oligonucleotide; PRF1 exon 2; Set C
cacuccaccgugucagugcugaagcuguacu

SEQ ID NO: 17125 - RNA, 29 nt, Artificial Sequence
  Synthetic Oligonucleotide; PRF1 exon 2; Set C
acuccaccgugucagugcugaagcuguac

SEQ ID NO: 17126 - RNA, 35 nt, Artificial Sequence
  Synthetic Oligonucleotide; PRF1 exon 2; Set C
ggcacuccaccgugucagugcugaagcuguacugg

SEQ ID NO: 17127 - RNA, 39 nt, Artificial Sequence
  Synthetic Oligonucleotide; PRF1 exon 2; Set C
gcggcacuccaccgugucagugcugaagcuguacugguc

SEQ ID NO: 17128 - RNA, 37 nt, Artificial Sequence
  Synthetic Oligonucleotide; PRF1 exon 2; Set C
cggcacuccaccgugucagugcugaagcuguacuggu

SEQ ID NO: 17129 - RNA, 28 nt, Artificial Sequence
  Synthetic Oligonucleotide; PRF1 exon 2; Set C
acuccaccgugucagugcugaagcugua

SEQ ID NO: 17130 - RNA, 30 nt, Artificial Sequence
  Synthetic Oligonucleotide; PRF1 exon 2; Set C
cacuccaccgugucagugcugaagcuguac

SEQ ID NO: 17131 - RNA, 36 nt, Artificial Sequence
  Synthetic Oligonucleotide; PRF1 exon 2; Set C
cggcacuccaccgugucagugcugaagcuguacugg

SEQ ID NO: 17132 - RNA, 38 nt, Artificial Sequence
  Synthetic Oligonucleotide; PRF1 exon 2; Set C
gcggcacuccaccgugucagugcugaagcuguacuggu

SEQ ID NO: 17133 - RNA, 29 nt, Artificial Sequence
  Synthetic Oligonucleotide; PRF1 exon 2; Set C
cacuccaccgugucagugcugaagcugua

SEQ ID NO: 17134 - RNA, 40 nt, Artificial Sequence
  Synthetic Oligonucleotide; PRF1 exon 2; Set C
agaagcggcacuccaccgugucagugcugaagcuguacug

SEQ ID NO: 17135 - RNA, 40 nt, Artificial Sequence
  Synthetic Oligonucleotide; PRF1 exon 2; Set C
uguagaagcggcacuccaccgugucagugcugaagcugua

SEQ ID NO: 17136 - RNA, 31 nt, Artificial Sequence
  Synthetic Oligonucleotide; PRF1 exon 2; Set C
agaagcggcacuccaccgugucagugcugaa

SEQ ID NO: 17137 - RNA, 32 nt, Artificial Sequence
  Synthetic Oligonucleotide; PRF1 exon 2; Set C
uagaagcggcacuccaccgugucagugcugaa

SEQ ID NO: 17138 - RNA, 30 nt, Artificial Sequence
  Synthetic Oligonucleotide; PRF1 exon 2; Set C
agaagcggcacuccaccgugucagugcuga

SEQ ID NO: 17139 - RNA, 31 nt, Artificial Sequence
  Synthetic Oligonucleotide; PRF1 exon 2; Set C
uagaagcggcacuccaccgugucagugcuga

SEQ ID NO: 17140 - RNA, 21 nt, Artificial Sequence
  Synthetic Oligonucleotide; PRF1 exon 2; Set C
guagaagcggcacuccaccgu

SEQ ID NO: 17141 - RNA, 23 nt, Artificial Sequence
  Synthetic Oligonucleotide; PRF1 exon 2; Set C
uguagaagcggcacuccaccgug

SEQ ID NO: 17142 - RNA, 22 nt, Artificial Sequence
  Synthetic Oligonucleotide; PRF1 exon 2; Set C
uguagaagcggcacuccaccgu

SEQ ID NO: 17143 - RNA, 24 nt, Artificial Sequence
  Synthetic Oligonucleotide; PRF1 exon 2; Set C
cuguagaagcggcacuccaccgug

SEQ ID NO: 17144 - RNA, 23 nt, Artificial Sequence
  Synthetic Oligonucleotide; PRF1 exon 2; Set C
cuguagaagcggcacuccaccgu

SEQ ID NO: 17145 - RNA, 15 nt, Artificial Sequence
  Synthetic Oligonucleotide; PRF1 exon 2; Set C
uguagaagcggcacu

SEQ ID NO: 17146 - RNA, 16 nt, Artificial Sequence
  Synthetic Oligonucleotide; PRF1 exon 2; Set C
cuguagaagcggcacu

SEQ ID NO: 17147 - RNA, 19 nt, Artificial Sequence
  Synthetic Oligonucleotide; PRF1 exon 2; Set B
cucaccuguagaagcggca

SEQ ID NO: 17148 - RNA, 20 nt, Artificial Sequence
  Synthetic Oligonucleotide; PRF1 exon 2; Set B
ucucaccuguagaagcggca

SEQ ID NO: 17149 - RNA, 18 nt, Artificial Sequence
  Synthetic Oligonucleotide; PRF1 exon 2; Set C
cucaccuguagaagcggc

SEQ ID NO: 17150 - RNA, 19 nt, Artificial Sequence
  Synthetic Oligonucleotide; PRF1 exon 2; Set B
ucucaccuguagaagcggc

SEQ ID NO: 17151 - RNA, 17 nt, Artificial Sequence
  Synthetic Oligonucleotide; PRF1 exon 2; Set C
cucaccuguagaagcgg

SEQ ID NO: 17152 - RNA, 16 nt, Artificial Sequence
  Synthetic Oligonucleotide; PRF1 exon 2; Set C
cucaccuguagaagcg

SEQ ID NO: 17153 - RNA, 18 nt, Artificial Sequence
  Synthetic Oligonucleotide; PRF1 exon 2; Set C
ucucaccuguagaagcgg

SEQ ID NO: 17154 - RNA, 40 nt, Artificial Sequence
  Synthetic Oligonucleotide; PRF1 exon 2; Set C
cuagccccagcucucaccuguagaagcggcacuccaccgu

SEQ ID NO: 17155 - RNA, 17 nt, Artificial Sequence
  Synthetic Oligonucleotide; PRF1 exon 2; Set C
ucucaccuguagaagcg

SEQ ID NO: 17156 - RNA, 28 nt, Artificial Sequence
  Synthetic Oligonucleotide; PRF1 exon 2; Set C
cuagccccagcucucaccuguagaagcg

SEQ ID NO: 17157 - RNA, 40 nt, Artificial Sequence
  Synthetic Oligonucleotide; PRF1 exon 2; Set C
uuuccagccccccaccccuagccccagcucucaccuguag

SEQ ID NO: 17158 - RNA, 17 nt, Artificial Sequence
  Synthetic Oligonucleotide; PD-L1 exon 2; Set C
uggaaugcccuaauuau

SEQ ID NO: 17159 - RNA, 18 nt, Artificial Sequence
  Synthetic Oligonucleotide; PD-L1 exon 2; Set C
cuggaaugcccuaauuau

SEQ ID NO: 17160 - RNA, 16 nt, Artificial Sequence
  Synthetic Oligonucleotide; PD-L1 exon 2; Set C
uggaaugcccuaauua

SEQ ID NO: 17161 - RNA, 15 nt, Artificial Sequence
  Synthetic Oligonucleotide; PD-L1 exon 2; Set C
uggaaugcccuaauu

SEQ ID NO: 17162 - RNA, 17 nt, Artificial Sequence
  Synthetic Oligonucleotide; PD-L1 exon 2; Set C
cuggaaugcccuaauua

SEQ ID NO: 17163 - RNA, 19 nt, Artificial Sequence
  Synthetic Oligonucleotide; PD-L1 exon 2; Set C
ucuggaaugcccuaauuau

SEQ ID NO: 17164 - RNA, 16 nt, Artificial Sequence
  Synthetic Oligonucleotide; PD-L1 exon 2; Set C
cuggaaugcccuaauu

SEQ ID NO: 17165 - RNA, 18 nt, Artificial Sequence
  Synthetic Oligonucleotide; PD-L1 exon 2; Set C
ucuggaaugcccuaauua

SEQ ID NO: 17166 - RNA, 20 nt, Artificial Sequence
  Synthetic Oligonucleotide; PD-L1 exon 2; Set C
uucuggaaugcccuaauuau

SEQ ID NO: 17167 - RNA, 17 nt, Artificial Sequence
  Synthetic Oligonucleotide; PD-L1 exon 2; Set C
ucuggaaugcccuaauu

SEQ ID NO: 17168 - RNA, 21 nt, Artificial Sequence
  Synthetic Oligonucleotide; PD-L1 exon 2; Set C
uuucuggaaugcccuaauuau

SEQ ID NO: 17169 - RNA, 19 nt, Artificial Sequence
  Synthetic Oligonucleotide; PD-L1 exon 2; Set C
uucuggaaugcccuaauua

SEQ ID NO: 17170 - RNA, 18 nt, Artificial Sequence
  Synthetic Oligonucleotide; PD-L1 exon 2; Set C
uucuggaaugcccuaauu

SEQ ID NO: 17171 - RNA, 22 nt, Artificial Sequence
  Synthetic Oligonucleotide; PD-L1 exon 2; Set C
cuuucuggaaugcccuaauuau

SEQ ID NO: 17172 - RNA, 20 nt, Artificial Sequence
  Synthetic Oligonucleotide; PD-L1 exon 2; Set C
uuucuggaaugcccuaauua

SEQ ID NO: 17173 - RNA, 19 nt, Artificial Sequence
  Synthetic Oligonucleotide; PD-L1 exon 2; Set C
uuucuggaaugcccuaauu

SEQ ID NO: 17174 - RNA, 21 nt, Artificial Sequence
  Synthetic Oligonucleotide; PD-L1 exon 2; Set C
cuuucuggaaugcccuaauua

SEQ ID NO: 17175 - RNA, 20 nt, Artificial Sequence
  Synthetic Oligonucleotide; PD-L1 exon 2; Set C
cuuucuggaaugcccuaauu

SEQ ID NO: 17176 - RNA, 32 nt, Artificial Sequence
  Synthetic Oligonucleotide; PD-L1 exon 2; Set C
uuuggugucuuaccguucagcaaaugccagua

SEQ ID NO: 17177 - RNA, 18 nt, Artificial Sequence
  Synthetic Oligonucleotide; PD-L1 exon 2; Set C
ucuuaccguucagcaaau

SEQ ID NO: 17178 - RNA, 31 nt, Artificial Sequence
  Synthetic Oligonucleotide; PD-L1 exon 2; Set C
uuuggugucuuaccguucagcaaaugccagu

SEQ ID NO: 17179 - RNA, 33 nt, Artificial Sequence
  Synthetic Oligonucleotide; PD-L1 exon 2; Set C
auuuggugucuuaccguucagcaaaugccagua

SEQ ID NO: 17180 - RNA, 19 nt, Artificial Sequence
  Synthetic Oligonucleotide; PD-L1 exon 2; Set C
gucuuaccguucagcaaau

SEQ ID NO: 17181 - RNA, 17 nt, Artificial Sequence
  Synthetic Oligonucleotide; PD-L1 exon 2; Set C
ucuuaccguucagcaaa

SEQ ID NO: 17182 - RNA, 32 nt, Artificial Sequence
  Synthetic Oligonucleotide; PD-L1 exon 2; Set C
auuuggugucuuaccguucagcaaaugccagu

SEQ ID NO: 17183 - RNA, 34 nt, Artificial Sequence
  Synthetic Oligonucleotide; PD-L1 exon 2; Set C
gauuuggugucuuaccguucagcaaaugccagua

SEQ ID NO: 17184 - RNA, 18 nt, Artificial Sequence
  Synthetic Oligonucleotide; PD-L1 exon 2; Set C
gucuuaccguucagcaaa

SEQ ID NO: 17185 - RNA, 33 nt, Artificial Sequence
  Synthetic Oligonucleotide; PD-L1 exon 2; Set C
gauuuggugucuuaccguucagcaaaugccagu

SEQ ID NO: 17186 - RNA, 25 nt, Artificial Sequence
  Synthetic Oligonucleotide; PD-L1 exon 2; Set A
uuuggugucuuaccguucagcaaau

SEQ ID NO: 17187 - RNA, 40 nt, Artificial Sequence
  Synthetic Oligonucleotide; PD-L1 exon 2; Set C
uggaaggauuuggugucuuaccguucagcaaaugccagua

SEQ ID NO: 17188 - RNA, 26 nt, Artificial Sequence
  Synthetic Oligonucleotide; PD-L1 exon 2; Set A
auuuggugucuuaccguucagcaaau

SEQ ID NO: 17189 - RNA, 24 nt, Artificial Sequence
  Synthetic Oligonucleotide; PD-L1 exon 2; Set A
uuuggugucuuaccguucagcaaa

SEQ ID NO: 17190 - RNA, 39 nt, Artificial Sequence
  Synthetic Oligonucleotide; PD-L1 exon 2; Set C
uggaaggauuuggugucuuaccguucagcaaaugccagu

SEQ ID NO: 17191 - RNA, 27 nt, Artificial Sequence
  Synthetic Oligonucleotide; PD-L1 exon 2; Set A
gauuuggugucuuaccguucagcaaau

SEQ ID NO: 17192 - RNA, 25 nt, Artificial Sequence
  Synthetic Oligonucleotide; PD-L1 exon 2; Set A
auuuggugucuuaccguucagcaaa

SEQ ID NO: 17193 - RNA, 26 nt, Artificial Sequence
  Synthetic Oligonucleotide; PD-L1 exon 2; Set A
gauuuggugucuuaccguucagcaaa

SEQ ID NO: 17194 - RNA, 24 nt, Artificial Sequence
  Synthetic Oligonucleotide; PD-L1 exon 2; Set A
auuuggugucuuaccguucagcaa

SEQ ID NO: 17195 - RNA, 25 nt, Artificial Sequence
  Synthetic Oligonucleotide; PD-L1 exon 2; Set A
gauuuggugucuuaccguucagcaa

SEQ ID NO: 17196 - RNA, 23 nt, Artificial Sequence
  Synthetic Oligonucleotide; PD-L1 exon 2; Set A
auuuggugucuuaccguucagca

SEQ ID NO: 17197 - RNA, 24 nt, Artificial Sequence
  Synthetic Oligonucleotide; PD-L1 exon 2; Set A
gauuuggugucuuaccguucagca

SEQ ID NO: 17198 - RNA, 17 nt, Artificial Sequence
  Synthetic Oligonucleotide; PD-L1 exon 2; Set C
uuggugucuuaccguuc

SEQ ID NO: 17199 - RNA, 18 nt, Artificial Sequence
  Synthetic Oligonucleotide; PD-L1 exon 2; Set C
uuuggugucuuaccguuc

SEQ ID NO: 17200 - RNA, 16 nt, Artificial Sequence
  Synthetic Oligonucleotide; PD-L1 exon 2; Set C
uuggugucuuaccguu

SEQ ID NO: 17201 - RNA, 32 nt, Artificial Sequence
  Synthetic Oligonucleotide; PD-L1 exon 2; Set A
ggaaggauuuggugucuuaccguucagcaaau

SEQ ID NO: 17202 - RNA, 19 nt, Artificial Sequence
  Synthetic Oligonucleotide; PD-L1 exon 2; Set C
auuuggugucuuaccguuc

SEQ ID NO: 17203 - RNA, 17 nt, Artificial Sequence
  Synthetic Oligonucleotide; PD-L1 exon 2; Set C
uuuggugucuuaccguu

SEQ ID NO: 17204 - RNA, 33 nt, Artificial Sequence
  Synthetic Oligonucleotide; PD-L1 exon 2; Set C
uggaaggauuuggugucuuaccguucagcaaau

SEQ ID NO: 17205 - RNA, 31 nt, Artificial Sequence
  Synthetic Oligonucleotide; PD-L1 exon 2; Set A
ggaaggauuuggugucuuaccguucagcaaa

SEQ ID NO: 17206 - RNA, 20 nt, Artificial Sequence
  Synthetic Oligonucleotide; PD-L1 exon 2; Set C
gauuuggugucuuaccguuc

SEQ ID NO: 17207 - RNA, 18 nt, Artificial Sequence
  Synthetic Oligonucleotide; PD-L1 exon 2; Set C
auuuggugucuuaccguu

SEQ ID NO: 17208 - RNA, 34 nt, Artificial Sequence
  Synthetic Oligonucleotide; PD-L1 exon 2; Set A
auggaaggauuuggugucuuaccguucagcaaau

SEQ ID NO: 17209 - RNA, 32 nt, Artificial Sequence
  Synthetic Oligonucleotide; PD-L1 exon 2; Set C
uggaaggauuuggugucuuaccguucagcaaa

SEQ ID NO: 17210 - RNA, 16 nt, Artificial Sequence
  Synthetic Oligonucleotide; PD-L1 exon 2; Set C
uuuggugucuuaccgu

SEQ ID NO: 17211 - RNA, 19 nt, Artificial Sequence
  Synthetic Oligonucleotide; PD-L1 exon 2; Set C
gauuuggugucuuaccguu

SEQ ID NO: 17212 - RNA, 17 nt, Artificial Sequence
  Synthetic Oligonucleotide; PD-L1 exon 2; Set C
auuuggugucuuaccgu

SEQ ID NO: 17213 - RNA, 15 nt, Artificial Sequence
  Synthetic Oligonucleotide; PD-L1 exon 2; Set C
uuuggugucuuaccg

SEQ ID NO: 17214 - RNA, 18 nt, Artificial Sequence
  Synthetic Oligonucleotide; PD-L1 exon 2; Set C
gauuuggugucuuaccgu

SEQ ID NO: 17215 - RNA, 16 nt, Artificial Sequence
  Synthetic Oligonucleotide; PD-L1 exon 2; Set C
auuuggugucuuaccg

SEQ ID NO: 17216 - RNA, 17 nt, Artificial Sequence
  Synthetic Oligonucleotide; PD-L1 exon 2; Set C
gauuuggugucuuaccg

SEQ ID NO: 17217 - RNA, 15 nt, Artificial Sequence
  Synthetic Oligonucleotide; PD-L1 exon 2; Set C
auuuggugucuuacc

SEQ ID NO: 17218 - RNA, 24 nt, Artificial Sequence
  Synthetic Oligonucleotide; PD-L1 exon 2; Set B
gaaggauuuggugucuuaccguuc

SEQ ID NO: 17219 - RNA, 16 nt, Artificial Sequence
  Synthetic Oligonucleotide; PD-L1 exon 2; Set C
gauuuggugucuuacc

SEQ ID NO: 17220 - RNA, 25 nt, Artificial Sequence
  Synthetic Oligonucleotide; PD-L1 exon 2; Set B
ggaaggauuuggugucuuaccguuc

SEQ ID NO: 17221 - RNA, 23 nt, Artificial Sequence
  Synthetic Oligonucleotide; PD-L1 exon 2; Set B
gaaggauuuggugucuuaccguu

SEQ ID NO: 17222 - RNA, 26 nt, Artificial Sequence
  Synthetic Oligonucleotide; PD-L1 exon 2; Set B
uggaaggauuuggugucuuaccguuc

SEQ ID NO: 17223 - RNA, 24 nt, Artificial Sequence
  Synthetic Oligonucleotide; PD-L1 exon 2; Set B
ggaaggauuuggugucuuaccguu

SEQ ID NO: 17224 - RNA, 25 nt, Artificial Sequence
  Synthetic Oligonucleotide; PD-L1 exon 2; Set B
uggaaggauuuggugucuuaccguu

SEQ ID NO: 17225 - RNA, 27 nt, Artificial Sequence
  Synthetic Oligonucleotide; PD-L1 exon 2; Set B
auggaaggauuuggugucuuaccguuc

SEQ ID NO: 17226 - RNA, 26 nt, Artificial Sequence
  Synthetic Oligonucleotide; PD-L1 exon 2; Set B
auggaaggauuuggugucuuaccguu

SEQ ID NO: 17227 - RNA, 28 nt, Artificial Sequence
  Synthetic Oligonucleotide; PD-L1 exon 2; Set B
aauggaaggauuuggugucuuaccguuc

SEQ ID NO: 17228 - RNA, 24 nt, Artificial Sequence
  Synthetic Oligonucleotide; PD-L1 exon 2; Set B
uggaaggauuuggugucuuaccgu

SEQ ID NO: 17229 - RNA, 27 nt, Artificial Sequence
  Synthetic Oligonucleotide; PD-L1 exon 2; Set B
aauggaaggauuuggugucuuaccguu

SEQ ID NO: 17230 - RNA, 29 nt, Artificial Sequence
  Synthetic Oligonucleotide; PD-L1 exon 2; Set B
uaauggaaggauuuggugucuuaccguuc

SEQ ID NO: 17231 - RNA, 23 nt, Artificial Sequence
  Synthetic Oligonucleotide; PD-L1 exon 2; Set B
uggaaggauuuggugucuuaccg

SEQ ID NO: 17232 - RNA, 28 nt, Artificial Sequence
  Synthetic Oligonucleotide; PD-L1 exon 2; Set B
uaauggaaggauuuggugucuuaccguu

SEQ ID NO: 17233 - RNA, 22 nt, Artificial Sequence
  Synthetic Oligonucleotide; PD-L1 exon 2; Set C
uggaaggauuuggugucuuacc

SEQ ID NO: 17234 - RNA, 20 nt, Artificial Sequence
  Synthetic Oligonucleotide; PD-L1 exon 2; Set C
uggaaggauuuggugucuua

SEQ ID NO: 17235 - RNA, 17 nt, Artificial Sequence
  Synthetic Oligonucleotide; PD-L1 exon 2; Set C
ggaaggauuuggugucu

SEQ ID NO: 17236 - RNA, 19 nt, Artificial Sequence
  Synthetic Oligonucleotide; PD-L1 exon 2; Set C
uggaaggauuuggugucuu

SEQ ID NO: 17237 - RNA, 16 nt, Artificial Sequence
  Synthetic Oligonucleotide; PD-L1 exon 2; Set C
ggaaggauuugguguc

SEQ ID NO: 17238 - RNA, 18 nt, Artificial Sequence
  Synthetic Oligonucleotide; PD-L1 exon 2; Set C
uggaaggauuuggugucu

SEQ ID NO: 17239 - RNA, 35 nt, Artificial Sequence
  Synthetic Oligonucleotide; PD-L1 exon 2; Set B
agaaccuaauggaaggauuuggugucuuaccguuc

SEQ ID NO: 17240 - RNA, 17 nt, Artificial Sequence
  Synthetic Oligonucleotide; PD-L1 exon 2; Set C
uggaaggauuugguguc

SEQ ID NO: 17241 - RNA, 19 nt, Artificial Sequence
  Synthetic Oligonucleotide; PD-L1 exon 2; Set C
auggaaggauuuggugucu

SEQ ID NO: 17242 - RNA, 34 nt, Artificial Sequence
  Synthetic Oligonucleotide; PD-L1 exon 2; Set B
agaaccuaauggaaggauuuggugucuuaccguu

SEQ ID NO: 17243 - RNA, 18 nt, Artificial Sequence
  Synthetic Oligonucleotide; PD-L1 exon 2; Set C
auggaaggauuugguguc

SEQ ID NO: 17244 - RNA, 20 nt, Artificial Sequence
  Synthetic Oligonucleotide; PD-L1 exon 2; Set C
aauggaaggauuuggugucu

SEQ ID NO: 17245 - RNA, 19 nt, Artificial Sequence
  Synthetic Oligonucleotide; PD-L1 exon 2; Set C
aauggaaggauuugguguc

SEQ ID NO: 17246 - RNA, 21 nt, Artificial Sequence
  Synthetic Oligonucleotide; PD-L1 exon 2; Set C
uaauggaaggauuuggugucu

SEQ ID NO: 17247 - RNA, 39 nt, Artificial Sequence
  Synthetic Oligonucleotide; PD-L1 exon 2; Set B
auauagaaccuaauggaaggauuuggugucuuaccguuc

SEQ ID NO: 17248 - RNA, 38 nt, Artificial Sequence
  Synthetic Oligonucleotide; PD-L1 exon 2; Set B
auauagaaccuaauggaaggauuuggugucuuaccguu

SEQ ID NO: 17249 - RNA, 27 nt, Artificial Sequence
  Synthetic Oligonucleotide; PD-L1 exon 2; Set B
agaaccuaauggaaggauuuggugucu

SEQ ID NO: 17250 - RNA, 26 nt, Artificial Sequence
  Synthetic Oligonucleotide; PD-L1 exon 2; Set C
agaaccuaauggaaggauuugguguc

SEQ ID NO: 17251 - RNA, 32 nt, Artificial Sequence
  Synthetic Oligonucleotide; PD-L1 exon 2; Set B
auauagaaccuaauggaaggauuuggugucuu

SEQ ID NO: 17252 - RNA, 31 nt, Artificial Sequence
  Synthetic Oligonucleotide; PD-L1 exon 2; Set B
auauagaaccuaauggaaggauuuggugucu

SEQ ID NO: 17253 - RNA, 30 nt, Artificial Sequence
  Synthetic Oligonucleotide; PD-L1 exon 2; Set B
auauagaaccuaauggaaggauuugguguc

SEQ ID NO: 17254 - RNA, 40 nt, Artificial Sequence
  Synthetic Oligonucleotide; PD-L1 exon 2; Set B
uuaaaauauagaaccuaauggaaggauuuggugucuuacc

SEQ ID NO: 17255 - RNA, 37 nt, Artificial Sequence
  Synthetic Oligonucleotide; PD-L1 exon 2; Set B
uaaaauauagaaccuaauggaaggauuuggugucuua

SEQ ID NO: 17256 - RNA, 20 nt, Artificial Sequence
  Synthetic Oligonucleotide; PD-L1 exon 2; Set C
agaaccuaauggaaggauuu

SEQ ID NO: 17257 - RNA, 36 nt, Artificial Sequence
  Synthetic Oligonucleotide; PD-L1 exon 2; Set B
uaaaauauagaaccuaauggaaggauuuggugucuu

SEQ ID NO: 17258 - RNA, 38 nt, Artificial Sequence
  Synthetic Oligonucleotide; PD-L1 exon 2; Set B
uuaaaauauagaaccuaauggaaggauuuggugucuua

SEQ ID NO: 17259 - RNA, 19 nt, Artificial Sequence
  Synthetic Oligonucleotide; PD-L1 exon 2; Set C
agaaccuaauggaaggauu

SEQ ID NO: 17260 - RNA, 35 nt, Artificial Sequence
  Synthetic Oligonucleotide; PD-L1 exon 2; Set B
uaaaauauagaaccuaauggaaggauuuggugucu

SEQ ID NO: 17261 - RNA, 37 nt, Artificial Sequence
  Synthetic Oligonucleotide; PD-L1 exon 2; Set B
uuaaaauauagaaccuaauggaaggauuuggugucuu

SEQ ID NO: 17262 - RNA, 39 nt, Artificial Sequence
  Synthetic Oligonucleotide; PD-L1 exon 2; Set B
uuuaaaauauagaaccuaauggaaggauuuggugucuua

SEQ ID NO: 17263 - RNA, 18 nt, Artificial Sequence
  Synthetic Oligonucleotide; PD-L1 exon 2; Set C
agaaccuaauggaaggau

SEQ ID NO: 17264 - RNA, 34 nt, Artificial Sequence
  Synthetic Oligonucleotide; PD-L1 exon 2; Set C
uaaaauauagaaccuaauggaaggauuugguguc

SEQ ID NO: 17265 - RNA, 36 nt, Artificial Sequence
  Synthetic Oligonucleotide; PD-L1 exon 2; Set B
uuaaaauauagaaccuaauggaaggauuuggugucu

SEQ ID NO: 17266 - RNA, 38 nt, Artificial Sequence
  Synthetic Oligonucleotide; PD-L1 exon 2; Set B
uuuaaaauauagaaccuaauggaaggauuuggugucuu

SEQ ID NO: 17267 - RNA, 35 nt, Artificial Sequence
  Synthetic Oligonucleotide; PD-L1 exon 2; Set C
uuaaaauauagaaccuaauggaaggauuugguguc

SEQ ID NO: 17268 - RNA, 37 nt, Artificial Sequence
  Synthetic Oligonucleotide; PD-L1 exon 2; Set B
uuuaaaauauagaaccuaauggaaggauuuggugucu

SEQ ID NO: 17269 - RNA, 39 nt, Artificial Sequence
  Synthetic Oligonucleotide; PD-L1 exon 2; Set B
auuuaaaauauagaaccuaauggaaggauuuggugucuu

SEQ ID NO: 17270 - RNA, 24 nt, Artificial Sequence
  Synthetic Oligonucleotide; PD-L1 exon 2; Set C
auauagaaccuaauggaaggauuu

SEQ ID NO: 17271 - RNA, 36 nt, Artificial Sequence
  Synthetic Oligonucleotide; PD-L1 exon 2; Set C
uuuaaaauauagaaccuaauggaaggauuugguguc

SEQ ID NO: 17272 - RNA, 38 nt, Artificial Sequence
  Synthetic Oligonucleotide; PD-L1 exon 2; Set B
auuuaaaauauagaaccuaauggaaggauuuggugucu

SEQ ID NO: 17273 - RNA, 40 nt, Artificial Sequence
  Synthetic Oligonucleotide; PD-L1 exon 2; Set B
uauuuaaaauauagaaccuaauggaaggauuuggugucuu

SEQ ID NO: 17274 - RNA, 23 nt, Artificial Sequence
  Synthetic Oligonucleotide; PD-L1 exon 2; Set C
auauagaaccuaauggaaggauu

SEQ ID NO: 17275 - RNA, 37 nt, Artificial Sequence
  Synthetic Oligonucleotide; PD-L1 exon 2; Set C
auuuaaaauauagaaccuaauggaaggauuugguguc

SEQ ID NO: 17276 - RNA, 39 nt, Artificial Sequence
  Synthetic Oligonucleotide; PD-L1 exon 2; Set B
uauuuaaaauauagaaccuaauggaaggauuuggugucu

SEQ ID NO: 17277 - RNA, 22 nt, Artificial Sequence
  Synthetic Oligonucleotide; PD-L1 exon 2; Set C
auauagaaccuaauggaaggau

SEQ ID NO: 17278 - RNA, 38 nt, Artificial Sequence
  Synthetic Oligonucleotide; PD-L1 exon 2; Set B
uauuuaaaauauagaaccuaauggaaggauuugguguc

SEQ ID NO: 17279 - RNA, 40 nt, Artificial Sequence
  Synthetic Oligonucleotide; PD-L1 exon 2; Set B
auauuuaaaauauagaaccuaauggaaggauuuggugucu

SEQ ID NO: 17280 - RNA, 39 nt, Artificial Sequence
  Synthetic Oligonucleotide; PD-L1 exon 2; Set B
auauuuaaaauauagaaccuaauggaaggauuugguguc

SEQ ID NO: 17281 - RNA, 29 nt, Artificial Sequence
  Synthetic Oligonucleotide; PD-L1 exon 2; Set C
uaaaauauagaaccuaauggaaggauuug

SEQ ID NO: 17282 - RNA, 28 nt, Artificial Sequence
  Synthetic Oligonucleotide; PD-L1 exon 2; Set C
uaaaauauagaaccuaauggaaggauuu

SEQ ID NO: 17283 - RNA, 40 nt, Artificial Sequence
  Synthetic Oligonucleotide; PD-L1 exon 2; Set C
aauauuuaaaauauagaaccuaauggaaggauuugguguc

SEQ ID NO: 17284 - RNA, 30 nt, Artificial Sequence
  Synthetic Oligonucleotide; PD-L1 exon 2; Set C
uuaaaauauagaaccuaauggaaggauuug

SEQ ID NO: 17285 - RNA, 27 nt, Artificial Sequence
  Synthetic Oligonucleotide; PD-L1 exon 2; Set C
uaaaauauagaaccuaauggaaggauu

SEQ ID NO: 17286 - RNA, 29 nt, Artificial Sequence
  Synthetic Oligonucleotide; PD-L1 exon 2; Set C
uuaaaauauagaaccuaauggaaggauuu

SEQ ID NO: 17287 - RNA, 31 nt, Artificial Sequence
  Synthetic Oligonucleotide; PD-L1 exon 2; Set C
uuuaaaauauagaaccuaauggaaggauuug

SEQ ID NO: 17288 - RNA, 28 nt, Artificial Sequence
  Synthetic Oligonucleotide; PD-L1 exon 2; Set C
uuaaaauauagaaccuaauggaaggauu

SEQ ID NO: 17289 - RNA, 26 nt, Artificial Sequence
  Synthetic Oligonucleotide; PD-L1 exon 2; Set C
uaaaauauagaaccuaauggaaggau

SEQ ID NO: 17290 - RNA, 30 nt, Artificial Sequence
  Synthetic Oligonucleotide; PD-L1 exon 2; Set C
uuuaaaauauagaaccuaauggaaggauuu

SEQ ID NO: 17291 - RNA, 32 nt, Artificial Sequence
  Synthetic Oligonucleotide; PD-L1 exon 2; Set C
auuuaaaauauagaaccuaauggaaggauuug

SEQ ID NO: 17292 - RNA, 27 nt, Artificial Sequence
  Synthetic Oligonucleotide; PD-L1 exon 2; Set C
uuaaaauauagaaccuaauggaaggau

SEQ ID NO: 17293 - RNA, 29 nt, Artificial Sequence
  Synthetic Oligonucleotide; PD-L1 exon 2; Set C
uuuaaaauauagaaccuaauggaaggauu

SEQ ID NO: 17294 - RNA, 31 nt, Artificial Sequence
  Synthetic Oligonucleotide; PD-L1 exon 2; Set C
auuuaaaauauagaaccuaauggaaggauuu

SEQ ID NO: 17295 - RNA, 17 nt, Artificial Sequence
  Synthetic Oligonucleotide; PD-L1 exon 2; Set C
auauagaaccuaaugga

SEQ ID NO: 17296 - RNA, 33 nt, Artificial Sequence
  Synthetic Oligonucleotide; PD-L1 exon 2; Set C
uauuuaaaauauagaaccuaauggaaggauuug

SEQ ID NO: 17297 - RNA, 28 nt, Artificial Sequence
  Synthetic Oligonucleotide; PD-L1 exon 2; Set C
uuuaaaauauagaaccuaauggaaggau

SEQ ID NO: 17298 - RNA, 30 nt, Artificial Sequence
  Synthetic Oligonucleotide; PD-L1 exon 2; Set C
auuuaaaauauagaaccuaauggaaggauu

SEQ ID NO: 17299 - RNA, 32 nt, Artificial Sequence
  Synthetic Oligonucleotide; PD-L1 exon 2; Set C
uauuuaaaauauagaaccuaauggaaggauuu

SEQ ID NO: 17300 - RNA, 16 nt, Artificial Sequence
  Synthetic Oligonucleotide; PD-L1 exon 2; Set C
auauagaaccuaaugg

SEQ ID NO: 17301 - RNA, 34 nt, Artificial Sequence
  Synthetic Oligonucleotide; PD-L1 exon 2; Set C
auauuuaaaauauagaaccuaauggaaggauuug

SEQ ID NO: 17302 - RNA, 29 nt, Artificial Sequence
  Synthetic Oligonucleotide; PD-L1 exon 2; Set C
auuuaaaauauagaaccuaauggaaggau

SEQ ID NO: 17303 - RNA, 31 nt, Artificial Sequence
  Synthetic Oligonucleotide; PD-L1 exon 2; Set C
uauuuaaaauauagaaccuaauggaaggauu

SEQ ID NO: 17304 - RNA, 33 nt, Artificial Sequence
  Synthetic Oligonucleotide; PD-L1 exon 2; Set C
auauuuaaaauauagaaccuaauggaaggauuu

SEQ ID NO: 17305 - RNA, 35 nt, Artificial Sequence
  Synthetic Oligonucleotide; PD-L1 exon 2; Set C
aauauuuaaaauauagaaccuaauggaaggauuug

SEQ ID NO: 17306 - RNA, 32 nt, Artificial Sequence
  Synthetic Oligonucleotide; PD-L1 exon 2; Set C
auauuuaaaauauagaaccuaauggaaggauu

SEQ ID NO: 17307 - RNA, 30 nt, Artificial Sequence
  Synthetic Oligonucleotide; PD-L1 exon 2; Set C
uauuuaaaauauagaaccuaauggaaggau

SEQ ID NO: 17308 - RNA, 34 nt, Artificial Sequence
  Synthetic Oligonucleotide; PD-L1 exon 2; Set C
aauauuuaaaauauagaaccuaauggaaggauuu

SEQ ID NO: 17309 - RNA, 36 nt, Artificial Sequence
  Synthetic Oligonucleotide; PD-L1 exon 2; Set C
aaauauuuaaaauauagaaccuaauggaaggauuug

SEQ ID NO: 17310 - RNA, 33 nt, Artificial Sequence
  Synthetic Oligonucleotide; PD-L1 exon 2; Set C
aauauuuaaaauauagaaccuaauggaaggauu

SEQ ID NO: 17311 - RNA, 31 nt, Artificial Sequence
  Synthetic Oligonucleotide; PD-L1 exon 2; Set C
auauuuaaaauauagaaccuaauggaaggau

SEQ ID NO: 17312 - RNA, 35 nt, Artificial Sequence
  Synthetic Oligonucleotide; PD-L1 exon 2; Set C
aaauauuuaaaauauagaaccuaauggaaggauuu

SEQ ID NO: 17313 - RNA, 21 nt, Artificial Sequence
  Synthetic Oligonucleotide; PD-L1 exon 2; Set C
uaaaauauagaaccuaaugga

SEQ ID NO: 17314 - RNA, 37 nt, Artificial Sequence
  Synthetic Oligonucleotide; PD-L1 exon 2; Set C
aaaauauuuaaaauauagaaccuaauggaaggauuug

SEQ ID NO: 17315 - RNA, 34 nt, Artificial Sequence
  Synthetic Oligonucleotide; PD-L1 exon 2; Set C
aaauauuuaaaauauagaaccuaauggaaggauu

SEQ ID NO: 17316 - RNA, 32 nt, Artificial Sequence
  Synthetic Oligonucleotide; PD-L1 exon 2; Set C
aauauuuaaaauauagaaccuaauggaaggau

SEQ ID NO: 17317 - RNA, 36 nt, Artificial Sequence
  Synthetic Oligonucleotide; PD-L1 exon 2; Set C
aaaauauuuaaaauauagaaccuaauggaaggauuu

SEQ ID NO: 17318 - RNA, 20 nt, Artificial Sequence
  Synthetic Oligonucleotide; PD-L1 exon 2; Set C
uaaaauauagaaccuaaugg

SEQ ID NO: 17319 - RNA, 22 nt, Artificial Sequence
  Synthetic Oligonucleotide; PD-L1 exon 2; Set C
uuaaaauauagaaccuaaugga

SEQ ID NO: 17320 - RNA, 38 nt, Artificial Sequence
  Synthetic Oligonucleotide; PD-L1 exon 2; Set C
uaaaauauuuaaaauauagaaccuaauggaaggauuug

SEQ ID NO: 17321 - RNA, 35 nt, Artificial Sequence
  Synthetic Oligonucleotide; PD-L1 exon 2; Set C
aaaauauuuaaaauauagaaccuaauggaaggauu

SEQ ID NO: 17322 - RNA, 33 nt, Artificial Sequence
  Synthetic Oligonucleotide; PD-L1 exon 2; Set C
aaauauuuaaaauauagaaccuaauggaaggau

SEQ ID NO: 17323 - RNA, 37 nt, Artificial Sequence
  Synthetic Oligonucleotide; PD-L1 exon 2; Set C
uaaaauauuuaaaauauagaaccuaauggaaggauuu

SEQ ID NO: 17324 - RNA, 21 nt, Artificial Sequence
  Synthetic Oligonucleotide; PD-L1 exon 2; Set C
uuaaaauauagaaccuaaugg

SEQ ID NO: 17325 - RNA, 23 nt, Artificial Sequence
  Synthetic Oligonucleotide; PD-L1 exon 2; Set C
uuuaaaauauagaaccuaaugga

SEQ ID NO: 17326 - RNA, 19 nt, Artificial Sequence
  Synthetic Oligonucleotide; PD-L1 exon 2; Set C
uaaaauauagaaccuaaug

SEQ ID NO: 17327 - RNA, 39 nt, Artificial Sequence
  Synthetic Oligonucleotide; PD-L1 exon 2; Set C
uuaaaauauuuaaaauauagaaccuaauggaaggauuug

SEQ ID NO: 17328 - RNA, 36 nt, Artificial Sequence
  Synthetic Oligonucleotide; PD-L1 exon 2; Set C
uaaaauauuuaaaauauagaaccuaauggaaggauu

SEQ ID NO: 17329 - RNA, 34 nt, Artificial Sequence
  Synthetic Oligonucleotide; PD-L1 exon 2; Set C
aaaauauuuaaaauauagaaccuaauggaaggau

SEQ ID NO: 17330 - RNA, 38 nt, Artificial Sequence
  Synthetic Oligonucleotide; PD-L1 exon 2; Set C
uuaaaauauuuaaaauauagaaccuaauggaaggauuu

SEQ ID NO: 17331 - RNA, 22 nt, Artificial Sequence
  Synthetic Oligonucleotide; PD-L1 exon 2; Set C
uuuaaaauauagaaccuaaugg

SEQ ID NO: 17332 - RNA, 24 nt, Artificial Sequence
  Synthetic Oligonucleotide; PD-L1 exon 2; Set C
auuuaaaauauagaaccuaaugga

SEQ ID NO: 17333 - RNA, 20 nt, Artificial Sequence
  Synthetic Oligonucleotide; PD-L1 exon 2; Set C
uuaaaauauagaaccuaaug

SEQ ID NO: 17334 - RNA, 40 nt, Artificial Sequence
  Synthetic Oligonucleotide; PD-L1 exon 2; Set C
guuaaaauauuuaaaauauagaaccuaauggaaggauuug

SEQ ID NO: 17335 - RNA, 37 nt, Artificial Sequence
  Synthetic Oligonucleotide; PD-L1 exon 2; Set C
uuaaaauauuuaaaauauagaaccuaauggaaggauu

SEQ ID NO: 17336 - RNA, 35 nt, Artificial Sequence
  Synthetic Oligonucleotide; PD-L1 exon 2; Set C
uaaaauauuuaaaauauagaaccuaauggaaggau

SEQ ID NO: 17337 - RNA, 39 nt, Artificial Sequence
  Synthetic Oligonucleotide; PD-L1 exon 2; Set C
guuaaaauauuuaaaauauagaaccuaauggaaggauuu

SEQ ID NO: 17338 - RNA, 23 nt, Artificial Sequence
  Synthetic Oligonucleotide; PD-L1 exon 2; Set C
auuuaaaauauagaaccuaaugg

SEQ ID NO: 17339 - RNA, 25 nt, Artificial Sequence
  Synthetic Oligonucleotide; PD-L1 exon 2; Set C
uauuuaaaauauagaaccuaaugga

SEQ ID NO: 17340 - RNA, 21 nt, Artificial Sequence
  Synthetic Oligonucleotide; PD-L1 exon 2; Set C
uuuaaaauauagaaccuaaug

SEQ ID NO: 17341 - RNA, 19 nt, Artificial Sequence
  Synthetic Oligonucleotide; PD-L1 exon 2; Set C
uuaaaauauagaaccuaau

SEQ ID NO: 17342 - RNA, 38 nt, Artificial Sequence
  Synthetic Oligonucleotide; PD-L1 exon 2; Set C
guuaaaauauuuaaaauauagaaccuaauggaaggauu

SEQ ID NO: 17343 - RNA, 36 nt, Artificial Sequence
  Synthetic Oligonucleotide; PD-L1 exon 2; Set C
uuaaaauauuuaaaauauagaaccuaauggaaggau

SEQ ID NO: 17344 - RNA, 24 nt, Artificial Sequence
  Synthetic Oligonucleotide; PD-L1 exon 2; Set C
uauuuaaaauauagaaccuaaugg

SEQ ID NO: 17345 - RNA, 26 nt, Artificial Sequence
  Synthetic Oligonucleotide; PD-L1 exon 2; Set C
auauuuaaaauauagaaccuaaugga

SEQ ID NO: 17346 - RNA, 22 nt, Artificial Sequence
  Synthetic Oligonucleotide; PD-L1 exon 2; Set C
auuuaaaauauagaaccuaaug

SEQ ID NO: 17347 - RNA, 37 nt, Artificial Sequence
  Synthetic Oligonucleotide; PD-L1 exon 2; Set C
guuaaaauauuuaaaauauagaaccuaauggaaggau

SEQ ID NO: 17348 - RNA, 25 nt, Artificial Sequence
  Synthetic Oligonucleotide; PD-L1 exon 2; Set C
auauuuaaaauauagaaccuaaugg

SEQ ID NO: 17349 - RNA, 27 nt, Artificial Sequence
  Synthetic Oligonucleotide; PD-L1 exon 2; Set C
aauauuuaaaauauagaaccuaaugga

SEQ ID NO: 17350 - RNA, 23 nt, Artificial Sequence
  Synthetic Oligonucleotide; PD-L1 exon 2; Set C
uauuuaaaauauagaaccuaaug

SEQ ID NO: 17351 - RNA, 26 nt, Artificial Sequence
  Synthetic Oligonucleotide; PD-L1 exon 2; Set C
aauauuuaaaauauagaaccuaaugg

SEQ ID NO: 17352 - RNA, 28 nt, Artificial Sequence
  Synthetic Oligonucleotide; PD-L1 exon 2; Set C
aaauauuuaaaauauagaaccuaaugga

SEQ ID NO: 17353 - RNA, 24 nt, Artificial Sequence
  Synthetic Oligonucleotide; PD-L1 exon 2; Set C
auauuuaaaauauagaaccuaaug

SEQ ID NO: 17354 - RNA, 30 nt, Artificial Sequence
  Synthetic Oligonucleotide; PD-L1 exon 2; Set C
aaaauauuuaaaauauagaaccuaauggaa

SEQ ID NO: 17355 - RNA, 27 nt, Artificial Sequence
  Synthetic Oligonucleotide; PD-L1 exon 2; Set C
aaauauuuaaaauauagaaccuaaugg

SEQ ID NO: 17356 - RNA, 29 nt, Artificial Sequence
  Synthetic Oligonucleotide; PD-L1 exon 2; Set C
aaaauauuuaaaauauagaaccuaaugga

SEQ ID NO: 17357 - RNA, 25 nt, Artificial Sequence
  Synthetic Oligonucleotide; PD-L1 exon 2; Set C
aauauuuaaaauauagaaccuaaug

SEQ ID NO: 17358 - RNA, 31 nt, Artificial Sequence
  Synthetic Oligonucleotide; PD-L1 exon 2; Set C
uaaaauauuuaaaauauagaaccuaauggaa

SEQ ID NO: 17359 - RNA, 28 nt, Artificial Sequence
  Synthetic Oligonucleotide; PD-L1 exon 2; Set C
aaaauauuuaaaauauagaaccuaaugg

SEQ ID NO: 17360 - RNA, 30 nt, Artificial Sequence
  Synthetic Oligonucleotide; PD-L1 exon 2; Set C
uaaaauauuuaaaauauagaaccuaaugga

SEQ ID NO: 17361 - RNA, 26 nt, Artificial Sequence
  Synthetic Oligonucleotide; PD-L1 exon 2; Set C
aaauauuuaaaauauagaaccuaaug

SEQ ID NO: 17362 - RNA, 24 nt, Artificial Sequence
  Synthetic Oligonucleotide; PD-L1 exon 2; Set C
aauauuuaaaauauagaaccuaau

SEQ ID NO: 17363 - RNA, 32 nt, Artificial Sequence
  Synthetic Oligonucleotide; PD-L1 exon 2; Set C
uuaaaauauuuaaaauauagaaccuaauggaa

SEQ ID NO: 17364 - RNA, 29 nt, Artificial Sequence
  Synthetic Oligonucleotide; PD-L1 exon 2; Set C
uaaaauauuuaaaauauagaaccuaaugg

SEQ ID NO: 17365 - RNA, 31 nt, Artificial Sequence
  Synthetic Oligonucleotide; PD-L1 exon 2; Set C
uuaaaauauuuaaaauauagaaccuaaugga

SEQ ID NO: 17366 - RNA, 27 nt, Artificial Sequence
  Synthetic Oligonucleotide; PD-L1 exon 2; Set C
aaaauauuuaaaauauagaaccuaaug

SEQ ID NO: 17367 - RNA, 25 nt, Artificial Sequence
  Synthetic Oligonucleotide; PD-L1 exon 2; Set C
aaauauuuaaaauauagaaccuaau

SEQ ID NO: 17368 - RNA, 33 nt, Artificial Sequence
  Synthetic Oligonucleotide; PD-L1 exon 2; Set C
guuaaaauauuuaaaauauagaaccuaauggaa

SEQ ID NO: 17369 - RNA, 30 nt, Artificial Sequence
  Synthetic Oligonucleotide; PD-L1 exon 2; Set C
uuaaaauauuuaaaauauagaaccuaaugg

SEQ ID NO: 17370 - RNA, 32 nt, Artificial Sequence
  Synthetic Oligonucleotide; PD-L1 exon 2; Set C
guuaaaauauuuaaaauauagaaccuaaugga

SEQ ID NO: 17371 - RNA, 28 nt, Artificial Sequence
  Synthetic Oligonucleotide; PD-L1 exon 2; Set C
uaaaauauuuaaaauauagaaccuaaug

SEQ ID NO: 17372 - RNA, 26 nt, Artificial Sequence
  Synthetic Oligonucleotide; PD-L1 exon 2; Set C
aaaauauuuaaaauauagaaccuaau

SEQ ID NO: 17373 - RNA, 24 nt, Artificial Sequence
  Synthetic Oligonucleotide; PD-L1 exon 2; Set C
aaauauuuaaaauauagaaccuaa

SEQ ID NO: 17374 - RNA, 31 nt, Artificial Sequence
  Synthetic Oligonucleotide; PD-L1 exon 2; Set C
guuaaaauauuuaaaauauagaaccuaaugg

SEQ ID NO: 17375 - RNA, 29 nt, Artificial Sequence
  Synthetic Oligonucleotide; PD-L1 exon 2; Set C
uuaaaauauuuaaaauauagaaccuaaug

SEQ ID NO: 17376 - RNA, 27 nt, Artificial Sequence
  Synthetic Oligonucleotide; PD-L1 exon 2; Set C
uaaaauauuuaaaauauagaaccuaau

SEQ ID NO: 17377 - RNA, 25 nt, Artificial Sequence
  Synthetic Oligonucleotide; PD-L1 exon 2; Set C
aaaauauuuaaaauauagaaccuaa

SEQ ID NO: 17378 - RNA, 30 nt, Artificial Sequence
  Synthetic Oligonucleotide; PD-L1 exon 2; Set C
guuaaaauauuuaaaauauagaaccuaaug

SEQ ID NO: 17379 - RNA, 28 nt, Artificial Sequence
  Synthetic Oligonucleotide; PD-L1 exon 2; Set C
uuaaaauauuuaaaauauagaaccuaau

SEQ ID NO: 17380 - RNA, 26 nt, Artificial Sequence
  Synthetic Oligonucleotide; PD-L1 exon 2; Set C
uaaaauauuuaaaauauagaaccuaa

SEQ ID NO: 17381 - RNA, 15 nt, Artificial Sequence
  Synthetic Oligonucleotide; PD-L1 exon 2; Set C
uauuuaaaauauaga

SEQ ID NO: 17382 - RNA, 29 nt, Artificial Sequence
  Synthetic Oligonucleotide; PD-L1 exon 2; Set C
guuaaaauauuuaaaauauagaaccuaau

SEQ ID NO: 17383 - RNA, 27 nt, Artificial Sequence
  Synthetic Oligonucleotide; PD-L1 exon 2; Set C
uuaaaauauuuaaaauauagaaccuaa

SEQ ID NO: 17384 - RNA, 16 nt, Artificial Sequence
  Synthetic Oligonucleotide; PD-L1 exon 2; Set C
auauuuaaaauauaga

SEQ ID NO: 17385 - RNA, 28 nt, Artificial Sequence
  Synthetic Oligonucleotide; PD-L1 exon 2; Set C
guuaaaauauuuaaaauauagaaccuaa

SEQ ID NO: 17386 - RNA, 17 nt, Artificial Sequence
  Synthetic Oligonucleotide; PD-L1 exon 2; Set C
aauauuuaaaauauaga

SEQ ID NO: 17387 - RNA, 18 nt, Artificial Sequence
  Synthetic Oligonucleotide; PD-L1 exon 2; Set C
aaauauuuaaaauauaga

SEQ ID NO: 17388 - RNA, 19 nt, Artificial Sequence
  Synthetic Oligonucleotide; PD-L1 exon 2; Set C
aaaauauuuaaaauauaga

SEQ ID NO: 17389 - RNA, 20 nt, Artificial Sequence
  Synthetic Oligonucleotide; PD-L1 exon 2; Set C
uaaaauauuuaaaauauaga

SEQ ID NO: 17390 - RNA, 21 nt, Artificial Sequence
  Synthetic Oligonucleotide; PD-L1 exon 2; Set C
uuaaaauauuuaaaauauaga

SEQ ID NO: 17391 - RNA, 22 nt, Artificial Sequence
  Synthetic Oligonucleotide; PD-L1 exon 2; Set C
guuaaaauauuuaaaauauaga

SEQ ID NO: 17392 - RNA, 15 nt, Artificial Sequence
  Synthetic Oligonucleotide; PD-L1 exon 2; Set C
aaaauauuuaaaaua

SEQ ID NO: 17393 - RNA, 16 nt, Artificial Sequence
  Synthetic Oligonucleotide; PD-L1 exon 2; Set C
uaaaauauuuaaaaua

SEQ ID NO: 17394 - RNA, 17 nt, Artificial Sequence
  Synthetic Oligonucleotide; PD-L1 exon 2; Set C
uuaaaauauuuaaaaua

SEQ ID NO: 17395 - RNA, 15 nt, Artificial Sequence
  Synthetic Oligonucleotide; PD-L1 exon 2; Set C
uaaaauauuuaaaau

SEQ ID NO: 17396 - RNA, 18 nt, Artificial Sequence
  Synthetic Oligonucleotide; PD-L1 exon 2; Set C
guuaaaauauuuaaaaua

SEQ ID NO: 17397 - RNA, 16 nt, Artificial Sequence
  Synthetic Oligonucleotide; PD-L1 exon 2; Set C
uuaaaauauuuaaaau

SEQ ID NO: 17398 - RNA, 17 nt, Artificial Sequence
  Synthetic Oligonucleotide; PD-L1 exon 2; Set C
guuaaaauauuuaaaau

SEQ ID NO: 17399 - RNA, 15 nt, Artificial Sequence
  Synthetic Oligonucleotide; PD-L1 exon 2; Set C
uuaaaauauuuaaaa

SEQ ID NO: 17400 - RNA, 16 nt, Artificial Sequence
  Synthetic Oligonucleotide; PD-L1 exon 2; Set C
guuaaaauauuuaaaa

SEQ ID NO: 17401 - RNA, 15 nt, Artificial Sequence
  Synthetic Oligonucleotide; PD-L1 exon 2; Set C
guuaaaauauuuaaa

SEQ ID NO: 17402 - RNA, 15 nt, Artificial Sequence
  Synthetic Oligonucleotide; PD-L1 exon 2; Set C
cuuaauaauuaaaca

SEQ ID NO: 17403 - RNA, 19 nt, Artificial Sequence
  Synthetic Oligonucleotide; PD-L1 exon 2; Set C
gcuucacuuaauaauuaaa

SEQ ID NO: 17404 - RNA, 18 nt, Artificial Sequence
  Synthetic Oligonucleotide; PD-L1 exon 2; Set C
gcuucacuuaauaauuaa

SEQ ID NO: 17405 - RNA, 17 nt, Artificial Sequence
  Synthetic Oligonucleotide; PD-L1 exon 2; Set C
gcuucacuuaauaauua

SEQ ID NO: 17406 - RNA, 16 nt, Artificial Sequence
  Synthetic Oligonucleotide; PD-L1 exon 2; Set C
gcuucacuuaauaauu

SEQ ID NO: 17407 - RNA, 15 nt, Artificial Sequence
  Synthetic Oligonucleotide; PD-L1 exon 2; Set C
gcuucacuuaauaau

SEQ ID NO: 17408 - RNA, 16 nt, Artificial Sequence
  Synthetic Oligonucleotide; PD-L1 exon 2; Set C
uauggaaaacacgaaa

SEQ ID NO: 17409 - RNA, 17 nt, Artificial Sequence
  Synthetic Oligonucleotide; PD-L1 exon 2; Set C
uuauggaaaacacgaaa

SEQ ID NO: 17410 - RNA, 18 nt, Artificial Sequence
  Synthetic Oligonucleotide; PD-L1 exon 2; Set C
auuauggaaaacacgaaa

SEQ ID NO: 17411 - RNA, 16 nt, Artificial Sequence
  Synthetic Oligonucleotide; PD-L1 exon 2; Set C
uuauggaaaacacgaa

SEQ ID NO: 17412 - RNA, 17 nt, Artificial Sequence
  Synthetic Oligonucleotide; PD-L1 exon 2; Set C
auuauggaaaacacgaa

SEQ ID NO: 17413 - RNA, 30 nt, Artificial Sequence
  Synthetic Oligonucleotide; PD-L1 exon 2; Set A
uggaaugcccuaauuauggaaaacacgaaa

SEQ ID NO: 17414 - RNA, 31 nt, Artificial Sequence
  Synthetic Oligonucleotide; PD-L1 exon 2; Set A
cuggaaugcccuaauuauggaaaacacgaaa

SEQ ID NO: 17415 - RNA, 29 nt, Artificial Sequence
  Synthetic Oligonucleotide; PD-L1 exon 2; Set A
uggaaugcccuaauuauggaaaacacgaa

SEQ ID NO: 17416 - RNA, 30 nt, Artificial Sequence
  Synthetic Oligonucleotide; PD-L1 exon 2; Set A
cuggaaugcccuaauuauggaaaacacgaa

SEQ ID NO: 17417 - RNA, 32 nt, Artificial Sequence
  Synthetic Oligonucleotide; PD-L1 exon 2; Set A
ucuggaaugcccuaauuauggaaaacacgaaa

SEQ ID NO: 17418 - RNA, 31 nt, Artificial Sequence
  Synthetic Oligonucleotide; PD-L1 exon 2; Set A
ucuggaaugcccuaauuauggaaaacacgaa

SEQ ID NO: 17419 - RNA, 33 nt, Artificial Sequence
  Synthetic Oligonucleotide; PD-L1 exon 2; Set A
uucuggaaugcccuaauuauggaaaacacgaaa

SEQ ID NO: 17420 - RNA, 34 nt, Artificial Sequence
  Synthetic Oligonucleotide; PD-L1 exon 2; Set A
uuucuggaaugcccuaauuauggaaaacacgaaa

SEQ ID NO: 17421 - RNA, 32 nt, Artificial Sequence
  Synthetic Oligonucleotide; PD-L1 exon 2; Set A
uucuggaaugcccuaauuauggaaaacacgaa

SEQ ID NO: 17422 - RNA, 35 nt, Artificial Sequence
  Synthetic Oligonucleotide; PD-L1 exon 2; Set A
cuuucuggaaugcccuaauuauggaaaacacgaaa

SEQ ID NO: 17423 - RNA, 33 nt, Artificial Sequence
  Synthetic Oligonucleotide; PD-L1 exon 2; Set A
uuucuggaaugcccuaauuauggaaaacacgaa

SEQ ID NO: 17424 - RNA, 34 nt, Artificial Sequence
  Synthetic Oligonucleotide; PD-L1 exon 2; Set A
cuuucuggaaugcccuaauuauggaaaacacgaa

SEQ ID NO: 17425 - RNA, 22 nt, Artificial Sequence
  Synthetic Oligonucleotide; PD-L1 exon 2; Set C
uggaaugcccuaauuauggaaa

SEQ ID NO: 17426 - RNA, 23 nt, Artificial Sequence
  Synthetic Oligonucleotide; PD-L1 exon 2; Set C
cuggaaugcccuaauuauggaaa

SEQ ID NO: 17427 - RNA, 24 nt, Artificial Sequence
  Synthetic Oligonucleotide; PD-L1 exon 2; Set C
ucuggaaugcccuaauuauggaaa

SEQ ID NO: 17428 - RNA, 25 nt, Artificial Sequence
  Synthetic Oligonucleotide; PD-L1 exon 2; Set C
uucuggaaugcccuaauuauggaaa

SEQ ID NO: 17429 - RNA, 16 nt, Artificial Sequence
  Synthetic Oligonucleotide; PD-L1 exon 2; Set C
ggaaugcccuaauuau

SEQ ID NO: 17430 - RNA, 26 nt, Artificial Sequence
  Synthetic Oligonucleotide; PD-L1 exon 2; Set C
uuucuggaaugcccuaauuauggaaa

SEQ ID NO: 17431 - RNA, 15 nt, Artificial Sequence
  Synthetic Oligonucleotide; PD-L1 exon 2; Set C
ggaaugcccuaauua

SEQ ID NO: 17432 - RNA, 27 nt, Artificial Sequence
  Synthetic Oligonucleotide; PD-L1 exon 2; Set C
cuuucuggaaugcccuaauuauggaaa

SEQ ID NO: 17433 - RNA, 15 nt, Artificial Sequence
  Synthetic Oligonucleotide; PD-L1 exon 2; Set C
cuggaaugcccuaau

SEQ ID NO: 17434 - RNA, 16 nt, Artificial Sequence
  Synthetic Oligonucleotide; PD-L1 exon 2; Set C
ucuggaaugcccuaau

SEQ ID NO: 17435 - RNA, 23 nt, Artificial Sequence
  Synthetic Oligonucleotide; PD-L1 exon 2; Set C
ucuuucuggaaugcccuaauuau

SEQ ID NO: 17436 - RNA, 17 nt, Artificial Sequence
  Synthetic Oligonucleotide; PD-L1 exon 2; Set C
uucuggaaugcccuaau

SEQ ID NO: 17437 - RNA, 15 nt, Artificial Sequence
  Synthetic Oligonucleotide; PD-L1 exon 2; Set C
ucuggaaugcccuaa

SEQ ID NO: 17438 - RNA, 24 nt, Artificial Sequence
  Synthetic Oligonucleotide; PD-L1 exon 2; Set C
aucuuucuggaaugcccuaauuau

SEQ ID NO: 17439 - RNA, 22 nt, Artificial Sequence
  Synthetic Oligonucleotide; PD-L1 exon 2; Set C
ucuuucuggaaugcccuaauua

SEQ ID NO: 17440 - RNA, 18 nt, Artificial Sequence
  Synthetic Oligonucleotide; PD-L1 exon 2; Set C
uuucuggaaugcccuaau

SEQ ID NO: 17441 - RNA, 16 nt, Artificial Sequence
  Synthetic Oligonucleotide; PD-L1 exon 2; Set C
uucuggaaugcccuaa

SEQ ID NO: 17442 - RNA, 21 nt, Artificial Sequence
  Synthetic Oligonucleotide; PD-L1 exon 2; Set C
ucuuucuggaaugcccuaauu

SEQ ID NO: 17443 - RNA, 23 nt, Artificial Sequence
  Synthetic Oligonucleotide; PD-L1 exon 2; Set C
aucuuucuggaaugcccuaauua

SEQ ID NO: 17444 - RNA, 19 nt, Artificial Sequence
  Synthetic Oligonucleotide; PD-L1 exon 2; Set C
cuuucuggaaugcccuaau

SEQ ID NO: 17445 - RNA, 17 nt, Artificial Sequence
  Synthetic Oligonucleotide; PD-L1 exon 2; Set C
uuucuggaaugcccuaa

SEQ ID NO: 17446 - RNA, 22 nt, Artificial Sequence
  Synthetic Oligonucleotide; PD-L1 exon 2; Set C
aucuuucuggaaugcccuaauu

SEQ ID NO: 17447 - RNA, 18 nt, Artificial Sequence
  Synthetic Oligonucleotide; PD-L1 exon 2; Set C
cuuucuggaaugcccuaa

SEQ ID NO: 17448 - RNA, 33 nt, Artificial Sequence
  Synthetic Oligonucleotide; PD-L1 exon 2; Set A
aauauccucaucuuucuggaaugcccuaauuau

SEQ ID NO: 17449 - RNA, 34 nt, Artificial Sequence
  Synthetic Oligonucleotide; PD-L1 exon 2; Set A
aaauauccucaucuuucuggaaugcccuaauuau

SEQ ID NO: 17450 - RNA, 32 nt, Artificial Sequence
  Synthetic Oligonucleotide; PD-L1 exon 2; Set A
aauauccucaucuuucuggaaugcccuaauua

SEQ ID NO: 17451 - RNA, 31 nt, Artificial Sequence
  Synthetic Oligonucleotide; PD-L1 exon 2; Set A
aauauccucaucuuucuggaaugcccuaauu

SEQ ID NO: 17452 - RNA, 33 nt, Artificial Sequence
  Synthetic Oligonucleotide; PD-L1 exon 2; Set A
aaauauccucaucuuucuggaaugcccuaauua

SEQ ID NO: 17453 - RNA, 35 nt, Artificial Sequence
  Synthetic Oligonucleotide; PD-L1 exon 2; Set A
caaauauccucaucuuucuggaaugcccuaauuau

SEQ ID NO: 17454 - RNA, 32 nt, Artificial Sequence
  Synthetic Oligonucleotide; PD-L1 exon 2; Set A
aaauauccucaucuuucuggaaugcccuaauu

SEQ ID NO: 17455 - RNA, 34 nt, Artificial Sequence
  Synthetic Oligonucleotide; PD-L1 exon 2; Set A
caaauauccucaucuuucuggaaugcccuaauua

SEQ ID NO: 17456 - RNA, 36 nt, Artificial Sequence
  Synthetic Oligonucleotide; PD-L1 exon 2; Set A
gcaaauauccucaucuuucuggaaugcccuaauuau

SEQ ID NO: 17457 - RNA, 33 nt, Artificial Sequence
  Synthetic Oligonucleotide; PD-L1 exon 2; Set A
caaauauccucaucuuucuggaaugcccuaauu

SEQ ID NO: 17458 - RNA, 35 nt, Artificial Sequence
  Synthetic Oligonucleotide; PD-L1 exon 2; Set A
gcaaauauccucaucuuucuggaaugcccuaauua

SEQ ID NO: 17459 - RNA, 34 nt, Artificial Sequence
  Synthetic Oligonucleotide; PD-L1 exon 2; Set A
gcaaauauccucaucuuucuggaaugcccuaauu

SEQ ID NO: 17460 - RNA, 29 nt, Artificial Sequence
  Synthetic Oligonucleotide; PD-L1 exon 2; Set C
aguaggucaugaauauaaagacagcaaau

SEQ ID NO: 17461 - RNA, 28 nt, Artificial Sequence
  Synthetic Oligonucleotide; PD-L1 exon 2; Set C
aguaggucaugaauauaaagacagcaaa

SEQ ID NO: 17462 - RNA, 16 nt, Artificial Sequence
  Synthetic Oligonucleotide; PD-L1 exon 2; Set C
guaggucaugaauaua

SEQ ID NO: 17463 - RNA, 15 nt, Artificial Sequence
  Synthetic Oligonucleotide; PD-L1 exon 2; Set C
guaggucaugaauau

SEQ ID NO: 17464 - RNA, 17 nt, Artificial Sequence
  Synthetic Oligonucleotide; PD-L1 exon 2; Set C
aguaggucaugaauaua

SEQ ID NO: 17465 - RNA, 16 nt, Artificial Sequence
  Synthetic Oligonucleotide; PD-L1 exon 2; Set C
aguaggucaugaauau

SEQ ID NO: 17466 - RNA, 40 nt, Artificial Sequence
  Synthetic Oligonucleotide; PD-L1 exon 2; Set A
uucagcaaaugccaguaggucaugaauauaaagacagcaa

SEQ ID NO: 17467 - RNA, 39 nt, Artificial Sequence
  Synthetic Oligonucleotide; PD-L1 exon 2; Set C
uucagcaaaugccaguaggucaugaauauaaagacagca

SEQ ID NO: 17468 - RNA, 40 nt, Artificial Sequence
  Synthetic Oligonucleotide; PD-L1 exon 2; Set C
guucagcaaaugccaguaggucaugaauauaaagacagca

SEQ ID NO: 17469 - RNA, 23 nt, Artificial Sequence
  Synthetic Oligonucleotide; PD-L1 exon 2; Set C
aaugccaguaggucaugaauaua

SEQ ID NO: 17470 - RNA, 22 nt, Artificial Sequence
  Synthetic Oligonucleotide; PD-L1 exon 2; Set C
aaugccaguaggucaugaauau

SEQ ID NO: 17471 - RNA, 24 nt, Artificial Sequence
  Synthetic Oligonucleotide; PD-L1 exon 2; Set C
aaaugccaguaggucaugaauaua

SEQ ID NO: 17472 - RNA, 23 nt, Artificial Sequence
  Synthetic Oligonucleotide; PD-L1 exon 2; Set C
aaaugccaguaggucaugaauau

SEQ ID NO: 17473 - RNA, 30 nt, Artificial Sequence
  Synthetic Oligonucleotide; PD-L1 exon 2; Set A
uucagcaaaugccaguaggucaugaauaua

SEQ ID NO: 17474 - RNA, 29 nt, Artificial Sequence
  Synthetic Oligonucleotide; PD-L1 exon 2; Set A
uucagcaaaugccaguaggucaugaauau

SEQ ID NO: 17475 - RNA, 31 nt, Artificial Sequence
  Synthetic Oligonucleotide; PD-L1 exon 2; Set A
guucagcaaaugccaguaggucaugaauaua

SEQ ID NO: 17476 - RNA, 30 nt, Artificial Sequence
  Synthetic Oligonucleotide; PD-L1 exon 2; Set A
guucagcaaaugccaguaggucaugaauau

SEQ ID NO: 17477 - RNA, 32 nt, Artificial Sequence
  Synthetic Oligonucleotide; PD-L1 exon 2; Set A
cguucagcaaaugccaguaggucaugaauaua

SEQ ID NO: 17478 - RNA, 31 nt, Artificial Sequence
  Synthetic Oligonucleotide; PD-L1 exon 2; Set A
cguucagcaaaugccaguaggucaugaauau

SEQ ID NO: 17479 - RNA, 32 nt, Artificial Sequence
  Synthetic Oligonucleotide; PD-L1 exon 2; Set A
ccguucagcaaaugccaguaggucaugaauau

SEQ ID NO: 17480 - RNA, 33 nt, Artificial Sequence
  Synthetic Oligonucleotide; PD-L1 exon 2; Set C
accguucagcaaaugccaguaggucaugaauau

SEQ ID NO: 17481 - RNA, 36 nt, Artificial Sequence
  Synthetic Oligonucleotide; PD-L1 exon 2; Set C
uuaccguucagcaaaugccaguaggucaugaauaua

SEQ ID NO: 17482 - RNA, 35 nt, Artificial Sequence
  Synthetic Oligonucleotide; PD-L1 exon 2; Set C
uuaccguucagcaaaugccaguaggucaugaauau

SEQ ID NO: 17483 - RNA, 37 nt, Artificial Sequence
  Synthetic Oligonucleotide; PD-L1 exon 2; Set C
cuuaccguucagcaaaugccaguaggucaugaauaua

SEQ ID NO: 17484 - RNA, 36 nt, Artificial Sequence
  Synthetic Oligonucleotide; PD-L1 exon 2; Set C
cuuaccguucagcaaaugccaguaggucaugaauau

SEQ ID NO: 17485 - RNA, 38 nt, Artificial Sequence
  Synthetic Oligonucleotide; PD-L1 exon 2; Set C
ucuuaccguucagcaaaugccaguaggucaugaauaua

SEQ ID NO: 17486 - RNA, 37 nt, Artificial Sequence
  Synthetic Oligonucleotide; PD-L1 exon 2; Set C
ucuuaccguucagcaaaugccaguaggucaugaauau

SEQ ID NO: 17487 - RNA, 39 nt, Artificial Sequence
  Synthetic Oligonucleotide; PD-L1 exon 2; Set C
gucuuaccguucagcaaaugccaguaggucaugaauaua

SEQ ID NO: 17488 - RNA, 21 nt, Artificial Sequence
  Synthetic Oligonucleotide; PD-L1 exon 2; Set C
uucagcaaaugccaguagguc

SEQ ID NO: 17489 - RNA, 38 nt, Artificial Sequence
  Synthetic Oligonucleotide; PD-L1 exon 2; Set C
gucuuaccguucagcaaaugccaguaggucaugaauau

SEQ ID NO: 17490 - RNA, 22 nt, Artificial Sequence
  Synthetic Oligonucleotide; PD-L1 exon 2; Set A
guucagcaaaugccaguagguc

SEQ ID NO: 17491 - RNA, 17 nt, Artificial Sequence
  Synthetic Oligonucleotide; PD-L1 exon 2; Set C
uucagcaaaugccagua

SEQ ID NO: 17492 - RNA, 16 nt, Artificial Sequence
  Synthetic Oligonucleotide; PD-L1 exon 2; Set C
uucagcaaaugccagu

SEQ ID NO: 17493 - RNA, 18 nt, Artificial Sequence
  Synthetic Oligonucleotide; PD-L1 exon 2; Set C
guucagcaaaugccagua

SEQ ID NO: 17494 - RNA, 17 nt, Artificial Sequence
  Synthetic Oligonucleotide; PD-L1 exon 2; Set C
guucagcaaaugccagu

SEQ ID NO: 17495 - RNA, 19 nt, Artificial Sequence
  Synthetic Oligonucleotide; PD-L1 exon 2; Set C
cguucagcaaaugccagua

SEQ ID NO: 17496 - RNA, 18 nt, Artificial Sequence
  Synthetic Oligonucleotide; PD-L1 exon 2; Set C
cguucagcaaaugccagu

SEQ ID NO: 17497 - RNA, 20 nt, Artificial Sequence
  Synthetic Oligonucleotide; PD-L1 exon 2; Set C
ccguucagcaaaugccagua

SEQ ID NO: 17498 - RNA, 19 nt, Artificial Sequence
  Synthetic Oligonucleotide; PD-L1 exon 2; Set C
ccguucagcaaaugccagu

SEQ ID NO: 17499 - RNA, 21 nt, Artificial Sequence
  Synthetic Oligonucleotide; PD-L1 exon 2; Set A
accguucagcaaaugccagua

SEQ ID NO: 17500 - RNA, 29 nt, Artificial Sequence
  Synthetic Oligonucleotide; PD-L1 exon 2; Set C
ucuuaccguucagcaaaugccaguagguc

SEQ ID NO: 17501 - RNA, 20 nt, Artificial Sequence
  Synthetic Oligonucleotide; PD-L1 exon 2; Set A
accguucagcaaaugccagu

SEQ ID NO: 17502 - RNA, 22 nt, Artificial Sequence
  Synthetic Oligonucleotide; PD-L1 exon 2; Set A
uaccguucagcaaaugccagua

SEQ ID NO: 17503 - RNA, 30 nt, Artificial Sequence
  Synthetic Oligonucleotide; PD-L1 exon 2; Set C
gucuuaccguucagcaaaugccaguagguc

SEQ ID NO: 17504 - RNA, 21 nt, Artificial Sequence
  Synthetic Oligonucleotide; PD-L1 exon 2; Set A
uaccguucagcaaaugccagu

SEQ ID NO: 17505 - RNA, 23 nt, Artificial Sequence
  Synthetic Oligonucleotide; PD-L1 exon 2; Set A
uuaccguucagcaaaugccagua

SEQ ID NO: 17506 - RNA, 22 nt, Artificial Sequence
  Synthetic Oligonucleotide; PD-L1 exon 2; Set A
uuaccguucagcaaaugccagu

SEQ ID NO: 17507 - RNA, 24 nt, Artificial Sequence
  Synthetic Oligonucleotide; PD-L1 exon 2; Set A
cuuaccguucagcaaaugccagua

SEQ ID NO: 17508 - RNA, 23 nt, Artificial Sequence
  Synthetic Oligonucleotide; PD-L1 exon 2; Set A
cuuaccguucagcaaaugccagu

SEQ ID NO: 17509 - RNA, 25 nt, Artificial Sequence
  Synthetic Oligonucleotide; PD-L1 exon 2; Set A
ucuuaccguucagcaaaugccagua

SEQ ID NO: 17510 - RNA, 24 nt, Artificial Sequence
  Synthetic Oligonucleotide; PD-L1 exon 2; Set A
ucuuaccguucagcaaaugccagu

SEQ ID NO: 17511 - RNA, 26 nt, Artificial Sequence
  Synthetic Oligonucleotide; PD-L1 exon 2; Set A
gucuuaccguucagcaaaugccagua

SEQ ID NO: 17512 - RNA, 25 nt, Artificial Sequence
  Synthetic Oligonucleotide; PD-L1 exon 2; Set A
gucuuaccguucagcaaaugccagu

SEQ ID NO: 17513 - RNA, 35 nt, Artificial Sequence
  Synthetic Oligonucleotide; PD-L1 exon 2; Set C
uuggugucuuaccguucagcaaaugccaguagguc

SEQ ID NO: 17514 - RNA, 36 nt, Artificial Sequence
  Synthetic Oligonucleotide; PD-L1 exon 2; Set C
uuuggugucuuaccguucagcaaaugccaguagguc

SEQ ID NO: 17515 - RNA, 38 nt, Artificial Sequence
  Synthetic Oligonucleotide; PD-L1 exon 2; Set C
auuuggugucuuaccguucagcaaaugccaguagguca

SEQ ID NO: 17516 - RNA, 40 nt, Artificial Sequence
  Synthetic Oligonucleotide; PD-L1 exon 2; Set C
gauuuggugucuuaccguucagcaaaugccaguaggucau

SEQ ID NO: 17517 - RNA, 15 nt, Artificial Sequence
  Synthetic Oligonucleotide; PD-L1 exon 2; Set C
uaccguucagcaaau

SEQ ID NO: 17518 - RNA, 37 nt, Artificial Sequence
  Synthetic Oligonucleotide; PD-L1 exon 2; Set C
auuuggugucuuaccguucagcaaaugccaguagguc

SEQ ID NO: 17519 - RNA, 39 nt, Artificial Sequence
  Synthetic Oligonucleotide; PD-L1 exon 2; Set C
gauuuggugucuuaccguucagcaaaugccaguagguca

SEQ ID NO: 17520 - RNA, 30 nt, Artificial Sequence
  Synthetic Oligonucleotide; PD-L1 exon 2; Set C
uggugucuuaccguucagcaaaugccagua

SEQ ID NO: 17521 - RNA, 16 nt, Artificial Sequence
  Synthetic Oligonucleotide; PD-L1 exon 2; Set C
uuaccguucagcaaau

SEQ ID NO: 17522 - RNA, 38 nt, Artificial Sequence
  Synthetic Oligonucleotide; PD-L1 exon 2; Set C
gauuuggugucuuaccguucagcaaaugccaguagguc

SEQ ID NO: 17523 - RNA, 29 nt, Artificial Sequence
  Synthetic Oligonucleotide; PD-L1 exon 2; Set C
uggugucuuaccguucagcaaaugccagu

SEQ ID NO: 17524 - RNA, 31 nt, Artificial Sequence
  Synthetic Oligonucleotide; PD-L1 exon 2; Set C
uuggugucuuaccguucagcaaaugccagua

SEQ ID NO: 17525 - RNA, 17 nt, Artificial Sequence
  Synthetic Oligonucleotide; PD-L1 exon 2; Set C
cuuaccguucagcaaau

SEQ ID NO: 17526 - RNA, 15 nt, Artificial Sequence
  Synthetic Oligonucleotide; PD-L1 exon 2; Set C
uuaccguucagcaaa

SEQ ID NO: 17527 - RNA, 30 nt, Artificial Sequence
  Synthetic Oligonucleotide; PD-L1 exon 2; Set C
uuggugucuuaccguucagcaaaugccagu

SEQ ID NO: 17528 - RNA, 16 nt, Artificial Sequence
  Synthetic Oligonucleotide; PD-L1 exon 2; Set C
cuuaccguucagcaaa

SEQ ID NO: 17529 - RNA, 15 nt, Artificial Sequence
  Synthetic Oligonucleotide; PD-L1 exon 2; Set C
cuuaccguucagcaa

SEQ ID NO: 17530 - RNA, 16 nt, Artificial Sequence
  Synthetic Oligonucleotide; PD-L1 exon 2; Set C
ucuuaccguucagcaa

SEQ ID NO: 17531 - RNA, 17 nt, Artificial Sequence
  Synthetic Oligonucleotide; PD-L1 exon 2; Set C
gucuuaccguucagcaa

SEQ ID NO: 17532 - RNA, 15 nt, Artificial Sequence
  Synthetic Oligonucleotide; PD-L1 exon 2; Set C
ucuuaccguucagca

SEQ ID NO: 17533 - RNA, 16 nt, Artificial Sequence
  Synthetic Oligonucleotide; PD-L1 exon 2; Set C
gucuuaccguucagca

SEQ ID NO: 17534 - RNA, 23 nt, Artificial Sequence
  Synthetic Oligonucleotide; PD-L1 exon 2; Set A
uggugucuuaccguucagcaaau

SEQ ID NO: 17535 - RNA, 38 nt, Artificial Sequence
  Synthetic Oligonucleotide; PD-L1 exon 2; Set C
gaaggauuuggugucuuaccguucagcaaaugccagua

SEQ ID NO: 17536 - RNA, 24 nt, Artificial Sequence
  Synthetic Oligonucleotide; PD-L1 exon 2; Set A
uuggugucuuaccguucagcaaau

SEQ ID NO: 17537 - RNA, 22 nt, Artificial Sequence
  Synthetic Oligonucleotide; PD-L1 exon 2; Set A
uggugucuuaccguucagcaaa

SEQ ID NO: 17538 - RNA, 37 nt, Artificial Sequence
  Synthetic Oligonucleotide; PD-L1 exon 2; Set C
gaaggauuuggugucuuaccguucagcaaaugccagu

SEQ ID NO: 17539 - RNA, 39 nt, Artificial Sequence
  Synthetic Oligonucleotide; PD-L1 exon 2; Set C
ggaaggauuuggugucuuaccguucagcaaaugccagua

SEQ ID NO: 17540 - RNA, 23 nt, Artificial Sequence
  Synthetic Oligonucleotide; PD-L1 exon 2; Set A
uuggugucuuaccguucagcaaa

SEQ ID NO: 17541 - RNA, 21 nt, Artificial Sequence
  Synthetic Oligonucleotide; PD-L1 exon 2; Set A
uggugucuuaccguucagcaa

SEQ ID NO: 17542 - RNA, 38 nt, Artificial Sequence
  Synthetic Oligonucleotide; PD-L1 exon 2; Set C
ggaaggauuuggugucuuaccguucagcaaaugccagu

SEQ ID NO: 17543 - RNA, 22 nt, Artificial Sequence
  Synthetic Oligonucleotide; PD-L1 exon 2; Set A
uuggugucuuaccguucagcaa

SEQ ID NO: 17544 - RNA, 20 nt, Artificial Sequence
  Synthetic Oligonucleotide; PD-L1 exon 2; Set A
uggugucuuaccguucagca

SEQ ID NO: 17545 - RNA, 23 nt, Artificial Sequence
  Synthetic Oligonucleotide; PD-L1 exon 2; Set A
uuuggugucuuaccguucagcaa

SEQ ID NO: 17546 - RNA, 21 nt, Artificial Sequence
  Synthetic Oligonucleotide; PD-L1 exon 2; Set A
uuggugucuuaccguucagca

SEQ ID NO: 17547 - RNA, 40 nt, Artificial Sequence
  Synthetic Oligonucleotide; PD-L1 exon 2; Set C
auggaaggauuuggugucuuaccguucagcaaaugccagu

SEQ ID NO: 17548 - RNA, 22 nt, Artificial Sequence
  Synthetic Oligonucleotide; PD-L1 exon 2; Set A
uuuggugucuuaccguucagca

SEQ ID NO: 17549 - RNA, 16 nt, Artificial Sequence
  Synthetic Oligonucleotide; PD-L1 exon 2; Set C
uggugucuuaccguuc

SEQ ID NO: 17550 - RNA, 15 nt, Artificial Sequence
  Synthetic Oligonucleotide; PD-L1 exon 2; Set C
uggugucuuaccguu

SEQ ID NO: 17551 - RNA, 31 nt, Artificial Sequence
  Synthetic Oligonucleotide; PD-L1 exon 2; Set A
gaaggauuuggugucuuaccguucagcaaau

SEQ ID NO: 17552 - RNA, 30 nt, Artificial Sequence
  Synthetic Oligonucleotide; PD-L1 exon 2; Set A
gaaggauuuggugucuuaccguucagcaaa

SEQ ID NO: 17553 - RNA, 15 nt, Artificial Sequence
  Synthetic Oligonucleotide; PD-L1 exon 2; Set C
uuggugucuuaccgu

SEQ ID NO: 17554 - RNA, 29 nt, Artificial Sequence
  Synthetic Oligonucleotide; PD-L1 exon 2; Set A
gaaggauuuggugucuuaccguucagcaa

SEQ ID NO: 17555 - RNA, 30 nt, Artificial Sequence
  Synthetic Oligonucleotide; PD-L1 exon 2; Set C
ggaaggauuuggugucuuaccguucagcaa

SEQ ID NO: 17556 - RNA, 28 nt, Artificial Sequence
  Synthetic Oligonucleotide; PD-L1 exon 2; Set A
gaaggauuuggugucuuaccguucagca

SEQ ID NO: 17557 - RNA, 35 nt, Artificial Sequence
  Synthetic Oligonucleotide; PD-L1 exon 2; Set A
aauggaaggauuuggugucuuaccguucagcaaau

SEQ ID NO: 17558 - RNA, 33 nt, Artificial Sequence
  Synthetic Oligonucleotide; PD-L1 exon 2; Set C
auggaaggauuuggugucuuaccguucagcaaa

SEQ ID NO: 17559 - RNA, 31 nt, Artificial Sequence
  Synthetic Oligonucleotide; PD-L1 exon 2; Set C
uggaaggauuuggugucuuaccguucagcaa

SEQ ID NO: 17560 - RNA, 29 nt, Artificial Sequence
  Synthetic Oligonucleotide; PD-L1 exon 2; Set C
ggaaggauuuggugucuuaccguucagca

SEQ ID NO: 17561 - RNA, 36 nt, Artificial Sequence
  Synthetic Oligonucleotide; PD-L1 exon 2; Set A
uaauggaaggauuuggugucuuaccguucagcaaau

SEQ ID NO: 17562 - RNA, 34 nt, Artificial Sequence
  Synthetic Oligonucleotide; PD-L1 exon 2; Set A
aauggaaggauuuggugucuuaccguucagcaaa

SEQ ID NO: 17563 - RNA, 32 nt, Artificial Sequence
  Synthetic Oligonucleotide; PD-L1 exon 2; Set C
auggaaggauuuggugucuuaccguucagcaa

SEQ ID NO: 17564 - RNA, 30 nt, Artificial Sequence
  Synthetic Oligonucleotide; PD-L1 exon 2; Set C
uggaaggauuuggugucuuaccguucagca

SEQ ID NO: 17565 - RNA, 37 nt, Artificial Sequence
  Synthetic Oligonucleotide; PD-L1 exon 2; Set C
cuaauggaaggauuuggugucuuaccguucagcaaau

SEQ ID NO: 17566 - RNA, 35 nt, Artificial Sequence
  Synthetic Oligonucleotide; PD-L1 exon 2; Set A
uaauggaaggauuuggugucuuaccguucagcaaa

SEQ ID NO: 17567 - RNA, 33 nt, Artificial Sequence
  Synthetic Oligonucleotide; PD-L1 exon 2; Set C
aauggaaggauuuggugucuuaccguucagcaa

SEQ ID NO: 17568 - RNA, 31 nt, Artificial Sequence
  Synthetic Oligonucleotide; PD-L1 exon 2; Set C
auggaaggauuuggugucuuaccguucagca

SEQ ID NO: 17569 - RNA, 34 nt, Artificial Sequence
  Synthetic Oligonucleotide; PD-L1 exon 2; Set C
uaauggaaggauuuggugucuuaccguucagcaa

SEQ ID NO: 17570 - RNA, 32 nt, Artificial Sequence
  Synthetic Oligonucleotide; PD-L1 exon 2; Set C
aauggaaggauuuggugucuuaccguucagca

SEQ ID NO: 17571 - RNA, 33 nt, Artificial Sequence
  Synthetic Oligonucleotide; PD-L1 exon 2; Set C
uaauggaaggauuuggugucuuaccguucagca

SEQ ID NO: 17572 - RNA, 15 nt, Artificial Sequence
  Synthetic Oligonucleotide; PD-L1 exon 2; Set C
gauuuggugucuuac

SEQ ID NO: 17573 - RNA, 22 nt, Artificial Sequence
  Synthetic Oligonucleotide; PD-L1 exon 2; Set C
gaaggauuuggugucuuaccgu

SEQ ID NO: 17574 - RNA, 23 nt, Artificial Sequence
  Synthetic Oligonucleotide; PD-L1 exon 2; Set B
ggaaggauuuggugucuuaccgu

SEQ ID NO: 17575 - RNA, 21 nt, Artificial Sequence
  Synthetic Oligonucleotide; PD-L1 exon 2; Set C
gaaggauuuggugucuuaccg

SEQ ID NO: 17576 - RNA, 22 nt, Artificial Sequence
  Synthetic Oligonucleotide; PD-L1 exon 2; Set B
ggaaggauuuggugucuuaccg

SEQ ID NO: 17577 - RNA, 20 nt, Artificial Sequence
  Synthetic Oligonucleotide; PD-L1 exon 2; Set C
gaaggauuuggugucuuacc

SEQ ID NO: 17578 - RNA, 25 nt, Artificial Sequence
  Synthetic Oligonucleotide; PD-L1 exon 2; Set B
auggaaggauuuggugucuuaccgu

SEQ ID NO: 17579 - RNA, 21 nt, Artificial Sequence
  Synthetic Oligonucleotide; PD-L1 exon 2; Set C
ggaaggauuuggugucuuacc

SEQ ID NO: 17580 - RNA, 19 nt, Artificial Sequence
  Synthetic Oligonucleotide; PD-L1 exon 2; Set C
gaaggauuuggugucuuac

SEQ ID NO: 17581 - RNA, 30 nt, Artificial Sequence
  Synthetic Oligonucleotide; PD-L1 exon 2; Set B
cuaauggaaggauuuggugucuuaccguuc

SEQ ID NO: 17582 - RNA, 26 nt, Artificial Sequence
  Synthetic Oligonucleotide; PD-L1 exon 2; Set B
aauggaaggauuuggugucuuaccgu

SEQ ID NO: 17583 - RNA, 18 nt, Artificial Sequence
  Synthetic Oligonucleotide; PD-L1 exon 2; Set C
gaaggauuuggugucuua

SEQ ID NO: 17584 - RNA, 24 nt, Artificial Sequence
  Synthetic Oligonucleotide; PD-L1 exon 2; Set B
auggaaggauuuggugucuuaccg

SEQ ID NO: 17585 - RNA, 40 nt, Artificial Sequence
  Synthetic Oligonucleotide; PD-L1 exon 2; Set C
agaaccuaauggaaggauuuggugucuuaccguucagcaa

SEQ ID NO: 17586 - RNA, 20 nt, Artificial Sequence
  Synthetic Oligonucleotide; PD-L1 exon 2; Set C
ggaaggauuuggugucuuac

SEQ ID NO: 17587 - RNA, 29 nt, Artificial Sequence
  Synthetic Oligonucleotide; PD-L1 exon 2; Set B
cuaauggaaggauuuggugucuuaccguu

SEQ ID NO: 17588 - RNA, 17 nt, Artificial Sequence
  Synthetic Oligonucleotide; PD-L1 exon 2; Set C
gaaggauuuggugucuu

SEQ ID NO: 17589 - RNA, 27 nt, Artificial Sequence
  Synthetic Oligonucleotide; PD-L1 exon 2; Set B
uaauggaaggauuuggugucuuaccgu

SEQ ID NO: 17590 - RNA, 19 nt, Artificial Sequence
  Synthetic Oligonucleotide; PD-L1 exon 2; Set C
ggaaggauuuggugucuua

SEQ ID NO: 17591 - RNA, 25 nt, Artificial Sequence
  Synthetic Oligonucleotide; PD-L1 exon 2; Set B
aauggaaggauuuggugucuuaccg

SEQ ID NO: 17592 - RNA, 23 nt, Artificial Sequence
  Synthetic Oligonucleotide; PD-L1 exon 2; Set C
auggaaggauuuggugucuuacc

SEQ ID NO: 17593 - RNA, 39 nt, Artificial Sequence
  Synthetic Oligonucleotide; PD-L1 exon 2; Set C
agaaccuaauggaaggauuuggugucuuaccguucagca

SEQ ID NO: 17594 - RNA, 21 nt, Artificial Sequence
  Synthetic Oligonucleotide; PD-L1 exon 2; Set C
uggaaggauuuggugucuuac

SEQ ID NO: 17595 - RNA, 16 nt, Artificial Sequence
  Synthetic Oligonucleotide; PD-L1 exon 2; Set C
gaaggauuuggugucu

SEQ ID NO: 17596 - RNA, 18 nt, Artificial Sequence
  Synthetic Oligonucleotide; PD-L1 exon 2; Set C
ggaaggauuuggugucuu

SEQ ID NO: 17597 - RNA, 26 nt, Artificial Sequence
  Synthetic Oligonucleotide; PD-L1 exon 2; Set B
uaauggaaggauuuggugucuuaccg

SEQ ID NO: 17598 - RNA, 24 nt, Artificial Sequence
  Synthetic Oligonucleotide; PD-L1 exon 2; Set C
aauggaaggauuuggugucuuacc

SEQ ID NO: 17599 - RNA, 22 nt, Artificial Sequence
  Synthetic Oligonucleotide; PD-L1 exon 2; Set C
auggaaggauuuggugucuuac

SEQ ID NO: 17600 - RNA, 15 nt, Artificial Sequence
  Synthetic Oligonucleotide; PD-L1 exon 2; Set C
gaaggauuugguguc

SEQ ID NO: 17601 - RNA, 21 nt, Artificial Sequence
  Synthetic Oligonucleotide; PD-L1 exon 2; Set C
auggaaggauuuggugucuua

SEQ ID NO: 17602 - RNA, 25 nt, Artificial Sequence
  Synthetic Oligonucleotide; PD-L1 exon 2; Set C
uaauggaaggauuuggugucuuacc

SEQ ID NO: 17603 - RNA, 23 nt, Artificial Sequence
  Synthetic Oligonucleotide; PD-L1 exon 2; Set C
aauggaaggauuuggugucuuac

SEQ ID NO: 17604 - RNA, 34 nt, Artificial Sequence
  Synthetic Oligonucleotide; PD-L1 exon 2; Set C
gaaccuaauggaaggauuuggugucuuaccguuc

SEQ ID NO: 17605 - RNA, 20 nt, Artificial Sequence
  Synthetic Oligonucleotide; PD-L1 exon 2; Set C
auggaaggauuuggugucuu

SEQ ID NO: 17606 - RNA, 22 nt, Artificial Sequence
  Synthetic Oligonucleotide; PD-L1 exon 2; Set C
aauggaaggauuuggugucuua

SEQ ID NO: 17607 - RNA, 24 nt, Artificial Sequence
  Synthetic Oligonucleotide; PD-L1 exon 2; Set C
uaauggaaggauuuggugucuuac

SEQ ID NO: 17608 - RNA, 33 nt, Artificial Sequence
  Synthetic Oligonucleotide; PD-L1 exon 2; Set B
gaaccuaauggaaggauuuggugucuuaccguu

SEQ ID NO: 17609 - RNA, 21 nt, Artificial Sequence
  Synthetic Oligonucleotide; PD-L1 exon 2; Set C
aauggaaggauuuggugucuu

SEQ ID NO: 17610 - RNA, 23 nt, Artificial Sequence
  Synthetic Oligonucleotide; PD-L1 exon 2; Set C
uaauggaaggauuuggugucuua

SEQ ID NO: 17611 - RNA, 36 nt, Artificial Sequence
  Synthetic Oligonucleotide; PD-L1 exon 2; Set C
uagaaccuaauggaaggauuuggugucuuaccguuc

SEQ ID NO: 17612 - RNA, 22 nt, Artificial Sequence
  Synthetic Oligonucleotide; PD-L1 exon 2; Set C
uaauggaaggauuuggugucuu

SEQ ID NO: 17613 - RNA, 35 nt, Artificial Sequence
  Synthetic Oligonucleotide; PD-L1 exon 2; Set B
uagaaccuaauggaaggauuuggugucuuaccguu

SEQ ID NO: 17614 - RNA, 37 nt, Artificial Sequence
  Synthetic Oligonucleotide; PD-L1 exon 2; Set B
auagaaccuaauggaaggauuuggugucuuaccguuc

SEQ ID NO: 17615 - RNA, 33 nt, Artificial Sequence
  Synthetic Oligonucleotide; PD-L1 exon 2; Set B
agaaccuaauggaaggauuuggugucuuaccgu

SEQ ID NO: 17616 - RNA, 36 nt, Artificial Sequence
  Synthetic Oligonucleotide; PD-L1 exon 2; Set B
auagaaccuaauggaaggauuuggugucuuaccguu

SEQ ID NO: 17617 - RNA, 38 nt, Artificial Sequence
  Synthetic Oligonucleotide; PD-L1 exon 2; Set C
uauagaaccuaauggaaggauuuggugucuuaccguuc

SEQ ID NO: 17618 - RNA, 20 nt, Artificial Sequence
  Synthetic Oligonucleotide; PD-L1 exon 2; Set C
uaauggaaggauuugguguc

SEQ ID NO: 17619 - RNA, 22 nt, Artificial Sequence
  Synthetic Oligonucleotide; PD-L1 exon 2; Set C
cuaauggaaggauuuggugucu

SEQ ID NO: 17620 - RNA, 34 nt, Artificial Sequence
  Synthetic Oligonucleotide; PD-L1 exon 2; Set B
uagaaccuaauggaaggauuuggugucuuaccgu

SEQ ID NO: 17621 - RNA, 32 nt, Artificial Sequence
  Synthetic Oligonucleotide; PD-L1 exon 2; Set B
agaaccuaauggaaggauuuggugucuuaccg

SEQ ID NO: 17622 - RNA, 37 nt, Artificial Sequence
  Synthetic Oligonucleotide; PD-L1 exon 2; Set B
uauagaaccuaauggaaggauuuggugucuuaccguu

SEQ ID NO: 17623 - RNA, 21 nt, Artificial Sequence
  Synthetic Oligonucleotide; PD-L1 exon 2; Set C
cuaauggaaggauuugguguc

SEQ ID NO: 17624 - RNA, 35 nt, Artificial Sequence
  Synthetic Oligonucleotide; PD-L1 exon 2; Set B
auagaaccuaauggaaggauuuggugucuuaccgu

SEQ ID NO: 17625 - RNA, 33 nt, Artificial Sequence
  Synthetic Oligonucleotide; PD-L1 exon 2; Set B
uagaaccuaauggaaggauuuggugucuuaccg

SEQ ID NO: 17626 - RNA, 31 nt, Artificial Sequence
  Synthetic Oligonucleotide; PD-L1 exon 2; Set B
agaaccuaauggaaggauuuggugucuuacc

SEQ ID NO: 17627 - RNA, 40 nt, Artificial Sequence
  Synthetic Oligonucleotide; PD-L1 exon 2; Set B
aauauagaaccuaauggaaggauuuggugucuuaccguuc

SEQ ID NO: 17628 - RNA, 36 nt, Artificial Sequence
  Synthetic Oligonucleotide; PD-L1 exon 2; Set B
uauagaaccuaauggaaggauuuggugucuuaccgu

SEQ ID NO: 17629 - RNA, 34 nt, Artificial Sequence
  Synthetic Oligonucleotide; PD-L1 exon 2; Set B
auagaaccuaauggaaggauuuggugucuuaccg

SEQ ID NO: 17630 - RNA, 30 nt, Artificial Sequence
  Synthetic Oligonucleotide; PD-L1 exon 2; Set B
agaaccuaauggaaggauuuggugucuuac

SEQ ID NO: 17631 - RNA, 39 nt, Artificial Sequence
  Synthetic Oligonucleotide; PD-L1 exon 2; Set B
aauauagaaccuaauggaaggauuuggugucuuaccguu

SEQ ID NO: 17632 - RNA, 37 nt, Artificial Sequence
  Synthetic Oligonucleotide; PD-L1 exon 2; Set B
auauagaaccuaauggaaggauuuggugucuuaccgu

SEQ ID NO: 17633 - RNA, 29 nt, Artificial Sequence
  Synthetic Oligonucleotide; PD-L1 exon 2; Set B
agaaccuaauggaaggauuuggugucuua

SEQ ID NO: 17634 - RNA, 15 nt, Artificial Sequence
  Synthetic Oligonucleotide; PD-L1 exon 2; Set C
aauggaaggauuugg

SEQ ID NO: 17635 - RNA, 40 nt, Artificial Sequence
  Synthetic Oligonucleotide; PD-L1 exon 2; Set B
aaauauagaaccuaauggaaggauuuggugucuuaccguu

SEQ ID NO: 17636 - RNA, 26 nt, Artificial Sequence
  Synthetic Oligonucleotide; PD-L1 exon 2; Set B
gaaccuaauggaaggauuuggugucu

SEQ ID NO: 17637 - RNA, 28 nt, Artificial Sequence
  Synthetic Oligonucleotide; PD-L1 exon 2; Set B
agaaccuaauggaaggauuuggugucuu

SEQ ID NO: 17638 - RNA, 38 nt, Artificial Sequence
  Synthetic Oligonucleotide; PD-L1 exon 2; Set B
aauauagaaccuaauggaaggauuuggugucuuaccgu

SEQ ID NO: 17639 - RNA, 30 nt, Artificial Sequence
  Synthetic Oligonucleotide; PD-L1 exon 2; Set B
uagaaccuaauggaaggauuuggugucuua

SEQ ID NO: 17640 - RNA, 36 nt, Artificial Sequence
  Synthetic Oligonucleotide; PD-L1 exon 2; Set B
auauagaaccuaauggaaggauuuggugucuuaccg

SEQ ID NO: 17641 - RNA, 16 nt, Artificial Sequence
  Synthetic Oligonucleotide; PD-L1 exon 2; Set C
uaauggaaggauuugg

SEQ ID NO: 17642 - RNA, 25 nt, Artificial Sequence
  Synthetic Oligonucleotide; PD-L1 exon 2; Set C
gaaccuaauggaaggauuugguguc

SEQ ID NO: 17643 - RNA, 29 nt, Artificial Sequence
  Synthetic Oligonucleotide; PD-L1 exon 2; Set B
uagaaccuaauggaaggauuuggugucuu

SEQ ID NO: 17644 - RNA, 15 nt, Artificial Sequence
  Synthetic Oligonucleotide; PD-L1 exon 2; Set C
uaauggaaggauuug

SEQ ID NO: 17645 - RNA, 39 nt, Artificial Sequence
  Synthetic Oligonucleotide; PD-L1 exon 2; Set B
aaauauagaaccuaauggaaggauuuggugucuuaccgu

SEQ ID NO: 17646 - RNA, 31 nt, Artificial Sequence
  Synthetic Oligonucleotide; PD-L1 exon 2; Set B
auagaaccuaauggaaggauuuggugucuua

SEQ ID NO: 17647 - RNA, 37 nt, Artificial Sequence
  Synthetic Oligonucleotide; PD-L1 exon 2; Set B
aauauagaaccuaauggaaggauuuggugucuuaccg

SEQ ID NO: 17648 - RNA, 35 nt, Artificial Sequence
  Synthetic Oligonucleotide; PD-L1 exon 2; Set B
auauagaaccuaauggaaggauuuggugucuuacc

SEQ ID NO: 17649 - RNA, 28 nt, Artificial Sequence
  Synthetic Oligonucleotide; PD-L1 exon 2; Set B
uagaaccuaauggaaggauuuggugucu

SEQ ID NO: 17650 - RNA, 30 nt, Artificial Sequence
  Synthetic Oligonucleotide; PD-L1 exon 2; Set B
auagaaccuaauggaaggauuuggugucuu

SEQ ID NO: 17651 - RNA, 40 nt, Artificial Sequence
  Synthetic Oligonucleotide; PD-L1 exon 2; Set B
aaaauauagaaccuaauggaaggauuuggugucuuaccgu

SEQ ID NO: 17652 - RNA, 38 nt, Artificial Sequence
  Synthetic Oligonucleotide; PD-L1 exon 2; Set B
aaauauagaaccuaauggaaggauuuggugucuuaccg

SEQ ID NO: 17653 - RNA, 36 nt, Artificial Sequence
  Synthetic Oligonucleotide; PD-L1 exon 2; Set B
aauauagaaccuaauggaaggauuuggugucuuacc

SEQ ID NO: 17654 - RNA, 34 nt, Artificial Sequence
  Synthetic Oligonucleotide; PD-L1 exon 2; Set B
auauagaaccuaauggaaggauuuggugucuuac

SEQ ID NO: 17655 - RNA, 15 nt, Artificial Sequence
  Synthetic Oligonucleotide; PD-L1 exon 2; Set C
cuaauggaaggauuu

SEQ ID NO: 17656 - RNA, 27 nt, Artificial Sequence
  Synthetic Oligonucleotide; PD-L1 exon 2; Set B
uagaaccuaauggaaggauuugguguc

SEQ ID NO: 17657 - RNA, 29 nt, Artificial Sequence
  Synthetic Oligonucleotide; PD-L1 exon 2; Set B
auagaaccuaauggaaggauuuggugucu

SEQ ID NO: 17658 - RNA, 31 nt, Artificial Sequence
  Synthetic Oligonucleotide; PD-L1 exon 2; Set B
uauagaaccuaauggaaggauuuggugucuu

SEQ ID NO: 17659 - RNA, 33 nt, Artificial Sequence
  Synthetic Oligonucleotide; PD-L1 exon 2; Set B
auauagaaccuaauggaaggauuuggugucuua

SEQ ID NO: 17660 - RNA, 39 nt, Artificial Sequence
  Synthetic Oligonucleotide; PD-L1 exon 2; Set B
aaaauauagaaccuaauggaaggauuuggugucuuaccg

SEQ ID NO: 17661 - RNA, 37 nt, Artificial Sequence
  Synthetic Oligonucleotide; PD-L1 exon 2; Set B
aaauauagaaccuaauggaaggauuuggugucuuacc

SEQ ID NO: 17662 - RNA, 28 nt, Artificial Sequence
  Synthetic Oligonucleotide; PD-L1 exon 2; Set B
auagaaccuaauggaaggauuugguguc

SEQ ID NO: 17663 - RNA, 30 nt, Artificial Sequence
  Synthetic Oligonucleotide; PD-L1 exon 2; Set B
uauagaaccuaauggaaggauuuggugucu

SEQ ID NO: 17664 - RNA, 34 nt, Artificial Sequence
  Synthetic Oligonucleotide; PD-L1 exon 2; Set B
aauauagaaccuaauggaaggauuuggugucuua

SEQ ID NO: 17665 - RNA, 40 nt, Artificial Sequence
  Synthetic Oligonucleotide; PD-L1 exon 2; Set B
uaaaauauagaaccuaauggaaggauuuggugucuuaccg

SEQ ID NO: 17666 - RNA, 38 nt, Artificial Sequence
  Synthetic Oligonucleotide; PD-L1 exon 2; Set B
aaaauauagaaccuaauggaaggauuuggugucuuacc

SEQ ID NO: 17667 - RNA, 36 nt, Artificial Sequence
  Synthetic Oligonucleotide; PD-L1 exon 2; Set B
aaauauagaaccuaauggaaggauuuggugucuuac

SEQ ID NO: 17668 - RNA, 29 nt, Artificial Sequence
  Synthetic Oligonucleotide; PD-L1 exon 2; Set B
uauagaaccuaauggaaggauuugguguc

SEQ ID NO: 17669 - RNA, 33 nt, Artificial Sequence
  Synthetic Oligonucleotide; PD-L1 exon 2; Set B
aauauagaaccuaauggaaggauuuggugucuu

SEQ ID NO: 17670 - RNA, 35 nt, Artificial Sequence
  Synthetic Oligonucleotide; PD-L1 exon 2; Set B
aaauauagaaccuaauggaaggauuuggugucuua

SEQ ID NO: 17671 - RNA, 39 nt, Artificial Sequence
  Synthetic Oligonucleotide; PD-L1 exon 2; Set B
uaaaauauagaaccuaauggaaggauuuggugucuuacc

SEQ ID NO: 17672 - RNA, 37 nt, Artificial Sequence
  Synthetic Oligonucleotide; PD-L1 exon 2; Set B
aaaauauagaaccuaauggaaggauuuggugucuuac

SEQ ID NO: 17673 - RNA, 32 nt, Artificial Sequence
  Synthetic Oligonucleotide; PD-L1 exon 2; Set B
aauauagaaccuaauggaaggauuuggugucu

SEQ ID NO: 17674 - RNA, 34 nt, Artificial Sequence
  Synthetic Oligonucleotide; PD-L1 exon 2; Set B
aaauauagaaccuaauggaaggauuuggugucuu

SEQ ID NO: 17675 - RNA, 36 nt, Artificial Sequence
  Synthetic Oligonucleotide; PD-L1 exon 2; Set B
aaaauauagaaccuaauggaaggauuuggugucuua

SEQ ID NO: 17676 - RNA, 22 nt, Artificial Sequence
  Synthetic Oligonucleotide; PD-L1 exon 2; Set C
agaaccuaauggaaggauuugg

SEQ ID NO: 17677 - RNA, 38 nt, Artificial Sequence
  Synthetic Oligonucleotide; PD-L1 exon 2; Set B
uaaaauauagaaccuaauggaaggauuuggugucuuac

SEQ ID NO: 17678 - RNA, 19 nt, Artificial Sequence
  Synthetic Oligonucleotide; PD-L1 exon 2; Set C
gaaccuaauggaaggauuu

SEQ ID NO: 17679 - RNA, 31 nt, Artificial Sequence
  Synthetic Oligonucleotide; PD-L1 exon 2; Set B
aauauagaaccuaauggaaggauuugguguc

SEQ ID NO: 17680 - RNA, 33 nt, Artificial Sequence
  Synthetic Oligonucleotide; PD-L1 exon 2; Set B
aaauauagaaccuaauggaaggauuuggugucu

SEQ ID NO: 17681 - RNA, 35 nt, Artificial Sequence
  Synthetic Oligonucleotide; PD-L1 exon 2; Set B
aaaauauagaaccuaauggaaggauuuggugucuu

SEQ ID NO: 17682 - RNA, 21 nt, Artificial Sequence
  Synthetic Oligonucleotide; PD-L1 exon 2; Set C
agaaccuaauggaaggauuug

SEQ ID NO: 17683 - RNA, 39 nt, Artificial Sequence
  Synthetic Oligonucleotide; PD-L1 exon 2; Set B
uuaaaauauagaaccuaauggaaggauuuggugucuuac

SEQ ID NO: 17684 - RNA, 18 nt, Artificial Sequence
  Synthetic Oligonucleotide; PD-L1 exon 2; Set C
gaaccuaauggaaggauu

SEQ ID NO: 17685 - RNA, 32 nt, Artificial Sequence
  Synthetic Oligonucleotide; PD-L1 exon 2; Set C
aaauauagaaccuaauggaaggauuugguguc

SEQ ID NO: 17686 - RNA, 34 nt, Artificial Sequence
  Synthetic Oligonucleotide; PD-L1 exon 2; Set B
aaaauauagaaccuaauggaaggauuuggugucu

SEQ ID NO: 17687 - RNA, 22 nt, Artificial Sequence
  Synthetic Oligonucleotide; PD-L1 exon 2; Set C
uagaaccuaauggaaggauuug

SEQ ID NO: 17688 - RNA, 40 nt, Artificial Sequence
  Synthetic Oligonucleotide; PD-L1 exon 2; Set B
uuuaaaauauagaaccuaauggaaggauuuggugucuuac

SEQ ID NO: 17689 - RNA, 17 nt, Artificial Sequence
  Synthetic Oligonucleotide; PD-L1 exon 2; Set C
gaaccuaauggaaggau

SEQ ID NO: 17690 - RNA, 21 nt, Artificial Sequence
  Synthetic Oligonucleotide; PD-L1 exon 2; Set C
uagaaccuaauggaaggauuu

SEQ ID NO: 17691 - RNA, 33 nt, Artificial Sequence
  Synthetic Oligonucleotide; PD-L1 exon 2; Set C
aaaauauagaaccuaauggaaggauuugguguc

SEQ ID NO: 17692 - RNA, 23 nt, Artificial Sequence
  Synthetic Oligonucleotide; PD-L1 exon 2; Set C
auagaaccuaauggaaggauuug

SEQ ID NO: 17693 - RNA, 20 nt, Artificial Sequence
  Synthetic Oligonucleotide; PD-L1 exon 2; Set C
uagaaccuaauggaaggauu

SEQ ID NO: 17694 - RNA, 22 nt, Artificial Sequence
  Synthetic Oligonucleotide; PD-L1 exon 2; Set C
auagaaccuaauggaaggauuu

SEQ ID NO: 17695 - RNA, 24 nt, Artificial Sequence
  Synthetic Oligonucleotide; PD-L1 exon 2; Set C
uauagaaccuaauggaaggauuug

SEQ ID NO: 17696 - RNA, 40 nt, Artificial Sequence
  Synthetic Oligonucleotide; PD-L1 exon 2; Set B
auuuaaaauauagaaccuaauggaaggauuuggugucuua

SEQ ID NO: 17697 - RNA, 26 nt, Artificial Sequence
  Synthetic Oligonucleotide; PD-L1 exon 2; Set C
auauagaaccuaauggaaggauuugg

SEQ ID NO: 17698 - RNA, 19 nt, Artificial Sequence
  Synthetic Oligonucleotide; PD-L1 exon 2; Set C
uagaaccuaauggaaggau

SEQ ID NO: 17699 - RNA, 21 nt, Artificial Sequence
  Synthetic Oligonucleotide; PD-L1 exon 2; Set C
auagaaccuaauggaaggauu

SEQ ID NO: 17700 - RNA, 23 nt, Artificial Sequence
  Synthetic Oligonucleotide; PD-L1 exon 2; Set C
uauagaaccuaauggaaggauuu

SEQ ID NO: 17701 - RNA, 25 nt, Artificial Sequence
  Synthetic Oligonucleotide; PD-L1 exon 2; Set C
auauagaaccuaauggaaggauuug

SEQ ID NO: 17702 - RNA, 27 nt, Artificial Sequence
  Synthetic Oligonucleotide; PD-L1 exon 2; Set C
aauauagaaccuaauggaaggauuugg

SEQ ID NO: 17703 - RNA, 20 nt, Artificial Sequence
  Synthetic Oligonucleotide; PD-L1 exon 2; Set C
auagaaccuaauggaaggau

SEQ ID NO: 17704 - RNA, 22 nt, Artificial Sequence
  Synthetic Oligonucleotide; PD-L1 exon 2; Set C
uauagaaccuaauggaaggauu

SEQ ID NO: 17705 - RNA, 26 nt, Artificial Sequence
  Synthetic Oligonucleotide; PD-L1 exon 2; Set C
aauauagaaccuaauggaaggauuug

SEQ ID NO: 17706 - RNA, 28 nt, Artificial Sequence
  Synthetic Oligonucleotide; PD-L1 exon 2; Set C
aaauauagaaccuaauggaaggauuugg

SEQ ID NO: 17707 - RNA, 21 nt, Artificial Sequence
  Synthetic Oligonucleotide; PD-L1 exon 2; Set C
uauagaaccuaauggaaggau

SEQ ID NO: 17708 - RNA, 25 nt, Artificial Sequence
  Synthetic Oligonucleotide; PD-L1 exon 2; Set C
aauauagaaccuaauggaaggauuu

SEQ ID NO: 17709 - RNA, 27 nt, Artificial Sequence
  Synthetic Oligonucleotide; PD-L1 exon 2; Set C
aaauauagaaccuaauggaaggauuug

SEQ ID NO: 17710 - RNA, 29 nt, Artificial Sequence
  Synthetic Oligonucleotide; PD-L1 exon 2; Set C
aaaauauagaaccuaauggaaggauuugg

SEQ ID NO: 17711 - RNA, 24 nt, Artificial Sequence
  Synthetic Oligonucleotide; PD-L1 exon 2; Set C
aauauagaaccuaauggaaggauu

SEQ ID NO: 17712 - RNA, 26 nt, Artificial Sequence
  Synthetic Oligonucleotide; PD-L1 exon 2; Set C
aaauauagaaccuaauggaaggauuu

SEQ ID NO: 17713 - RNA, 28 nt, Artificial Sequence
  Synthetic Oligonucleotide; PD-L1 exon 2; Set C
aaaauauagaaccuaauggaaggauuug

SEQ ID NO: 17714 - RNA, 30 nt, Artificial Sequence
  Synthetic Oligonucleotide; PD-L1 exon 2; Set C
uaaaauauagaaccuaauggaaggauuugg

SEQ ID NO: 17715 - RNA, 25 nt, Artificial Sequence
  Synthetic Oligonucleotide; PD-L1 exon 2; Set C
aaauauagaaccuaauggaaggauu

SEQ ID NO: 17716 - RNA, 23 nt, Artificial Sequence
  Synthetic Oligonucleotide; PD-L1 exon 2; Set C
aauauagaaccuaauggaaggau

SEQ ID NO: 17717 - RNA, 27 nt, Artificial Sequence
  Synthetic Oligonucleotide; PD-L1 exon 2; Set C
aaaauauagaaccuaauggaaggauuu

SEQ ID NO: 17718 - RNA, 31 nt, Artificial Sequence
  Synthetic Oligonucleotide; PD-L1 exon 2; Set C
uuaaaauauagaaccuaauggaaggauuugg

SEQ ID NO: 17719 - RNA, 26 nt, Artificial Sequence
  Synthetic Oligonucleotide; PD-L1 exon 2; Set C
aaaauauagaaccuaauggaaggauu

SEQ ID NO: 17720 - RNA, 24 nt, Artificial Sequence
  Synthetic Oligonucleotide; PD-L1 exon 2; Set C
aaauauagaaccuaauggaaggau

SEQ ID NO: 17721 - RNA, 32 nt, Artificial Sequence
  Synthetic Oligonucleotide; PD-L1 exon 2; Set C
uuuaaaauauagaaccuaauggaaggauuugg

SEQ ID NO: 17722 - RNA, 25 nt, Artificial Sequence
  Synthetic Oligonucleotide; PD-L1 exon 2; Set C
aaaauauagaaccuaauggaaggau

SEQ ID NO: 17723 - RNA, 15 nt, Artificial Sequence
  Synthetic Oligonucleotide; PD-L1 exon 2; Set C
auagaaccuaaugga

SEQ ID NO: 17724 - RNA, 33 nt, Artificial Sequence
  Synthetic Oligonucleotide; PD-L1 exon 2; Set C
auuuaaaauauagaaccuaauggaaggauuugg

SEQ ID NO: 17725 - RNA, 39 nt, Artificial Sequence
  Synthetic Oligonucleotide; PD-L1 exon 2; Set C
aauauuuaaaauauagaaccuaauggaaggauuuggugu

SEQ ID NO: 17726 - RNA, 16 nt, Artificial Sequence
  Synthetic Oligonucleotide; PD-L1 exon 2; Set C
uauagaaccuaaugga

SEQ ID NO: 17727 - RNA, 18 nt, Artificial Sequence
  Synthetic Oligonucleotide; PD-L1 exon 2; Set C
auauagaaccuaauggaa

SEQ ID NO: 17728 - RNA, 34 nt, Artificial Sequence
  Synthetic Oligonucleotide; PD-L1 exon 2; Set C
uauuuaaaauauagaaccuaauggaaggauuugg

SEQ ID NO: 17729 - RNA, 40 nt, Artificial Sequence
  Synthetic Oligonucleotide; PD-L1 exon 2; Set C
aaauauuuaaaauauagaaccuaauggaaggauuuggugu

SEQ ID NO: 17730 - RNA, 15 nt, Artificial Sequence
  Synthetic Oligonucleotide; PD-L1 exon 2; Set C
uauagaaccuaaugg

SEQ ID NO: 17731 - RNA, 19 nt, Artificial Sequence
  Synthetic Oligonucleotide; PD-L1 exon 2; Set C
aauauagaaccuaauggaa

SEQ ID NO: 17732 - RNA, 35 nt, Artificial Sequence
  Synthetic Oligonucleotide; PD-L1 exon 2; Set C
auauuuaaaauauagaaccuaauggaaggauuugg

SEQ ID NO: 17733 - RNA, 18 nt, Artificial Sequence
  Synthetic Oligonucleotide; PD-L1 exon 2; Set C
aauauagaaccuaaugga

SEQ ID NO: 17734 - RNA, 20 nt, Artificial Sequence
  Synthetic Oligonucleotide; PD-L1 exon 2; Set C
aaauauagaaccuaauggaa

SEQ ID NO: 17735 - RNA, 36 nt, Artificial Sequence
  Synthetic Oligonucleotide; PD-L1 exon 2; Set C
aauauuuaaaauauagaaccuaauggaaggauuugg

SEQ ID NO: 17736 - RNA, 17 nt, Artificial Sequence
  Synthetic Oligonucleotide; PD-L1 exon 2; Set C
aauauagaaccuaaugg

SEQ ID NO: 17737 - RNA, 19 nt, Artificial Sequence
  Synthetic Oligonucleotide; PD-L1 exon 2; Set C
aaauauagaaccuaaugga

SEQ ID NO: 17738 - RNA, 15 nt, Artificial Sequence
  Synthetic Oligonucleotide; PD-L1 exon 2; Set C
auauagaaccuaaug

SEQ ID NO: 17739 - RNA, 21 nt, Artificial Sequence
  Synthetic Oligonucleotide; PD-L1 exon 2; Set C
aaaauauagaaccuaauggaa

SEQ ID NO: 17740 - RNA, 37 nt, Artificial Sequence
  Synthetic Oligonucleotide; PD-L1 exon 2; Set C
aaauauuuaaaauauagaaccuaauggaaggauuugg

SEQ ID NO: 17741 - RNA, 18 nt, Artificial Sequence
  Synthetic Oligonucleotide; PD-L1 exon 2; Set C
aaauauagaaccuaaugg

SEQ ID NO: 17742 - RNA, 20 nt, Artificial Sequence
  Synthetic Oligonucleotide; PD-L1 exon 2; Set C
aaaauauagaaccuaaugga

SEQ ID NO: 17743 - RNA, 16 nt, Artificial Sequence
  Synthetic Oligonucleotide; PD-L1 exon 2; Set C
aauauagaaccuaaug

SEQ ID NO: 17744 - RNA, 22 nt, Artificial Sequence
  Synthetic Oligonucleotide; PD-L1 exon 2; Set C
uaaaauauagaaccuaauggaa

SEQ ID NO: 17745 - RNA, 38 nt, Artificial Sequence
  Synthetic Oligonucleotide; PD-L1 exon 2; Set C
aaaauauuuaaaauauagaaccuaauggaaggauuugg

SEQ ID NO: 17746 - RNA, 19 nt, Artificial Sequence
  Synthetic Oligonucleotide; PD-L1 exon 2; Set C
aaaauauagaaccuaaugg

SEQ ID NO: 17747 - RNA, 17 nt, Artificial Sequence
  Synthetic Oligonucleotide; PD-L1 exon 2; Set C
aaauauagaaccuaaug

SEQ ID NO: 17748 - RNA, 15 nt, Artificial Sequence
  Synthetic Oligonucleotide; PD-L1 exon 2; Set C
aauauagaaccuaau

SEQ ID NO: 17749 - RNA, 23 nt, Artificial Sequence
  Synthetic Oligonucleotide; PD-L1 exon 2; Set C
uuaaaauauagaaccuaauggaa

SEQ ID NO: 17750 - RNA, 39 nt, Artificial Sequence
  Synthetic Oligonucleotide; PD-L1 exon 2; Set C
uaaaauauuuaaaauauagaaccuaauggaaggauuugg

SEQ ID NO: 17751 - RNA, 18 nt, Artificial Sequence
  Synthetic Oligonucleotide; PD-L1 exon 2; Set C
aaaauauagaaccuaaug

SEQ ID NO: 17752 - RNA, 16 nt, Artificial Sequence
  Synthetic Oligonucleotide; PD-L1 exon 2; Set C
aaauauagaaccuaau

SEQ ID NO: 17753 - RNA, 24 nt, Artificial Sequence
  Synthetic Oligonucleotide; PD-L1 exon 2; Set C
uuuaaaauauagaaccuaauggaa

SEQ ID NO: 17754 - RNA, 40 nt, Artificial Sequence
  Synthetic Oligonucleotide; PD-L1 exon 2; Set C
uuaaaauauuuaaaauauagaaccuaauggaaggauuugg

SEQ ID NO: 17755 - RNA, 17 nt, Artificial Sequence
  Synthetic Oligonucleotide; PD-L1 exon 2; Set C
aaaauauagaaccuaau

SEQ ID NO: 17756 - RNA, 15 nt, Artificial Sequence
  Synthetic Oligonucleotide; PD-L1 exon 2; Set C
aaauauagaaccuaa

SEQ ID NO: 17757 - RNA, 25 nt, Artificial Sequence
  Synthetic Oligonucleotide; PD-L1 exon 2; Set C
auuuaaaauauagaaccuaauggaa

SEQ ID NO: 17758 - RNA, 18 nt, Artificial Sequence
  Synthetic Oligonucleotide; PD-L1 exon 2; Set C
uaaaauauagaaccuaau

SEQ ID NO: 17759 - RNA, 16 nt, Artificial Sequence
  Synthetic Oligonucleotide; PD-L1 exon 2; Set C
aaaauauagaaccuaa

SEQ ID NO: 17760 - RNA, 26 nt, Artificial Sequence
  Synthetic Oligonucleotide; PD-L1 exon 2; Set C
uauuuaaaauauagaaccuaauggaa

SEQ ID NO: 17761 - RNA, 17 nt, Artificial Sequence
  Synthetic Oligonucleotide; PD-L1 exon 2; Set C
uaaaauauagaaccuaa

SEQ ID NO: 17762 - RNA, 27 nt, Artificial Sequence
  Synthetic Oligonucleotide; PD-L1 exon 2; Set C
auauuuaaaauauagaaccuaauggaa

SEQ ID NO: 17763 - RNA, 40 nt, Artificial Sequence
  Synthetic Oligonucleotide; PD-L1 exon 2; Set C
gguuaaaauauuuaaaauauagaaccuaauggaaggauuu

SEQ ID NO: 17764 - RNA, 20 nt, Artificial Sequence
  Synthetic Oligonucleotide; PD-L1 exon 2; Set C
uuuaaaauauagaaccuaau

SEQ ID NO: 17765 - RNA, 18 nt, Artificial Sequence
  Synthetic Oligonucleotide; PD-L1 exon 2; Set C
uuaaaauauagaaccuaa

SEQ ID NO: 17766 - RNA, 28 nt, Artificial Sequence
  Synthetic Oligonucleotide; PD-L1 exon 2; Set C
aauauuuaaaauauagaaccuaauggaa

SEQ ID NO: 17767 - RNA, 16 nt, Artificial Sequence
  Synthetic Oligonucleotide; PD-L1 exon 2; Set C
uaaaauauagaaccua

SEQ ID NO: 17768 - RNA, 39 nt, Artificial Sequence
  Synthetic Oligonucleotide; PD-L1 exon 2; Set C
gguuaaaauauuuaaaauauagaaccuaauggaaggauu

SEQ ID NO: 17769 - RNA, 21 nt, Artificial Sequence
  Synthetic Oligonucleotide; PD-L1 exon 2; Set C
auuuaaaauauagaaccuaau

SEQ ID NO: 17770 - RNA, 19 nt, Artificial Sequence
  Synthetic Oligonucleotide; PD-L1 exon 2; Set C
uuuaaaauauagaaccuaa

SEQ ID NO: 17771 - RNA, 29 nt, Artificial Sequence
  Synthetic Oligonucleotide; PD-L1 exon 2; Set C
aaauauuuaaaauauagaaccuaauggaa

SEQ ID NO: 17772 - RNA, 17 nt, Artificial Sequence
  Synthetic Oligonucleotide; PD-L1 exon 2; Set C
uuaaaauauagaaccua

SEQ ID NO: 17773 - RNA, 38 nt, Artificial Sequence
  Synthetic Oligonucleotide; PD-L1 exon 2; Set C
gguuaaaauauuuaaaauauagaaccuaauggaaggau

SEQ ID NO: 17774 - RNA, 22 nt, Artificial Sequence
  Synthetic Oligonucleotide; PD-L1 exon 2; Set C
uauuuaaaauauagaaccuaau

SEQ ID NO: 17775 - RNA, 20 nt, Artificial Sequence
  Synthetic Oligonucleotide; PD-L1 exon 2; Set C
auuuaaaauauagaaccuaa

SEQ ID NO: 17776 - RNA, 18 nt, Artificial Sequence
  Synthetic Oligonucleotide; PD-L1 exon 2; Set C
uuuaaaauauagaaccua

SEQ ID NO: 17777 - RNA, 23 nt, Artificial Sequence
  Synthetic Oligonucleotide; PD-L1 exon 2; Set C
auauuuaaaauauagaaccuaau

SEQ ID NO: 17778 - RNA, 21 nt, Artificial Sequence
  Synthetic Oligonucleotide; PD-L1 exon 2; Set C
uauuuaaaauauagaaccuaa

SEQ ID NO: 17779 - RNA, 19 nt, Artificial Sequence
  Synthetic Oligonucleotide; PD-L1 exon 2; Set C
auuuaaaauauagaaccua

SEQ ID NO: 17780 - RNA, 22 nt, Artificial Sequence
  Synthetic Oligonucleotide; PD-L1 exon 2; Set C
auauuuaaaauauagaaccuaa

SEQ ID NO: 17781 - RNA, 20 nt, Artificial Sequence
  Synthetic Oligonucleotide; PD-L1 exon 2; Set C
uauuuaaaauauagaaccua

SEQ ID NO: 17782 - RNA, 23 nt, Artificial Sequence
  Synthetic Oligonucleotide; PD-L1 exon 2; Set C
aauauuuaaaauauagaaccuaa

SEQ ID NO: 17783 - RNA, 21 nt, Artificial Sequence
  Synthetic Oligonucleotide; PD-L1 exon 2; Set C
auauuuaaaauauagaaccua

SEQ ID NO: 17784 - RNA, 22 nt, Artificial Sequence
  Synthetic Oligonucleotide; PD-L1 exon 2; Set C
aauauuuaaaauauagaaccua

SEQ ID NO: 17785 - RNA, 15 nt, Artificial Sequence
  Synthetic Oligonucleotide; PD-L1 exon 2; Set C
auuuaaaauauagaa

SEQ ID NO: 17786 - RNA, 23 nt, Artificial Sequence
  Synthetic Oligonucleotide; PD-L1 exon 2; Set C
aaauauuuaaaauauagaaccua

SEQ ID NO: 17787 - RNA, 32 nt, Artificial Sequence
  Synthetic Oligonucleotide; PD-L1 exon 2; Set C
gguuaaaauauuuaaaauauagaaccuaaugg

SEQ ID NO: 17788 - RNA, 16 nt, Artificial Sequence
  Synthetic Oligonucleotide; PD-L1 exon 2; Set C
uauuuaaaauauagaa

SEQ ID NO: 17789 - RNA, 24 nt, Artificial Sequence
  Synthetic Oligonucleotide; PD-L1 exon 2; Set C
aaaauauuuaaaauauagaaccua

SEQ ID NO: 17790 - RNA, 17 nt, Artificial Sequence
  Synthetic Oligonucleotide; PD-L1 exon 2; Set C
auauuuaaaauauagaa

SEQ ID NO: 17791 - RNA, 25 nt, Artificial Sequence
  Synthetic Oligonucleotide; PD-L1 exon 2; Set C
uaaaauauuuaaaauauagaaccua

SEQ ID NO: 17792 - RNA, 18 nt, Artificial Sequence
  Synthetic Oligonucleotide; PD-L1 exon 2; Set C
aauauuuaaaauauagaa

SEQ ID NO: 17793 - RNA, 26 nt, Artificial Sequence
  Synthetic Oligonucleotide; PD-L1 exon 2; Set C
uuaaaauauuuaaaauauagaaccua

SEQ ID NO: 17794 - RNA, 15 nt, Artificial Sequence
  Synthetic Oligonucleotide; PD-L1 exon 2; Set C
auauuuaaaauauag

SEQ ID NO: 17795 - RNA, 19 nt, Artificial Sequence
  Synthetic Oligonucleotide; PD-L1 exon 2; Set C
aaauauuuaaaauauagaa

SEQ ID NO: 17796 - RNA, 27 nt, Artificial Sequence
  Synthetic Oligonucleotide; PD-L1 exon 2; Set C
guuaaaauauuuaaaauauagaaccua

SEQ ID NO: 17797 - RNA, 16 nt, Artificial Sequence
  Synthetic Oligonucleotide; PD-L1 exon 2; Set C
aauauuuaaaauauag

SEQ ID NO: 17798 - RNA, 20 nt, Artificial Sequence
  Synthetic Oligonucleotide; PD-L1 exon 2; Set C
aaaauauuuaaaauauagaa

SEQ ID NO: 17799 - RNA, 17 nt, Artificial Sequence
  Synthetic Oligonucleotide; PD-L1 exon 2; Set C
aaauauuuaaaauauag

SEQ ID NO: 17800 - RNA, 15 nt, Artificial Sequence
  Synthetic Oligonucleotide; PD-L1 exon 2; Set C
aauauuuaaaauaua

SEQ ID NO: 17801 - RNA, 21 nt, Artificial Sequence
  Synthetic Oligonucleotide; PD-L1 exon 2; Set C
uaaaauauuuaaaauauagaa

SEQ ID NO: 17802 - RNA, 18 nt, Artificial Sequence
  Synthetic Oligonucleotide; PD-L1 exon 2; Set C
aaaauauuuaaaauauag

SEQ ID NO: 17803 - RNA, 16 nt, Artificial Sequence
  Synthetic Oligonucleotide; PD-L1 exon 2; Set C
aaauauuuaaaauaua

SEQ ID NO: 17804 - RNA, 22 nt, Artificial Sequence
  Synthetic Oligonucleotide; PD-L1 exon 2; Set C
uuaaaauauuuaaaauauagaa

SEQ ID NO: 17805 - RNA, 19 nt, Artificial Sequence
  Synthetic Oligonucleotide; PD-L1 exon 2; Set C
uaaaauauuuaaaauauag

SEQ ID NO: 17806 - RNA, 17 nt, Artificial Sequence
  Synthetic Oligonucleotide; PD-L1 exon 2; Set C
aaaauauuuaaaauaua

SEQ ID NO: 17807 - RNA, 15 nt, Artificial Sequence
  Synthetic Oligonucleotide; PD-L1 exon 2; Set C
aaauauuuaaaauau

SEQ ID NO: 17808 - RNA, 23 nt, Artificial Sequence
  Synthetic Oligonucleotide; PD-L1 exon 2; Set C
guuaaaauauuuaaaauauagaa

SEQ ID NO: 17809 - RNA, 20 nt, Artificial Sequence
  Synthetic Oligonucleotide; PD-L1 exon 2; Set C
uuaaaauauuuaaaauauag

SEQ ID NO: 17810 - RNA, 18 nt, Artificial Sequence
  Synthetic Oligonucleotide; PD-L1 exon 2; Set C
uaaaauauuuaaaauaua

SEQ ID NO: 17811 - RNA, 16 nt, Artificial Sequence
  Synthetic Oligonucleotide; PD-L1 exon 2; Set C
aaaauauuuaaaauau

SEQ ID NO: 17812 - RNA, 23 nt, Artificial Sequence
  Synthetic Oligonucleotide; PD-L1 exon 2; Set C
gguuaaaauauuuaaaauauaga

SEQ ID NO: 17813 - RNA, 21 nt, Artificial Sequence
  Synthetic Oligonucleotide; PD-L1 exon 2; Set C
guuaaaauauuuaaaauauag

SEQ ID NO: 17814 - RNA, 19 nt, Artificial Sequence
  Synthetic Oligonucleotide; PD-L1 exon 2; Set C
uuaaaauauuuaaaauaua

SEQ ID NO: 17815 - RNA, 17 nt, Artificial Sequence
  Synthetic Oligonucleotide; PD-L1 exon 2; Set C
uaaaauauuuaaaauau

SEQ ID NO: 17816 - RNA, 20 nt, Artificial Sequence
  Synthetic Oligonucleotide; PD-L1 exon 2; Set C
guuaaaauauuuaaaauaua

SEQ ID NO: 17817 - RNA, 18 nt, Artificial Sequence
  Synthetic Oligonucleotide; PD-L1 exon 2; Set C
uuaaaauauuuaaaauau

SEQ ID NO: 17818 - RNA, 19 nt, Artificial Sequence
  Synthetic Oligonucleotide; PD-L1 exon 2; Set C
guuaaaauauuuaaaauau

SEQ ID NO: 17819 - RNA, 19 nt, Artificial Sequence
  Synthetic Oligonucleotide; PD-L1 exon 2; Set C
gguuaaaauauuuaaaaua

SEQ ID NO: 17820 - RNA, 15 nt, Artificial Sequence
  Synthetic Oligonucleotide; PD-L1 exon 2; Set C
gguuaaaauauuuaa

SEQ ID NO: 17821 - RNA, 20 nt, Artificial Sequence
  Synthetic Oligonucleotide; PD-L1 exon 2; Set C
cuucacuuaauaauuaaaca

SEQ ID NO: 17822 - RNA, 17 nt, Artificial Sequence
  Synthetic Oligonucleotide; PD-L1 exon 2; Set C
uucacuuaauaauuaaa

SEQ ID NO: 17823 - RNA, 21 nt, Artificial Sequence
  Synthetic Oligonucleotide; PD-L1 exon 2; Set C
gcuucacuuaauaauuaaaca

SEQ ID NO: 17824 - RNA, 19 nt, Artificial Sequence
  Synthetic Oligonucleotide; PD-L1 exon 2; Set C
cuucacuuaauaauuaaac

SEQ ID NO: 17825 - RNA, 16 nt, Artificial Sequence
  Synthetic Oligonucleotide; PD-L1 exon 2; Set C
uucacuuaauaauuaa

SEQ ID NO: 17826 - RNA, 18 nt, Artificial Sequence
  Synthetic Oligonucleotide; PD-L1 exon 2; Set C
cuucacuuaauaauuaaa

SEQ ID NO: 17827 - RNA, 20 nt, Artificial Sequence
  Synthetic Oligonucleotide; PD-L1 exon 2; Set C
gcuucacuuaauaauuaaac

SEQ ID NO: 17828 - RNA, 17 nt, Artificial Sequence
  Synthetic Oligonucleotide; PD-L1 exon 2; Set C
cuucacuuaauaauuaa

SEQ ID NO: 17829 - RNA, 15 nt, Artificial Sequence
  Synthetic Oligonucleotide; PD-L1 exon 2; Set C
uucacuuaauaauua

SEQ ID NO: 17830 - RNA, 16 nt, Artificial Sequence
  Synthetic Oligonucleotide; PD-L1 exon 2; Set C
cuucacuuaauaauua

SEQ ID NO: 17831 - RNA, 15 nt, Artificial Sequence
  Synthetic Oligonucleotide; PD-L1 exon 2; Set C
cuucacuuaauaauu

SEQ ID NO: 17832 - RNA, 32 nt, Artificial Sequence
  Synthetic Oligonucleotide; PD-L1 exon 2; Set C
aaaagaagacugcuucacuuaauaauuaaaca

SEQ ID NO: 17833 - RNA, 33 nt, Artificial Sequence
  Synthetic Oligonucleotide; PD-L1 exon 2; Set C
gaaaagaagacugcuucacuuaauaauuaaaca

SEQ ID NO: 17834 - RNA, 31 nt, Artificial Sequence
  Synthetic Oligonucleotide; PD-L1 exon 2; Set C
aaaagaagacugcuucacuuaauaauuaaac

SEQ ID NO: 17835 - RNA, 30 nt, Artificial Sequence
  Synthetic Oligonucleotide; PD-L1 exon 2; Set C
aaaagaagacugcuucacuuaauaauuaaa

SEQ ID NO: 17836 - RNA, 32 nt, Artificial Sequence
  Synthetic Oligonucleotide; PD-L1 exon 2; Set C
gaaaagaagacugcuucacuuaauaauuaaac

SEQ ID NO: 17837 - RNA, 29 nt, Artificial Sequence
  Synthetic Oligonucleotide; PD-L1 exon 2; Set C
aaaagaagacugcuucacuuaauaauuaa

SEQ ID NO: 17838 - RNA, 31 nt, Artificial Sequence
  Synthetic Oligonucleotide; PD-L1 exon 2; Set C
gaaaagaagacugcuucacuuaauaauuaaa

SEQ ID NO: 17839 - RNA, 30 nt, Artificial Sequence
  Synthetic Oligonucleotide; PD-L1 exon 2; Set C
gaaaagaagacugcuucacuuaauaauuaa

SEQ ID NO: 17840 - RNA, 28 nt, Artificial Sequence
  Synthetic Oligonucleotide; PD-L1 exon 2; Set C
aaaagaagacugcuucacuuaauaauua

SEQ ID NO: 17841 - RNA, 29 nt, Artificial Sequence
  Synthetic Oligonucleotide; PD-L1 exon 2; Set C
gaaaagaagacugcuucacuuaauaauua

SEQ ID NO: 17842 - RNA, 27 nt, Artificial Sequence
  Synthetic Oligonucleotide; PD-L1 exon 2; Set C
aaaagaagacugcuucacuuaauaauu

SEQ ID NO: 17843 - RNA, 28 nt, Artificial Sequence
  Synthetic Oligonucleotide; PD-L1 exon 2; Set C
gaaaagaagacugcuucacuuaauaauu

SEQ ID NO: 17844 - RNA, 26 nt, Artificial Sequence
  Synthetic Oligonucleotide; PD-L1 exon 2; Set C
aaaagaagacugcuucacuuaauaau

SEQ ID NO: 17845 - RNA, 27 nt, Artificial Sequence
  Synthetic Oligonucleotide; PD-L1 exon 2; Set C
gaaaagaagacugcuucacuuaauaau

SEQ ID NO: 17846 - RNA, 26 nt, Artificial Sequence
  Synthetic Oligonucleotide; PD-L1 exon 2; Set C
gaaaagaagacugcuucacuuaauaa

SEQ ID NO: 17847 - RNA, 40 nt, Artificial Sequence
  Synthetic Oligonucleotide; PD-L1 exon 2; Set A
uauggaaaacacgaaaagaagacugcuucacuuaauaauu

SEQ ID NO: 17848 - RNA, 39 nt, Artificial Sequence
  Synthetic Oligonucleotide; PD-L1 exon 2; Set A
uauggaaaacacgaaaagaagacugcuucacuuaauaau

SEQ ID NO: 17849 - RNA, 40 nt, Artificial Sequence
  Synthetic Oligonucleotide; PD-L1 exon 2; Set A
uuauggaaaacacgaaaagaagacugcuucacuuaauaau

SEQ ID NO: 17850 - RNA, 38 nt, Artificial Sequence
  Synthetic Oligonucleotide; PD-L1 exon 2; Set A
uauggaaaacacgaaaagaagacugcuucacuuaauaa

SEQ ID NO: 17851 - RNA, 39 nt, Artificial Sequence
  Synthetic Oligonucleotide; PD-L1 exon 2; Set A
uuauggaaaacacgaaaagaagacugcuucacuuaauaa

SEQ ID NO: 17852 - RNA, 40 nt, Artificial Sequence
  Synthetic Oligonucleotide; PD-L1 exon 2; Set A
auuauggaaaacacgaaaagaagacugcuucacuuaauaa

SEQ ID NO: 17853 - RNA, 15 nt, Artificial Sequence
  Synthetic Oligonucleotide; PD-L1 exon 2; Set C
uauggaaaacacgaa

SEQ ID NO: 17854 - RNA, 19 nt, Artificial Sequence
  Synthetic Oligonucleotide; PD-L1 exon 2; Set C
aauuauggaaaacacgaaa

SEQ ID NO: 17855 - RNA, 18 nt, Artificial Sequence
  Synthetic Oligonucleotide; PD-L1 exon 2; Set C
aauuauggaaaacacgaa

SEQ ID NO: 17856 - RNA, 20 nt, Artificial Sequence
  Synthetic Oligonucleotide; PD-L1 exon 2; Set C
uaauuauggaaaacacgaaa

SEQ ID NO: 17857 - RNA, 19 nt, Artificial Sequence
  Synthetic Oligonucleotide; PD-L1 exon 2; Set C
uaauuauggaaaacacgaa

SEQ ID NO: 17858 - RNA, 25 nt, Artificial Sequence
  Synthetic Oligonucleotide; PD-L1 exon 2; Set C
ugcccuaauuauggaaaacacgaaa

SEQ ID NO: 17859 - RNA, 24 nt, Artificial Sequence
  Synthetic Oligonucleotide; PD-L1 exon 2; Set C
ugcccuaauuauggaaaacacgaa

SEQ ID NO: 17860 - RNA, 29 nt, Artificial Sequence
  Synthetic Oligonucleotide; PD-L1 exon 2; Set C
ggaaugcccuaauuauggaaaacacgaaa

SEQ ID NO: 17861 - RNA, 28 nt, Artificial Sequence
  Synthetic Oligonucleotide; PD-L1 exon 2; Set A
ggaaugcccuaauuauggaaaacacgaa

SEQ ID NO: 17862 - RNA, 17 nt, Artificial Sequence
  Synthetic Oligonucleotide; PD-L1 exon 2; Set C
ugcccuaauuauggaaa

SEQ ID NO: 17863 - RNA, 36 nt, Artificial Sequence
  Synthetic Oligonucleotide; PD-L1 exon 2; Set A
ucuuucuggaaugcccuaauuauggaaaacacgaaa

SEQ ID NO: 17864 - RNA, 37 nt, Artificial Sequence
  Synthetic Oligonucleotide; PD-L1 exon 2; Set A
aucuuucuggaaugcccuaauuauggaaaacacgaaa

SEQ ID NO: 17865 - RNA, 35 nt, Artificial Sequence
  Synthetic Oligonucleotide; PD-L1 exon 2; Set A
ucuuucuggaaugcccuaauuauggaaaacacgaa

SEQ ID NO: 17866 - RNA, 21 nt, Artificial Sequence
  Synthetic Oligonucleotide; PD-L1 exon 2; Set C
ggaaugcccuaauuauggaaa

SEQ ID NO: 17867 - RNA, 36 nt, Artificial Sequence
  Synthetic Oligonucleotide; PD-L1 exon 2; Set A
aucuuucuggaaugcccuaauuauggaaaacacgaa

SEQ ID NO: 17868 - RNA, 28 nt, Artificial Sequence
  Synthetic Oligonucleotide; PD-L1 exon 2; Set C
ucuuucuggaaugcccuaauuauggaaa

SEQ ID NO: 17869 - RNA, 29 nt, Artificial Sequence
  Synthetic Oligonucleotide; PD-L1 exon 2; Set C
aucuuucuggaaugcccuaauuauggaaa

SEQ ID NO: 17870 - RNA, 20 nt, Artificial Sequence
  Synthetic Oligonucleotide; PD-L1 exon 2; Set C
ucuuucuggaaugcccuaau

SEQ ID NO: 17871 - RNA, 21 nt, Artificial Sequence
  Synthetic Oligonucleotide; PD-L1 exon 2; Set C
aucuuucuggaaugcccuaau

SEQ ID NO: 17872 - RNA, 19 nt, Artificial Sequence
  Synthetic Oligonucleotide; PD-L1 exon 2; Set C
ucuuucuggaaugcccuaa

SEQ ID NO: 17873 - RNA, 38 nt, Artificial Sequence
  Synthetic Oligonucleotide; PD-L1 exon 2; Set A
aauauccucaucuuucuggaaugcccuaauuauggaaa

SEQ ID NO: 17874 - RNA, 20 nt, Artificial Sequence
  Synthetic Oligonucleotide; PD-L1 exon 2; Set C
aucuuucuggaaugcccuaa

SEQ ID NO: 17875 - RNA, 39 nt, Artificial Sequence
  Synthetic Oligonucleotide; PD-L1 exon 2; Set A
aaauauccucaucuuucuggaaugcccuaauuauggaaa

SEQ ID NO: 17876 - RNA, 40 nt, Artificial Sequence
  Synthetic Oligonucleotide; PD-L1 exon 2; Set A
caaauauccucaucuuucuggaaugcccuaauuauggaaa

SEQ ID NO: 17877 - RNA, 15 nt, Artificial Sequence
  Synthetic Oligonucleotide; PD-L1 exon 2; Set C
aucuuucuggaaugc

SEQ ID NO: 17878 - RNA, 30 nt, Artificial Sequence
  Synthetic Oligonucleotide; PD-L1 exon 2; Set A
aauauccucaucuuucuggaaugcccuaau

SEQ ID NO: 17879 - RNA, 31 nt, Artificial Sequence
  Synthetic Oligonucleotide; PD-L1 exon 2; Set A
aaauauccucaucuuucuggaaugcccuaau

SEQ ID NO: 17880 - RNA, 29 nt, Artificial Sequence
  Synthetic Oligonucleotide; PD-L1 exon 2; Set A
aauauccucaucuuucuggaaugcccuaa

SEQ ID NO: 17881 - RNA, 32 nt, Artificial Sequence
  Synthetic Oligonucleotide; PD-L1 exon 2; Set A
caaauauccucaucuuucuggaaugcccuaau

SEQ ID NO: 17882 - RNA, 30 nt, Artificial Sequence
  Synthetic Oligonucleotide; PD-L1 exon 2; Set A
aaauauccucaucuuucuggaaugcccuaa

SEQ ID NO: 17883 - RNA, 33 nt, Artificial Sequence
  Synthetic Oligonucleotide; PD-L1 exon 2; Set A
gcaaauauccucaucuuucuggaaugcccuaau

SEQ ID NO: 17884 - RNA, 31 nt, Artificial Sequence
  Synthetic Oligonucleotide; PD-L1 exon 2; Set A
caaauauccucaucuuucuggaaugcccuaa

SEQ ID NO: 17885 - RNA, 32 nt, Artificial Sequence
  Synthetic Oligonucleotide; PD-L1 exon 2; Set A
gcaaauauccucaucuuucuggaaugcccuaa

SEQ ID NO: 17886 - RNA, 20 nt, Artificial Sequence
  Synthetic Oligonucleotide; PD-L1 exon 2; Set C
aauauccucaucuuucugga

SEQ ID NO: 17887 - RNA, 19 nt, Artificial Sequence
  Synthetic Oligonucleotide; PD-L1 exon 2; Set C
aauauccucaucuuucugg

SEQ ID NO: 17888 - RNA, 21 nt, Artificial Sequence
  Synthetic Oligonucleotide; PD-L1 exon 2; Set C
aaauauccucaucuuucugga

SEQ ID NO: 17889 - RNA, 18 nt, Artificial Sequence
  Synthetic Oligonucleotide; PD-L1 exon 2; Set C
aauauccucaucuuucug

SEQ ID NO: 17890 - RNA, 20 nt, Artificial Sequence
  Synthetic Oligonucleotide; PD-L1 exon 2; Set C
aaauauccucaucuuucugg

SEQ ID NO: 17891 - RNA, 22 nt, Artificial Sequence
  Synthetic Oligonucleotide; PD-L1 exon 2; Set C
caaauauccucaucuuucugga

SEQ ID NO: 17892 - RNA, 19 nt, Artificial Sequence
  Synthetic Oligonucleotide; PD-L1 exon 2; Set C
aaauauccucaucuuucug

SEQ ID NO: 17893 - RNA, 17 nt, Artificial Sequence
  Synthetic Oligonucleotide; PD-L1 exon 2; Set C
aauauccucaucuuucu

SEQ ID NO: 17894 - RNA, 21 nt, Artificial Sequence
  Synthetic Oligonucleotide; PD-L1 exon 2; Set C
caaauauccucaucuuucugg

SEQ ID NO: 17895 - RNA, 23 nt, Artificial Sequence
  Synthetic Oligonucleotide; PD-L1 exon 2; Set C
gcaaauauccucaucuuucugga

SEQ ID NO: 17896 - RNA, 20 nt, Artificial Sequence
  Synthetic Oligonucleotide; PD-L1 exon 2; Set C
caaauauccucaucuuucug

SEQ ID NO: 17897 - RNA, 18 nt, Artificial Sequence
  Synthetic Oligonucleotide; PD-L1 exon 2; Set C
aaauauccucaucuuucu

SEQ ID NO: 17898 - RNA, 16 nt, Artificial Sequence
  Synthetic Oligonucleotide; PD-L1 exon 2; Set C
aauauccucaucuuuc

SEQ ID NO: 17899 - RNA, 22 nt, Artificial Sequence
  Synthetic Oligonucleotide; PD-L1 exon 2; Set C
gcaaauauccucaucuuucugg

SEQ ID NO: 17900 - RNA, 21 nt, Artificial Sequence
  Synthetic Oligonucleotide; PD-L1 exon 2; Set C
gcaaauauccucaucuuucug

SEQ ID NO: 17901 - RNA, 19 nt, Artificial Sequence
  Synthetic Oligonucleotide; PD-L1 exon 2; Set C
caaauauccucaucuuucu

SEQ ID NO: 17902 - RNA, 17 nt, Artificial Sequence
  Synthetic Oligonucleotide; PD-L1 exon 2; Set C
aaauauccucaucuuuc

SEQ ID NO: 17903 - RNA, 15 nt, Artificial Sequence
  Synthetic Oligonucleotide; PD-L1 exon 2; Set C
aauauccucaucuuu

SEQ ID NO: 17904 - RNA, 20 nt, Artificial Sequence
  Synthetic Oligonucleotide; PD-L1 exon 2; Set C
gcaaauauccucaucuuucu

SEQ ID NO: 17905 - RNA, 16 nt, Artificial Sequence
  Synthetic Oligonucleotide; PD-L1 exon 2; Set C
aaauauccucaucuuu

SEQ ID NO: 17906 - RNA, 18 nt, Artificial Sequence
  Synthetic Oligonucleotide; PD-L1 exon 2; Set C
caaauauccucaucuuuc

SEQ ID NO: 17907 - RNA, 15 nt, Artificial Sequence
  Synthetic Oligonucleotide; PD-L1 exon 2; Set C
aaauauccucaucuu

SEQ ID NO: 17908 - RNA, 17 nt, Artificial Sequence
  Synthetic Oligonucleotide; PD-L1 exon 2; Set C
caaauauccucaucuuu

SEQ ID NO: 17909 - RNA, 19 nt, Artificial Sequence
  Synthetic Oligonucleotide; PD-L1 exon 2; Set C
gcaaauauccucaucuuuc

SEQ ID NO: 17910 - RNA, 16 nt, Artificial Sequence
  Synthetic Oligonucleotide; PD-L1 exon 2; Set C
caaauauccucaucuu

SEQ ID NO: 17911 - RNA, 18 nt, Artificial Sequence
  Synthetic Oligonucleotide; PD-L1 exon 2; Set C
gcaaauauccucaucuuu

SEQ ID NO: 17912 - RNA, 17 nt, Artificial Sequence
  Synthetic Oligonucleotide; PD-L1 exon 2; Set C
gcaaauauccucaucuu

SEQ ID NO: 17913 - RNA, 31 nt, Artificial Sequence
  Synthetic Oligonucleotide; PD-L1 exon 2; Set A
auaaagacagcaaauauccucaucuuucugg

SEQ ID NO: 17914 - RNA, 33 nt, Artificial Sequence
  Synthetic Oligonucleotide; PD-L1 exon 2; Set A
uauaaagacagcaaauauccucaucuuucugga

SEQ ID NO: 17915 - RNA, 30 nt, Artificial Sequence
  Synthetic Oligonucleotide; PD-L1 exon 2; Set C
auaaagacagcaaauauccucaucuuucug

SEQ ID NO: 17916 - RNA, 32 nt, Artificial Sequence
  Synthetic Oligonucleotide; PD-L1 exon 2; Set A
uauaaagacagcaaauauccucaucuuucugg

SEQ ID NO: 17917 - RNA, 31 nt, Artificial Sequence
  Synthetic Oligonucleotide; PD-L1 exon 2; Set C
uauaaagacagcaaauauccucaucuuucug

SEQ ID NO: 17918 - RNA, 29 nt, Artificial Sequence
  Synthetic Oligonucleotide; PD-L1 exon 2; Set C
auaaagacagcaaauauccucaucuuucu

SEQ ID NO: 17919 - RNA, 30 nt, Artificial Sequence
  Synthetic Oligonucleotide; PD-L1 exon 2; Set C
uauaaagacagcaaauauccucaucuuucu

SEQ ID NO: 17920 - RNA, 29 nt, Artificial Sequence
  Synthetic Oligonucleotide; PD-L1 exon 2; Set C
uauaaagacagcaaauauccucaucuuuc

SEQ ID NO: 17921 - RNA, 28 nt, Artificial Sequence
  Synthetic Oligonucleotide; PD-L1 exon 2; Set C
uauaaagacagcaaauauccucaucuuu

SEQ ID NO: 17922 - RNA, 27 nt, Artificial Sequence
  Synthetic Oligonucleotide; PD-L1 exon 2; Set C
uauaaagacagcaaauauccucaucuu

SEQ ID NO: 17923 - RNA, 40 nt, Artificial Sequence
  Synthetic Oligonucleotide; PD-L1 exon 2; Set A
gucaugaauauaaagacagcaaauauccucaucuuucugg

SEQ ID NO: 17924 - RNA, 39 nt, Artificial Sequence
  Synthetic Oligonucleotide; PD-L1 exon 2; Set A
gucaugaauauaaagacagcaaauauccucaucuuucug

SEQ ID NO: 17925 - RNA, 38 nt, Artificial Sequence
  Synthetic Oligonucleotide; PD-L1 exon 2; Set A
gucaugaauauaaagacagcaaauauccucaucuuucu

SEQ ID NO: 17926 - RNA, 15 nt, Artificial Sequence
  Synthetic Oligonucleotide; PD-L1 exon 2; Set C
auaaagacagcaaau

SEQ ID NO: 17927 - RNA, 40 nt, Artificial Sequence
  Synthetic Oligonucleotide; PD-L1 exon 2; Set A
guaggucaugaauauaaagacagcaaauauccucaucuuu

SEQ ID NO: 17928 - RNA, 16 nt, Artificial Sequence
  Synthetic Oligonucleotide; PD-L1 exon 2; Set C
uauaaagacagcaaau

SEQ ID NO: 17929 - RNA, 39 nt, Artificial Sequence
  Synthetic Oligonucleotide; PD-L1 exon 2; Set A
guaggucaugaauauaaagacagcaaauauccucaucuu

SEQ ID NO: 17930 - RNA, 15 nt, Artificial Sequence
  Synthetic Oligonucleotide; PD-L1 exon 2; Set C
uauaaagacagcaaa

SEQ ID NO: 17931 - RNA, 40 nt, Artificial Sequence
  Synthetic Oligonucleotide; PD-L1 exon 2; Set A
aguaggucaugaauauaaagacagcaaauauccucaucuu

SEQ ID NO: 17932 - RNA, 24 nt, Artificial Sequence
  Synthetic Oligonucleotide; PD-L1 exon 2; Set C
gucaugaauauaaagacagcaaau

SEQ ID NO: 17933 - RNA, 23 nt, Artificial Sequence
  Synthetic Oligonucleotide; PD-L1 exon 2; Set C
gucaugaauauaaagacagcaaa

SEQ ID NO: 17934 - RNA, 28 nt, Artificial Sequence
  Synthetic Oligonucleotide; PD-L1 exon 2; Set C
guaggucaugaauauaaagacagcaaau

SEQ ID NO: 17935 - RNA, 27 nt, Artificial Sequence
  Synthetic Oligonucleotide; PD-L1 exon 2; Set C
guaggucaugaauauaaagacagcaaa

SEQ ID NO: 17936 - RNA, 26 nt, Artificial Sequence
  Synthetic Oligonucleotide; PD-L1 exon 2; Set C
guaggucaugaauauaaagacagcaa

SEQ ID NO: 17937 - RNA, 27 nt, Artificial Sequence
  Synthetic Oligonucleotide; PD-L1 exon 2; Set C
aguaggucaugaauauaaagacagcaa

SEQ ID NO: 17938 - RNA, 25 nt, Artificial Sequence
  Synthetic Oligonucleotide; PD-L1 exon 2; Set C
guaggucaugaauauaaagacagca

SEQ ID NO: 17939 - RNA, 26 nt, Artificial Sequence
  Synthetic Oligonucleotide; PD-L1 exon 2; Set C
aguaggucaugaauauaaagacagca

SEQ ID NO: 17940 - RNA, 35 nt, Artificial Sequence
  Synthetic Oligonucleotide; PD-L1 exon 2; Set A
aaugccaguaggucaugaauauaaagacagcaaau

SEQ ID NO: 17941 - RNA, 34 nt, Artificial Sequence
  Synthetic Oligonucleotide; PD-L1 exon 2; Set A
aaugccaguaggucaugaauauaaagacagcaaa

SEQ ID NO: 17942 - RNA, 36 nt, Artificial Sequence
  Synthetic Oligonucleotide; PD-L1 exon 2; Set A
aaaugccaguaggucaugaauauaaagacagcaaau

SEQ ID NO: 17943 - RNA, 35 nt, Artificial Sequence
  Synthetic Oligonucleotide; PD-L1 exon 2; Set A
aaaugccaguaggucaugaauauaaagacagcaaa

SEQ ID NO: 17944 - RNA, 33 nt, Artificial Sequence
  Synthetic Oligonucleotide; PD-L1 exon 2; Set A
aaugccaguaggucaugaauauaaagacagcaa

SEQ ID NO: 17945 - RNA, 37 nt, Artificial Sequence
  Synthetic Oligonucleotide; PD-L1 exon 2; Set A
caaaugccaguaggucaugaauauaaagacagcaaau

SEQ ID NO: 17946 - RNA, 36 nt, Artificial Sequence
  Synthetic Oligonucleotide; PD-L1 exon 2; Set A
caaaugccaguaggucaugaauauaaagacagcaaa

SEQ ID NO: 17947 - RNA, 34 nt, Artificial Sequence
  Synthetic Oligonucleotide; PD-L1 exon 2; Set A
aaaugccaguaggucaugaauauaaagacagcaa

SEQ ID NO: 17948 - RNA, 38 nt, Artificial Sequence
  Synthetic Oligonucleotide; PD-L1 exon 2; Set A
gcaaaugccaguaggucaugaauauaaagacagcaaau

SEQ ID NO: 17949 - RNA, 32 nt, Artificial Sequence
  Synthetic Oligonucleotide; PD-L1 exon 2; Set A
aaugccaguaggucaugaauauaaagacagca

SEQ ID NO: 17950 - RNA, 37 nt, Artificial Sequence
  Synthetic Oligonucleotide; PD-L1 exon 2; Set A
gcaaaugccaguaggucaugaauauaaagacagcaaa

SEQ ID NO: 17951 - RNA, 35 nt, Artificial Sequence
  Synthetic Oligonucleotide; PD-L1 exon 2; Set A
caaaugccaguaggucaugaauauaaagacagcaa

SEQ ID NO: 17952 - RNA, 33 nt, Artificial Sequence
  Synthetic Oligonucleotide; PD-L1 exon 2; Set A
aaaugccaguaggucaugaauauaaagacagca

SEQ ID NO: 17953 - RNA, 36 nt, Artificial Sequence
  Synthetic Oligonucleotide; PD-L1 exon 2; Set A
gcaaaugccaguaggucaugaauauaaagacagcaa

SEQ ID NO: 17954 - RNA, 34 nt, Artificial Sequence
  Synthetic Oligonucleotide; PD-L1 exon 2; Set A
caaaugccaguaggucaugaauauaaagacagca

SEQ ID NO: 17955 - RNA, 35 nt, Artificial Sequence
  Synthetic Oligonucleotide; PD-L1 exon 2; Set A
gcaaaugccaguaggucaugaauauaaagacagca

SEQ ID NO: 17956 - RNA, 25 nt, Artificial Sequence
  Synthetic Oligonucleotide; PD-L1 exon 2; Set C
caaaugccaguaggucaugaauaua

SEQ ID NO: 17957 - RNA, 24 nt, Artificial Sequence
  Synthetic Oligonucleotide; PD-L1 exon 2; Set C
caaaugccaguaggucaugaauau

SEQ ID NO: 17958 - RNA, 26 nt, Artificial Sequence
  Synthetic Oligonucleotide; PD-L1 exon 2; Set A
gcaaaugccaguaggucaugaauaua

SEQ ID NO: 17959 - RNA, 25 nt, Artificial Sequence
  Synthetic Oligonucleotide; PD-L1 exon 2; Set C
gcaaaugccaguaggucaugaauau

SEQ ID NO: 17960 - RNA, 16 nt, Artificial Sequence
  Synthetic Oligonucleotide; PD-L1 exon 2; Set C
aaugccaguaggucau

SEQ ID NO: 17961 - RNA, 15 nt, Artificial Sequence
  Synthetic Oligonucleotide; PD-L1 exon 2; Set C
aaugccaguagguca

SEQ ID NO: 17962 - RNA, 17 nt, Artificial Sequence
  Synthetic Oligonucleotide; PD-L1 exon 2; Set C
aaaugccaguaggucau

SEQ ID NO: 17963 - RNA, 16 nt, Artificial Sequence
  Synthetic Oligonucleotide; PD-L1 exon 2; Set C
aaaugccaguagguca

SEQ ID NO: 17964 - RNA, 18 nt, Artificial Sequence
  Synthetic Oligonucleotide; PD-L1 exon 2; Set C
caaaugccaguaggucau

SEQ ID NO: 17965 - RNA, 33 nt, Artificial Sequence
  Synthetic Oligonucleotide; PD-L1 exon 2; Set A
ccguucagcaaaugccaguaggucaugaauaua

SEQ ID NO: 17966 - RNA, 15 nt, Artificial Sequence
  Synthetic Oligonucleotide; PD-L1 exon 2; Set C
aaaugccaguagguc

SEQ ID NO: 17967 - RNA, 17 nt, Artificial Sequence
  Synthetic Oligonucleotide; PD-L1 exon 2; Set C
caaaugccaguagguca

SEQ ID NO: 17968 - RNA, 19 nt, Artificial Sequence
  Synthetic Oligonucleotide; PD-L1 exon 2; Set C
gcaaaugccaguaggucau

SEQ ID NO: 17969 - RNA, 34 nt, Artificial Sequence
  Synthetic Oligonucleotide; PD-L1 exon 2; Set C
accguucagcaaaugccaguaggucaugaauaua

SEQ ID NO: 17970 - RNA, 16 nt, Artificial Sequence
  Synthetic Oligonucleotide; PD-L1 exon 2; Set C
caaaugccaguagguc

SEQ ID NO: 17971 - RNA, 18 nt, Artificial Sequence
  Synthetic Oligonucleotide; PD-L1 exon 2; Set C
gcaaaugccaguagguca

SEQ ID NO: 17972 - RNA, 35 nt, Artificial Sequence
  Synthetic Oligonucleotide; PD-L1 exon 2; Set C
uaccguucagcaaaugccaguaggucaugaauaua

SEQ ID NO: 17973 - RNA, 17 nt, Artificial Sequence
  Synthetic Oligonucleotide; PD-L1 exon 2; Set C
gcaaaugccaguagguc

SEQ ID NO: 17974 - RNA, 34 nt, Artificial Sequence
  Synthetic Oligonucleotide; PD-L1 exon 2; Set C
uaccguucagcaaaugccaguaggucaugaauau

SEQ ID NO: 17975 - RNA, 23 nt, Artificial Sequence
  Synthetic Oligonucleotide; PD-L1 exon 2; Set A
uucagcaaaugccaguaggucau

SEQ ID NO: 17976 - RNA, 22 nt, Artificial Sequence
  Synthetic Oligonucleotide; PD-L1 exon 2; Set A
uucagcaaaugccaguagguca

SEQ ID NO: 17977 - RNA, 24 nt, Artificial Sequence
  Synthetic Oligonucleotide; PD-L1 exon 2; Set A
guucagcaaaugccaguaggucau

SEQ ID NO: 17978 - RNA, 23 nt, Artificial Sequence
  Synthetic Oligonucleotide; PD-L1 exon 2; Set A
guucagcaaaugccaguagguca

SEQ ID NO: 17979 - RNA, 25 nt, Artificial Sequence
  Synthetic Oligonucleotide; PD-L1 exon 2; Set A
cguucagcaaaugccaguaggucau

SEQ ID NO: 17980 - RNA, 40 nt, Artificial Sequence
  Synthetic Oligonucleotide; PD-L1 exon 2; Set C
ugucuuaccguucagcaaaugccaguaggucaugaauaua

SEQ ID NO: 17981 - RNA, 24 nt, Artificial Sequence
  Synthetic Oligonucleotide; PD-L1 exon 2; Set A
cguucagcaaaugccaguagguca

SEQ ID NO: 17982 - RNA, 26 nt, Artificial Sequence
  Synthetic Oligonucleotide; PD-L1 exon 2; Set A
ccguucagcaaaugccaguaggucau

SEQ ID NO: 17983 - RNA, 39 nt, Artificial Sequence
  Synthetic Oligonucleotide; PD-L1 exon 2; Set C
ugucuuaccguucagcaaaugccaguaggucaugaauau

SEQ ID NO: 17984 - RNA, 23 nt, Artificial Sequence
  Synthetic Oligonucleotide; PD-L1 exon 2; Set A
cguucagcaaaugccaguagguc

SEQ ID NO: 17985 - RNA, 25 nt, Artificial Sequence
  Synthetic Oligonucleotide; PD-L1 exon 2; Set A
ccguucagcaaaugccaguagguca

SEQ ID NO: 17986 - RNA, 27 nt, Artificial Sequence
  Synthetic Oligonucleotide; PD-L1 exon 2; Set A
accguucagcaaaugccaguaggucau

SEQ ID NO: 17987 - RNA, 24 nt, Artificial Sequence
  Synthetic Oligonucleotide; PD-L1 exon 2; Set A
ccguucagcaaaugccaguagguc

SEQ ID NO: 17988 - RNA, 26 nt, Artificial Sequence
  Synthetic Oligonucleotide; PD-L1 exon 2; Set A
accguucagcaaaugccaguagguca

SEQ ID NO: 17989 - RNA, 25 nt, Artificial Sequence
  Synthetic Oligonucleotide; PD-L1 exon 2; Set A
accguucagcaaaugccaguagguc

SEQ ID NO: 17990 - RNA, 29 nt, Artificial Sequence
  Synthetic Oligonucleotide; PD-L1 exon 2; Set A
uuaccguucagcaaaugccaguaggucau

SEQ ID NO: 17991 - RNA, 26 nt, Artificial Sequence
  Synthetic Oligonucleotide; PD-L1 exon 2; Set A
uaccguucagcaaaugccaguagguc

SEQ ID NO: 17992 - RNA, 28 nt, Artificial Sequence
  Synthetic Oligonucleotide; PD-L1 exon 2; Set C
uuaccguucagcaaaugccaguagguca

SEQ ID NO: 17993 - RNA, 30 nt, Artificial Sequence
  Synthetic Oligonucleotide; PD-L1 exon 2; Set C
cuuaccguucagcaaaugccaguaggucau

SEQ ID NO: 17994 - RNA, 27 nt, Artificial Sequence
  Synthetic Oligonucleotide; PD-L1 exon 2; Set A
uuaccguucagcaaaugccaguagguc

SEQ ID NO: 17995 - RNA, 29 nt, Artificial Sequence
  Synthetic Oligonucleotide; PD-L1 exon 2; Set C
cuuaccguucagcaaaugccaguagguca

SEQ ID NO: 17996 - RNA, 31 nt, Artificial Sequence
  Synthetic Oligonucleotide; PD-L1 exon 2; Set C
ucuuaccguucagcaaaugccaguaggucau

SEQ ID NO: 17997 - RNA, 28 nt, Artificial Sequence
  Synthetic Oligonucleotide; PD-L1 exon 2; Set A
cuuaccguucagcaaaugccaguagguc

SEQ ID NO: 17998 - RNA, 30 nt, Artificial Sequence
  Synthetic Oligonucleotide; PD-L1 exon 2; Set C
ucuuaccguucagcaaaugccaguagguca

SEQ ID NO: 17999 - RNA, 32 nt, Artificial Sequence
  Synthetic Oligonucleotide; PD-L1 exon 2; Set C
gucuuaccguucagcaaaugccaguaggucau

SEQ ID NO: 18000 - RNA, 31 nt, Artificial Sequence
  Synthetic Oligonucleotide; PD-L1 exon 2; Set C
gucuuaccguucagcaaaugccaguagguca

SEQ ID NO: 18001 - RNA, 28 nt, Artificial Sequence
  Synthetic Oligonucleotide; PD-L1 exon 2; Set A
ucuuaccguucagcaaaugccaguaggu

SEQ ID NO: 18002 - RNA, 27 nt, Artificial Sequence
  Synthetic Oligonucleotide; PD-L1 exon 2; Set A
ucuuaccguucagcaaaugccaguagg

SEQ ID NO: 18003 - RNA, 29 nt, Artificial Sequence
  Synthetic Oligonucleotide; PD-L1 exon 2; Set C
gucuuaccguucagcaaaugccaguaggu

SEQ ID NO: 18004 - RNA, 36 nt, Artificial Sequence
  Synthetic Oligonucleotide; PD-L1 exon 2; Set C
uggugucuuaccguucagcaaaugccaguaggucau

SEQ ID NO: 18005 - RNA, 28 nt, Artificial Sequence
  Synthetic Oligonucleotide; PD-L1 exon 2; Set A
gucuuaccguucagcaaaugccaguagg

SEQ ID NO: 18006 - RNA, 26 nt, Artificial Sequence
  Synthetic Oligonucleotide; PD-L1 exon 2; Set A
ucuuaccguucagcaaaugccaguag

SEQ ID NO: 18007 - RNA, 35 nt, Artificial Sequence
  Synthetic Oligonucleotide; PD-L1 exon 2; Set C
uggugucuuaccguucagcaaaugccaguagguca

SEQ ID NO: 18008 - RNA, 37 nt, Artificial Sequence
  Synthetic Oligonucleotide; PD-L1 exon 2; Set C
uuggugucuuaccguucagcaaaugccaguaggucau

SEQ ID NO: 18009 - RNA, 27 nt, Artificial Sequence
  Synthetic Oligonucleotide; PD-L1 exon 2; Set A
gucuuaccguucagcaaaugccaguag

SEQ ID NO: 18010 - RNA, 34 nt, Artificial Sequence
  Synthetic Oligonucleotide; PD-L1 exon 2; Set C
uggugucuuaccguucagcaaaugccaguagguc

SEQ ID NO: 18011 - RNA, 36 nt, Artificial Sequence
  Synthetic Oligonucleotide; PD-L1 exon 2; Set C
uuggugucuuaccguucagcaaaugccaguagguca

SEQ ID NO: 18012 - RNA, 38 nt, Artificial Sequence
  Synthetic Oligonucleotide; PD-L1 exon 2; Set C
uuuggugucuuaccguucagcaaaugccaguaggucau

SEQ ID NO: 18013 - RNA, 27 nt, Artificial Sequence
  Synthetic Oligonucleotide; PD-L1 exon 2; Set A
ugucuuaccguucagcaaaugccagua

SEQ ID NO: 18014 - RNA, 37 nt, Artificial Sequence
  Synthetic Oligonucleotide; PD-L1 exon 2; Set C
uuuggugucuuaccguucagcaaaugccaguagguca

SEQ ID NO: 18015 - RNA, 39 nt, Artificial Sequence
  Synthetic Oligonucleotide; PD-L1 exon 2; Set C
auuuggugucuuaccguucagcaaaugccaguaggucau

SEQ ID NO: 18016 - RNA, 15 nt, Artificial Sequence
  Synthetic Oligonucleotide; PD-L1 exon 2; Set C
accguucagcaaaug

SEQ ID NO: 18017 - RNA, 26 nt, Artificial Sequence
  Synthetic Oligonucleotide; PD-L1 exon 2; Set A
ugucuuaccguucagcaaaugccagu

SEQ ID NO: 18018 - RNA, 28 nt, Artificial Sequence
  Synthetic Oligonucleotide; PD-L1 exon 2; Set A
gugucuuaccguucagcaaaugccagua

SEQ ID NO: 18019 - RNA, 27 nt, Artificial Sequence
  Synthetic Oligonucleotide; PD-L1 exon 2; Set A
gugucuuaccguucagcaaaugccagu

SEQ ID NO: 18020 - RNA, 17 nt, Artificial Sequence
  Synthetic Oligonucleotide; PD-L1 exon 2; Set C
uuaccguucagcaaaug

SEQ ID NO: 18021 - RNA, 35 nt, Artificial Sequence
  Synthetic Oligonucleotide; PD-L1 exon 2; Set C
uuuggugucuuaccguucagcaaaugccaguaggu

SEQ ID NO: 18022 - RNA, 18 nt, Artificial Sequence
  Synthetic Oligonucleotide; PD-L1 exon 2; Set C
cuuaccguucagcaaaug

SEQ ID NO: 18023 - RNA, 34 nt, Artificial Sequence
  Synthetic Oligonucleotide; PD-L1 exon 2; Set C
uuuggugucuuaccguucagcaaaugccaguagg

SEQ ID NO: 18024 - RNA, 36 nt, Artificial Sequence
  Synthetic Oligonucleotide; PD-L1 exon 2; Set C
auuuggugucuuaccguucagcaaaugccaguaggu

SEQ ID NO: 18025 - RNA, 19 nt, Artificial Sequence
  Synthetic Oligonucleotide; PD-L1 exon 2; Set C
ucuuaccguucagcaaaug

SEQ ID NO: 18026 - RNA, 35 nt, Artificial Sequence
  Synthetic Oligonucleotide; PD-L1 exon 2; Set C
auuuggugucuuaccguucagcaaaugccaguagg

SEQ ID NO: 18027 - RNA, 37 nt, Artificial Sequence
  Synthetic Oligonucleotide; PD-L1 exon 2; Set C
gauuuggugucuuaccguucagcaaaugccaguaggu

SEQ ID NO: 18028 - RNA, 33 nt, Artificial Sequence
  Synthetic Oligonucleotide; PD-L1 exon 2; Set C
uuuggugucuuaccguucagcaaaugccaguag

SEQ ID NO: 18029 - RNA, 20 nt, Artificial Sequence
  Synthetic Oligonucleotide; PD-L1 exon 2; Set C
gucuuaccguucagcaaaug

SEQ ID NO: 18030 - RNA, 36 nt, Artificial Sequence
  Synthetic Oligonucleotide; PD-L1 exon 2; Set C
gauuuggugucuuaccguucagcaaaugccaguagg

SEQ ID NO: 18031 - RNA, 34 nt, Artificial Sequence
  Synthetic Oligonucleotide; PD-L1 exon 2; Set C
auuuggugucuuaccguucagcaaaugccaguag

SEQ ID NO: 18032 - RNA, 35 nt, Artificial Sequence
  Synthetic Oligonucleotide; PD-L1 exon 2; Set C
gauuuggugucuuaccguucagcaaaugccaguag

SEQ ID NO: 18033 - RNA, 20 nt, Artificial Sequence
  Synthetic Oligonucleotide; PD-L1 exon 2; Set C
ugucuuaccguucagcaaau

SEQ ID NO: 18034 - RNA, 21 nt, Artificial Sequence
  Synthetic Oligonucleotide; PD-L1 exon 2; Set C
gugucuuaccguucagcaaau

SEQ ID NO: 18035 - RNA, 19 nt, Artificial Sequence
  Synthetic Oligonucleotide; PD-L1 exon 2; Set C
ugucuuaccguucagcaaa

SEQ ID NO: 18036 - RNA, 34 nt, Artificial Sequence
  Synthetic Oligonucleotide; PD-L1 exon 2; Set C
ggauuuggugucuuaccguucagcaaaugccagu

SEQ ID NO: 18037 - RNA, 22 nt, Artificial Sequence
  Synthetic Oligonucleotide; PD-L1 exon 2; Set C
ggugucuuaccguucagcaaau

SEQ ID NO: 18038 - RNA, 20 nt, Artificial Sequence
  Synthetic Oligonucleotide; PD-L1 exon 2; Set C
gugucuuaccguucagcaaa

SEQ ID NO: 18039 - RNA, 18 nt, Artificial Sequence
  Synthetic Oligonucleotide; PD-L1 exon 2; Set C
ugucuuaccguucagcaa

SEQ ID NO: 18040 - RNA, 35 nt, Artificial Sequence
  Synthetic Oligonucleotide; PD-L1 exon 2; Set C
aggauuuggugucuuaccguucagcaaaugccagu

SEQ ID NO: 18041 - RNA, 19 nt, Artificial Sequence
  Synthetic Oligonucleotide; PD-L1 exon 2; Set C
gugucuuaccguucagcaa

SEQ ID NO: 18042 - RNA, 17 nt, Artificial Sequence
  Synthetic Oligonucleotide; PD-L1 exon 2; Set C
ugucuuaccguucagca

SEQ ID NO: 18043 - RNA, 25 nt, Artificial Sequence
  Synthetic Oligonucleotide; PD-L1 exon 2; Set A
uuggugucuuaccguucagcaaaug

SEQ ID NO: 18044 - RNA, 36 nt, Artificial Sequence
  Synthetic Oligonucleotide; PD-L1 exon 2; Set C
aaggauuuggugucuuaccguucagcaaaugccagu

SEQ ID NO: 18045 - RNA, 26 nt, Artificial Sequence
  Synthetic Oligonucleotide; PD-L1 exon 2; Set A
uuuggugucuuaccguucagcaaaug

SEQ ID NO: 18046 - RNA, 27 nt, Artificial Sequence
  Synthetic Oligonucleotide; PD-L1 exon 2; Set A
auuuggugucuuaccguucagcaaaug

SEQ ID NO: 18047 - RNA, 28 nt, Artificial Sequence
  Synthetic Oligonucleotide; PD-L1 exon 2; Set A
gauuuggugucuuaccguucagcaaaug

SEQ ID NO: 18048 - RNA, 28 nt, Artificial Sequence
  Synthetic Oligonucleotide; PD-L1 exon 2; Set A
ggauuuggugucuuaccguucagcaaau

SEQ ID NO: 18049 - RNA, 15 nt, Artificial Sequence
  Synthetic Oligonucleotide; PD-L1 exon 2; Set C
ggugucuuaccguuc

SEQ ID NO: 18050 - RNA, 29 nt, Artificial Sequence
  Synthetic Oligonucleotide; PD-L1 exon 2; Set A
aggauuuggugucuuaccguucagcaaau

SEQ ID NO: 18051 - RNA, 27 nt, Artificial Sequence
  Synthetic Oligonucleotide; PD-L1 exon 2; Set A
ggauuuggugucuuaccguucagcaaa

SEQ ID NO: 18052 - RNA, 30 nt, Artificial Sequence
  Synthetic Oligonucleotide; PD-L1 exon 2; Set A
aaggauuuggugucuuaccguucagcaaau

SEQ ID NO: 18053 - RNA, 28 nt, Artificial Sequence
  Synthetic Oligonucleotide; PD-L1 exon 2; Set A
aggauuuggugucuuaccguucagcaaa

SEQ ID NO: 18054 - RNA, 32 nt, Artificial Sequence
  Synthetic Oligonucleotide; PD-L1 exon 2; Set A
gaaggauuuggugucuuaccguucagcaaaug

SEQ ID NO: 18055 - RNA, 29 nt, Artificial Sequence
  Synthetic Oligonucleotide; PD-L1 exon 2; Set A
aaggauuuggugucuuaccguucagcaaa

SEQ ID NO: 18056 - RNA, 33 nt, Artificial Sequence
  Synthetic Oligonucleotide; PD-L1 exon 2; Set A
ggaaggauuuggugucuuaccguucagcaaaug

SEQ ID NO: 18057 - RNA, 34 nt, Artificial Sequence
  Synthetic Oligonucleotide; PD-L1 exon 2; Set C
uggaaggauuuggugucuuaccguucagcaaaug

SEQ ID NO: 18058 - RNA, 35 nt, Artificial Sequence
  Synthetic Oligonucleotide; PD-L1 exon 2; Set A
auggaaggauuuggugucuuaccguucagcaaaug

SEQ ID NO: 18059 - RNA, 36 nt, Artificial Sequence
  Synthetic Oligonucleotide; PD-L1 exon 2; Set A
aauggaaggauuuggugucuuaccguucagcaaaug

SEQ ID NO: 18060 - RNA, 21 nt, Artificial Sequence
  Synthetic Oligonucleotide; PD-L1 exon 2; Set C
ggauuuggugucuuaccguuc

SEQ ID NO: 18061 - RNA, 37 nt, Artificial Sequence
  Synthetic Oligonucleotide; PD-L1 exon 2; Set A
uaauggaaggauuuggugucuuaccguucagcaaaug

SEQ ID NO: 18062 - RNA, 20 nt, Artificial Sequence
  Synthetic Oligonucleotide; PD-L1 exon 2; Set C
ggauuuggugucuuaccguu

SEQ ID NO: 18063 - RNA, 22 nt, Artificial Sequence
  Synthetic Oligonucleotide; PD-L1 exon 2; Set C
aggauuuggugucuuaccguuc

SEQ ID NO: 18064 - RNA, 21 nt, Artificial Sequence
  Synthetic Oligonucleotide; PD-L1 exon 2; Set C
aggauuuggugucuuaccguu

SEQ ID NO: 18065 - RNA, 23 nt, Artificial Sequence
  Synthetic Oligonucleotide; PD-L1 exon 2; Set C
aaggauuuggugucuuaccguuc

SEQ ID NO: 18066 - RNA, 19 nt, Artificial Sequence
  Synthetic Oligonucleotide; PD-L1 exon 2; Set C
ggauuuggugucuuaccgu

SEQ ID NO: 18067 - RNA, 22 nt, Artificial Sequence
  Synthetic Oligonucleotide; PD-L1 exon 2; Set C
aaggauuuggugucuuaccguu

SEQ ID NO: 18068 - RNA, 36 nt, Artificial Sequence
  Synthetic Oligonucleotide; PD-L1 exon 2; Set C
cuaauggaaggauuuggugucuuaccguucagcaaa

SEQ ID NO: 18069 - RNA, 20 nt, Artificial Sequence
  Synthetic Oligonucleotide; PD-L1 exon 2; Set C
aggauuuggugucuuaccgu

SEQ ID NO: 18070 - RNA, 21 nt, Artificial Sequence
  Synthetic Oligonucleotide; PD-L1 exon 2; Set C
aaggauuuggugucuuaccgu

SEQ ID NO: 18071 - RNA, 35 nt, Artificial Sequence
  Synthetic Oligonucleotide; PD-L1 exon 2; Set C
cuaauggaaggauuuggugucuuaccguucagcaa

SEQ ID NO: 18072 - RNA, 34 nt, Artificial Sequence
  Synthetic Oligonucleotide; PD-L1 exon 2; Set C
cuaauggaaggauuuggugucuuaccguucagca

SEQ ID NO: 18073 - RNA, 15 nt, Artificial Sequence
  Synthetic Oligonucleotide; PD-L1 exon 2; Set C
ggauuuggugucuua

SEQ ID NO: 18074 - RNA, 40 nt, Artificial Sequence
  Synthetic Oligonucleotide; PD-L1 exon 2; Set C
gaaccuaauggaaggauuuggugucuuaccguucagcaaa

SEQ ID NO: 18075 - RNA, 16 nt, Artificial Sequence
  Synthetic Oligonucleotide; PD-L1 exon 2; Set C
aggauuuggugucuua

SEQ ID NO: 18076 - RNA, 15 nt, Artificial Sequence
  Synthetic Oligonucleotide; PD-L1 exon 2; Set C
aggauuuggugucuu

SEQ ID NO: 18077 - RNA, 39 nt, Artificial Sequence
  Synthetic Oligonucleotide; PD-L1 exon 2; Set C
gaaccuaauggaaggauuuggugucuuaccguucagcaa

SEQ ID NO: 18078 - RNA, 16 nt, Artificial Sequence
  Synthetic Oligonucleotide; PD-L1 exon 2; Set C
aaggauuuggugucuu

SEQ ID NO: 18079 - RNA, 38 nt, Artificial Sequence
  Synthetic Oligonucleotide; PD-L1 exon 2; Set C
gaaccuaauggaaggauuuggugucuuaccguucagca

SEQ ID NO: 18080 - RNA, 15 nt, Artificial Sequence
  Synthetic Oligonucleotide; PD-L1 exon 2; Set C
aaggauuuggugucu

SEQ ID NO: 18081 - RNA, 28 nt, Artificial Sequence
  Synthetic Oligonucleotide; PD-L1 exon 2; Set B
cuaauggaaggauuuggugucuuaccgu

SEQ ID NO: 18082 - RNA, 40 nt, Artificial Sequence
  Synthetic Oligonucleotide; PD-L1 exon 2; Set C
uagaaccuaauggaaggauuuggugucuuaccguucagca

SEQ ID NO: 18083 - RNA, 27 nt, Artificial Sequence
  Synthetic Oligonucleotide; PD-L1 exon 2; Set B
cuaauggaaggauuuggugucuuaccg

SEQ ID NO: 18084 - RNA, 26 nt, Artificial Sequence
  Synthetic Oligonucleotide; PD-L1 exon 2; Set B
cuaauggaaggauuuggugucuuacc

SEQ ID NO: 18085 - RNA, 25 nt, Artificial Sequence
  Synthetic Oligonucleotide; PD-L1 exon 2; Set C
cuaauggaaggauuuggugucuuac

SEQ ID NO: 18086 - RNA, 15 nt, Artificial Sequence
  Synthetic Oligonucleotide; PD-L1 exon 2; Set C
ggaaggauuuggugu

SEQ ID NO: 18087 - RNA, 32 nt, Artificial Sequence
  Synthetic Oligonucleotide; PD-L1 exon 2; Set B
gaaccuaauggaaggauuuggugucuuaccgu

SEQ ID NO: 18088 - RNA, 24 nt, Artificial Sequence
  Synthetic Oligonucleotide; PD-L1 exon 2; Set C
cuaauggaaggauuuggugucuua

SEQ ID NO: 18089 - RNA, 16 nt, Artificial Sequence
  Synthetic Oligonucleotide; PD-L1 exon 2; Set C
uggaaggauuuggugu

SEQ ID NO: 18090 - RNA, 23 nt, Artificial Sequence
  Synthetic Oligonucleotide; PD-L1 exon 2; Set C
cuaauggaaggauuuggugucuu

SEQ ID NO: 18091 - RNA, 31 nt, Artificial Sequence
  Synthetic Oligonucleotide; PD-L1 exon 2; Set B
gaaccuaauggaaggauuuggugucuuaccg

SEQ ID NO: 18092 - RNA, 17 nt, Artificial Sequence
  Synthetic Oligonucleotide; PD-L1 exon 2; Set C
auggaaggauuuggugu

SEQ ID NO: 18093 - RNA, 15 nt, Artificial Sequence
  Synthetic Oligonucleotide; PD-L1 exon 2; Set C
uggaaggauuuggug

SEQ ID NO: 18094 - RNA, 30 nt, Artificial Sequence
  Synthetic Oligonucleotide; PD-L1 exon 2; Set B
gaaccuaauggaaggauuuggugucuuacc

SEQ ID NO: 18095 - RNA, 18 nt, Artificial Sequence
  Synthetic Oligonucleotide; PD-L1 exon 2; Set C
aauggaaggauuuggugu

SEQ ID NO: 18096 - RNA, 16 nt, Artificial Sequence
  Synthetic Oligonucleotide; PD-L1 exon 2; Set C
auggaaggauuuggug

SEQ ID NO: 18097 - RNA, 29 nt, Artificial Sequence
  Synthetic Oligonucleotide; PD-L1 exon 2; Set B
gaaccuaauggaaggauuuggugucuuac

SEQ ID NO: 18098 - RNA, 19 nt, Artificial Sequence
  Synthetic Oligonucleotide; PD-L1 exon 2; Set C
uaauggaaggauuuggugu

SEQ ID NO: 18099 - RNA, 17 nt, Artificial Sequence
  Synthetic Oligonucleotide; PD-L1 exon 2; Set C
aauggaaggauuuggug

SEQ ID NO: 18100 - RNA, 28 nt, Artificial Sequence
  Synthetic Oligonucleotide; PD-L1 exon 2; Set B
gaaccuaauggaaggauuuggugucuua

SEQ ID NO: 18101 - RNA, 32 nt, Artificial Sequence
  Synthetic Oligonucleotide; PD-L1 exon 2; Set B
uagaaccuaauggaaggauuuggugucuuacc

SEQ ID NO: 18102 - RNA, 18 nt, Artificial Sequence
  Synthetic Oligonucleotide; PD-L1 exon 2; Set C
uaauggaaggauuuggug

SEQ ID NO: 18103 - RNA, 27 nt, Artificial Sequence
  Synthetic Oligonucleotide; PD-L1 exon 2; Set B
gaaccuaauggaaggauuuggugucuu

SEQ ID NO: 18104 - RNA, 35 nt, Artificial Sequence
  Synthetic Oligonucleotide; PD-L1 exon 2; Set B
uauagaaccuaauggaaggauuuggugucuuaccg

SEQ ID NO: 18105 - RNA, 33 nt, Artificial Sequence
  Synthetic Oligonucleotide; PD-L1 exon 2; Set B
auagaaccuaauggaaggauuuggugucuuacc

SEQ ID NO: 18106 - RNA, 31 nt, Artificial Sequence
  Synthetic Oligonucleotide; PD-L1 exon 2; Set B
uagaaccuaauggaaggauuuggugucuuac

SEQ ID NO: 18107 - RNA, 34 nt, Artificial Sequence
  Synthetic Oligonucleotide; PD-L1 exon 2; Set B
uauagaaccuaauggaaggauuuggugucuuacc

SEQ ID NO: 18108 - RNA, 32 nt, Artificial Sequence
  Synthetic Oligonucleotide; PD-L1 exon 2; Set B
auagaaccuaauggaaggauuuggugucuuac

SEQ ID NO: 18109 - RNA, 17 nt, Artificial Sequence
  Synthetic Oligonucleotide; PD-L1 exon 2; Set C
cuaauggaaggauuugg

SEQ ID NO: 18110 - RNA, 33 nt, Artificial Sequence
  Synthetic Oligonucleotide; PD-L1 exon 2; Set B
uauagaaccuaauggaaggauuuggugucuuac

SEQ ID NO: 18111 - RNA, 16 nt, Artificial Sequence
  Synthetic Oligonucleotide; PD-L1 exon 2; Set C
cuaauggaaggauuug

SEQ ID NO: 18112 - RNA, 32 nt, Artificial Sequence
  Synthetic Oligonucleotide; PD-L1 exon 2; Set B
uauagaaccuaauggaaggauuuggugucuua

SEQ ID NO: 18113 - RNA, 35 nt, Artificial Sequence
  Synthetic Oligonucleotide; PD-L1 exon 2; Set B
aauauagaaccuaauggaaggauuuggugucuuac

SEQ ID NO: 18114 - RNA, 25 nt, Artificial Sequence
  Synthetic Oligonucleotide; PD-L1 exon 2; Set C
agaaccuaauggaaggauuuggugu

SEQ ID NO: 18115 - RNA, 24 nt, Artificial Sequence
  Synthetic Oligonucleotide; PD-L1 exon 2; Set C
agaaccuaauggaaggauuuggug

SEQ ID NO: 18116 - RNA, 21 nt, Artificial Sequence
  Synthetic Oligonucleotide; PD-L1 exon 2; Set C
gaaccuaauggaaggauuugg

SEQ ID NO: 18117 - RNA, 20 nt, Artificial Sequence
  Synthetic Oligonucleotide; PD-L1 exon 2; Set C
gaaccuaauggaaggauuug

SEQ ID NO: 18118 - RNA, 23 nt, Artificial Sequence
  Synthetic Oligonucleotide; PD-L1 exon 2; Set C
uagaaccuaauggaaggauuugg

SEQ ID NO: 18119 - RNA, 29 nt, Artificial Sequence
  Synthetic Oligonucleotide; PD-L1 exon 2; Set C
auauagaaccuaauggaaggauuuggugu

SEQ ID NO: 18120 - RNA, 24 nt, Artificial Sequence
  Synthetic Oligonucleotide; PD-L1 exon 2; Set C
auagaaccuaauggaaggauuugg

SEQ ID NO: 18121 - RNA, 30 nt, Artificial Sequence
  Synthetic Oligonucleotide; PD-L1 exon 2; Set C
aauauagaaccuaauggaaggauuuggugu

SEQ ID NO: 18122 - RNA, 28 nt, Artificial Sequence
  Synthetic Oligonucleotide; PD-L1 exon 2; Set C
auauagaaccuaauggaaggauuuggug

SEQ ID NO: 18123 - RNA, 25 nt, Artificial Sequence
  Synthetic Oligonucleotide; PD-L1 exon 2; Set C
uauagaaccuaauggaaggauuugg

SEQ ID NO: 18124 - RNA, 31 nt, Artificial Sequence
  Synthetic Oligonucleotide; PD-L1 exon 2; Set C
aaauauagaaccuaauggaaggauuuggugu

SEQ ID NO: 18125 - RNA, 27 nt, Artificial Sequence
  Synthetic Oligonucleotide; PD-L1 exon 2; Set C
auauagaaccuaauggaaggauuuggu

SEQ ID NO: 18126 - RNA, 32 nt, Artificial Sequence
  Synthetic Oligonucleotide; PD-L1 exon 2; Set C
aaaauauagaaccuaauggaaggauuuggugu

SEQ ID NO: 18127 - RNA, 33 nt, Artificial Sequence
  Synthetic Oligonucleotide; PD-L1 exon 2; Set C
uaaaauauagaaccuaauggaaggauuuggugu

SEQ ID NO: 18128 - RNA, 17 nt, Artificial Sequence
  Synthetic Oligonucleotide; PD-L1 exon 2; Set C
agaaccuaauggaagga

SEQ ID NO: 18129 - RNA, 34 nt, Artificial Sequence
  Synthetic Oligonucleotide; PD-L1 exon 2; Set C
uuaaaauauagaaccuaauggaaggauuuggugu

SEQ ID NO: 18130 - RNA, 32 nt, Artificial Sequence
  Synthetic Oligonucleotide; PD-L1 exon 2; Set C
uaaaauauagaaccuaauggaaggauuuggug

SEQ ID NO: 18131 - RNA, 16 nt, Artificial Sequence
  Synthetic Oligonucleotide; PD-L1 exon 2; Set C
agaaccuaauggaagg

SEQ ID NO: 18132 - RNA, 35 nt, Artificial Sequence
  Synthetic Oligonucleotide; PD-L1 exon 2; Set C
uuuaaaauauagaaccuaauggaaggauuuggugu

SEQ ID NO: 18133 - RNA, 33 nt, Artificial Sequence
  Synthetic Oligonucleotide; PD-L1 exon 2; Set C
uuaaaauauagaaccuaauggaaggauuuggug

SEQ ID NO: 18134 - RNA, 15 nt, Artificial Sequence
  Synthetic Oligonucleotide; PD-L1 exon 2; Set C
agaaccuaauggaag

SEQ ID NO: 18135 - RNA, 31 nt, Artificial Sequence
  Synthetic Oligonucleotide; PD-L1 exon 2; Set C
uaaaauauagaaccuaauggaaggauuuggu

SEQ ID NO: 18136 - RNA, 36 nt, Artificial Sequence
  Synthetic Oligonucleotide; PD-L1 exon 2; Set C
auuuaaaauauagaaccuaauggaaggauuuggugu

SEQ ID NO: 18137 - RNA, 34 nt, Artificial Sequence
  Synthetic Oligonucleotide; PD-L1 exon 2; Set C
uuuaaaauauagaaccuaauggaaggauuuggug

SEQ ID NO: 18138 - RNA, 32 nt, Artificial Sequence
  Synthetic Oligonucleotide; PD-L1 exon 2; Set C
uuaaaauauagaaccuaauggaaggauuuggu

SEQ ID NO: 18139 - RNA, 15 nt, Artificial Sequence
  Synthetic Oligonucleotide; PD-L1 exon 2; Set C
uagaaccuaauggaa

SEQ ID NO: 18140 - RNA, 37 nt, Artificial Sequence
  Synthetic Oligonucleotide; PD-L1 exon 2; Set C
uauuuaaaauauagaaccuaauggaaggauuuggugu

SEQ ID NO: 18141 - RNA, 35 nt, Artificial Sequence
  Synthetic Oligonucleotide; PD-L1 exon 2; Set C
auuuaaaauauagaaccuaauggaaggauuuggug

SEQ ID NO: 18142 - RNA, 21 nt, Artificial Sequence
  Synthetic Oligonucleotide; PD-L1 exon 2; Set C
auauagaaccuaauggaagga

SEQ ID NO: 18143 - RNA, 33 nt, Artificial Sequence
  Synthetic Oligonucleotide; PD-L1 exon 2; Set C
uuuaaaauauagaaccuaauggaaggauuuggu

SEQ ID NO: 18144 - RNA, 16 nt, Artificial Sequence
  Synthetic Oligonucleotide; PD-L1 exon 2; Set C
auagaaccuaauggaa

SEQ ID NO: 18145 - RNA, 38 nt, Artificial Sequence
  Synthetic Oligonucleotide; PD-L1 exon 2; Set C
auauuuaaaauauagaaccuaauggaaggauuuggugu

SEQ ID NO: 18146 - RNA, 36 nt, Artificial Sequence
  Synthetic Oligonucleotide; PD-L1 exon 2; Set C
uauuuaaaauauagaaccuaauggaaggauuuggug

SEQ ID NO: 18147 - RNA, 20 nt, Artificial Sequence
  Synthetic Oligonucleotide; PD-L1 exon 2; Set C
auauagaaccuaauggaagg

SEQ ID NO: 18148 - RNA, 34 nt, Artificial Sequence
  Synthetic Oligonucleotide; PD-L1 exon 2; Set C
auuuaaaauauagaaccuaauggaaggauuuggu

SEQ ID NO: 18149 - RNA, 17 nt, Artificial Sequence
  Synthetic Oligonucleotide; PD-L1 exon 2; Set C
uauagaaccuaauggaa

SEQ ID NO: 18150 - RNA, 37 nt, Artificial Sequence
  Synthetic Oligonucleotide; PD-L1 exon 2; Set C
auauuuaaaauauagaaccuaauggaaggauuuggug

SEQ ID NO: 18151 - RNA, 19 nt, Artificial Sequence
  Synthetic Oligonucleotide; PD-L1 exon 2; Set C
auauagaaccuaauggaag

SEQ ID NO: 18152 - RNA, 35 nt, Artificial Sequence
  Synthetic Oligonucleotide; PD-L1 exon 2; Set C
uauuuaaaauauagaaccuaauggaaggauuuggu

SEQ ID NO: 18153 - RNA, 38 nt, Artificial Sequence
  Synthetic Oligonucleotide; PD-L1 exon 2; Set C
aauauuuaaaauauagaaccuaauggaaggauuuggug

SEQ ID NO: 18154 - RNA, 36 nt, Artificial Sequence
  Synthetic Oligonucleotide; PD-L1 exon 2; Set C
auauuuaaaauauagaaccuaauggaaggauuuggu

SEQ ID NO: 18155 - RNA, 39 nt, Artificial Sequence
  Synthetic Oligonucleotide; PD-L1 exon 2; Set C
aaauauuuaaaauauagaaccuaauggaaggauuuggug

SEQ ID NO: 18156 - RNA, 25 nt, Artificial Sequence
  Synthetic Oligonucleotide; PD-L1 exon 2; Set C
uaaaauauagaaccuaauggaagga

SEQ ID NO: 18157 - RNA, 37 nt, Artificial Sequence
  Synthetic Oligonucleotide; PD-L1 exon 2; Set C
aauauuuaaaauauagaaccuaauggaaggauuuggu

SEQ ID NO: 18158 - RNA, 40 nt, Artificial Sequence
  Synthetic Oligonucleotide; PD-L1 exon 2; Set C
aaaauauuuaaaauauagaaccuaauggaaggauuuggug

SEQ ID NO: 18159 - RNA, 26 nt, Artificial Sequence
  Synthetic Oligonucleotide; PD-L1 exon 2; Set C
uuaaaauauagaaccuaauggaagga

SEQ ID NO: 18160 - RNA, 24 nt, Artificial Sequence
  Synthetic Oligonucleotide; PD-L1 exon 2; Set C
uaaaauauagaaccuaauggaagg

SEQ ID NO: 18161 - RNA, 38 nt, Artificial Sequence
  Synthetic Oligonucleotide; PD-L1 exon 2; Set C
aaauauuuaaaauauagaaccuaauggaaggauuuggu

SEQ ID NO: 18162 - RNA, 25 nt, Artificial Sequence
  Synthetic Oligonucleotide; PD-L1 exon 2; Set C
uuaaaauauagaaccuaauggaagg

SEQ ID NO: 18163 - RNA, 27 nt, Artificial Sequence
  Synthetic Oligonucleotide; PD-L1 exon 2; Set C
uuuaaaauauagaaccuaauggaagga

SEQ ID NO: 18164 - RNA, 23 nt, Artificial Sequence
  Synthetic Oligonucleotide; PD-L1 exon 2; Set C
uaaaauauagaaccuaauggaag

SEQ ID NO: 18165 - RNA, 39 nt, Artificial Sequence
  Synthetic Oligonucleotide; PD-L1 exon 2; Set C
aaaauauuuaaaauauagaaccuaauggaaggauuuggu

SEQ ID NO: 18166 - RNA, 26 nt, Artificial Sequence
  Synthetic Oligonucleotide; PD-L1 exon 2; Set C
uuuaaaauauagaaccuaauggaagg

SEQ ID NO: 18167 - RNA, 28 nt, Artificial Sequence
  Synthetic Oligonucleotide; PD-L1 exon 2; Set C
auuuaaaauauagaaccuaauggaagga

SEQ ID NO: 18168 - RNA, 24 nt, Artificial Sequence
  Synthetic Oligonucleotide; PD-L1 exon 2; Set C
uuaaaauauagaaccuaauggaag

SEQ ID NO: 18169 - RNA, 40 nt, Artificial Sequence
  Synthetic Oligonucleotide; PD-L1 exon 2; Set C
uaaaauauuuaaaauauagaaccuaauggaaggauuuggu

SEQ ID NO: 18170 - RNA, 27 nt, Artificial Sequence
  Synthetic Oligonucleotide; PD-L1 exon 2; Set C
auuuaaaauauagaaccuaauggaagg

SEQ ID NO: 18171 - RNA, 29 nt, Artificial Sequence
  Synthetic Oligonucleotide; PD-L1 exon 2; Set C
uauuuaaaauauagaaccuaauggaagga

SEQ ID NO: 18172 - RNA, 25 nt, Artificial Sequence
  Synthetic Oligonucleotide; PD-L1 exon 2; Set C
uuuaaaauauagaaccuaauggaag

SEQ ID NO: 18173 - RNA, 30 nt, Artificial Sequence
  Synthetic Oligonucleotide; PD-L1 exon 2; Set C
auauuuaaaauauagaaccuaauggaagga

SEQ ID NO: 18174 - RNA, 28 nt, Artificial Sequence
  Synthetic Oligonucleotide; PD-L1 exon 2; Set C
uauuuaaaauauagaaccuaauggaagg

SEQ ID NO: 18175 - RNA, 26 nt, Artificial Sequence
  Synthetic Oligonucleotide; PD-L1 exon 2; Set C
auuuaaaauauagaaccuaauggaag

SEQ ID NO: 18176 - RNA, 31 nt, Artificial Sequence
  Synthetic Oligonucleotide; PD-L1 exon 2; Set C
aauauuuaaaauauagaaccuaauggaagga

SEQ ID NO: 18177 - RNA, 29 nt, Artificial Sequence
  Synthetic Oligonucleotide; PD-L1 exon 2; Set C
auauuuaaaauauagaaccuaauggaagg

SEQ ID NO: 18178 - RNA, 27 nt, Artificial Sequence
  Synthetic Oligonucleotide; PD-L1 exon 2; Set C
uauuuaaaauauagaaccuaauggaag

SEQ ID NO: 18179 - RNA, 32 nt, Artificial Sequence
  Synthetic Oligonucleotide; PD-L1 exon 2; Set C
aaauauuuaaaauauagaaccuaauggaagga

SEQ ID NO: 18180 - RNA, 30 nt, Artificial Sequence
  Synthetic Oligonucleotide; PD-L1 exon 2; Set C
aauauuuaaaauauagaaccuaauggaagg

SEQ ID NO: 18181 - RNA, 28 nt, Artificial Sequence
  Synthetic Oligonucleotide; PD-L1 exon 2; Set C
auauuuaaaauauagaaccuaauggaag

SEQ ID NO: 18182 - RNA, 15 nt, Artificial Sequence
  Synthetic Oligonucleotide; PD-L1 exon 2; Set C
aaaauauagaaccua

SEQ ID NO: 18183 - RNA, 33 nt, Artificial Sequence
  Synthetic Oligonucleotide; PD-L1 exon 2; Set C
aaaauauuuaaaauauagaaccuaauggaagga

SEQ ID NO: 18184 - RNA, 31 nt, Artificial Sequence
  Synthetic Oligonucleotide; PD-L1 exon 2; Set C
aaauauuuaaaauauagaaccuaauggaagg

SEQ ID NO: 18185 - RNA, 29 nt, Artificial Sequence
  Synthetic Oligonucleotide; PD-L1 exon 2; Set C
aauauuuaaaauauagaaccuaauggaag

SEQ ID NO: 18186 - RNA, 34 nt, Artificial Sequence
  Synthetic Oligonucleotide; PD-L1 exon 2; Set C
uaaaauauuuaaaauauagaaccuaauggaagga

SEQ ID NO: 18187 - RNA, 32 nt, Artificial Sequence
  Synthetic Oligonucleotide; PD-L1 exon 2; Set C
aaaauauuuaaaauauagaaccuaauggaagg

SEQ ID NO: 18188 - RNA, 30 nt, Artificial Sequence
  Synthetic Oligonucleotide; PD-L1 exon 2; Set C
aaauauuuaaaauauagaaccuaauggaag

SEQ ID NO: 18189 - RNA, 35 nt, Artificial Sequence
  Synthetic Oligonucleotide; PD-L1 exon 2; Set C
uuaaaauauuuaaaauauagaaccuaauggaagga

SEQ ID NO: 18190 - RNA, 33 nt, Artificial Sequence
  Synthetic Oligonucleotide; PD-L1 exon 2; Set C
uaaaauauuuaaaauauagaaccuaauggaagg

SEQ ID NO: 18191 - RNA, 31 nt, Artificial Sequence
  Synthetic Oligonucleotide; PD-L1 exon 2; Set C
aaaauauuuaaaauauagaaccuaauggaag

SEQ ID NO: 18192 - RNA, 36 nt, Artificial Sequence
  Synthetic Oligonucleotide; PD-L1 exon 2; Set C
guuaaaauauuuaaaauauagaaccuaauggaagga

SEQ ID NO: 18193 - RNA, 34 nt, Artificial Sequence
  Synthetic Oligonucleotide; PD-L1 exon 2; Set C
uuaaaauauuuaaaauauagaaccuaauggaagg

SEQ ID NO: 18194 - RNA, 32 nt, Artificial Sequence
  Synthetic Oligonucleotide; PD-L1 exon 2; Set C
uaaaauauuuaaaauauagaaccuaauggaag

SEQ ID NO: 18195 - RNA, 35 nt, Artificial Sequence
  Synthetic Oligonucleotide; PD-L1 exon 2; Set C
guuaaaauauuuaaaauauagaaccuaauggaagg

SEQ ID NO: 18196 - RNA, 33 nt, Artificial Sequence
  Synthetic Oligonucleotide; PD-L1 exon 2; Set C
uuaaaauauuuaaaauauagaaccuaauggaag

SEQ ID NO: 18197 - RNA, 34 nt, Artificial Sequence
  Synthetic Oligonucleotide; PD-L1 exon 2; Set C
guuaaaauauuuaaaauauagaaccuaauggaag

SEQ ID NO: 18198 - RNA, 34 nt, Artificial Sequence
  Synthetic Oligonucleotide; PD-L1 exon 2; Set C
gguuaaaauauuuaaaauauagaaccuaauggaa

SEQ ID NO: 18199 - RNA, 33 nt, Artificial Sequence
  Synthetic Oligonucleotide; PD-L1 exon 2; Set C
gguuaaaauauuuaaaauauagaaccuaaugga

SEQ ID NO: 18200 - RNA, 31 nt, Artificial Sequence
  Synthetic Oligonucleotide; PD-L1 exon 2; Set C
gguuaaaauauuuaaaauauagaaccuaaug

SEQ ID NO: 18201 - RNA, 30 nt, Artificial Sequence
  Synthetic Oligonucleotide; PD-L1 exon 2; Set C
gguuaaaauauuuaaaauauagaaccuaau

SEQ ID NO: 18202 - RNA, 29 nt, Artificial Sequence
  Synthetic Oligonucleotide; PD-L1 exon 2; Set C
gguuaaaauauuuaaaauauagaaccuaa

SEQ ID NO: 18203 - RNA, 25 nt, Artificial Sequence
  Synthetic Oligonucleotide; PD-L1 exon 2; Set C
guuaaaauauuuaaaauauagaacc

SEQ ID NO: 18204 - RNA, 24 nt, Artificial Sequence
  Synthetic Oligonucleotide; PD-L1 exon 2; Set C
gguuaaaauauuuaaaauauagaa

SEQ ID NO: 18205 - RNA, 22 nt, Artificial Sequence
  Synthetic Oligonucleotide; PD-L1 exon 2; Set C
gguuaaaauauuuaaaauauag

SEQ ID NO: 18206 - RNA, 21 nt, Artificial Sequence
  Synthetic Oligonucleotide; PD-L1 exon 2; Set C
gguuaaaauauuuaaaauaua

SEQ ID NO: 18207 - RNA, 20 nt, Artificial Sequence
  Synthetic Oligonucleotide; PD-L1 exon 2; Set C
gguuaaaauauuuaaaauau

SEQ ID NO: 18208 - RNA, 18 nt, Artificial Sequence
  Synthetic Oligonucleotide; PD-L1 exon 2; Set C
gguuaaaauauuuaaaau

SEQ ID NO: 18209 - RNA, 17 nt, Artificial Sequence
  Synthetic Oligonucleotide; PD-L1 exon 2; Set C
gguuaaaauauuuaaaa

SEQ ID NO: 18210 - RNA, 16 nt, Artificial Sequence
  Synthetic Oligonucleotide; PD-L1 exon 2; Set C
gguuaaaauauuuaaa

SEQ ID NO: 18211 - RNA, 19 nt, Artificial Sequence
  Synthetic Oligonucleotide; PD-L1 exon 2; Set C
uucacuuaauaauuaaaca

SEQ ID NO: 18212 - RNA, 18 nt, Artificial Sequence
  Synthetic Oligonucleotide; PD-L1 exon 2; Set C
uucacuuaauaauuaaac

SEQ ID NO: 18213 - RNA, 25 nt, Artificial Sequence
  Synthetic Oligonucleotide; PD-L1 exon 2; Set C
aaaagaagacugcuucacuuaauaa

SEQ ID NO: 18214 - RNA, 40 nt, Artificial Sequence
  Synthetic Oligonucleotide; PD-L1 exon 2; Set C
aaaacacgaaaagaagacugcuucacuuaauaauuaaaca

SEQ ID NO: 18215 - RNA, 24 nt, Artificial Sequence
  Synthetic Oligonucleotide; PD-L1 exon 2; Set C
aaaagaagacugcuucacuuaaua

SEQ ID NO: 18216 - RNA, 39 nt, Artificial Sequence
  Synthetic Oligonucleotide; PD-L1 exon 2; Set C
aaaacacgaaaagaagacugcuucacuuaauaauuaaac

SEQ ID NO: 18217 - RNA, 25 nt, Artificial Sequence
  Synthetic Oligonucleotide; PD-L1 exon 2; Set C
gaaaagaagacugcuucacuuaaua

SEQ ID NO: 18218 - RNA, 38 nt, Artificial Sequence
  Synthetic Oligonucleotide; PD-L1 exon 2; Set C
aaaacacgaaaagaagacugcuucacuuaauaauuaaa

SEQ ID NO: 18219 - RNA, 24 nt, Artificial Sequence
  Synthetic Oligonucleotide; PD-L1 exon 2; Set C
gaaaagaagacugcuucacuuaau

SEQ ID NO: 18220 - RNA, 37 nt, Artificial Sequence
  Synthetic Oligonucleotide; PD-L1 exon 2; Set C
aaaacacgaaaagaagacugcuucacuuaauaauuaa

SEQ ID NO: 18221 - RNA, 36 nt, Artificial Sequence
  Synthetic Oligonucleotide; PD-L1 exon 2; Set C
aaaacacgaaaagaagacugcuucacuuaauaauua

SEQ ID NO: 18222 - RNA, 35 nt, Artificial Sequence
  Synthetic Oligonucleotide; PD-L1 exon 2; Set C
aaaacacgaaaagaagacugcuucacuuaauaauu

SEQ ID NO: 18223 - RNA, 34 nt, Artificial Sequence
  Synthetic Oligonucleotide; PD-L1 exon 2; Set C
aaaacacgaaaagaagacugcuucacuuaauaau

SEQ ID NO: 18224 - RNA, 33 nt, Artificial Sequence
  Synthetic Oligonucleotide; PD-L1 exon 2; Set C
aaaacacgaaaagaagacugcuucacuuaauaa

SEQ ID NO: 18225 - RNA, 37 nt, Artificial Sequence
  Synthetic Oligonucleotide; PD-L1 exon 2; Set A
uauggaaaacacgaaaagaagacugcuucacuuaaua

SEQ ID NO: 18226 - RNA, 38 nt, Artificial Sequence
  Synthetic Oligonucleotide; PD-L1 exon 2; Set A
uuauggaaaacacgaaaagaagacugcuucacuuaaua

SEQ ID NO: 18227 - RNA, 36 nt, Artificial Sequence
  Synthetic Oligonucleotide; PD-L1 exon 2; Set A
uauggaaaacacgaaaagaagacugcuucacuuaau

SEQ ID NO: 18228 - RNA, 39 nt, Artificial Sequence
  Synthetic Oligonucleotide; PD-L1 exon 2; Set A
auuauggaaaacacgaaaagaagacugcuucacuuaaua

SEQ ID NO: 18229 - RNA, 37 nt, Artificial Sequence
  Synthetic Oligonucleotide; PD-L1 exon 2; Set A
uuauggaaaacacgaaaagaagacugcuucacuuaau

SEQ ID NO: 18230 - RNA, 35 nt, Artificial Sequence
  Synthetic Oligonucleotide; PD-L1 exon 2; Set A
uauggaaaacacgaaaagaagacugcuucacuuaa

SEQ ID NO: 18231 - RNA, 38 nt, Artificial Sequence
  Synthetic Oligonucleotide; PD-L1 exon 2; Set A
auuauggaaaacacgaaaagaagacugcuucacuuaau

SEQ ID NO: 18232 - RNA, 36 nt, Artificial Sequence
  Synthetic Oligonucleotide; PD-L1 exon 2; Set A
uuauggaaaacacgaaaagaagacugcuucacuuaa

SEQ ID NO: 18233 - RNA, 34 nt, Artificial Sequence
  Synthetic Oligonucleotide; PD-L1 exon 2; Set A
uauggaaaacacgaaaagaagacugcuucacuua

SEQ ID NO: 18234 - RNA, 33 nt, Artificial Sequence
  Synthetic Oligonucleotide; PD-L1 exon 2; Set A
uauggaaaacacgaaaagaagacugcuucacuu

SEQ ID NO: 18235 - RNA, 37 nt, Artificial Sequence
  Synthetic Oligonucleotide; PD-L1 exon 2; Set A
auuauggaaaacacgaaaagaagacugcuucacuuaa

SEQ ID NO: 18236 - RNA, 35 nt, Artificial Sequence
  Synthetic Oligonucleotide; PD-L1 exon 2; Set A
uuauggaaaacacgaaaagaagacugcuucacuua

SEQ ID NO: 18237 - RNA, 34 nt, Artificial Sequence
  Synthetic Oligonucleotide; PD-L1 exon 2; Set A
uuauggaaaacacgaaaagaagacugcuucacuu

SEQ ID NO: 18238 - RNA, 36 nt, Artificial Sequence
  Synthetic Oligonucleotide; PD-L1 exon 2; Set A
auuauggaaaacacgaaaagaagacugcuucacuua

SEQ ID NO: 18239 - RNA, 35 nt, Artificial Sequence
  Synthetic Oligonucleotide; PD-L1 exon 2; Set A
auuauggaaaacacgaaaagaagacugcuucacuu

SEQ ID NO: 18240 - RNA, 22 nt, Artificial Sequence
  Synthetic Oligonucleotide; PD-L1 exon 2; Set C
ggaaugcccuaauuauggaaaa

SEQ ID NO: 18241 - RNA, 23 nt, Artificial Sequence
  Synthetic Oligonucleotide; PD-L1 exon 2; Set C
uggaaugcccuaauuauggaaaa

SEQ ID NO: 18242 - RNA, 24 nt, Artificial Sequence
  Synthetic Oligonucleotide; PD-L1 exon 2; Set C
cuggaaugcccuaauuauggaaaa

SEQ ID NO: 18243 - RNA, 25 nt, Artificial Sequence
  Synthetic Oligonucleotide; PD-L1 exon 2; Set C
ucuggaaugcccuaauuauggaaaa

SEQ ID NO: 18244 - RNA, 26 nt, Artificial Sequence
  Synthetic Oligonucleotide; PD-L1 exon 2; Set C
uucuggaaugcccuaauuauggaaaa

SEQ ID NO: 18245 - RNA, 15 nt, Artificial Sequence
  Synthetic Oligonucleotide; PD-L1 exon 2; Set C
gaaugcccuaauuau

SEQ ID NO: 18246 - RNA, 27 nt, Artificial Sequence
  Synthetic Oligonucleotide; PD-L1 exon 2; Set C
uuucuggaaugcccuaauuauggaaaa

SEQ ID NO: 18247 - RNA, 28 nt, Artificial Sequence
  Synthetic Oligonucleotide; PD-L1 exon 2; Set C
cuuucuggaaugcccuaauuauggaaaa

SEQ ID NO: 18248 - RNA, 18 nt, Artificial Sequence
  Synthetic Oligonucleotide; PD-L1 exon 2; Set C
uggaaugcccuaauuaug

SEQ ID NO: 18249 - RNA, 20 nt, Artificial Sequence
  Synthetic Oligonucleotide; PD-L1 exon 2; Set C
cuggaaugcccuaauuaugg

SEQ ID NO: 18250 - RNA, 29 nt, Artificial Sequence
  Synthetic Oligonucleotide; PD-L1 exon 2; Set C
ucuuucuggaaugcccuaauuauggaaaa

SEQ ID NO: 18251 - RNA, 19 nt, Artificial Sequence
  Synthetic Oligonucleotide; PD-L1 exon 2; Set C
cuggaaugcccuaauuaug

SEQ ID NO: 18252 - RNA, 21 nt, Artificial Sequence
  Synthetic Oligonucleotide; PD-L1 exon 2; Set C
ucuggaaugcccuaauuaugg

SEQ ID NO: 18253 - RNA, 30 nt, Artificial Sequence
  Synthetic Oligonucleotide; PD-L1 exon 2; Set C
aucuuucuggaaugcccuaauuauggaaaa

SEQ ID NO: 18254 - RNA, 20 nt, Artificial Sequence
  Synthetic Oligonucleotide; PD-L1 exon 2; Set C
ucuggaaugcccuaauuaug

SEQ ID NO: 18255 - RNA, 22 nt, Artificial Sequence
  Synthetic Oligonucleotide; PD-L1 exon 2; Set C
uucuggaaugcccuaauuaugg

SEQ ID NO: 18256 - RNA, 21 nt, Artificial Sequence
  Synthetic Oligonucleotide; PD-L1 exon 2; Set C
uucuggaaugcccuaauuaug

SEQ ID NO: 18257 - RNA, 23 nt, Artificial Sequence
  Synthetic Oligonucleotide; PD-L1 exon 2; Set C
uuucuggaaugcccuaauuaugg

SEQ ID NO: 18258 - RNA, 22 nt, Artificial Sequence
  Synthetic Oligonucleotide; PD-L1 exon 2; Set C
uuucuggaaugcccuaauuaug

SEQ ID NO: 18259 - RNA, 24 nt, Artificial Sequence
  Synthetic Oligonucleotide; PD-L1 exon 2; Set C
cuuucuggaaugcccuaauuaugg

SEQ ID NO: 18260 - RNA, 23 nt, Artificial Sequence
  Synthetic Oligonucleotide; PD-L1 exon 2; Set C
cuuucuggaaugcccuaauuaug

SEQ ID NO: 18261 - RNA, 40 nt, Artificial Sequence
  Synthetic Oligonucleotide; PD-L1 exon 2; Set A
aaauauccucaucuuucuggaaugcccuaauuauggaaaa

SEQ ID NO: 18262 - RNA, 32 nt, Artificial Sequence
  Synthetic Oligonucleotide; PD-L1 exon 2; Set A
auauccucaucuuucuggaaugcccuaauuau

SEQ ID NO: 18263 - RNA, 31 nt, Artificial Sequence
  Synthetic Oligonucleotide; PD-L1 exon 2; Set A
auauccucaucuuucuggaaugcccuaauua

SEQ ID NO: 18264 - RNA, 30 nt, Artificial Sequence
  Synthetic Oligonucleotide; PD-L1 exon 2; Set A
auauccucaucuuucuggaaugcccuaauu

SEQ ID NO: 18265 - RNA, 24 nt, Artificial Sequence
  Synthetic Oligonucleotide; PD-L1 exon 2; Set C
aauauccucaucuuucuggaaugc

SEQ ID NO: 18266 - RNA, 25 nt, Artificial Sequence
  Synthetic Oligonucleotide; PD-L1 exon 2; Set C
aaauauccucaucuuucuggaaugc

SEQ ID NO: 18267 - RNA, 26 nt, Artificial Sequence
  Synthetic Oligonucleotide; PD-L1 exon 2; Set C
caaauauccucaucuuucuggaaugc

SEQ ID NO: 18268 - RNA, 27 nt, Artificial Sequence
  Synthetic Oligonucleotide; PD-L1 exon 2; Set A
gcaaauauccucaucuuucuggaaugc

SEQ ID NO: 18269 - RNA, 18 nt, Artificial Sequence
  Synthetic Oligonucleotide; PD-L1 exon 2; Set C
auauccucaucuuucugg

SEQ ID NO: 18270 - RNA, 36 nt, Artificial Sequence
  Synthetic Oligonucleotide; PD-L1 exon 2; Set A
auaaagacagcaaauauccucaucuuucuggaaugc

SEQ ID NO: 18271 - RNA, 15 nt, Artificial Sequence
  Synthetic Oligonucleotide; PD-L1 exon 2; Set C
caaauauccucaucu

SEQ ID NO: 18272 - RNA, 37 nt, Artificial Sequence
  Synthetic Oligonucleotide; PD-L1 exon 2; Set A
uauaaagacagcaaauauccucaucuuucuggaaugc

SEQ ID NO: 18273 - RNA, 16 nt, Artificial Sequence
  Synthetic Oligonucleotide; PD-L1 exon 2; Set C
gcaaauauccucaucu

SEQ ID NO: 18274 - RNA, 15 nt, Artificial Sequence
  Synthetic Oligonucleotide; PD-L1 exon 2; Set C
gcaaauauccucauc

SEQ ID NO: 18275 - RNA, 32 nt, Artificial Sequence
  Synthetic Oligonucleotide; PD-L1 exon 2; Set A
auaaagacagcaaauauccucaucuuucugga

SEQ ID NO: 18276 - RNA, 28 nt, Artificial Sequence
  Synthetic Oligonucleotide; PD-L1 exon 2; Set C
auaaagacagcaaauauccucaucuuuc

SEQ ID NO: 18277 - RNA, 27 nt, Artificial Sequence
  Synthetic Oligonucleotide; PD-L1 exon 2; Set C
auaaagacagcaaauauccucaucuuu

SEQ ID NO: 18278 - RNA, 26 nt, Artificial Sequence
  Synthetic Oligonucleotide; PD-L1 exon 2; Set C
auaaagacagcaaauauccucaucuu

SEQ ID NO: 18279 - RNA, 39 nt, Artificial Sequence
  Synthetic Oligonucleotide; PD-L1 exon 2; Set A
caugaauauaaagacagcaaauauccucaucuuucugga

SEQ ID NO: 18280 - RNA, 38 nt, Artificial Sequence
  Synthetic Oligonucleotide; PD-L1 exon 2; Set A
caugaauauaaagacagcaaauauccucaucuuucugg

SEQ ID NO: 18281 - RNA, 40 nt, Artificial Sequence
  Synthetic Oligonucleotide; PD-L1 exon 2; Set A
ucaugaauauaaagacagcaaauauccucaucuuucugga

SEQ ID NO: 18282 - RNA, 26 nt, Artificial Sequence
  Synthetic Oligonucleotide; PD-L1 exon 2; Set C
uauaaagacagcaaauauccucaucu

SEQ ID NO: 18283 - RNA, 37 nt, Artificial Sequence
  Synthetic Oligonucleotide; PD-L1 exon 2; Set A
caugaauauaaagacagcaaauauccucaucuuucug

SEQ ID NO: 18284 - RNA, 39 nt, Artificial Sequence
  Synthetic Oligonucleotide; PD-L1 exon 2; Set A
ucaugaauauaaagacagcaaauauccucaucuuucugg

SEQ ID NO: 18285 - RNA, 25 nt, Artificial Sequence
  Synthetic Oligonucleotide; PD-L1 exon 2; Set C
uauaaagacagcaaauauccucauc

SEQ ID NO: 18286 - RNA, 38 nt, Artificial Sequence
  Synthetic Oligonucleotide; PD-L1 exon 2; Set A
ucaugaauauaaagacagcaaauauccucaucuuucug

SEQ ID NO: 18287 - RNA, 36 nt, Artificial Sequence
  Synthetic Oligonucleotide; PD-L1 exon 2; Set A
caugaauauaaagacagcaaauauccucaucuuucu

SEQ ID NO: 18288 - RNA, 37 nt, Artificial Sequence
  Synthetic Oligonucleotide; PD-L1 exon 2; Set A
ucaugaauauaaagacagcaaauauccucaucuuucu

SEQ ID NO: 18289 - RNA, 35 nt, Artificial Sequence
  Synthetic Oligonucleotide; PD-L1 exon 2; Set A
caugaauauaaagacagcaaauauccucaucuuuc

SEQ ID NO: 18290 - RNA, 36 nt, Artificial Sequence
  Synthetic Oligonucleotide; PD-L1 exon 2; Set A
ucaugaauauaaagacagcaaauauccucaucuuuc

SEQ ID NO: 18291 - RNA, 34 nt, Artificial Sequence
  Synthetic Oligonucleotide; PD-L1 exon 2; Set C
caugaauauaaagacagcaaauauccucaucuuu

SEQ ID NO: 18292 - RNA, 33 nt, Artificial Sequence
  Synthetic Oligonucleotide; PD-L1 exon 2; Set C
caugaauauaaagacagcaaauauccucaucuu

SEQ ID NO: 18293 - RNA, 37 nt, Artificial Sequence
  Synthetic Oligonucleotide; PD-L1 exon 2; Set A
gucaugaauauaaagacagcaaauauccucaucuuuc

SEQ ID NO: 18294 - RNA, 35 nt, Artificial Sequence
  Synthetic Oligonucleotide; PD-L1 exon 2; Set A
ucaugaauauaaagacagcaaauauccucaucuuu

SEQ ID NO: 18295 - RNA, 34 nt, Artificial Sequence
  Synthetic Oligonucleotide; PD-L1 exon 2; Set C
ucaugaauauaaagacagcaaauauccucaucuu

SEQ ID NO: 18296 - RNA, 36 nt, Artificial Sequence
  Synthetic Oligonucleotide; PD-L1 exon 2; Set A
gucaugaauauaaagacagcaaauauccucaucuuu

SEQ ID NO: 18297 - RNA, 35 nt, Artificial Sequence
  Synthetic Oligonucleotide; PD-L1 exon 2; Set A
gucaugaauauaaagacagcaaauauccucaucuu

SEQ ID NO: 18298 - RNA, 38 nt, Artificial Sequence
  Synthetic Oligonucleotide; PD-L1 exon 2; Set A
guaggucaugaauauaaagacagcaaauauccucaucu

SEQ ID NO: 18299 - RNA, 37 nt, Artificial Sequence
  Synthetic Oligonucleotide; PD-L1 exon 2; Set A
guaggucaugaauauaaagacagcaaauauccucauc

SEQ ID NO: 18300 - RNA, 39 nt, Artificial Sequence
  Synthetic Oligonucleotide; PD-L1 exon 2; Set A
aguaggucaugaauauaaagacagcaaauauccucaucu

SEQ ID NO: 18301 - RNA, 38 nt, Artificial Sequence
  Synthetic Oligonucleotide; PD-L1 exon 2; Set A
aguaggucaugaauauaaagacagcaaauauccucauc

SEQ ID NO: 18302 - RNA, 22 nt, Artificial Sequence
  Synthetic Oligonucleotide; PD-L1 exon 2; Set C
caugaauauaaagacagcaaau

SEQ ID NO: 18303 - RNA, 21 nt, Artificial Sequence
  Synthetic Oligonucleotide; PD-L1 exon 2; Set C
caugaauauaaagacagcaaa

SEQ ID NO: 18304 - RNA, 23 nt, Artificial Sequence
  Synthetic Oligonucleotide; PD-L1 exon 2; Set C
ucaugaauauaaagacagcaaau

SEQ ID NO: 18305 - RNA, 22 nt, Artificial Sequence
  Synthetic Oligonucleotide; PD-L1 exon 2; Set C
ucaugaauauaaagacagcaaa

SEQ ID NO: 18306 - RNA, 20 nt, Artificial Sequence
  Synthetic Oligonucleotide; PD-L1 exon 2; Set C
caugaauauaaagacagcaa

SEQ ID NO: 18307 - RNA, 21 nt, Artificial Sequence
  Synthetic Oligonucleotide; PD-L1 exon 2; Set C
ucaugaauauaaagacagcaa

SEQ ID NO: 18308 - RNA, 19 nt, Artificial Sequence
  Synthetic Oligonucleotide; PD-L1 exon 2; Set C
caugaauauaaagacagca

SEQ ID NO: 18309 - RNA, 22 nt, Artificial Sequence
  Synthetic Oligonucleotide; PD-L1 exon 2; Set C
gucaugaauauaaagacagcaa

SEQ ID NO: 18310 - RNA, 20 nt, Artificial Sequence
  Synthetic Oligonucleotide; PD-L1 exon 2; Set C
ucaugaauauaaagacagca

SEQ ID NO: 18311 - RNA, 21 nt, Artificial Sequence
  Synthetic Oligonucleotide; PD-L1 exon 2; Set C
gucaugaauauaaagacagca

SEQ ID NO: 18312 - RNA, 29 nt, Artificial Sequence
  Synthetic Oligonucleotide; PD-L1 exon 2; Set C
guaggucaugaauauaaagacagcaaaua

SEQ ID NO: 18313 - RNA, 30 nt, Artificial Sequence
  Synthetic Oligonucleotide; PD-L1 exon 2; Set C
aguaggucaugaauauaaagacagcaaaua

SEQ ID NO: 18314 - RNA, 34 nt, Artificial Sequence
  Synthetic Oligonucleotide; PD-L1 exon 2; Set A
augccaguaggucaugaauauaaagacagcaaau

SEQ ID NO: 18315 - RNA, 36 nt, Artificial Sequence
  Synthetic Oligonucleotide; PD-L1 exon 2; Set A
aaugccaguaggucaugaauauaaagacagcaaaua

SEQ ID NO: 18316 - RNA, 33 nt, Artificial Sequence
  Synthetic Oligonucleotide; PD-L1 exon 2; Set A
augccaguaggucaugaauauaaagacagcaaa

SEQ ID NO: 18317 - RNA, 37 nt, Artificial Sequence
  Synthetic Oligonucleotide; PD-L1 exon 2; Set A
aaaugccaguaggucaugaauauaaagacagcaaaua

SEQ ID NO: 18318 - RNA, 32 nt, Artificial Sequence
  Synthetic Oligonucleotide; PD-L1 exon 2; Set A
augccaguaggucaugaauauaaagacagcaa

SEQ ID NO: 18319 - RNA, 15 nt, Artificial Sequence
  Synthetic Oligonucleotide; PD-L1 exon 2; Set C
uaggucaugaauaua

SEQ ID NO: 18320 - RNA, 15 nt, Artificial Sequence
  Synthetic Oligonucleotide; PD-L1 exon 2; Set C
aguaggucaugaaua

SEQ ID NO: 18321 - RNA, 22 nt, Artificial Sequence
  Synthetic Oligonucleotide; PD-L1 exon 2; Set C
augccaguaggucaugaauaua

SEQ ID NO: 18322 - RNA, 21 nt, Artificial Sequence
  Synthetic Oligonucleotide; PD-L1 exon 2; Set C
augccaguaggucaugaauau

SEQ ID NO: 18323 - RNA, 21 nt, Artificial Sequence
  Synthetic Oligonucleotide; PD-L1 exon 2; Set C
aaugccaguaggucaugaaua

SEQ ID NO: 18324 - RNA, 22 nt, Artificial Sequence
  Synthetic Oligonucleotide; PD-L1 exon 2; Set C
aaaugccaguaggucaugaaua

SEQ ID NO: 18325 - RNA, 23 nt, Artificial Sequence
  Synthetic Oligonucleotide; PD-L1 exon 2; Set C
caaaugccaguaggucaugaaua

SEQ ID NO: 18326 - RNA, 24 nt, Artificial Sequence
  Synthetic Oligonucleotide; PD-L1 exon 2; Set C
gcaaaugccaguaggucaugaaua

SEQ ID NO: 18327 - RNA, 28 nt, Artificial Sequence
  Synthetic Oligonucleotide; PD-L1 exon 2; Set A
uucagcaaaugccaguaggucaugaaua

SEQ ID NO: 18328 - RNA, 29 nt, Artificial Sequence
  Synthetic Oligonucleotide; PD-L1 exon 2; Set A
guucagcaaaugccaguaggucaugaaua

SEQ ID NO: 18329 - RNA, 30 nt, Artificial Sequence
  Synthetic Oligonucleotide; PD-L1 exon 2; Set A
cguucagcaaaugccaguaggucaugaaua

SEQ ID NO: 18330 - RNA, 15 nt, Artificial Sequence
  Synthetic Oligonucleotide; PD-L1 exon 2; Set C
caaaugccaguaggu

SEQ ID NO: 18331 - RNA, 31 nt, Artificial Sequence
  Synthetic Oligonucleotide; PD-L1 exon 2; Set A
ccguucagcaaaugccaguaggucaugaaua

SEQ ID NO: 18332 - RNA, 16 nt, Artificial Sequence
  Synthetic Oligonucleotide; PD-L1 exon 2; Set C
gcaaaugccaguaggu

SEQ ID NO: 18333 - RNA, 32 nt, Artificial Sequence
  Synthetic Oligonucleotide; PD-L1 exon 2; Set C
accguucagcaaaugccaguaggucaugaaua

SEQ ID NO: 18334 - RNA, 15 nt, Artificial Sequence
  Synthetic Oligonucleotide; PD-L1 exon 2; Set C
gcaaaugccaguagg

SEQ ID NO: 18335 - RNA, 34 nt, Artificial Sequence
  Synthetic Oligonucleotide; PD-L1 exon 2; Set C
uuaccguucagcaaaugccaguaggucaugaaua

SEQ ID NO: 18336 - RNA, 35 nt, Artificial Sequence
  Synthetic Oligonucleotide; PD-L1 exon 2; Set C
cuuaccguucagcaaaugccaguaggucaugaaua

SEQ ID NO: 18337 - RNA, 20 nt, Artificial Sequence
  Synthetic Oligonucleotide; PD-L1 exon 2; Set C
uucagcaaaugccaguaggu

SEQ ID NO: 18338 - RNA, 36 nt, Artificial Sequence
  Synthetic Oligonucleotide; PD-L1 exon 2; Set C
ucuuaccguucagcaaaugccaguaggucaugaaua

SEQ ID NO: 18339 - RNA, 19 nt, Artificial Sequence
  Synthetic Oligonucleotide; PD-L1 exon 2; Set C
uucagcaaaugccaguagg

SEQ ID NO: 18340 - RNA, 21 nt, Artificial Sequence
  Synthetic Oligonucleotide; PD-L1 exon 2; Set C
guucagcaaaugccaguaggu

SEQ ID NO: 18341 - RNA, 37 nt, Artificial Sequence
  Synthetic Oligonucleotide; PD-L1 exon 2; Set C
gucuuaccguucagcaaaugccaguaggucaugaaua

SEQ ID NO: 18342 - RNA, 40 nt, Artificial Sequence
  Synthetic Oligonucleotide; PD-L1 exon 2; Set C
gugucuuaccguucagcaaaugccaguaggucaugaauau

SEQ ID NO: 18343 - RNA, 28 nt, Artificial Sequence
  Synthetic Oligonucleotide; PD-L1 exon 2; Set A
uaccguucagcaaaugccaguaggucau

SEQ ID NO: 18344 - RNA, 20 nt, Artificial Sequence
  Synthetic Oligonucleotide; PD-L1 exon 2; Set C
guucagcaaaugccaguagg

SEQ ID NO: 18345 - RNA, 18 nt, Artificial Sequence
  Synthetic Oligonucleotide; PD-L1 exon 2; Set C
uucagcaaaugccaguag

SEQ ID NO: 18346 - RNA, 22 nt, Artificial Sequence
  Synthetic Oligonucleotide; PD-L1 exon 2; Set A
cguucagcaaaugccaguaggu

SEQ ID NO: 18347 - RNA, 27 nt, Artificial Sequence
  Synthetic Oligonucleotide; PD-L1 exon 2; Set C
uaccguucagcaaaugccaguagguca

SEQ ID NO: 18348 - RNA, 21 nt, Artificial Sequence
  Synthetic Oligonucleotide; PD-L1 exon 2; Set C
cguucagcaaaugccaguagg

SEQ ID NO: 18349 - RNA, 19 nt, Artificial Sequence
  Synthetic Oligonucleotide; PD-L1 exon 2; Set C
guucagcaaaugccaguag

SEQ ID NO: 18350 - RNA, 23 nt, Artificial Sequence
  Synthetic Oligonucleotide; PD-L1 exon 2; Set A
ccguucagcaaaugccaguaggu

SEQ ID NO: 18351 - RNA, 22 nt, Artificial Sequence
  Synthetic Oligonucleotide; PD-L1 exon 2; Set A
ccguucagcaaaugccaguagg

SEQ ID NO: 18352 - RNA, 20 nt, Artificial Sequence
  Synthetic Oligonucleotide; PD-L1 exon 2; Set C
cguucagcaaaugccaguag

SEQ ID NO: 18353 - RNA, 24 nt, Artificial Sequence
  Synthetic Oligonucleotide; PD-L1 exon 2; Set A
accguucagcaaaugccaguaggu

SEQ ID NO: 18354 - RNA, 23 nt, Artificial Sequence
  Synthetic Oligonucleotide; PD-L1 exon 2; Set A
accguucagcaaaugccaguagg

SEQ ID NO: 18355 - RNA, 21 nt, Artificial Sequence
  Synthetic Oligonucleotide; PD-L1 exon 2; Set C
ccguucagcaaaugccaguag

SEQ ID NO: 18356 - RNA, 25 nt, Artificial Sequence
  Synthetic Oligonucleotide; PD-L1 exon 2; Set A
uaccguucagcaaaugccaguaggu

SEQ ID NO: 18357 - RNA, 24 nt, Artificial Sequence
  Synthetic Oligonucleotide; PD-L1 exon 2; Set A
uaccguucagcaaaugccaguagg

SEQ ID NO: 18358 - RNA, 26 nt, Artificial Sequence
  Synthetic Oligonucleotide; PD-L1 exon 2; Set A
uuaccguucagcaaaugccaguaggu

SEQ ID NO: 18359 - RNA, 22 nt, Artificial Sequence
  Synthetic Oligonucleotide; PD-L1 exon 2; Set A
accguucagcaaaugccaguag

SEQ ID NO: 18360 - RNA, 33 nt, Artificial Sequence
  Synthetic Oligonucleotide; PD-L1 exon 2; Set C
ugucuuaccguucagcaaaugccaguaggucau

SEQ ID NO: 18361 - RNA, 25 nt, Artificial Sequence
  Synthetic Oligonucleotide; PD-L1 exon 2; Set A
uuaccguucagcaaaugccaguagg

SEQ ID NO: 18362 - RNA, 27 nt, Artificial Sequence
  Synthetic Oligonucleotide; PD-L1 exon 2; Set A
cuuaccguucagcaaaugccaguaggu

SEQ ID NO: 18363 - RNA, 23 nt, Artificial Sequence
  Synthetic Oligonucleotide; PD-L1 exon 2; Set A
uaccguucagcaaaugccaguag

SEQ ID NO: 18364 - RNA, 32 nt, Artificial Sequence
  Synthetic Oligonucleotide; PD-L1 exon 2; Set C
ugucuuaccguucagcaaaugccaguagguca

SEQ ID NO: 18365 - RNA, 26 nt, Artificial Sequence
  Synthetic Oligonucleotide; PD-L1 exon 2; Set A
cuuaccguucagcaaaugccaguagg

SEQ ID NO: 18366 - RNA, 24 nt, Artificial Sequence
  Synthetic Oligonucleotide; PD-L1 exon 2; Set A
uuaccguucagcaaaugccaguag

SEQ ID NO: 18367 - RNA, 31 nt, Artificial Sequence
  Synthetic Oligonucleotide; PD-L1 exon 2; Set C
ugucuuaccguucagcaaaugccaguagguc

SEQ ID NO: 18368 - RNA, 25 nt, Artificial Sequence
  Synthetic Oligonucleotide; PD-L1 exon 2; Set A
cuuaccguucagcaaaugccaguag

SEQ ID NO: 18369 - RNA, 32 nt, Artificial Sequence
  Synthetic Oligonucleotide; PD-L1 exon 2; Set C
gugucuuaccguucagcaaaugccaguagguc

SEQ ID NO: 18370 - RNA, 33 nt, Artificial Sequence
  Synthetic Oligonucleotide; PD-L1 exon 2; Set C
ggugucuuaccguucagcaaaugccaguagguc

SEQ ID NO: 18371 - RNA, 33 nt, Artificial Sequence
  Synthetic Oligonucleotide; PD-L1 exon 2; Set C
uggugucuuaccguucagcaaaugccaguaggu

SEQ ID NO: 18372 - RNA, 16 nt, Artificial Sequence
  Synthetic Oligonucleotide; PD-L1 exon 2; Set C
uaccguucagcaaaug

SEQ ID NO: 18373 - RNA, 32 nt, Artificial Sequence
  Synthetic Oligonucleotide; PD-L1 exon 2; Set C
uggugucuuaccguucagcaaaugccaguagg

SEQ ID NO: 18374 - RNA, 34 nt, Artificial Sequence
  Synthetic Oligonucleotide; PD-L1 exon 2; Set C
uuggugucuuaccguucagcaaaugccaguaggu

SEQ ID NO: 18375 - RNA, 29 nt, Artificial Sequence
  Synthetic Oligonucleotide; PD-L1 exon 2; Set C
ggugucuuaccguucagcaaaugccagua

SEQ ID NO: 18376 - RNA, 33 nt, Artificial Sequence
  Synthetic Oligonucleotide; PD-L1 exon 2; Set C
uuggugucuuaccguucagcaaaugccaguagg

SEQ ID NO: 18377 - RNA, 31 nt, Artificial Sequence
  Synthetic Oligonucleotide; PD-L1 exon 2; Set C
uggugucuuaccguucagcaaaugccaguag

SEQ ID NO: 18378 - RNA, 28 nt, Artificial Sequence
  Synthetic Oligonucleotide; PD-L1 exon 2; Set C
ggugucuuaccguucagcaaaugccagu

SEQ ID NO: 18379 - RNA, 32 nt, Artificial Sequence
  Synthetic Oligonucleotide; PD-L1 exon 2; Set C
uuggugucuuaccguucagcaaaugccaguag

SEQ ID NO: 18380 - RNA, 39 nt, Artificial Sequence
  Synthetic Oligonucleotide; PD-L1 exon 2; Set C
ggauuuggugucuuaccguucagcaaaugccaguagguc

SEQ ID NO: 18381 - RNA, 40 nt, Artificial Sequence
  Synthetic Oligonucleotide; PD-L1 exon 2; Set C
aggauuuggugucuuaccguucagcaaaugccaguagguc

SEQ ID NO: 18382 - RNA, 21 nt, Artificial Sequence
  Synthetic Oligonucleotide; PD-L1 exon 2; Set C
ugucuuaccguucagcaaaug

SEQ ID NO: 18383 - RNA, 35 nt, Artificial Sequence
  Synthetic Oligonucleotide; PD-L1 exon 2; Set C
ggauuuggugucuuaccguucagcaaaugccagua

SEQ ID NO: 18384 - RNA, 36 nt, Artificial Sequence
  Synthetic Oligonucleotide; PD-L1 exon 2; Set C
aggauuuggugucuuaccguucagcaaaugccagua

SEQ ID NO: 18385 - RNA, 24 nt, Artificial Sequence
  Synthetic Oligonucleotide; PD-L1 exon 2; Set A
uggugucuuaccguucagcaaaug

SEQ ID NO: 18386 - RNA, 40 nt, Artificial Sequence
  Synthetic Oligonucleotide; PD-L1 exon 2; Set C
gaaggauuuggugucuuaccguucagcaaaugccaguagg

SEQ ID NO: 18387 - RNA, 37 nt, Artificial Sequence
  Synthetic Oligonucleotide; PD-L1 exon 2; Set C
aaggauuuggugucuuaccguucagcaaaugccagua

SEQ ID NO: 18388 - RNA, 21 nt, Artificial Sequence
  Synthetic Oligonucleotide; PD-L1 exon 2; Set C
ggugucuuaccguucagcaaa

SEQ ID NO: 18389 - RNA, 39 nt, Artificial Sequence
  Synthetic Oligonucleotide; PD-L1 exon 2; Set C
gaaggauuuggugucuuaccguucagcaaaugccaguag

SEQ ID NO: 18390 - RNA, 20 nt, Artificial Sequence
  Synthetic Oligonucleotide; PD-L1 exon 2; Set A
ggugucuuaccguucagcaa

SEQ ID NO: 18391 - RNA, 18 nt, Artificial Sequence
  Synthetic Oligonucleotide; PD-L1 exon 2; Set C
gugucuuaccguucagca

SEQ ID NO: 18392 - RNA, 40 nt, Artificial Sequence
  Synthetic Oligonucleotide; PD-L1 exon 2; Set C
ggaaggauuuggugucuuaccguucagcaaaugccaguag

SEQ ID NO: 18393 - RNA, 19 nt, Artificial Sequence
  Synthetic Oligonucleotide; PD-L1 exon 2; Set A
ggugucuuaccguucagca

SEQ ID NO: 18394 - RNA, 26 nt, Artificial Sequence
  Synthetic Oligonucleotide; PD-L1 exon 2; Set A
ggauuuggugucuuaccguucagcaa

SEQ ID NO: 18395 - RNA, 20 nt, Artificial Sequence
  Synthetic Oligonucleotide; PD-L1 exon 2; Set C
uuuggugucuuaccguucag

SEQ ID NO: 18396 - RNA, 27 nt, Artificial Sequence
  Synthetic Oligonucleotide; PD-L1 exon 2; Set A
aggauuuggugucuuaccguucagcaa

SEQ ID NO: 18397 - RNA, 25 nt, Artificial Sequence
  Synthetic Oligonucleotide; PD-L1 exon 2; Set A
ggauuuggugucuuaccguucagca

SEQ ID NO: 18398 - RNA, 19 nt, Artificial Sequence
  Synthetic Oligonucleotide; PD-L1 exon 2; Set C
uuuggugucuuaccguuca

SEQ ID NO: 18399 - RNA, 21 nt, Artificial Sequence
  Synthetic Oligonucleotide; PD-L1 exon 2; Set C
auuuggugucuuaccguucag

SEQ ID NO: 18400 - RNA, 28 nt, Artificial Sequence
  Synthetic Oligonucleotide; PD-L1 exon 2; Set A
aaggauuuggugucuuaccguucagcaa

SEQ ID NO: 18401 - RNA, 26 nt, Artificial Sequence
  Synthetic Oligonucleotide; PD-L1 exon 2; Set A
aggauuuggugucuuaccguucagca

SEQ ID NO: 18402 - RNA, 20 nt, Artificial Sequence
  Synthetic Oligonucleotide; PD-L1 exon 2; Set C
auuuggugucuuaccguuca

SEQ ID NO: 18403 - RNA, 22 nt, Artificial Sequence
  Synthetic Oligonucleotide; PD-L1 exon 2; Set C
gauuuggugucuuaccguucag

SEQ ID NO: 18404 - RNA, 27 nt, Artificial Sequence
  Synthetic Oligonucleotide; PD-L1 exon 2; Set A
aaggauuuggugucuuaccguucagca

SEQ ID NO: 18405 - RNA, 21 nt, Artificial Sequence
  Synthetic Oligonucleotide; PD-L1 exon 2; Set C
gauuuggugucuuaccguuca

SEQ ID NO: 18406 - RNA, 38 nt, Artificial Sequence
  Synthetic Oligonucleotide; PD-L1 exon 2; Set C
cuaauggaaggauuuggugucuuaccguucagcaaaug

SEQ ID NO: 18407 - RNA, 38 nt, Artificial Sequence
  Synthetic Oligonucleotide; PD-L1 exon 2; Set C
ccuaauggaaggauuuggugucuuaccguucagcaaau

SEQ ID NO: 18408 - RNA, 18 nt, Artificial Sequence
  Synthetic Oligonucleotide; PD-L1 exon 2; Set C
ggauuuggugucuuaccg

SEQ ID NO: 18409 - RNA, 28 nt, Artificial Sequence
  Synthetic Oligonucleotide; PD-L1 exon 2; Set A
uggaaggauuuggugucuuaccguucag

SEQ ID NO: 18410 - RNA, 39 nt, Artificial Sequence
  Synthetic Oligonucleotide; PD-L1 exon 2; Set C
accuaauggaaggauuuggugucuuaccguucagcaaau

SEQ ID NO: 18411 - RNA, 37 nt, Artificial Sequence
  Synthetic Oligonucleotide; PD-L1 exon 2; Set C
ccuaauggaaggauuuggugucuuaccguucagcaaa

SEQ ID NO: 18412 - RNA, 19 nt, Artificial Sequence
  Synthetic Oligonucleotide; PD-L1 exon 2; Set C
aggauuuggugucuuaccg

SEQ ID NO: 18413 - RNA, 17 nt, Artificial Sequence
  Synthetic Oligonucleotide; PD-L1 exon 2; Set C
ggauuuggugucuuacc

SEQ ID NO: 18414 - RNA, 27 nt, Artificial Sequence
  Synthetic Oligonucleotide; PD-L1 exon 2; Set B
uggaaggauuuggugucuuaccguuca

SEQ ID NO: 18415 - RNA, 40 nt, Artificial Sequence
  Synthetic Oligonucleotide; PD-L1 exon 2; Set C
aaccuaauggaaggauuuggugucuuaccguucagcaaau

SEQ ID NO: 18416 - RNA, 38 nt, Artificial Sequence
  Synthetic Oligonucleotide; PD-L1 exon 2; Set C
accuaauggaaggauuuggugucuuaccguucagcaaa

SEQ ID NO: 18417 - RNA, 20 nt, Artificial Sequence
  Synthetic Oligonucleotide; PD-L1 exon 2; Set C
aaggauuuggugucuuaccg

SEQ ID NO: 18418 - RNA, 18 nt, Artificial Sequence
  Synthetic Oligonucleotide; PD-L1 exon 2; Set C
aggauuuggugucuuacc

SEQ ID NO: 18419 - RNA, 36 nt, Artificial Sequence
  Synthetic Oligonucleotide; PD-L1 exon 2; Set C
ccuaauggaaggauuuggugucuuaccguucagcaa

SEQ ID NO: 18420 - RNA, 16 nt, Artificial Sequence
  Synthetic Oligonucleotide; PD-L1 exon 2; Set C
ggauuuggugucuuac

SEQ ID NO: 18421 - RNA, 39 nt, Artificial Sequence
  Synthetic Oligonucleotide; PD-L1 exon 2; Set C
aaccuaauggaaggauuuggugucuuaccguucagcaaa

SEQ ID NO: 18422 - RNA, 19 nt, Artificial Sequence
  Synthetic Oligonucleotide; PD-L1 exon 2; Set C
aaggauuuggugucuuacc

SEQ ID NO: 18423 - RNA, 37 nt, Artificial Sequence
  Synthetic Oligonucleotide; PD-L1 exon 2; Set C
accuaauggaaggauuuggugucuuaccguucagcaa

SEQ ID NO: 18424 - RNA, 35 nt, Artificial Sequence
  Synthetic Oligonucleotide; PD-L1 exon 2; Set C
ccuaauggaaggauuuggugucuuaccguucagca

SEQ ID NO: 18425 - RNA, 17 nt, Artificial Sequence
  Synthetic Oligonucleotide; PD-L1 exon 2; Set C
aggauuuggugucuuac

SEQ ID NO: 18426 - RNA, 38 nt, Artificial Sequence
  Synthetic Oligonucleotide; PD-L1 exon 2; Set C
aaccuaauggaaggauuuggugucuuaccguucagcaa

SEQ ID NO: 18427 - RNA, 36 nt, Artificial Sequence
  Synthetic Oligonucleotide; PD-L1 exon 2; Set C
accuaauggaaggauuuggugucuuaccguucagca

SEQ ID NO: 18428 - RNA, 18 nt, Artificial Sequence
  Synthetic Oligonucleotide; PD-L1 exon 2; Set C
aaggauuuggugucuuac

SEQ ID NO: 18429 - RNA, 17 nt, Artificial Sequence
  Synthetic Oligonucleotide; PD-L1 exon 2; Set C
aaggauuuggugucuua

SEQ ID NO: 18430 - RNA, 37 nt, Artificial Sequence
  Synthetic Oligonucleotide; PD-L1 exon 2; Set C
aaccuaauggaaggauuuggugucuuaccguucagca

SEQ ID NO: 18431 - RNA, 31 nt, Artificial Sequence
  Synthetic Oligonucleotide; PD-L1 exon 2; Set B
ccuaauggaaggauuuggugucuuaccguuc

SEQ ID NO: 18432 - RNA, 32 nt, Artificial Sequence
  Synthetic Oligonucleotide; PD-L1 exon 2; Set B
accuaauggaaggauuuggugucuuaccguuc

SEQ ID NO: 18433 - RNA, 30 nt, Artificial Sequence
  Synthetic Oligonucleotide; PD-L1 exon 2; Set B
ccuaauggaaggauuuggugucuuaccguu

SEQ ID NO: 18434 - RNA, 31 nt, Artificial Sequence
  Synthetic Oligonucleotide; PD-L1 exon 2; Set B
accuaauggaaggauuuggugucuuaccguu

SEQ ID NO: 18435 - RNA, 33 nt, Artificial Sequence
  Synthetic Oligonucleotide; PD-L1 exon 2; Set B
aaccuaauggaaggauuuggugucuuaccguuc

SEQ ID NO: 18436 - RNA, 29 nt, Artificial Sequence
  Synthetic Oligonucleotide; PD-L1 exon 2; Set B
ccuaauggaaggauuuggugucuuaccgu

SEQ ID NO: 18437 - RNA, 32 nt, Artificial Sequence
  Synthetic Oligonucleotide; PD-L1 exon 2; Set B
aaccuaauggaaggauuuggugucuuaccguu

SEQ ID NO: 18438 - RNA, 30 nt, Artificial Sequence
  Synthetic Oligonucleotide; PD-L1 exon 2; Set B
accuaauggaaggauuuggugucuuaccgu

SEQ ID NO: 18439 - RNA, 28 nt, Artificial Sequence
  Synthetic Oligonucleotide; PD-L1 exon 2; Set B
ccuaauggaaggauuuggugucuuaccg

SEQ ID NO: 18440 - RNA, 31 nt, Artificial Sequence
  Synthetic Oligonucleotide; PD-L1 exon 2; Set B
aaccuaauggaaggauuuggugucuuaccgu

SEQ ID NO: 18441 - RNA, 29 nt, Artificial Sequence
  Synthetic Oligonucleotide; PD-L1 exon 2; Set B
accuaauggaaggauuuggugucuuaccg

SEQ ID NO: 18442 - RNA, 27 nt, Artificial Sequence
  Synthetic Oligonucleotide; PD-L1 exon 2; Set B
ccuaauggaaggauuuggugucuuacc

SEQ ID NO: 18443 - RNA, 30 nt, Artificial Sequence
  Synthetic Oligonucleotide; PD-L1 exon 2; Set B
aaccuaauggaaggauuuggugucuuaccg

SEQ ID NO: 18444 - RNA, 28 nt, Artificial Sequence
  Synthetic Oligonucleotide; PD-L1 exon 2; Set B
accuaauggaaggauuuggugucuuacc

SEQ ID NO: 18445 - RNA, 25 nt, Artificial Sequence
  Synthetic Oligonucleotide; PD-L1 exon 2; Set C
ccuaauggaaggauuuggugucuua

SEQ ID NO: 18446 - RNA, 29 nt, Artificial Sequence
  Synthetic Oligonucleotide; PD-L1 exon 2; Set B
aaccuaauggaaggauuuggugucuuacc

SEQ ID NO: 18447 - RNA, 24 nt, Artificial Sequence
  Synthetic Oligonucleotide; PD-L1 exon 2; Set C
ccuaauggaaggauuuggugucuu

SEQ ID NO: 18448 - RNA, 26 nt, Artificial Sequence
  Synthetic Oligonucleotide; PD-L1 exon 2; Set B
accuaauggaaggauuuggugucuua

SEQ ID NO: 18449 - RNA, 23 nt, Artificial Sequence
  Synthetic Oligonucleotide; PD-L1 exon 2; Set C
ccuaauggaaggauuuggugucu

SEQ ID NO: 18450 - RNA, 25 nt, Artificial Sequence
  Synthetic Oligonucleotide; PD-L1 exon 2; Set B
accuaauggaaggauuuggugucuu

SEQ ID NO: 18451 - RNA, 27 nt, Artificial Sequence
  Synthetic Oligonucleotide; PD-L1 exon 2; Set C
aaccuaauggaaggauuuggugucuua

SEQ ID NO: 18452 - RNA, 15 nt, Artificial Sequence
  Synthetic Oligonucleotide; PD-L1 exon 2; Set C
auggaaggauuuggu

SEQ ID NO: 18453 - RNA, 22 nt, Artificial Sequence
  Synthetic Oligonucleotide; PD-L1 exon 2; Set C
ccuaauggaaggauuugguguc

SEQ ID NO: 18454 - RNA, 24 nt, Artificial Sequence
  Synthetic Oligonucleotide; PD-L1 exon 2; Set C
accuaauggaaggauuuggugucu

SEQ ID NO: 18455 - RNA, 26 nt, Artificial Sequence
  Synthetic Oligonucleotide; PD-L1 exon 2; Set C
aaccuaauggaaggauuuggugucuu

SEQ ID NO: 18456 - RNA, 20 nt, Artificial Sequence
  Synthetic Oligonucleotide; PD-L1 exon 2; Set C
cuaauggaaggauuuggugu

SEQ ID NO: 18457 - RNA, 16 nt, Artificial Sequence
  Synthetic Oligonucleotide; PD-L1 exon 2; Set C
aauggaaggauuuggu

SEQ ID NO: 18458 - RNA, 23 nt, Artificial Sequence
  Synthetic Oligonucleotide; PD-L1 exon 2; Set C
accuaauggaaggauuugguguc

SEQ ID NO: 18459 - RNA, 25 nt, Artificial Sequence
  Synthetic Oligonucleotide; PD-L1 exon 2; Set C
aaccuaauggaaggauuuggugucu

SEQ ID NO: 18460 - RNA, 19 nt, Artificial Sequence
  Synthetic Oligonucleotide; PD-L1 exon 2; Set C
cuaauggaaggauuuggug

SEQ ID NO: 18461 - RNA, 17 nt, Artificial Sequence
  Synthetic Oligonucleotide; PD-L1 exon 2; Set C
uaauggaaggauuuggu

SEQ ID NO: 18462 - RNA, 24 nt, Artificial Sequence
  Synthetic Oligonucleotide; PD-L1 exon 2; Set C
aaccuaauggaaggauuugguguc

SEQ ID NO: 18463 - RNA, 18 nt, Artificial Sequence
  Synthetic Oligonucleotide; PD-L1 exon 2; Set C
ccuaauggaaggauuugg

SEQ ID NO: 18464 - RNA, 24 nt, Artificial Sequence
  Synthetic Oligonucleotide; PD-L1 exon 2; Set C
gaaccuaauggaaggauuuggugu

SEQ ID NO: 18465 - RNA, 17 nt, Artificial Sequence
  Synthetic Oligonucleotide; PD-L1 exon 2; Set C
ccuaauggaaggauuug

SEQ ID NO: 18466 - RNA, 19 nt, Artificial Sequence
  Synthetic Oligonucleotide; PD-L1 exon 2; Set C
accuaauggaaggauuugg

SEQ ID NO: 18467 - RNA, 23 nt, Artificial Sequence
  Synthetic Oligonucleotide; PD-L1 exon 2; Set C
gaaccuaauggaaggauuuggug

SEQ ID NO: 18468 - RNA, 16 nt, Artificial Sequence
  Synthetic Oligonucleotide; PD-L1 exon 2; Set C
ccuaauggaaggauuu

SEQ ID NO: 18469 - RNA, 18 nt, Artificial Sequence
  Synthetic Oligonucleotide; PD-L1 exon 2; Set C
accuaauggaaggauuug

SEQ ID NO: 18470 - RNA, 20 nt, Artificial Sequence
  Synthetic Oligonucleotide; PD-L1 exon 2; Set C
aaccuaauggaaggauuugg

SEQ ID NO: 18471 - RNA, 26 nt, Artificial Sequence
  Synthetic Oligonucleotide; PD-L1 exon 2; Set C
uagaaccuaauggaaggauuuggugu

SEQ ID NO: 18472 - RNA, 15 nt, Artificial Sequence
  Synthetic Oligonucleotide; PD-L1 exon 2; Set C
ccuaauggaaggauu

SEQ ID NO: 18473 - RNA, 17 nt, Artificial Sequence
  Synthetic Oligonucleotide; PD-L1 exon 2; Set C
accuaauggaaggauuu

SEQ ID NO: 18474 - RNA, 19 nt, Artificial Sequence
  Synthetic Oligonucleotide; PD-L1 exon 2; Set C
aaccuaauggaaggauuug

SEQ ID NO: 18475 - RNA, 27 nt, Artificial Sequence
  Synthetic Oligonucleotide; PD-L1 exon 2; Set C
auagaaccuaauggaaggauuuggugu

SEQ ID NO: 18476 - RNA, 25 nt, Artificial Sequence
  Synthetic Oligonucleotide; PD-L1 exon 2; Set C
uagaaccuaauggaaggauuuggug

SEQ ID NO: 18477 - RNA, 23 nt, Artificial Sequence
  Synthetic Oligonucleotide; PD-L1 exon 2; Set C
agaaccuaauggaaggauuuggu

SEQ ID NO: 18478 - RNA, 16 nt, Artificial Sequence
  Synthetic Oligonucleotide; PD-L1 exon 2; Set C
accuaauggaaggauu

SEQ ID NO: 18479 - RNA, 18 nt, Artificial Sequence
  Synthetic Oligonucleotide; PD-L1 exon 2; Set C
aaccuaauggaaggauuu

SEQ ID NO: 18480 - RNA, 28 nt, Artificial Sequence
  Synthetic Oligonucleotide; PD-L1 exon 2; Set C
uauagaaccuaauggaaggauuuggugu

SEQ ID NO: 18481 - RNA, 26 nt, Artificial Sequence
  Synthetic Oligonucleotide; PD-L1 exon 2; Set C
auagaaccuaauggaaggauuuggug

SEQ ID NO: 18482 - RNA, 24 nt, Artificial Sequence
  Synthetic Oligonucleotide; PD-L1 exon 2; Set C
uagaaccuaauggaaggauuuggu

SEQ ID NO: 18483 - RNA, 15 nt, Artificial Sequence
  Synthetic Oligonucleotide; PD-L1 exon 2; Set C
accuaauggaaggau

SEQ ID NO: 18484 - RNA, 17 nt, Artificial Sequence
  Synthetic Oligonucleotide; PD-L1 exon 2; Set C
aaccuaauggaaggauu

SEQ ID NO: 18485 - RNA, 27 nt, Artificial Sequence
  Synthetic Oligonucleotide; PD-L1 exon 2; Set C
uauagaaccuaauggaaggauuuggug

SEQ ID NO: 18486 - RNA, 25 nt, Artificial Sequence
  Synthetic Oligonucleotide; PD-L1 exon 2; Set C
auagaaccuaauggaaggauuuggu

SEQ ID NO: 18487 - RNA, 16 nt, Artificial Sequence
  Synthetic Oligonucleotide; PD-L1 exon 2; Set C
aaccuaauggaaggau

SEQ ID NO: 18488 - RNA, 26 nt, Artificial Sequence
  Synthetic Oligonucleotide; PD-L1 exon 2; Set C
uauagaaccuaauggaaggauuuggu

SEQ ID NO: 18489 - RNA, 29 nt, Artificial Sequence
  Synthetic Oligonucleotide; PD-L1 exon 2; Set C
aauauagaaccuaauggaaggauuuggug

SEQ ID NO: 18490 - RNA, 30 nt, Artificial Sequence
  Synthetic Oligonucleotide; PD-L1 exon 2; Set C
aaauauagaaccuaauggaaggauuuggug

SEQ ID NO: 18491 - RNA, 28 nt, Artificial Sequence
  Synthetic Oligonucleotide; PD-L1 exon 2; Set C
aauauagaaccuaauggaaggauuuggu

SEQ ID NO: 18492 - RNA, 31 nt, Artificial Sequence
  Synthetic Oligonucleotide; PD-L1 exon 2; Set C
aaaauauagaaccuaauggaaggauuuggug

SEQ ID NO: 18493 - RNA, 29 nt, Artificial Sequence
  Synthetic Oligonucleotide; PD-L1 exon 2; Set C
aaauauagaaccuaauggaaggauuuggu

SEQ ID NO: 18494 - RNA, 18 nt, Artificial Sequence
  Synthetic Oligonucleotide; PD-L1 exon 2; Set C
uagaaccuaauggaagga

SEQ ID NO: 18495 - RNA, 30 nt, Artificial Sequence
  Synthetic Oligonucleotide; PD-L1 exon 2; Set C
aaaauauagaaccuaauggaaggauuuggu

SEQ ID NO: 18496 - RNA, 17 nt, Artificial Sequence
  Synthetic Oligonucleotide; PD-L1 exon 2; Set C
uagaaccuaauggaagg

SEQ ID NO: 18497 - RNA, 19 nt, Artificial Sequence
  Synthetic Oligonucleotide; PD-L1 exon 2; Set C
auagaaccuaauggaagga

SEQ ID NO: 18498 - RNA, 18 nt, Artificial Sequence
  Synthetic Oligonucleotide; PD-L1 exon 2; Set C
auagaaccuaauggaagg

SEQ ID NO: 18499 - RNA, 20 nt, Artificial Sequence
  Synthetic Oligonucleotide; PD-L1 exon 2; Set C
uauagaaccuaauggaagga

SEQ ID NO: 18500 - RNA, 16 nt, Artificial Sequence
  Synthetic Oligonucleotide; PD-L1 exon 2; Set C
uagaaccuaauggaag

SEQ ID NO: 18501 - RNA, 19 nt, Artificial Sequence
  Synthetic Oligonucleotide; PD-L1 exon 2; Set C
uauagaaccuaauggaagg

SEQ ID NO: 18502 - RNA, 17 nt, Artificial Sequence
  Synthetic Oligonucleotide; PD-L1 exon 2; Set C
auagaaccuaauggaag

SEQ ID NO: 18503 - RNA, 22 nt, Artificial Sequence
  Synthetic Oligonucleotide; PD-L1 exon 2; Set C
aauauagaaccuaauggaagga

SEQ ID NO: 18504 - RNA, 18 nt, Artificial Sequence
  Synthetic Oligonucleotide; PD-L1 exon 2; Set C
uauagaaccuaauggaag

SEQ ID NO: 18505 - RNA, 23 nt, Artificial Sequence
  Synthetic Oligonucleotide; PD-L1 exon 2; Set C
aaauauagaaccuaauggaagga

SEQ ID NO: 18506 - RNA, 21 nt, Artificial Sequence
  Synthetic Oligonucleotide; PD-L1 exon 2; Set C
aauauagaaccuaauggaagg

SEQ ID NO: 18507 - RNA, 24 nt, Artificial Sequence
  Synthetic Oligonucleotide; PD-L1 exon 2; Set C
aaaauauagaaccuaauggaagga

SEQ ID NO: 18508 - RNA, 22 nt, Artificial Sequence
  Synthetic Oligonucleotide; PD-L1 exon 2; Set C
aaauauagaaccuaauggaagg

SEQ ID NO: 18509 - RNA, 20 nt, Artificial Sequence
  Synthetic Oligonucleotide; PD-L1 exon 2; Set C
aauauagaaccuaauggaag

SEQ ID NO: 18510 - RNA, 23 nt, Artificial Sequence
  Synthetic Oligonucleotide; PD-L1 exon 2; Set C
aaaauauagaaccuaauggaagg

SEQ ID NO: 18511 - RNA, 21 nt, Artificial Sequence
  Synthetic Oligonucleotide; PD-L1 exon 2; Set C
aaauauagaaccuaauggaag

SEQ ID NO: 18512 - RNA, 22 nt, Artificial Sequence
  Synthetic Oligonucleotide; PD-L1 exon 2; Set C
aaaauauagaaccuaauggaag

SEQ ID NO: 18513 - RNA, 15 nt, Artificial Sequence
  Synthetic Oligonucleotide; PD-L1 exon 2; Set C
uaaaauauagaaccu

SEQ ID NO: 18514 - RNA, 16 nt, Artificial Sequence
  Synthetic Oligonucleotide; PD-L1 exon 2; Set C
uuaaaauauagaaccu

SEQ ID NO: 18515 - RNA, 37 nt, Artificial Sequence
  Synthetic Oligonucleotide; PD-L1 exon 2; Set C
gguuaaaauauuuaaaauauagaaccuaauggaagga

SEQ ID NO: 18516 - RNA, 15 nt, Artificial Sequence
  Synthetic Oligonucleotide; PD-L1 exon 2; Set C
uuaaaauauagaacc

SEQ ID NO: 18517 - RNA, 17 nt, Artificial Sequence
  Synthetic Oligonucleotide; PD-L1 exon 2; Set C
uuuaaaauauagaaccu

SEQ ID NO: 18518 - RNA, 36 nt, Artificial Sequence
  Synthetic Oligonucleotide; PD-L1 exon 2; Set C
gguuaaaauauuuaaaauauagaaccuaauggaagg

SEQ ID NO: 18519 - RNA, 16 nt, Artificial Sequence
  Synthetic Oligonucleotide; PD-L1 exon 2; Set C
uuuaaaauauagaacc

SEQ ID NO: 18520 - RNA, 18 nt, Artificial Sequence
  Synthetic Oligonucleotide; PD-L1 exon 2; Set C
auuuaaaauauagaaccu

SEQ ID NO: 18521 - RNA, 35 nt, Artificial Sequence
  Synthetic Oligonucleotide; PD-L1 exon 2; Set C
gguuaaaauauuuaaaauauagaaccuaauggaag

SEQ ID NO: 18522 - RNA, 17 nt, Artificial Sequence
  Synthetic Oligonucleotide; PD-L1 exon 2; Set C
auuuaaaauauagaacc

SEQ ID NO: 18523 - RNA, 19 nt, Artificial Sequence
  Synthetic Oligonucleotide; PD-L1 exon 2; Set C
uauuuaaaauauagaaccu

SEQ ID NO: 18524 - RNA, 15 nt, Artificial Sequence
  Synthetic Oligonucleotide; PD-L1 exon 2; Set C
uuuaaaauauagaac

SEQ ID NO: 18525 - RNA, 18 nt, Artificial Sequence
  Synthetic Oligonucleotide; PD-L1 exon 2; Set C
uauuuaaaauauagaacc

SEQ ID NO: 18526 - RNA, 20 nt, Artificial Sequence
  Synthetic Oligonucleotide; PD-L1 exon 2; Set C
auauuuaaaauauagaaccu

SEQ ID NO: 18527 - RNA, 16 nt, Artificial Sequence
  Synthetic Oligonucleotide; PD-L1 exon 2; Set C
auuuaaaauauagaac

SEQ ID NO: 18528 - RNA, 19 nt, Artificial Sequence
  Synthetic Oligonucleotide; PD-L1 exon 2; Set C
auauuuaaaauauagaacc

SEQ ID NO: 18529 - RNA, 21 nt, Artificial Sequence
  Synthetic Oligonucleotide; PD-L1 exon 2; Set C
aauauuuaaaauauagaaccu

SEQ ID NO: 18530 - RNA, 17 nt, Artificial Sequence
  Synthetic Oligonucleotide; PD-L1 exon 2; Set C
uauuuaaaauauagaac

SEQ ID NO: 18531 - RNA, 20 nt, Artificial Sequence
  Synthetic Oligonucleotide; PD-L1 exon 2; Set C
aauauuuaaaauauagaacc

SEQ ID NO: 18532 - RNA, 22 nt, Artificial Sequence
  Synthetic Oligonucleotide; PD-L1 exon 2; Set C
aaauauuuaaaauauagaaccu

SEQ ID NO: 18533 - RNA, 18 nt, Artificial Sequence
  Synthetic Oligonucleotide; PD-L1 exon 2; Set C
auauuuaaaauauagaac

SEQ ID NO: 18534 - RNA, 21 nt, Artificial Sequence
  Synthetic Oligonucleotide; PD-L1 exon 2; Set C
aaauauuuaaaauauagaacc

SEQ ID NO: 18535 - RNA, 23 nt, Artificial Sequence
  Synthetic Oligonucleotide; PD-L1 exon 2; Set C
aaaauauuuaaaauauagaaccu

SEQ ID NO: 18536 - RNA, 19 nt, Artificial Sequence
  Synthetic Oligonucleotide; PD-L1 exon 2; Set C
aauauuuaaaauauagaac

SEQ ID NO: 18537 - RNA, 22 nt, Artificial Sequence
  Synthetic Oligonucleotide; PD-L1 exon 2; Set C
aaaauauuuaaaauauagaacc

SEQ ID NO: 18538 - RNA, 24 nt, Artificial Sequence
  Synthetic Oligonucleotide; PD-L1 exon 2; Set C
uaaaauauuuaaaauauagaaccu

SEQ ID NO: 18539 - RNA, 20 nt, Artificial Sequence
  Synthetic Oligonucleotide; PD-L1 exon 2; Set C
aaauauuuaaaauauagaac

SEQ ID NO: 18540 - RNA, 23 nt, Artificial Sequence
  Synthetic Oligonucleotide; PD-L1 exon 2; Set C
uaaaauauuuaaaauauagaacc

SEQ ID NO: 18541 - RNA, 25 nt, Artificial Sequence
  Synthetic Oligonucleotide; PD-L1 exon 2; Set C
uuaaaauauuuaaaauauagaaccu

SEQ ID NO: 18542 - RNA, 21 nt, Artificial Sequence
  Synthetic Oligonucleotide; PD-L1 exon 2; Set C
aaaauauuuaaaauauagaac

SEQ ID NO: 18543 - RNA, 28 nt, Artificial Sequence
  Synthetic Oligonucleotide; PD-L1 exon 2; Set C
gguuaaaauauuuaaaauauagaaccua

SEQ ID NO: 18544 - RNA, 24 nt, Artificial Sequence
  Synthetic Oligonucleotide; PD-L1 exon 2; Set C
uuaaaauauuuaaaauauagaacc

SEQ ID NO: 18545 - RNA, 26 nt, Artificial Sequence
  Synthetic Oligonucleotide; PD-L1 exon 2; Set C
guuaaaauauuuaaaauauagaaccu

SEQ ID NO: 18546 - RNA, 22 nt, Artificial Sequence
  Synthetic Oligonucleotide; PD-L1 exon 2; Set C
uaaaauauuuaaaauauagaac

SEQ ID NO: 18547 - RNA, 23 nt, Artificial Sequence
  Synthetic Oligonucleotide; PD-L1 exon 2; Set C
uuaaaauauuuaaaauauagaac

SEQ ID NO: 18548 - RNA, 24 nt, Artificial Sequence
  Synthetic Oligonucleotide; PD-L1 exon 2; Set C
guuaaaauauuuaaaauauagaac

SEQ ID NO: 18549 - RNA, 23 nt, Artificial Sequence
  Synthetic Oligonucleotide; PD-L1 exon 2; Set C
aaaagaagacugcuucacuuaau

SEQ ID NO: 18550 - RNA, 22 nt, Artificial Sequence
  Synthetic Oligonucleotide; PD-L1 exon 2; Set C
aaaagaagacugcuucacuuaa

SEQ ID NO: 18551 - RNA, 23 nt, Artificial Sequence
  Synthetic Oligonucleotide; PD-L1 exon 2; Set C
gaaaagaagacugcuucacuuaa

SEQ ID NO: 18552 - RNA, 21 nt, Artificial Sequence
  Synthetic Oligonucleotide; PD-L1 exon 2; Set C
aaaagaagacugcuucacuua

SEQ ID NO: 18553 - RNA, 20 nt, Artificial Sequence
  Synthetic Oligonucleotide; PD-L1 exon 2; Set C
aaaagaagacugcuucacuu

SEQ ID NO: 18554 - RNA, 22 nt, Artificial Sequence
  Synthetic Oligonucleotide; PD-L1 exon 2; Set C
gaaaagaagacugcuucacuua

SEQ ID NO: 18555 - RNA, 21 nt, Artificial Sequence
  Synthetic Oligonucleotide; PD-L1 exon 2; Set C
gaaaagaagacugcuucacuu

SEQ ID NO: 18556 - RNA, 32 nt, Artificial Sequence
  Synthetic Oligonucleotide; PD-L1 exon 2; Set C
aaaacacgaaaagaagacugcuucacuuaaua

SEQ ID NO: 18557 - RNA, 31 nt, Artificial Sequence
  Synthetic Oligonucleotide; PD-L1 exon 2; Set C
aaaacacgaaaagaagacugcuucacuuaau

SEQ ID NO: 18558 - RNA, 30 nt, Artificial Sequence
  Synthetic Oligonucleotide; PD-L1 exon 2; Set C
aaaacacgaaaagaagacugcuucacuuaa

SEQ ID NO: 18559 - RNA, 29 nt, Artificial Sequence
  Synthetic Oligonucleotide; PD-L1 exon 2; Set C
aaaacacgaaaagaagacugcuucacuua

SEQ ID NO: 18560 - RNA, 28 nt, Artificial Sequence
  Synthetic Oligonucleotide; PD-L1 exon 2; Set C
aaaacacgaaaagaagacugcuucacuu

SEQ ID NO: 18561 - RNA, 40 nt, Artificial Sequence
  Synthetic Oligonucleotide; PD-L1 exon 2; Set A
aauuauggaaaacacgaaaagaagacugcuucacuuaaua

SEQ ID NO: 18562 - RNA, 39 nt, Artificial Sequence
  Synthetic Oligonucleotide; PD-L1 exon 2; Set A
aauuauggaaaacacgaaaagaagacugcuucacuuaau

SEQ ID NO: 18563 - RNA, 38 nt, Artificial Sequence
  Synthetic Oligonucleotide; PD-L1 exon 2; Set A
aauuauggaaaacacgaaaagaagacugcuucacuuaa

SEQ ID NO: 18564 - RNA, 40 nt, Artificial Sequence
  Synthetic Oligonucleotide; PD-L1 exon 2; Set A
uaauuauggaaaacacgaaaagaagacugcuucacuuaau

SEQ ID NO: 18565 - RNA, 39 nt, Artificial Sequence
  Synthetic Oligonucleotide; PD-L1 exon 2; Set A
uaauuauggaaaacacgaaaagaagacugcuucacuuaa

SEQ ID NO: 18566 - RNA, 37 nt, Artificial Sequence
  Synthetic Oligonucleotide; PD-L1 exon 2; Set A
aauuauggaaaacacgaaaagaagacugcuucacuua

SEQ ID NO: 18567 - RNA, 36 nt, Artificial Sequence
  Synthetic Oligonucleotide; PD-L1 exon 2; Set A
aauuauggaaaacacgaaaagaagacugcuucacuu

SEQ ID NO: 18568 - RNA, 38 nt, Artificial Sequence
  Synthetic Oligonucleotide; PD-L1 exon 2; Set A
uaauuauggaaaacacgaaaagaagacugcuucacuua

SEQ ID NO: 18569 - RNA, 37 nt, Artificial Sequence
  Synthetic Oligonucleotide; PD-L1 exon 2; Set A
uaauuauggaaaacacgaaaagaagacugcuucacuu

SEQ ID NO: 18570 - RNA, 27 nt, Artificial Sequence
  Synthetic Oligonucleotide; PD-L1 exon 2; Set C
uauggaaaacacgaaaagaagacugcu

SEQ ID NO: 18571 - RNA, 29 nt, Artificial Sequence
  Synthetic Oligonucleotide; PD-L1 exon 2; Set C
uuauggaaaacacgaaaagaagacugcuu

SEQ ID NO: 18572 - RNA, 31 nt, Artificial Sequence
  Synthetic Oligonucleotide; PD-L1 exon 2; Set C
auuauggaaaacacgaaaagaagacugcuuc

SEQ ID NO: 18573 - RNA, 28 nt, Artificial Sequence
  Synthetic Oligonucleotide; PD-L1 exon 2; Set C
uuauggaaaacacgaaaagaagacugcu

SEQ ID NO: 18574 - RNA, 30 nt, Artificial Sequence
  Synthetic Oligonucleotide; PD-L1 exon 2; Set C
auuauggaaaacacgaaaagaagacugcuu

SEQ ID NO: 18575 - RNA, 29 nt, Artificial Sequence
  Synthetic Oligonucleotide; PD-L1 exon 2; Set C
auuauggaaaacacgaaaagaagacugcu

SEQ ID NO: 18576 - RNA, 30 nt, Artificial Sequence
  Synthetic Oligonucleotide; PD-L1 exon 2; Set C
aauuauggaaaacacgaaaagaagacugcu

SEQ ID NO: 18577 - RNA, 31 nt, Artificial Sequence
  Synthetic Oligonucleotide; PD-L1 exon 2; Set C
uaauuauggaaaacacgaaaagaagacugcu

SEQ ID NO: 18578 - RNA, 36 nt, Artificial Sequence
  Synthetic Oligonucleotide; PD-L1 exon 2; Set A
ugcccuaauuauggaaaacacgaaaagaagacugcu

SEQ ID NO: 18579 - RNA, 15 nt, Artificial Sequence
  Synthetic Oligonucleotide; PD-L1 exon 2; Set C
auggaaaacacgaaa

SEQ ID NO: 18580 - RNA, 40 nt, Artificial Sequence
  Synthetic Oligonucleotide; PD-L1 exon 2; Set A
ggaaugcccuaauuauggaaaacacgaaaagaagacugcu

SEQ ID NO: 18581 - RNA, 26 nt, Artificial Sequence
  Synthetic Oligonucleotide; PD-L1 exon 2; Set C
augcccuaauuauggaaaacacgaaa

SEQ ID NO: 18582 - RNA, 27 nt, Artificial Sequence
  Synthetic Oligonucleotide; PD-L1 exon 2; Set C
aaugcccuaauuauggaaaacacgaaa

SEQ ID NO: 18583 - RNA, 25 nt, Artificial Sequence
  Synthetic Oligonucleotide; PD-L1 exon 2; Set C
augcccuaauuauggaaaacacgaa

SEQ ID NO: 18584 - RNA, 28 nt, Artificial Sequence
  Synthetic Oligonucleotide; PD-L1 exon 2; Set C
gaaugcccuaauuauggaaaacacgaaa

SEQ ID NO: 18585 - RNA, 26 nt, Artificial Sequence
  Synthetic Oligonucleotide; PD-L1 exon 2; Set C
aaugcccuaauuauggaaaacacgaa

SEQ ID NO: 18586 - RNA, 27 nt, Artificial Sequence
  Synthetic Oligonucleotide; PD-L1 exon 2; Set C
gaaugcccuaauuauggaaaacacgaa

SEQ ID NO: 18587 - RNA, 18 nt, Artificial Sequence
  Synthetic Oligonucleotide; PD-L1 exon 2; Set C
ugcccuaauuauggaaaa

SEQ ID NO: 18588 - RNA, 20 nt, Artificial Sequence
  Synthetic Oligonucleotide; PD-L1 exon 2; Set C
gaaugcccuaauuauggaaa

SEQ ID NO: 18589 - RNA, 20 nt, Artificial Sequence
  Synthetic Oligonucleotide; PD-L1 exon 2; Set C
ggaaugcccuaauuauggaa

SEQ ID NO: 18590 - RNA, 21 nt, Artificial Sequence
  Synthetic Oligonucleotide; PD-L1 exon 2; Set C
uggaaugcccuaauuauggaa

SEQ ID NO: 18591 - RNA, 18 nt, Artificial Sequence
  Synthetic Oligonucleotide; PD-L1 exon 2; Set C
ggaaugcccuaauuaugg

SEQ ID NO: 18592 - RNA, 22 nt, Artificial Sequence
  Synthetic Oligonucleotide; PD-L1 exon 2; Set C
cuggaaugcccuaauuauggaa

SEQ ID NO: 18593 - RNA, 20 nt, Artificial Sequence
  Synthetic Oligonucleotide; PD-L1 exon 2; Set C
uggaaugcccuaauuaugga

SEQ ID NO: 18594 - RNA, 17 nt, Artificial Sequence
  Synthetic Oligonucleotide; PD-L1 exon 2; Set C
ggaaugcccuaauuaug

SEQ ID NO: 18595 - RNA, 19 nt, Artificial Sequence
  Synthetic Oligonucleotide; PD-L1 exon 2; Set C
uggaaugcccuaauuaugg

SEQ ID NO: 18596 - RNA, 23 nt, Artificial Sequence
  Synthetic Oligonucleotide; PD-L1 exon 2; Set C
ucuggaaugcccuaauuauggaa

SEQ ID NO: 18597 - RNA, 21 nt, Artificial Sequence
  Synthetic Oligonucleotide; PD-L1 exon 2; Set C
cuggaaugcccuaauuaugga

SEQ ID NO: 18598 - RNA, 24 nt, Artificial Sequence
  Synthetic Oligonucleotide; PD-L1 exon 2; Set C
uucuggaaugcccuaauuauggaa

SEQ ID NO: 18599 - RNA, 22 nt, Artificial Sequence
  Synthetic Oligonucleotide; PD-L1 exon 2; Set C
ucuggaaugcccuaauuaugga

SEQ ID NO: 18600 - RNA, 25 nt, Artificial Sequence
  Synthetic Oligonucleotide; PD-L1 exon 2; Set C
uuucuggaaugcccuaauuauggaa

SEQ ID NO: 18601 - RNA, 23 nt, Artificial Sequence
  Synthetic Oligonucleotide; PD-L1 exon 2; Set C
uucuggaaugcccuaauuaugga

SEQ ID NO: 18602 - RNA, 26 nt, Artificial Sequence
  Synthetic Oligonucleotide; PD-L1 exon 2; Set C
cuuucuggaaugcccuaauuauggaa

SEQ ID NO: 18603 - RNA, 24 nt, Artificial Sequence
  Synthetic Oligonucleotide; PD-L1 exon 2; Set C
uuucuggaaugcccuaauuaugga

SEQ ID NO: 18604 - RNA, 25 nt, Artificial Sequence
  Synthetic Oligonucleotide; PD-L1 exon 2; Set A
cuuucuggaaugcccuaauuaugga

SEQ ID NO: 18605 - RNA, 25 nt, Artificial Sequence
  Synthetic Oligonucleotide; PD-L1 exon 2; Set C
ucuuucuggaaugcccuaauuaugg

SEQ ID NO: 18606 - RNA, 24 nt, Artificial Sequence
  Synthetic Oligonucleotide; PD-L1 exon 2; Set C
ucuuucuggaaugcccuaauuaug

SEQ ID NO: 18607 - RNA, 26 nt, Artificial Sequence
  Synthetic Oligonucleotide; PD-L1 exon 2; Set C
aucuuucuggaaugcccuaauuaugg

SEQ ID NO: 18608 - RNA, 25 nt, Artificial Sequence
  Synthetic Oligonucleotide; PD-L1 exon 2; Set C
aucuuucuggaaugcccuaauuaug

SEQ ID NO: 18609 - RNA, 25 nt, Artificial Sequence
  Synthetic Oligonucleotide; PD-L1 exon 2; Set C
caucuuucuggaaugcccuaauuau

SEQ ID NO: 18610 - RNA, 15 nt, Artificial Sequence
  Synthetic Oligonucleotide; PD-L1 exon 2; Set C
uucuggaaugcccua

SEQ ID NO: 18611 - RNA, 24 nt, Artificial Sequence
  Synthetic Oligonucleotide; PD-L1 exon 2; Set C
caucuuucuggaaugcccuaauua

SEQ ID NO: 18612 - RNA, 16 nt, Artificial Sequence
  Synthetic Oligonucleotide; PD-L1 exon 2; Set C
uuucuggaaugcccua

SEQ ID NO: 18613 - RNA, 23 nt, Artificial Sequence
  Synthetic Oligonucleotide; PD-L1 exon 2; Set C
caucuuucuggaaugcccuaauu

SEQ ID NO: 18614 - RNA, 37 nt, Artificial Sequence
  Synthetic Oligonucleotide; PD-L1 exon 2; Set A
auauccucaucuuucuggaaugcccuaauuauggaaa

SEQ ID NO: 18615 - RNA, 39 nt, Artificial Sequence
  Synthetic Oligonucleotide; PD-L1 exon 2; Set A
aauauccucaucuuucuggaaugcccuaauuauggaaaa

SEQ ID NO: 18616 - RNA, 17 nt, Artificial Sequence
  Synthetic Oligonucleotide; PD-L1 exon 2; Set C
cuuucuggaaugcccua

SEQ ID NO: 18617 - RNA, 15 nt, Artificial Sequence
  Synthetic Oligonucleotide; PD-L1 exon 2; Set C
uuucuggaaugcccu

SEQ ID NO: 18618 - RNA, 16 nt, Artificial Sequence
  Synthetic Oligonucleotide; PD-L1 exon 2; Set C
cuuucuggaaugcccu

SEQ ID NO: 18619 - RNA, 15 nt, Artificial Sequence
  Synthetic Oligonucleotide; PD-L1 exon 2; Set C
cuuucuggaaugccc

SEQ ID NO: 18620 - RNA, 35 nt, Artificial Sequence
  Synthetic Oligonucleotide; PD-L1 exon 2; Set A
aauauccucaucuuucuggaaugcccuaauuaugg

SEQ ID NO: 18621 - RNA, 34 nt, Artificial Sequence
  Synthetic Oligonucleotide; PD-L1 exon 2; Set A
aauauccucaucuuucuggaaugcccuaauuaug

SEQ ID NO: 18622 - RNA, 36 nt, Artificial Sequence
  Synthetic Oligonucleotide; PD-L1 exon 2; Set A
aaauauccucaucuuucuggaaugcccuaauuaugg

SEQ ID NO: 18623 - RNA, 35 nt, Artificial Sequence
  Synthetic Oligonucleotide; PD-L1 exon 2; Set A
aaauauccucaucuuucuggaaugcccuaauuaug

SEQ ID NO: 18624 - RNA, 37 nt, Artificial Sequence
  Synthetic Oligonucleotide; PD-L1 exon 2; Set A
caaauauccucaucuuucuggaaugcccuaauuaugg

SEQ ID NO: 18625 - RNA, 36 nt, Artificial Sequence
  Synthetic Oligonucleotide; PD-L1 exon 2; Set A
caaauauccucaucuuucuggaaugcccuaauuaug

SEQ ID NO: 18626 - RNA, 38 nt, Artificial Sequence
  Synthetic Oligonucleotide; PD-L1 exon 2; Set A
gcaaauauccucaucuuucuggaaugcccuaauuaugg

SEQ ID NO: 18627 - RNA, 29 nt, Artificial Sequence
  Synthetic Oligonucleotide; PD-L1 exon 2; Set A
auauccucaucuuucuggaaugcccuaau

SEQ ID NO: 18628 - RNA, 37 nt, Artificial Sequence
  Synthetic Oligonucleotide; PD-L1 exon 2; Set A
gcaaauauccucaucuuucuggaaugcccuaauuaug

SEQ ID NO: 18629 - RNA, 28 nt, Artificial Sequence
  Synthetic Oligonucleotide; PD-L1 exon 2; Set A
auauccucaucuuucuggaaugcccuaa

SEQ ID NO: 18630 - RNA, 23 nt, Artificial Sequence
  Synthetic Oligonucleotide; PD-L1 exon 2; Set C
auauccucaucuuucuggaaugc

SEQ ID NO: 18631 - RNA, 19 nt, Artificial Sequence
  Synthetic Oligonucleotide; PD-L1 exon 2; Set C
auauccucaucuuucugga

SEQ ID NO: 18632 - RNA, 17 nt, Artificial Sequence
  Synthetic Oligonucleotide; PD-L1 exon 2; Set C
auauccucaucuuucug

SEQ ID NO: 18633 - RNA, 16 nt, Artificial Sequence
  Synthetic Oligonucleotide; PD-L1 exon 2; Set C
auauccucaucuuucu

SEQ ID NO: 18634 - RNA, 15 nt, Artificial Sequence
  Synthetic Oligonucleotide; PD-L1 exon 2; Set C
auauccucaucuuuc

SEQ ID NO: 18635 - RNA, 34 nt, Artificial Sequence
  Synthetic Oligonucleotide; PD-L1 exon 2; Set A
auauaaagacagcaaauauccucaucuuucugga

SEQ ID NO: 18636 - RNA, 33 nt, Artificial Sequence
  Synthetic Oligonucleotide; PD-L1 exon 2; Set A
auauaaagacagcaaauauccucaucuuucugg

SEQ ID NO: 18637 - RNA, 32 nt, Artificial Sequence
  Synthetic Oligonucleotide; PD-L1 exon 2; Set C
auauaaagacagcaaauauccucaucuuucug

SEQ ID NO: 18638 - RNA, 31 nt, Artificial Sequence
  Synthetic Oligonucleotide; PD-L1 exon 2; Set C
auauaaagacagcaaauauccucaucuuucu

SEQ ID NO: 18639 - RNA, 30 nt, Artificial Sequence
  Synthetic Oligonucleotide; PD-L1 exon 2; Set C
auauaaagacagcaaauauccucaucuuuc

SEQ ID NO: 18640 - RNA, 29 nt, Artificial Sequence
  Synthetic Oligonucleotide; PD-L1 exon 2; Set C
auauaaagacagcaaauauccucaucuuu

SEQ ID NO: 18641 - RNA, 25 nt, Artificial Sequence
  Synthetic Oligonucleotide; PD-L1 exon 2; Set C
auaaagacagcaaauauccucaucu

SEQ ID NO: 18642 - RNA, 28 nt, Artificial Sequence
  Synthetic Oligonucleotide; PD-L1 exon 2; Set C
auauaaagacagcaaauauccucaucuu

SEQ ID NO: 18643 - RNA, 24 nt, Artificial Sequence
  Synthetic Oligonucleotide; PD-L1 exon 2; Set C
auaaagacagcaaauauccucauc

SEQ ID NO: 18644 - RNA, 40 nt, Artificial Sequence
  Synthetic Oligonucleotide; PD-L1 exon 2; Set A
ggucaugaauauaaagacagcaaauauccucaucuuucug

SEQ ID NO: 18645 - RNA, 39 nt, Artificial Sequence
  Synthetic Oligonucleotide; PD-L1 exon 2; Set A
ggucaugaauauaaagacagcaaauauccucaucuuucu

SEQ ID NO: 18646 - RNA, 40 nt, Artificial Sequence
  Synthetic Oligonucleotide; PD-L1 exon 2; Set A
aggucaugaauauaaagacagcaaauauccucaucuuucu

SEQ ID NO: 18647 - RNA, 38 nt, Artificial Sequence
  Synthetic Oligonucleotide; PD-L1 exon 2; Set A
ggucaugaauauaaagacagcaaauauccucaucuuuc

SEQ ID NO: 18648 - RNA, 32 nt, Artificial Sequence
  Synthetic Oligonucleotide; PD-L1 exon 2; Set C
caugaauauaaagacagcaaauauccucaucu

SEQ ID NO: 18649 - RNA, 39 nt, Artificial Sequence
  Synthetic Oligonucleotide; PD-L1 exon 2; Set A
aggucaugaauauaaagacagcaaauauccucaucuuuc

SEQ ID NO: 18650 - RNA, 37 nt, Artificial Sequence
  Synthetic Oligonucleotide; PD-L1 exon 2; Set A
ggucaugaauauaaagacagcaaauauccucaucuuu

SEQ ID NO: 18651 - RNA, 31 nt, Artificial Sequence
  Synthetic Oligonucleotide; PD-L1 exon 2; Set C
caugaauauaaagacagcaaauauccucauc

SEQ ID NO: 18652 - RNA, 33 nt, Artificial Sequence
  Synthetic Oligonucleotide; PD-L1 exon 2; Set C
ucaugaauauaaagacagcaaauauccucaucu

SEQ ID NO: 18653 - RNA, 36 nt, Artificial Sequence
  Synthetic Oligonucleotide; PD-L1 exon 2; Set A
ggucaugaauauaaagacagcaaauauccucaucuu

SEQ ID NO: 18654 - RNA, 38 nt, Artificial Sequence
  Synthetic Oligonucleotide; PD-L1 exon 2; Set A
aggucaugaauauaaagacagcaaauauccucaucuuu

SEQ ID NO: 18655 - RNA, 40 nt, Artificial Sequence
  Synthetic Oligonucleotide; PD-L1 exon 2; Set A
uaggucaugaauauaaagacagcaaauauccucaucuuuc

SEQ ID NO: 18656 - RNA, 32 nt, Artificial Sequence
  Synthetic Oligonucleotide; PD-L1 exon 2; Set C
ucaugaauauaaagacagcaaauauccucauc

SEQ ID NO: 18657 - RNA, 34 nt, Artificial Sequence
  Synthetic Oligonucleotide; PD-L1 exon 2; Set A
gucaugaauauaaagacagcaaauauccucaucu

SEQ ID NO: 18658 - RNA, 16 nt, Artificial Sequence
  Synthetic Oligonucleotide; PD-L1 exon 2; Set C
auaaagacagcaaaua

SEQ ID NO: 18659 - RNA, 37 nt, Artificial Sequence
  Synthetic Oligonucleotide; PD-L1 exon 2; Set A
aggucaugaauauaaagacagcaaauauccucaucuu

SEQ ID NO: 18660 - RNA, 39 nt, Artificial Sequence
  Synthetic Oligonucleotide; PD-L1 exon 2; Set A
uaggucaugaauauaaagacagcaaauauccucaucuuu

SEQ ID NO: 18661 - RNA, 33 nt, Artificial Sequence
  Synthetic Oligonucleotide; PD-L1 exon 2; Set C
gucaugaauauaaagacagcaaauauccucauc

SEQ ID NO: 18662 - RNA, 17 nt, Artificial Sequence
  Synthetic Oligonucleotide; PD-L1 exon 2; Set C
uauaaagacagcaaaua

SEQ ID NO: 18663 - RNA, 38 nt, Artificial Sequence
  Synthetic Oligonucleotide; PD-L1 exon 2; Set A
uaggucaugaauauaaagacagcaaauauccucaucuu

SEQ ID NO: 18664 - RNA, 17 nt, Artificial Sequence
  Synthetic Oligonucleotide; PD-L1 exon 2; Set C
auauaaagacagcaaau

SEQ ID NO: 18665 - RNA, 16 nt, Artificial Sequence
  Synthetic Oligonucleotide; PD-L1 exon 2; Set C
auauaaagacagcaaa

SEQ ID NO: 18666 - RNA, 15 nt, Artificial Sequence
  Synthetic Oligonucleotide; PD-L1 exon 2; Set C
auauaaagacagcaa

SEQ ID NO: 18667 - RNA, 25 nt, Artificial Sequence
  Synthetic Oligonucleotide; PD-L1 exon 2; Set C
gucaugaauauaaagacagcaaaua

SEQ ID NO: 18668 - RNA, 25 nt, Artificial Sequence
  Synthetic Oligonucleotide; PD-L1 exon 2; Set C
ggucaugaauauaaagacagcaaau

SEQ ID NO: 18669 - RNA, 24 nt, Artificial Sequence
  Synthetic Oligonucleotide; PD-L1 exon 2; Set C
ggucaugaauauaaagacagcaaa

SEQ ID NO: 18670 - RNA, 26 nt, Artificial Sequence
  Synthetic Oligonucleotide; PD-L1 exon 2; Set C
aggucaugaauauaaagacagcaaau

SEQ ID NO: 18671 - RNA, 25 nt, Artificial Sequence
  Synthetic Oligonucleotide; PD-L1 exon 2; Set C
aggucaugaauauaaagacagcaaa

SEQ ID NO: 18672 - RNA, 23 nt, Artificial Sequence
  Synthetic Oligonucleotide; PD-L1 exon 2; Set C
ggucaugaauauaaagacagcaa

SEQ ID NO: 18673 - RNA, 27 nt, Artificial Sequence
  Synthetic Oligonucleotide; PD-L1 exon 2; Set C
uaggucaugaauauaaagacagcaaau

SEQ ID NO: 18674 - RNA, 26 nt, Artificial Sequence
  Synthetic Oligonucleotide; PD-L1 exon 2; Set C
uaggucaugaauauaaagacagcaaa

SEQ ID NO: 18675 - RNA, 24 nt, Artificial Sequence
  Synthetic Oligonucleotide; PD-L1 exon 2; Set C
aggucaugaauauaaagacagcaa

SEQ ID NO: 18676 - RNA, 22 nt, Artificial Sequence
  Synthetic Oligonucleotide; PD-L1 exon 2; Set C
ggucaugaauauaaagacagca

SEQ ID NO: 18677 - RNA, 25 nt, Artificial Sequence
  Synthetic Oligonucleotide; PD-L1 exon 2; Set C
uaggucaugaauauaaagacagcaa

SEQ ID NO: 18678 - RNA, 23 nt, Artificial Sequence
  Synthetic Oligonucleotide; PD-L1 exon 2; Set C
aggucaugaauauaaagacagca

SEQ ID NO: 18679 - RNA, 24 nt, Artificial Sequence
  Synthetic Oligonucleotide; PD-L1 exon 2; Set C
uaggucaugaauauaaagacagca

SEQ ID NO: 18680 - RNA, 38 nt, Artificial Sequence
  Synthetic Oligonucleotide; PD-L1 exon 2; Set A
caaaugccaguaggucaugaauauaaagacagcaaaua

SEQ ID NO: 18681 - RNA, 31 nt, Artificial Sequence
  Synthetic Oligonucleotide; PD-L1 exon 2; Set A
augccaguaggucaugaauauaaagacagca

SEQ ID NO: 18682 - RNA, 39 nt, Artificial Sequence
  Synthetic Oligonucleotide; PD-L1 exon 2; Set A
gcaaaugccaguaggucaugaauauaaagacagcaaaua

SEQ ID NO: 18683 - RNA, 20 nt, Artificial Sequence
  Synthetic Oligonucleotide; PD-L1 exon 2; Set C
aaugccaguaggucaugaau

SEQ ID NO: 18684 - RNA, 21 nt, Artificial Sequence
  Synthetic Oligonucleotide; PD-L1 exon 2; Set C
aaaugccaguaggucaugaau

SEQ ID NO: 18685 - RNA, 15 nt, Artificial Sequence
  Synthetic Oligonucleotide; PD-L1 exon 2; Set C
augccaguaggucau

SEQ ID NO: 18686 - RNA, 17 nt, Artificial Sequence
  Synthetic Oligonucleotide; PD-L1 exon 2; Set C
aaugccaguaggucaug

SEQ ID NO: 18687 - RNA, 28 nt, Artificial Sequence
  Synthetic Oligonucleotide; PD-L1 exon 2; Set A
ucagcaaaugccaguaggucaugaauau

SEQ ID NO: 18688 - RNA, 18 nt, Artificial Sequence
  Synthetic Oligonucleotide; PD-L1 exon 2; Set C
aaaugccaguaggucaug

SEQ ID NO: 18689 - RNA, 27 nt, Artificial Sequence
  Synthetic Oligonucleotide; PD-L1 exon 2; Set A
uucagcaaaugccaguaggucaugaau

SEQ ID NO: 18690 - RNA, 28 nt, Artificial Sequence
  Synthetic Oligonucleotide; PD-L1 exon 2; Set A
guucagcaaaugccaguaggucaugaau

SEQ ID NO: 18691 - RNA, 26 nt, Artificial Sequence
  Synthetic Oligonucleotide; PD-L1 exon 2; Set A
uucagcaaaugccaguaggucaugaa

SEQ ID NO: 18692 - RNA, 29 nt, Artificial Sequence
  Synthetic Oligonucleotide; PD-L1 exon 2; Set A
cguucagcaaaugccaguaggucaugaau

SEQ ID NO: 18693 - RNA, 25 nt, Artificial Sequence
  Synthetic Oligonucleotide; PD-L1 exon 2; Set A
uucagcaaaugccaguaggucauga

SEQ ID NO: 18694 - RNA, 27 nt, Artificial Sequence
  Synthetic Oligonucleotide; PD-L1 exon 2; Set A
guucagcaaaugccaguaggucaugaa

SEQ ID NO: 18695 - RNA, 30 nt, Artificial Sequence
  Synthetic Oligonucleotide; PD-L1 exon 2; Set A
ccguucagcaaaugccaguaggucaugaau

SEQ ID NO: 18696 - RNA, 24 nt, Artificial Sequence
  Synthetic Oligonucleotide; PD-L1 exon 2; Set A
uucagcaaaugccaguaggucaug

SEQ ID NO: 18697 - RNA, 26 nt, Artificial Sequence
  Synthetic Oligonucleotide; PD-L1 exon 2; Set A
guucagcaaaugccaguaggucauga

SEQ ID NO: 18698 - RNA, 33 nt, Artificial Sequence
  Synthetic Oligonucleotide; PD-L1 exon 2; Set C
uaccguucagcaaaugccaguaggucaugaaua

SEQ ID NO: 18699 - RNA, 31 nt, Artificial Sequence
  Synthetic Oligonucleotide; PD-L1 exon 2; Set C
accguucagcaaaugccaguaggucaugaau

SEQ ID NO: 18700 - RNA, 25 nt, Artificial Sequence
  Synthetic Oligonucleotide; PD-L1 exon 2; Set A
guucagcaaaugccaguaggucaug

SEQ ID NO: 18701 - RNA, 27 nt, Artificial Sequence
  Synthetic Oligonucleotide; PD-L1 exon 2; Set A
cguucagcaaaugccaguaggucauga

SEQ ID NO: 18702 - RNA, 26 nt, Artificial Sequence
  Synthetic Oligonucleotide; PD-L1 exon 2; Set A
cguucagcaaaugccaguaggucaug

SEQ ID NO: 18703 - RNA, 33 nt, Artificial Sequence
  Synthetic Oligonucleotide; PD-L1 exon 2; Set C
uuaccguucagcaaaugccaguaggucaugaau

SEQ ID NO: 18704 - RNA, 27 nt, Artificial Sequence
  Synthetic Oligonucleotide; PD-L1 exon 2; Set A
ccguucagcaaaugccaguaggucaug

SEQ ID NO: 18705 - RNA, 34 nt, Artificial Sequence
  Synthetic Oligonucleotide; PD-L1 exon 2; Set C
cuuaccguucagcaaaugccaguaggucaugaau

SEQ ID NO: 18706 - RNA, 28 nt, Artificial Sequence
  Synthetic Oligonucleotide; PD-L1 exon 2; Set A
accguucagcaaaugccaguaggucaug

SEQ ID NO: 18707 - RNA, 32 nt, Artificial Sequence
  Synthetic Oligonucleotide; PD-L1 exon 2; Set C
uuaccguucagcaaaugccaguaggucaugaa

SEQ ID NO: 18708 - RNA, 15 nt, Artificial Sequence
  Synthetic Oligonucleotide; PD-L1 exon 2; Set C
cagcaaaugccagua

SEQ ID NO: 18709 - RNA, 35 nt, Artificial Sequence
  Synthetic Oligonucleotide; PD-L1 exon 2; Set C
ucuuaccguucagcaaaugccaguaggucaugaau

SEQ ID NO: 18710 - RNA, 31 nt, Artificial Sequence
  Synthetic Oligonucleotide; PD-L1 exon 2; Set C
uuaccguucagcaaaugccaguaggucauga

SEQ ID NO: 18711 - RNA, 33 nt, Artificial Sequence
  Synthetic Oligonucleotide; PD-L1 exon 2; Set C
cuuaccguucagcaaaugccaguaggucaugaa

SEQ ID NO: 18712 - RNA, 16 nt, Artificial Sequence
  Synthetic Oligonucleotide; PD-L1 exon 2; Set C
ucagcaaaugccagua

SEQ ID NO: 18713 - RNA, 38 nt, Artificial Sequence
  Synthetic Oligonucleotide; PD-L1 exon 2; Set C
ugucuuaccguucagcaaaugccaguaggucaugaaua

SEQ ID NO: 18714 - RNA, 36 nt, Artificial Sequence
  Synthetic Oligonucleotide; PD-L1 exon 2; Set C
gucuuaccguucagcaaaugccaguaggucaugaau

SEQ ID NO: 18715 - RNA, 30 nt, Artificial Sequence
  Synthetic Oligonucleotide; PD-L1 exon 2; Set A
uuaccguucagcaaaugccaguaggucaug

SEQ ID NO: 18716 - RNA, 32 nt, Artificial Sequence
  Synthetic Oligonucleotide; PD-L1 exon 2; Set C
cuuaccguucagcaaaugccaguaggucauga

SEQ ID NO: 18717 - RNA, 34 nt, Artificial Sequence
  Synthetic Oligonucleotide; PD-L1 exon 2; Set C
ucuuaccguucagcaaaugccaguaggucaugaa

SEQ ID NO: 18718 - RNA, 15 nt, Artificial Sequence
  Synthetic Oligonucleotide; PD-L1 exon 2; Set C
ucagcaaaugccagu

SEQ ID NO: 18719 - RNA, 31 nt, Artificial Sequence
  Synthetic Oligonucleotide; PD-L1 exon 2; Set C
cuuaccguucagcaaaugccaguaggucaug

SEQ ID NO: 18720 - RNA, 33 nt, Artificial Sequence
  Synthetic Oligonucleotide; PD-L1 exon 2; Set C
ucuuaccguucagcaaaugccaguaggucauga

SEQ ID NO: 18721 - RNA, 35 nt, Artificial Sequence
  Synthetic Oligonucleotide; PD-L1 exon 2; Set C
gucuuaccguucagcaaaugccaguaggucaugaa

SEQ ID NO: 18722 - RNA, 32 nt, Artificial Sequence
  Synthetic Oligonucleotide; PD-L1 exon 2; Set C
ucuuaccguucagcaaaugccaguaggucaug

SEQ ID NO: 18723 - RNA, 34 nt, Artificial Sequence
  Synthetic Oligonucleotide; PD-L1 exon 2; Set C
gucuuaccguucagcaaaugccaguaggucauga

SEQ ID NO: 18724 - RNA, 33 nt, Artificial Sequence
  Synthetic Oligonucleotide; PD-L1 exon 2; Set C
gucuuaccguucagcaaaugccaguaggucaug

SEQ ID NO: 18725 - RNA, 40 nt, Artificial Sequence
  Synthetic Oligonucleotide; PD-L1 exon 2; Set C
uggugucuuaccguucagcaaaugccaguaggucaugaau

SEQ ID NO: 18726 - RNA, 34 nt, Artificial Sequence
  Synthetic Oligonucleotide; PD-L1 exon 2; Set C
gugucuuaccguucagcaaaugccaguaggucau

SEQ ID NO: 18727 - RNA, 40 nt, Artificial Sequence
  Synthetic Oligonucleotide; PD-L1 exon 2; Set C
uuggugucuuaccguucagcaaaugccaguaggucaugaa

SEQ ID NO: 18728 - RNA, 33 nt, Artificial Sequence
  Synthetic Oligonucleotide; PD-L1 exon 2; Set C
gugucuuaccguucagcaaaugccaguagguca

SEQ ID NO: 18729 - RNA, 35 nt, Artificial Sequence
  Synthetic Oligonucleotide; PD-L1 exon 2; Set C
ggugucuuaccguucagcaaaugccaguaggucau

SEQ ID NO: 18730 - RNA, 37 nt, Artificial Sequence
  Synthetic Oligonucleotide; PD-L1 exon 2; Set C
uggugucuuaccguucagcaaaugccaguaggucaug

SEQ ID NO: 18731 - RNA, 39 nt, Artificial Sequence
  Synthetic Oligonucleotide; PD-L1 exon 2; Set C
uuggugucuuaccguucagcaaaugccaguaggucauga

SEQ ID NO: 18732 - RNA, 34 nt, Artificial Sequence
  Synthetic Oligonucleotide; PD-L1 exon 2; Set C
ggugucuuaccguucagcaaaugccaguagguca

SEQ ID NO: 18733 - RNA, 30 nt, Artificial Sequence
  Synthetic Oligonucleotide; PD-L1 exon 2; Set C
ugucuuaccguucagcaaaugccaguaggu

SEQ ID NO: 18734 - RNA, 38 nt, Artificial Sequence
  Synthetic Oligonucleotide; PD-L1 exon 2; Set C
uuggugucuuaccguucagcaaaugccaguaggucaug

SEQ ID NO: 18735 - RNA, 40 nt, Artificial Sequence
  Synthetic Oligonucleotide; PD-L1 exon 2; Set C
uuuggugucuuaccguucagcaaaugccaguaggucauga

SEQ ID NO: 18736 - RNA, 29 nt, Artificial Sequence
  Synthetic Oligonucleotide; PD-L1 exon 2; Set A
ugucuuaccguucagcaaaugccaguagg

SEQ ID NO: 18737 - RNA, 31 nt, Artificial Sequence
  Synthetic Oligonucleotide; PD-L1 exon 2; Set C
gugucuuaccguucagcaaaugccaguaggu

SEQ ID NO: 18738 - RNA, 39 nt, Artificial Sequence
  Synthetic Oligonucleotide; PD-L1 exon 2; Set C
uuuggugucuuaccguucagcaaaugccaguaggucaug

SEQ ID NO: 18739 - RNA, 30 nt, Artificial Sequence
  Synthetic Oligonucleotide; PD-L1 exon 2; Set C
gugucuuaccguucagcaaaugccaguagg

SEQ ID NO: 18740 - RNA, 28 nt, Artificial Sequence
  Synthetic Oligonucleotide; PD-L1 exon 2; Set A
ugucuuaccguucagcaaaugccaguag

SEQ ID NO: 18741 - RNA, 40 nt, Artificial Sequence
  Synthetic Oligonucleotide; PD-L1 exon 2; Set C
auuuggugucuuaccguucagcaaaugccaguaggucaug

SEQ ID NO: 18742 - RNA, 29 nt, Artificial Sequence
  Synthetic Oligonucleotide; PD-L1 exon 2; Set A
gugucuuaccguucagcaaaugccaguag

SEQ ID NO: 18743 - RNA, 40 nt, Artificial Sequence
  Synthetic Oligonucleotide; PD-L1 exon 2; Set C
ggauuuggugucuuaccguucagcaaaugccaguagguca

SEQ ID NO: 18744 - RNA, 38 nt, Artificial Sequence
  Synthetic Oligonucleotide; PD-L1 exon 2; Set C
ggauuuggugucuuaccguucagcaaaugccaguaggu

SEQ ID NO: 18745 - RNA, 37 nt, Artificial Sequence
  Synthetic Oligonucleotide; PD-L1 exon 2; Set C
ggauuuggugucuuaccguucagcaaaugccaguagg

SEQ ID NO: 18746 - RNA, 39 nt, Artificial Sequence
  Synthetic Oligonucleotide; PD-L1 exon 2; Set C
aggauuuggugucuuaccguucagcaaaugccaguaggu

SEQ ID NO: 18747 - RNA, 22 nt, Artificial Sequence
  Synthetic Oligonucleotide; PD-L1 exon 2; Set C
gugucuuaccguucagcaaaug

SEQ ID NO: 18748 - RNA, 38 nt, Artificial Sequence
  Synthetic Oligonucleotide; PD-L1 exon 2; Set C
aggauuuggugucuuaccguucagcaaaugccaguagg

SEQ ID NO: 18749 - RNA, 36 nt, Artificial Sequence
  Synthetic Oligonucleotide; PD-L1 exon 2; Set C
ggauuuggugucuuaccguucagcaaaugccaguag

SEQ ID NO: 18750 - RNA, 40 nt, Artificial Sequence
  Synthetic Oligonucleotide; PD-L1 exon 2; Set C
aaggauuuggugucuuaccguucagcaaaugccaguaggu

SEQ ID NO: 18751 - RNA, 23 nt, Artificial Sequence
  Synthetic Oligonucleotide; PD-L1 exon 2; Set A
ggugucuuaccguucagcaaaug

SEQ ID NO: 18752 - RNA, 39 nt, Artificial Sequence
  Synthetic Oligonucleotide; PD-L1 exon 2; Set C
aaggauuuggugucuuaccguucagcaaaugccaguagg

SEQ ID NO: 18753 - RNA, 37 nt, Artificial Sequence
  Synthetic Oligonucleotide; PD-L1 exon 2; Set C
aggauuuggugucuuaccguucagcaaaugccaguag

SEQ ID NO: 18754 - RNA, 38 nt, Artificial Sequence
  Synthetic Oligonucleotide; PD-L1 exon 2; Set C
aaggauuuggugucuuaccguucagcaaaugccaguag

SEQ ID NO: 18755 - RNA, 15 nt, Artificial Sequence
  Synthetic Oligonucleotide; PD-L1 exon 2; Set C
gucuuaccguucagc

SEQ ID NO: 18756 - RNA, 29 nt, Artificial Sequence
  Synthetic Oligonucleotide; PD-L1 exon 2; Set A
ggauuuggugucuuaccguucagcaaaug

SEQ ID NO: 18757 - RNA, 19 nt, Artificial Sequence
  Synthetic Oligonucleotide; PD-L1 exon 2; Set A
uggugucuuaccguucagc

SEQ ID NO: 18758 - RNA, 30 nt, Artificial Sequence
  Synthetic Oligonucleotide; PD-L1 exon 2; Set A
aggauuuggugucuuaccguucagcaaaug

SEQ ID NO: 18759 - RNA, 18 nt, Artificial Sequence
  Synthetic Oligonucleotide; PD-L1 exon 2; Set C
uggugucuuaccguucag

SEQ ID NO: 18760 - RNA, 20 nt, Artificial Sequence
  Synthetic Oligonucleotide; PD-L1 exon 2; Set A
uuggugucuuaccguucagc

SEQ ID NO: 18761 - RNA, 31 nt, Artificial Sequence
  Synthetic Oligonucleotide; PD-L1 exon 2; Set A
aaggauuuggugucuuaccguucagcaaaug

SEQ ID NO: 18762 - RNA, 17 nt, Artificial Sequence
  Synthetic Oligonucleotide; PD-L1 exon 2; Set C
uggugucuuaccguuca

SEQ ID NO: 18763 - RNA, 19 nt, Artificial Sequence
  Synthetic Oligonucleotide; PD-L1 exon 2; Set C
uuggugucuuaccguucag

SEQ ID NO: 18764 - RNA, 21 nt, Artificial Sequence
  Synthetic Oligonucleotide; PD-L1 exon 2; Set A
uuuggugucuuaccguucagc

SEQ ID NO: 18765 - RNA, 18 nt, Artificial Sequence
  Synthetic Oligonucleotide; PD-L1 exon 2; Set C
uuggugucuuaccguuca

SEQ ID NO: 18766 - RNA, 22 nt, Artificial Sequence
  Synthetic Oligonucleotide; PD-L1 exon 2; Set A
auuuggugucuuaccguucagc

SEQ ID NO: 18767 - RNA, 23 nt, Artificial Sequence
  Synthetic Oligonucleotide; PD-L1 exon 2; Set A
gauuuggugucuuaccguucagc

SEQ ID NO: 18768 - RNA, 27 nt, Artificial Sequence
  Synthetic Oligonucleotide; PD-L1 exon 2; Set A
gaaggauuuggugucuuaccguucagc

SEQ ID NO: 18769 - RNA, 26 nt, Artificial Sequence
  Synthetic Oligonucleotide; PD-L1 exon 2; Set A
gaaggauuuggugucuuaccguucag

SEQ ID NO: 18770 - RNA, 28 nt, Artificial Sequence
  Synthetic Oligonucleotide; PD-L1 exon 2; Set A
ggaaggauuuggugucuuaccguucagc

SEQ ID NO: 18771 - RNA, 25 nt, Artificial Sequence
  Synthetic Oligonucleotide; PD-L1 exon 2; Set B
gaaggauuuggugucuuaccguuca

SEQ ID NO: 18772 - RNA, 27 nt, Artificial Sequence
  Synthetic Oligonucleotide; PD-L1 exon 2; Set A
ggaaggauuuggugucuuaccguucag

SEQ ID NO: 18773 - RNA, 29 nt, Artificial Sequence
  Synthetic Oligonucleotide; PD-L1 exon 2; Set C
uggaaggauuuggugucuuaccguucagc

SEQ ID NO: 18774 - RNA, 26 nt, Artificial Sequence
  Synthetic Oligonucleotide; PD-L1 exon 2; Set B
ggaaggauuuggugucuuaccguuca

SEQ ID NO: 18775 - RNA, 30 nt, Artificial Sequence
  Synthetic Oligonucleotide; PD-L1 exon 2; Set C
auggaaggauuuggugucuuaccguucagc

SEQ ID NO: 18776 - RNA, 29 nt, Artificial Sequence
  Synthetic Oligonucleotide; PD-L1 exon 2; Set A
auggaaggauuuggugucuuaccguucag

SEQ ID NO: 18777 - RNA, 31 nt, Artificial Sequence
  Synthetic Oligonucleotide; PD-L1 exon 2; Set A
aauggaaggauuuggugucuuaccguucagc

SEQ ID NO: 18778 - RNA, 28 nt, Artificial Sequence
  Synthetic Oligonucleotide; PD-L1 exon 2; Set B
auggaaggauuuggugucuuaccguuca

SEQ ID NO: 18779 - RNA, 30 nt, Artificial Sequence
  Synthetic Oligonucleotide; PD-L1 exon 2; Set A
aauggaaggauuuggugucuuaccguucag

SEQ ID NO: 18780 - RNA, 32 nt, Artificial Sequence
  Synthetic Oligonucleotide; PD-L1 exon 2; Set A
uaauggaaggauuuggugucuuaccguucagc

SEQ ID NO: 18781 - RNA, 29 nt, Artificial Sequence
  Synthetic Oligonucleotide; PD-L1 exon 2; Set B
aauggaaggauuuggugucuuaccguuca

SEQ ID NO: 18782 - RNA, 31 nt, Artificial Sequence
  Synthetic Oligonucleotide; PD-L1 exon 2; Set A
uaauggaaggauuuggugucuuaccguucag

SEQ ID NO: 18783 - RNA, 30 nt, Artificial Sequence
  Synthetic Oligonucleotide; PD-L1 exon 2; Set B
uaauggaaggauuuggugucuuaccguuca

SEQ ID NO: 18784 - RNA, 38 nt, Artificial Sequence
  Synthetic Oligonucleotide; PD-L1 exon 2; Set C
agaaccuaauggaaggauuuggugucuuaccguucagc

SEQ ID NO: 18785 - RNA, 37 nt, Artificial Sequence
  Synthetic Oligonucleotide; PD-L1 exon 2; Set C
agaaccuaauggaaggauuuggugucuuaccguucag

SEQ ID NO: 18786 - RNA, 36 nt, Artificial Sequence
  Synthetic Oligonucleotide; PD-L1 exon 2; Set C
agaaccuaauggaaggauuuggugucuuaccguuca

SEQ ID NO: 18787 - RNA, 37 nt, Artificial Sequence
  Synthetic Oligonucleotide; PD-L1 exon 2; Set C
uagaaccuaauggaaggauuuggugucuuaccguuca

SEQ ID NO: 18788 - RNA, 39 nt, Artificial Sequence
  Synthetic Oligonucleotide; PD-L1 exon 2; Set C
auagaaccuaauggaaggauuuggugucuuaccguucag

SEQ ID NO: 18789 - RNA, 26 nt, Artificial Sequence
  Synthetic Oligonucleotide; PD-L1 exon 2; Set B
ccuaauggaaggauuuggugucuuac

SEQ ID NO: 18790 - RNA, 38 nt, Artificial Sequence
  Synthetic Oligonucleotide; PD-L1 exon 2; Set C
auagaaccuaauggaaggauuuggugucuuaccguuca

SEQ ID NO: 18791 - RNA, 27 nt, Artificial Sequence
  Synthetic Oligonucleotide; PD-L1 exon 2; Set B
accuaauggaaggauuuggugucuuac

SEQ ID NO: 18792 - RNA, 39 nt, Artificial Sequence
  Synthetic Oligonucleotide; PD-L1 exon 2; Set C
uauagaaccuaauggaaggauuuggugucuuaccguuca

SEQ ID NO: 18793 - RNA, 28 nt, Artificial Sequence
  Synthetic Oligonucleotide; PD-L1 exon 2; Set B
aaccuaauggaaggauuuggugucuuac

SEQ ID NO: 18794 - RNA, 40 nt, Artificial Sequence
  Synthetic Oligonucleotide; PD-L1 exon 2; Set C
auauagaaccuaauggaaggauuuggugucuuaccguuca

SEQ ID NO: 18795 - RNA, 21 nt, Artificial Sequence
  Synthetic Oligonucleotide; PD-L1 exon 2; Set C
ccuaauggaaggauuuggugu

SEQ ID NO: 18796 - RNA, 22 nt, Artificial Sequence
  Synthetic Oligonucleotide; PD-L1 exon 2; Set C
accuaauggaaggauuuggugu

SEQ ID NO: 18797 - RNA, 18 nt, Artificial Sequence
  Synthetic Oligonucleotide; PD-L1 exon 2; Set C
cuaauggaaggauuuggu

SEQ ID NO: 18798 - RNA, 23 nt, Artificial Sequence
  Synthetic Oligonucleotide; PD-L1 exon 2; Set C
aaccuaauggaaggauuuggugu

SEQ ID NO: 18799 - RNA, 22 nt, Artificial Sequence
  Synthetic Oligonucleotide; PD-L1 exon 2; Set C
gaaccuaauggaaggauuuggu

SEQ ID NO: 18800 - RNA, 16 nt, Artificial Sequence
  Synthetic Oligonucleotide; PD-L1 exon 2; Set C
gaaccuaauggaagga

SEQ ID NO: 18801 - RNA, 15 nt, Artificial Sequence
  Synthetic Oligonucleotide; PD-L1 exon 2; Set C
gaaccuaauggaagg

SEQ ID NO: 18802 - RNA, 27 nt, Artificial Sequence
  Synthetic Oligonucleotide; PD-L1 exon 2; Set C
gguuaaaauauuuaaaauauagaaccu

SEQ ID NO: 18803 - RNA, 26 nt, Artificial Sequence
  Synthetic Oligonucleotide; PD-L1 exon 2; Set C
gguuaaaauauuuaaaauauagaacc

SEQ ID NO: 18804 - RNA, 25 nt, Artificial Sequence
  Synthetic Oligonucleotide; PD-L1 exon 2; Set C
gguuaaaauauuuaaaauauagaac

SEQ ID NO: 18805 - RNA, 15 nt, Artificial Sequence
  Synthetic Oligonucleotide; PD-L1 exon 3; Set C
agaaaagggaaaauu

SEQ ID NO: 18806 - RNA, 15 nt, Artificial Sequence
  Synthetic Oligonucleotide; PD-L1 exon 3; Set C
cagaaaagggaaaau

SEQ ID NO: 18807 - RNA, 17 nt, Artificial Sequence
  Synthetic Oligonucleotide; PD-L1 exon 3; Set C
ucagaaaagggaaaauu

SEQ ID NO: 18808 - RNA, 16 nt, Artificial Sequence
  Synthetic Oligonucleotide; PD-L1 exon 3; Set C
ucagaaaagggaaaau

SEQ ID NO: 18809 - RNA, 18 nt, Artificial Sequence
  Synthetic Oligonucleotide; PD-L1 exon 3; Set C
uucagaaaagggaaaauu

SEQ ID NO: 18810 - RNA, 15 nt, Artificial Sequence
  Synthetic Oligonucleotide; PD-L1 exon 3; Set C
ucagaaaagggaaaa

SEQ ID NO: 18811 - RNA, 17 nt, Artificial Sequence
  Synthetic Oligonucleotide; PD-L1 exon 3; Set C
uucagaaaagggaaaau

SEQ ID NO: 18812 - RNA, 16 nt, Artificial Sequence
  Synthetic Oligonucleotide; PD-L1 exon 3; Set C
uucagaaaagggaaaa

SEQ ID NO: 18813 - RNA, 18 nt, Artificial Sequence
  Synthetic Oligonucleotide; PD-L1 exon 3; Set C
cuucagaaaagggaaaau

SEQ ID NO: 18814 - RNA, 15 nt, Artificial Sequence
  Synthetic Oligonucleotide; PD-L1 exon 3; Set C
uucagaaaagggaaa

SEQ ID NO: 18815 - RNA, 17 nt, Artificial Sequence
  Synthetic Oligonucleotide; PD-L1 exon 3; Set C
cuucagaaaagggaaaa

SEQ ID NO: 18816 - RNA, 16 nt, Artificial Sequence
  Synthetic Oligonucleotide; PD-L1 exon 3; Set C
cuucagaaaagggaaa

SEQ ID NO: 18817 - RNA, 15 nt, Artificial Sequence
  Synthetic Oligonucleotide; PD-L1 exon 3; Set C
cuucagaaaagggaa

SEQ ID NO: 18818 - RNA, 23 nt, Artificial Sequence
  Synthetic Oligonucleotide; PD-L1 exon 3; Set C
caaucuucagaaaagggaaaauu

SEQ ID NO: 18819 - RNA, 22 nt, Artificial Sequence
  Synthetic Oligonucleotide; PD-L1 exon 3; Set C
caaucuucagaaaagggaaaau

SEQ ID NO: 18820 - RNA, 21 nt, Artificial Sequence
  Synthetic Oligonucleotide; PD-L1 exon 3; Set C
caaucuucagaaaagggaaaa

SEQ ID NO: 18821 - RNA, 23 nt, Artificial Sequence
  Synthetic Oligonucleotide; PD-L1 exon 3; Set C
acaaucuucagaaaagggaaaau

SEQ ID NO: 18822 - RNA, 20 nt, Artificial Sequence
  Synthetic Oligonucleotide; PD-L1 exon 3; Set C
caaucuucagaaaagggaaa

SEQ ID NO: 18823 - RNA, 22 nt, Artificial Sequence
  Synthetic Oligonucleotide; PD-L1 exon 3; Set C
acaaucuucagaaaagggaaaa

SEQ ID NO: 18824 - RNA, 24 nt, Artificial Sequence
  Synthetic Oligonucleotide; PD-L1 exon 3; Set C
gacaaucuucagaaaagggaaaau

SEQ ID NO: 18825 - RNA, 21 nt, Artificial Sequence
  Synthetic Oligonucleotide; PD-L1 exon 3; Set C
acaaucuucagaaaagggaaa

SEQ ID NO: 18826 - RNA, 23 nt, Artificial Sequence
  Synthetic Oligonucleotide; PD-L1 exon 3; Set C
gacaaucuucagaaaagggaaaa

SEQ ID NO: 18827 - RNA, 19 nt, Artificial Sequence
  Synthetic Oligonucleotide; PD-L1 exon 3; Set C
caaucuucagaaaagggaa

SEQ ID NO: 18828 - RNA, 25 nt, Artificial Sequence
  Synthetic Oligonucleotide; PD-L1 exon 3; Set C
ggacaaucuucagaaaagggaaaau

SEQ ID NO: 18829 - RNA, 22 nt, Artificial Sequence
  Synthetic Oligonucleotide; PD-L1 exon 3; Set C
gacaaucuucagaaaagggaaa

SEQ ID NO: 18830 - RNA, 24 nt, Artificial Sequence
  Synthetic Oligonucleotide; PD-L1 exon 3; Set C
ggacaaucuucagaaaagggaaaa

SEQ ID NO: 18831 - RNA, 20 nt, Artificial Sequence
  Synthetic Oligonucleotide; PD-L1 exon 3; Set C
acaaucuucagaaaagggaa

SEQ ID NO: 18832 - RNA, 26 nt, Artificial Sequence
  Synthetic Oligonucleotide; PD-L1 exon 3; Set C
aggacaaucuucagaaaagggaaaau

SEQ ID NO: 18833 - RNA, 18 nt, Artificial Sequence
  Synthetic Oligonucleotide; PD-L1 exon 3; Set C
caaucuucagaaaaggga

SEQ ID NO: 18834 - RNA, 23 nt, Artificial Sequence
  Synthetic Oligonucleotide; PD-L1 exon 3; Set C
ggacaaucuucagaaaagggaaa

SEQ ID NO: 18835 - RNA, 25 nt, Artificial Sequence
  Synthetic Oligonucleotide; PD-L1 exon 3; Set C
aggacaaucuucagaaaagggaaaa

SEQ ID NO: 18836 - RNA, 21 nt, Artificial Sequence
  Synthetic Oligonucleotide; PD-L1 exon 3; Set C
gacaaucuucagaaaagggaa

SEQ ID NO: 18837 - RNA, 27 nt, Artificial Sequence
  Synthetic Oligonucleotide; PD-L1 exon 3; Set C
aaggacaaucuucagaaaagggaaaau

SEQ ID NO: 18838 - RNA, 19 nt, Artificial Sequence
  Synthetic Oligonucleotide; PD-L1 exon 3; Set C
acaaucuucagaaaaggga

SEQ ID NO: 18839 - RNA, 17 nt, Artificial Sequence
  Synthetic Oligonucleotide; PD-L1 exon 3; Set C
caaucuucagaaaaggg

SEQ ID NO: 18840 - RNA, 24 nt, Artificial Sequence
  Synthetic Oligonucleotide; PD-L1 exon 3; Set C
aggacaaucuucagaaaagggaaa

SEQ ID NO: 18841 - RNA, 26 nt, Artificial Sequence
  Synthetic Oligonucleotide; PD-L1 exon 3; Set C
aaggacaaucuucagaaaagggaaaa

SEQ ID NO: 18842 - RNA, 22 nt, Artificial Sequence
  Synthetic Oligonucleotide; PD-L1 exon 3; Set C
ggacaaucuucagaaaagggaa

SEQ ID NO: 18843 - RNA, 28 nt, Artificial Sequence
  Synthetic Oligonucleotide; PD-L1 exon 3; Set C
gaaggacaaucuucagaaaagggaaaau

SEQ ID NO: 18844 - RNA, 16 nt, Artificial Sequence
  Synthetic Oligonucleotide; PD-L1 exon 3; Set C
caaucuucagaaaagg

SEQ ID NO: 18845 - RNA, 20 nt, Artificial Sequence
  Synthetic Oligonucleotide; PD-L1 exon 3; Set C
gacaaucuucagaaaaggga

SEQ ID NO: 18846 - RNA, 25 nt, Artificial Sequence
  Synthetic Oligonucleotide; PD-L1 exon 3; Set C
aaggacaaucuucagaaaagggaaa

SEQ ID NO: 18847 - RNA, 27 nt, Artificial Sequence
  Synthetic Oligonucleotide; PD-L1 exon 3; Set C
gaaggacaaucuucagaaaagggaaaa

SEQ ID NO: 18848 - RNA, 23 nt, Artificial Sequence
  Synthetic Oligonucleotide; PD-L1 exon 3; Set C
aggacaaucuucagaaaagggaa

SEQ ID NO: 18849 - RNA, 29 nt, Artificial Sequence
  Synthetic Oligonucleotide; PD-L1 exon 3; Set C
agaaggacaaucuucagaaaagggaaaau

SEQ ID NO: 18850 - RNA, 15 nt, Artificial Sequence
  Synthetic Oligonucleotide; PD-L1 exon 3; Set C
caaucuucagaaaag

SEQ ID NO: 18851 - RNA, 17 nt, Artificial Sequence
  Synthetic Oligonucleotide; PD-L1 exon 3; Set C
acaaucuucagaaaagg

SEQ ID NO: 18852 - RNA, 21 nt, Artificial Sequence
  Synthetic Oligonucleotide; PD-L1 exon 3; Set C
ggacaaucuucagaaaaggga

SEQ ID NO: 18853 - RNA, 26 nt, Artificial Sequence
  Synthetic Oligonucleotide; PD-L1 exon 3; Set C
gaaggacaaucuucagaaaagggaaa

SEQ ID NO: 18854 - RNA, 28 nt, Artificial Sequence
  Synthetic Oligonucleotide; PD-L1 exon 3; Set C
agaaggacaaucuucagaaaagggaaaa

SEQ ID NO: 18855 - RNA, 24 nt, Artificial Sequence
  Synthetic Oligonucleotide; PD-L1 exon 3; Set C
aaggacaaucuucagaaaagggaa

SEQ ID NO: 18856 - RNA, 30 nt, Artificial Sequence
  Synthetic Oligonucleotide; PD-L1 exon 3; Set C
aagaaggacaaucuucagaaaagggaaaau

SEQ ID NO: 18857 - RNA, 16 nt, Artificial Sequence
  Synthetic Oligonucleotide; PD-L1 exon 3; Set C
acaaucuucagaaaag

SEQ ID NO: 18858 - RNA, 18 nt, Artificial Sequence
  Synthetic Oligonucleotide; PD-L1 exon 3; Set C
gacaaucuucagaaaagg

SEQ ID NO: 18859 - RNA, 22 nt, Artificial Sequence
  Synthetic Oligonucleotide; PD-L1 exon 3; Set C
aggacaaucuucagaaaaggga

SEQ ID NO: 18860 - RNA, 32 nt, Artificial Sequence
  Synthetic Oligonucleotide; PD-L1 exon 3; Set C
aaagaaggacaaucuucagaaaagggaaaauu

SEQ ID NO: 18861 - RNA, 27 nt, Artificial Sequence
  Synthetic Oligonucleotide; PD-L1 exon 3; Set C
agaaggacaaucuucagaaaagggaaa

SEQ ID NO: 18862 - RNA, 29 nt, Artificial Sequence
  Synthetic Oligonucleotide; PD-L1 exon 3; Set C
aagaaggacaaucuucagaaaagggaaaa

SEQ ID NO: 18863 - RNA, 25 nt, Artificial Sequence
  Synthetic Oligonucleotide; PD-L1 exon 3; Set C
gaaggacaaucuucagaaaagggaa

SEQ ID NO: 18864 - RNA, 31 nt, Artificial Sequence
  Synthetic Oligonucleotide; PD-L1 exon 3; Set C
aaagaaggacaaucuucagaaaagggaaaau

SEQ ID NO: 18865 - RNA, 15 nt, Artificial Sequence
  Synthetic Oligonucleotide; PD-L1 exon 3; Set C
acaaucuucagaaaa

SEQ ID NO: 18866 - RNA, 17 nt, Artificial Sequence
  Synthetic Oligonucleotide; PD-L1 exon 3; Set C
gacaaucuucagaaaag

SEQ ID NO: 18867 - RNA, 19 nt, Artificial Sequence
  Synthetic Oligonucleotide; PD-L1 exon 3; Set C
ggacaaucuucagaaaagg

SEQ ID NO: 18868 - RNA, 33 nt, Artificial Sequence
  Synthetic Oligonucleotide; PD-L1 exon 3; Set C
gaaagaaggacaaucuucagaaaagggaaaauu

SEQ ID NO: 18869 - RNA, 28 nt, Artificial Sequence
  Synthetic Oligonucleotide; PD-L1 exon 3; Set C
aagaaggacaaucuucagaaaagggaaa

SEQ ID NO: 18870 - RNA, 30 nt, Artificial Sequence
  Synthetic Oligonucleotide; PD-L1 exon 3; Set C
aaagaaggacaaucuucagaaaagggaaaa

SEQ ID NO: 18871 - RNA, 26 nt, Artificial Sequence
  Synthetic Oligonucleotide; PD-L1 exon 3; Set C
agaaggacaaucuucagaaaagggaa

SEQ ID NO: 18872 - RNA, 32 nt, Artificial Sequence
  Synthetic Oligonucleotide; PD-L1 exon 3; Set C
gaaagaaggacaaucuucagaaaagggaaaau

SEQ ID NO: 18873 - RNA, 16 nt, Artificial Sequence
  Synthetic Oligonucleotide; PD-L1 exon 3; Set C
gacaaucuucagaaaa

SEQ ID NO: 18874 - RNA, 18 nt, Artificial Sequence
  Synthetic Oligonucleotide; PD-L1 exon 3; Set C
ggacaaucuucagaaaag

SEQ ID NO: 18875 - RNA, 20 nt, Artificial Sequence
  Synthetic Oligonucleotide; PD-L1 exon 3; Set C
aggacaaucuucagaaaagg

SEQ ID NO: 18876 - RNA, 24 nt, Artificial Sequence
  Synthetic Oligonucleotide; PD-L1 exon 3; Set C
gaaggacaaucuucagaaaaggga

SEQ ID NO: 18877 - RNA, 34 nt, Artificial Sequence
  Synthetic Oligonucleotide; PD-L1 exon 3; Set C
agaaagaaggacaaucuucagaaaagggaaaauu

SEQ ID NO: 18878 - RNA, 29 nt, Artificial Sequence
  Synthetic Oligonucleotide; PD-L1 exon 3; Set C
aaagaaggacaaucuucagaaaagggaaa

SEQ ID NO: 18879 - RNA, 31 nt, Artificial Sequence
  Synthetic Oligonucleotide; PD-L1 exon 3; Set C
gaaagaaggacaaucuucagaaaagggaaaa

SEQ ID NO: 18880 - RNA, 27 nt, Artificial Sequence
  Synthetic Oligonucleotide; PD-L1 exon 3; Set C
aagaaggacaaucuucagaaaagggaa

SEQ ID NO: 18881 - RNA, 33 nt, Artificial Sequence
  Synthetic Oligonucleotide; PD-L1 exon 3; Set C
agaaagaaggacaaucuucagaaaagggaaaau

SEQ ID NO: 18882 - RNA, 17 nt, Artificial Sequence
  Synthetic Oligonucleotide; PD-L1 exon 3; Set C
ggacaaucuucagaaaa

SEQ ID NO: 18883 - RNA, 15 nt, Artificial Sequence
  Synthetic Oligonucleotide; PD-L1 exon 3; Set C
gacaaucuucagaaa

SEQ ID NO: 18884 - RNA, 19 nt, Artificial Sequence
  Synthetic Oligonucleotide; PD-L1 exon 3; Set C
aggacaaucuucagaaaag

SEQ ID NO: 18885 - RNA, 21 nt, Artificial Sequence
  Synthetic Oligonucleotide; PD-L1 exon 3; Set C
aaggacaaucuucagaaaagg

SEQ ID NO: 18886 - RNA, 25 nt, Artificial Sequence
  Synthetic Oligonucleotide; PD-L1 exon 3; Set C
agaaggacaaucuucagaaaaggga

SEQ ID NO: 18887 - RNA, 35 nt, Artificial Sequence
  Synthetic Oligonucleotide; PD-L1 exon 3; Set C
aagaaagaaggacaaucuucagaaaagggaaaauu

SEQ ID NO: 18888 - RNA, 30 nt, Artificial Sequence
  Synthetic Oligonucleotide; PD-L1 exon 3; Set C
gaaagaaggacaaucuucagaaaagggaaa

SEQ ID NO: 18889 - RNA, 32 nt, Artificial Sequence
  Synthetic Oligonucleotide; PD-L1 exon 3; Set C
agaaagaaggacaaucuucagaaaagggaaaa

SEQ ID NO: 18890 - RNA, 28 nt, Artificial Sequence
  Synthetic Oligonucleotide; PD-L1 exon 3; Set C
aaagaaggacaaucuucagaaaagggaa

SEQ ID NO: 18891 - RNA, 34 nt, Artificial Sequence
  Synthetic Oligonucleotide; PD-L1 exon 3; Set C
aagaaagaaggacaaucuucagaaaagggaaaau

SEQ ID NO: 18892 - RNA, 18 nt, Artificial Sequence
  Synthetic Oligonucleotide; PD-L1 exon 3; Set C
aggacaaucuucagaaaa

SEQ ID NO: 18893 - RNA, 16 nt, Artificial Sequence
  Synthetic Oligonucleotide; PD-L1 exon 3; Set C
ggacaaucuucagaaa

SEQ ID NO: 18894 - RNA, 20 nt, Artificial Sequence
  Synthetic Oligonucleotide; PD-L1 exon 3; Set C
aaggacaaucuucagaaaag

SEQ ID NO: 18895 - RNA, 22 nt, Artificial Sequence
  Synthetic Oligonucleotide; PD-L1 exon 3; Set C
gaaggacaaucuucagaaaagg

SEQ ID NO: 18896 - RNA, 26 nt, Artificial Sequence
  Synthetic Oligonucleotide; PD-L1 exon 3; Set C
aagaaggacaaucuucagaaaaggga

SEQ ID NO: 18897 - RNA, 24 nt, Artificial Sequence
  Synthetic Oligonucleotide; PD-L1 exon 3; Set C
agaaggacaaucuucagaaaaggg

SEQ ID NO: 18898 - RNA, 36 nt, Artificial Sequence
  Synthetic Oligonucleotide; PD-L1 exon 3; Set C
aaagaaagaaggacaaucuucagaaaagggaaaauu

SEQ ID NO: 18899 - RNA, 31 nt, Artificial Sequence
  Synthetic Oligonucleotide; PD-L1 exon 3; Set C
agaaagaaggacaaucuucagaaaagggaaa

SEQ ID NO: 18900 - RNA, 33 nt, Artificial Sequence
  Synthetic Oligonucleotide; PD-L1 exon 3; Set C
aagaaagaaggacaaucuucagaaaagggaaaa

SEQ ID NO: 18901 - RNA, 29 nt, Artificial Sequence
  Synthetic Oligonucleotide; PD-L1 exon 3; Set C
gaaagaaggacaaucuucagaaaagggaa

SEQ ID NO: 18902 - RNA, 15 nt, Artificial Sequence
  Synthetic Oligonucleotide; PD-L1 exon 3; Set C
ggacaaucuucagaa

SEQ ID NO: 18903 - RNA, 35 nt, Artificial Sequence
  Synthetic Oligonucleotide; PD-L1 exon 3; Set C
aaagaaagaaggacaaucuucagaaaagggaaaau

SEQ ID NO: 18904 - RNA, 19 nt, Artificial Sequence
  Synthetic Oligonucleotide; PD-L1 exon 3; Set C
aaggacaaucuucagaaaa

SEQ ID NO: 18905 - RNA, 17 nt, Artificial Sequence
  Synthetic Oligonucleotide; PD-L1 exon 3; Set C
aggacaaucuucagaaa

SEQ ID NO: 18906 - RNA, 21 nt, Artificial Sequence
  Synthetic Oligonucleotide; PD-L1 exon 3; Set C
gaaggacaaucuucagaaaag

SEQ ID NO: 18907 - RNA, 23 nt, Artificial Sequence
  Synthetic Oligonucleotide; PD-L1 exon 3; Set C
agaaggacaaucuucagaaaagg

SEQ ID NO: 18908 - RNA, 27 nt, Artificial Sequence
  Synthetic Oligonucleotide; PD-L1 exon 3; Set C
aaagaaggacaaucuucagaaaaggga

SEQ ID NO: 18909 - RNA, 25 nt, Artificial Sequence
  Synthetic Oligonucleotide; PD-L1 exon 3; Set C
aagaaggacaaucuucagaaaaggg

SEQ ID NO: 18910 - RNA, 37 nt, Artificial Sequence
  Synthetic Oligonucleotide; PD-L1 exon 3; Set C
aaaagaaagaaggacaaucuucagaaaagggaaaauu

SEQ ID NO: 18911 - RNA, 32 nt, Artificial Sequence
  Synthetic Oligonucleotide; PD-L1 exon 3; Set C
aagaaagaaggacaaucuucagaaaagggaaa

SEQ ID NO: 18912 - RNA, 34 nt, Artificial Sequence
  Synthetic Oligonucleotide; PD-L1 exon 3; Set C
aaagaaagaaggacaaucuucagaaaagggaaaa

SEQ ID NO: 18913 - RNA, 30 nt, Artificial Sequence
  Synthetic Oligonucleotide; PD-L1 exon 3; Set C
agaaagaaggacaaucuucagaaaagggaa

SEQ ID NO: 18914 - RNA, 16 nt, Artificial Sequence
  Synthetic Oligonucleotide; PD-L1 exon 3; Set C
aggacaaucuucagaa

SEQ ID NO: 18915 - RNA, 36 nt, Artificial Sequence
  Synthetic Oligonucleotide; PD-L1 exon 3; Set C
aaaagaaagaaggacaaucuucagaaaagggaaaau

SEQ ID NO: 18916 - RNA, 20 nt, Artificial Sequence
  Synthetic Oligonucleotide; PD-L1 exon 3; Set C
gaaggacaaucuucagaaaa

SEQ ID NO: 18917 - RNA, 18 nt, Artificial Sequence
  Synthetic Oligonucleotide; PD-L1 exon 3; Set C
aaggacaaucuucagaaa

SEQ ID NO: 18918 - RNA, 22 nt, Artificial Sequence
  Synthetic Oligonucleotide; PD-L1 exon 3; Set C
agaaggacaaucuucagaaaag

SEQ ID NO: 18919 - RNA, 24 nt, Artificial Sequence
  Synthetic Oligonucleotide; PD-L1 exon 3; Set C
aagaaggacaaucuucagaaaagg

SEQ ID NO: 18920 - RNA, 28 nt, Artificial Sequence
  Synthetic Oligonucleotide; PD-L1 exon 3; Set C
gaaagaaggacaaucuucagaaaaggga

SEQ ID NO: 18921 - RNA, 26 nt, Artificial Sequence
  Synthetic Oligonucleotide; PD-L1 exon 3; Set C
aaagaaggacaaucuucagaaaaggg

SEQ ID NO: 18922 - RNA, 38 nt, Artificial Sequence
  Synthetic Oligonucleotide; PD-L1 exon 3; Set C
aaaaagaaagaaggacaaucuucagaaaagggaaaauu

SEQ ID NO: 18923 - RNA, 33 nt, Artificial Sequence
  Synthetic Oligonucleotide; PD-L1 exon 3; Set C
aaagaaagaaggacaaucuucagaaaagggaaa

SEQ ID NO: 18924 - RNA, 35 nt, Artificial Sequence
  Synthetic Oligonucleotide; PD-L1 exon 3; Set C
aaaagaaagaaggacaaucuucagaaaagggaaaa

SEQ ID NO: 18925 - RNA, 31 nt, Artificial Sequence
  Synthetic Oligonucleotide; PD-L1 exon 3; Set C
aagaaagaaggacaaucuucagaaaagggaa

SEQ ID NO: 18926 - RNA, 17 nt, Artificial Sequence
  Synthetic Oligonucleotide; PD-L1 exon 3; Set C
aaggacaaucuucagaa

SEQ ID NO: 18927 - RNA, 37 nt, Artificial Sequence
  Synthetic Oligonucleotide; PD-L1 exon 3; Set C
aaaaagaaagaaggacaaucuucagaaaagggaaaau

SEQ ID NO: 18928 - RNA, 21 nt, Artificial Sequence
  Synthetic Oligonucleotide; PD-L1 exon 3; Set C
agaaggacaaucuucagaaaa

SEQ ID NO: 18929 - RNA, 19 nt, Artificial Sequence
  Synthetic Oligonucleotide; PD-L1 exon 3; Set C
gaaggacaaucuucagaaa

SEQ ID NO: 18930 - RNA, 15 nt, Artificial Sequence
  Synthetic Oligonucleotide; PD-L1 exon 3; Set C
aggacaaucuucaga

SEQ ID NO: 18931 - RNA, 23 nt, Artificial Sequence
  Synthetic Oligonucleotide; PD-L1 exon 3; Set C
aagaaggacaaucuucagaaaag

SEQ ID NO: 18932 - RNA, 25 nt, Artificial Sequence
  Synthetic Oligonucleotide; PD-L1 exon 3; Set C
aaagaaggacaaucuucagaaaagg

SEQ ID NO: 18933 - RNA, 29 nt, Artificial Sequence
  Synthetic Oligonucleotide; PD-L1 exon 3; Set C
agaaagaaggacaaucuucagaaaaggga

SEQ ID NO: 18934 - RNA, 27 nt, Artificial Sequence
  Synthetic Oligonucleotide; PD-L1 exon 3; Set C
gaaagaaggacaaucuucagaaaaggg

SEQ ID NO: 18935 - RNA, 39 nt, Artificial Sequence
  Synthetic Oligonucleotide; PD-L1 exon 3; Set C
uaaaaagaaagaaggacaaucuucagaaaagggaaaauu

SEQ ID NO: 18936 - RNA, 34 nt, Artificial Sequence
  Synthetic Oligonucleotide; PD-L1 exon 3; Set C
aaaagaaagaaggacaaucuucagaaaagggaaa

SEQ ID NO: 18937 - RNA, 36 nt, Artificial Sequence
  Synthetic Oligonucleotide; PD-L1 exon 3; Set C
aaaaagaaagaaggacaaucuucagaaaagggaaaa

SEQ ID NO: 18938 - RNA, 32 nt, Artificial Sequence
  Synthetic Oligonucleotide; PD-L1 exon 3; Set C
aaagaaagaaggacaaucuucagaaaagggaa

SEQ ID NO: 18939 - RNA, 18 nt, Artificial Sequence
  Synthetic Oligonucleotide; PD-L1 exon 3; Set C
gaaggacaaucuucagaa

SEQ ID NO: 18940 - RNA, 38 nt, Artificial Sequence
  Synthetic Oligonucleotide; PD-L1 exon 3; Set C
uaaaaagaaagaaggacaaucuucagaaaagggaaaau

SEQ ID NO: 18941 - RNA, 22 nt, Artificial Sequence
  Synthetic Oligonucleotide; PD-L1 exon 3; Set C
aagaaggacaaucuucagaaaa

SEQ ID NO: 18942 - RNA, 20 nt, Artificial Sequence
  Synthetic Oligonucleotide; PD-L1 exon 3; Set C
agaaggacaaucuucagaaa

SEQ ID NO: 18943 - RNA, 16 nt, Artificial Sequence
  Synthetic Oligonucleotide; PD-L1 exon 3; Set C
aaggacaaucuucaga

SEQ ID NO: 18944 - RNA, 24 nt, Artificial Sequence
  Synthetic Oligonucleotide; PD-L1 exon 3; Set C
aaagaaggacaaucuucagaaaag

SEQ ID NO: 18945 - RNA, 26 nt, Artificial Sequence
  Synthetic Oligonucleotide; PD-L1 exon 3; Set C
gaaagaaggacaaucuucagaaaagg

SEQ ID NO: 18946 - RNA, 30 nt, Artificial Sequence
  Synthetic Oligonucleotide; PD-L1 exon 3; Set C
aagaaagaaggacaaucuucagaaaaggga

SEQ ID NO: 18947 - RNA, 28 nt, Artificial Sequence
  Synthetic Oligonucleotide; PD-L1 exon 3; Set C
agaaagaaggacaaucuucagaaaaggg

SEQ ID NO: 18948 - RNA, 35 nt, Artificial Sequence
  Synthetic Oligonucleotide; PD-L1 exon 3; Set C
aaaaagaaagaaggacaaucuucagaaaagggaaa

SEQ ID NO: 18949 - RNA, 37 nt, Artificial Sequence
  Synthetic Oligonucleotide; PD-L1 exon 3; Set C
uaaaaagaaagaaggacaaucuucagaaaagggaaaa

SEQ ID NO: 18950 - RNA, 33 nt, Artificial Sequence
  Synthetic Oligonucleotide; PD-L1 exon 3; Set C
aaaagaaagaaggacaaucuucagaaaagggaa

SEQ ID NO: 18951 - RNA, 19 nt, Artificial Sequence
  Synthetic Oligonucleotide; PD-L1 exon 3; Set C
agaaggacaaucuucagaa

SEQ ID NO: 18952 - RNA, 23 nt, Artificial Sequence
  Synthetic Oligonucleotide; PD-L1 exon 3; Set C
aaagaaggacaaucuucagaaaa

SEQ ID NO: 18953 - RNA, 21 nt, Artificial Sequence
  Synthetic Oligonucleotide; PD-L1 exon 3; Set C
aagaaggacaaucuucagaaa

SEQ ID NO: 18954 - RNA, 17 nt, Artificial Sequence
  Synthetic Oligonucleotide; PD-L1 exon 3; Set C
gaaggacaaucuucaga

SEQ ID NO: 18955 - RNA, 25 nt, Artificial Sequence
  Synthetic Oligonucleotide; PD-L1 exon 3; Set C
gaaagaaggacaaucuucagaaaag

SEQ ID NO: 18956 - RNA, 27 nt, Artificial Sequence
  Synthetic Oligonucleotide; PD-L1 exon 3; Set C
agaaagaaggacaaucuucagaaaagg

SEQ ID NO: 18957 - RNA, 31 nt, Artificial Sequence
  Synthetic Oligonucleotide; PD-L1 exon 3; Set C
aaagaaagaaggacaaucuucagaaaaggga

SEQ ID NO: 18958 - RNA, 29 nt, Artificial Sequence
  Synthetic Oligonucleotide; PD-L1 exon 3; Set C
aagaaagaaggacaaucuucagaaaaggg

SEQ ID NO: 18959 - RNA, 36 nt, Artificial Sequence
  Synthetic Oligonucleotide; PD-L1 exon 3; Set C
uaaaaagaaagaaggacaaucuucagaaaagggaaa

SEQ ID NO: 18960 - RNA, 34 nt, Artificial Sequence
  Synthetic Oligonucleotide; PD-L1 exon 3; Set C
aaaaagaaagaaggacaaucuucagaaaagggaa

SEQ ID NO: 18961 - RNA, 20 nt, Artificial Sequence
  Synthetic Oligonucleotide; PD-L1 exon 3; Set C
aagaaggacaaucuucagaa

SEQ ID NO: 18962 - RNA, 24 nt, Artificial Sequence
  Synthetic Oligonucleotide; PD-L1 exon 3; Set C
gaaagaaggacaaucuucagaaaa

SEQ ID NO: 18963 - RNA, 22 nt, Artificial Sequence
  Synthetic Oligonucleotide; PD-L1 exon 3; Set C
aaagaaggacaaucuucagaaa

SEQ ID NO: 18964 - RNA, 18 nt, Artificial Sequence
  Synthetic Oligonucleotide; PD-L1 exon 3; Set C
agaaggacaaucuucaga

SEQ ID NO: 18965 - RNA, 26 nt, Artificial Sequence
  Synthetic Oligonucleotide; PD-L1 exon 3; Set C
agaaagaaggacaaucuucagaaaag

SEQ ID NO: 18966 - RNA, 28 nt, Artificial Sequence
  Synthetic Oligonucleotide; PD-L1 exon 3; Set C
aagaaagaaggacaaucuucagaaaagg

SEQ ID NO: 18967 - RNA, 32 nt, Artificial Sequence
  Synthetic Oligonucleotide; PD-L1 exon 3; Set C
aaaagaaagaaggacaaucuucagaaaaggga

SEQ ID NO: 18968 - RNA, 30 nt, Artificial Sequence
  Synthetic Oligonucleotide; PD-L1 exon 3; Set C
aaagaaagaaggacaaucuucagaaaaggg

SEQ ID NO: 18969 - RNA, 35 nt, Artificial Sequence
  Synthetic Oligonucleotide; PD-L1 exon 3; Set C
uaaaaagaaagaaggacaaucuucagaaaagggaa

SEQ ID NO: 18970 - RNA, 21 nt, Artificial Sequence
  Synthetic Oligonucleotide; PD-L1 exon 3; Set C
aaagaaggacaaucuucagaa

SEQ ID NO: 18971 - RNA, 25 nt, Artificial Sequence
  Synthetic Oligonucleotide; PD-L1 exon 3; Set C
agaaagaaggacaaucuucagaaaa

SEQ ID NO: 18972 - RNA, 23 nt, Artificial Sequence
  Synthetic Oligonucleotide; PD-L1 exon 3; Set C
gaaagaaggacaaucuucagaaa

SEQ ID NO: 18973 - RNA, 19 nt, Artificial Sequence
  Synthetic Oligonucleotide; PD-L1 exon 3; Set C
aagaaggacaaucuucaga

SEQ ID NO: 18974 - RNA, 27 nt, Artificial Sequence
  Synthetic Oligonucleotide; PD-L1 exon 3; Set C
aagaaagaaggacaaucuucagaaaag

SEQ ID NO: 18975 - RNA, 29 nt, Artificial Sequence
  Synthetic Oligonucleotide; PD-L1 exon 3; Set C
aaagaaagaaggacaaucuucagaaaagg

SEQ ID NO: 18976 - RNA, 33 nt, Artificial Sequence
  Synthetic Oligonucleotide; PD-L1 exon 3; Set C
aaaaagaaagaaggacaaucuucagaaaaggga

SEQ ID NO: 18977 - RNA, 31 nt, Artificial Sequence
  Synthetic Oligonucleotide; PD-L1 exon 3; Set C
aaaagaaagaaggacaaucuucagaaaaggg

SEQ ID NO: 18978 - RNA, 22 nt, Artificial Sequence
  Synthetic Oligonucleotide; PD-L1 exon 3; Set C
gaaagaaggacaaucuucagaa

SEQ ID NO: 18979 - RNA, 26 nt, Artificial Sequence
  Synthetic Oligonucleotide; PD-L1 exon 3; Set C
aagaaagaaggacaaucuucagaaaa

SEQ ID NO: 18980 - RNA, 24 nt, Artificial Sequence
  Synthetic Oligonucleotide; PD-L1 exon 3; Set C
agaaagaaggacaaucuucagaaa

SEQ ID NO: 18981 - RNA, 20 nt, Artificial Sequence
  Synthetic Oligonucleotide; PD-L1 exon 3; Set C
aaagaaggacaaucuucaga

SEQ ID NO: 18982 - RNA, 28 nt, Artificial Sequence
  Synthetic Oligonucleotide; PD-L1 exon 3; Set C
aaagaaagaaggacaaucuucagaaaag

SEQ ID NO: 18983 - RNA, 30 nt, Artificial Sequence
  Synthetic Oligonucleotide; PD-L1 exon 3; Set C
aaaagaaagaaggacaaucuucagaaaagg

SEQ ID NO: 18984 - RNA, 34 nt, Artificial Sequence
  Synthetic Oligonucleotide; PD-L1 exon 3; Set C
uaaaaagaaagaaggacaaucuucagaaaaggga

SEQ ID NO: 18985 - RNA, 32 nt, Artificial Sequence
  Synthetic Oligonucleotide; PD-L1 exon 3; Set C
aaaaagaaagaaggacaaucuucagaaaaggg

SEQ ID NO: 18986 - RNA, 23 nt, Artificial Sequence
  Synthetic Oligonucleotide; PD-L1 exon 3; Set C
agaaagaaggacaaucuucagaa

SEQ ID NO: 18987 - RNA, 27 nt, Artificial Sequence
  Synthetic Oligonucleotide; PD-L1 exon 3; Set C
aaagaaagaaggacaaucuucagaaaa

SEQ ID NO: 18988 - RNA, 25 nt, Artificial Sequence
  Synthetic Oligonucleotide; PD-L1 exon 3; Set C
aagaaagaaggacaaucuucagaaa

SEQ ID NO: 18989 - RNA, 21 nt, Artificial Sequence
  Synthetic Oligonucleotide; PD-L1 exon 3; Set C
gaaagaaggacaaucuucaga

SEQ ID NO: 18990 - RNA, 29 nt, Artificial Sequence
  Synthetic Oligonucleotide; PD-L1 exon 3; Set C
aaaagaaagaaggacaaucuucagaaaag

SEQ ID NO: 18991 - RNA, 31 nt, Artificial Sequence
  Synthetic Oligonucleotide; PD-L1 exon 3; Set C
aaaaagaaagaaggacaaucuucagaaaagg

SEQ ID NO: 18992 - RNA, 33 nt, Artificial Sequence
  Synthetic Oligonucleotide; PD-L1 exon 3; Set C
uaaaaagaaagaaggacaaucuucagaaaaggg

SEQ ID NO: 18993 - RNA, 19 nt, Artificial Sequence
  Synthetic Oligonucleotide; PD-L1 exon 3; Set C
aaagaaggacaaucuucag

SEQ ID NO: 18994 - RNA, 24 nt, Artificial Sequence
  Synthetic Oligonucleotide; PD-L1 exon 3; Set C
aagaaagaaggacaaucuucagaa

SEQ ID NO: 18995 - RNA, 28 nt, Artificial Sequence
  Synthetic Oligonucleotide; PD-L1 exon 3; Set C
aaaagaaagaaggacaaucuucagaaaa

SEQ ID NO: 18996 - RNA, 26 nt, Artificial Sequence
  Synthetic Oligonucleotide; PD-L1 exon 3; Set C
aaagaaagaaggacaaucuucagaaa

SEQ ID NO: 18997 - RNA, 22 nt, Artificial Sequence
  Synthetic Oligonucleotide; PD-L1 exon 3; Set C
agaaagaaggacaaucuucaga

SEQ ID NO: 18998 - RNA, 30 nt, Artificial Sequence
  Synthetic Oligonucleotide; PD-L1 exon 3; Set C
aaaaagaaagaaggacaaucuucagaaaag

SEQ ID NO: 18999 - RNA, 32 nt, Artificial Sequence
  Synthetic Oligonucleotide; PD-L1 exon 3; Set C
uaaaaagaaagaaggacaaucuucagaaaagg

SEQ ID NO: 19000 - RNA, 18 nt, Artificial Sequence
  Synthetic Oligonucleotide; PD-L1 exon 3; Set C
aaagaaggacaaucuuca

SEQ ID NO: 19001 - RNA, 20 nt, Artificial Sequence
  Synthetic Oligonucleotide; PD-L1 exon 3; Set C
gaaagaaggacaaucuucag

SEQ ID NO: 19002 - RNA, 25 nt, Artificial Sequence
  Synthetic Oligonucleotide; PD-L1 exon 3; Set C
aaagaaagaaggacaaucuucagaa

SEQ ID NO: 19003 - RNA, 29 nt, Artificial Sequence
  Synthetic Oligonucleotide; PD-L1 exon 3; Set C
aaaaagaaagaaggacaaucuucagaaaa

SEQ ID NO: 19004 - RNA, 27 nt, Artificial Sequence
  Synthetic Oligonucleotide; PD-L1 exon 3; Set C
aaaagaaagaaggacaaucuucagaaa

SEQ ID NO: 19005 - RNA, 23 nt, Artificial Sequence
  Synthetic Oligonucleotide; PD-L1 exon 3; Set C
aagaaagaaggacaaucuucaga

SEQ ID NO: 19006 - RNA, 31 nt, Artificial Sequence
  Synthetic Oligonucleotide; PD-L1 exon 3; Set C
uaaaaagaaagaaggacaaucuucagaaaag

SEQ ID NO: 19007 - RNA, 19 nt, Artificial Sequence
  Synthetic Oligonucleotide; PD-L1 exon 3; Set C
gaaagaaggacaaucuuca

SEQ ID NO: 19008 - RNA, 17 nt, Artificial Sequence
  Synthetic Oligonucleotide; PD-L1 exon 3; Set C
aaagaaggacaaucuuc

SEQ ID NO: 19009 - RNA, 21 nt, Artificial Sequence
  Synthetic Oligonucleotide; PD-L1 exon 3; Set C
agaaagaaggacaaucuucag

SEQ ID NO: 19010 - RNA, 26 nt, Artificial Sequence
  Synthetic Oligonucleotide; PD-L1 exon 3; Set C
aaaagaaagaaggacaaucuucagaa

SEQ ID NO: 19011 - RNA, 30 nt, Artificial Sequence
  Synthetic Oligonucleotide; PD-L1 exon 3; Set C
uaaaaagaaagaaggacaaucuucagaaaa

SEQ ID NO: 19012 - RNA, 28 nt, Artificial Sequence
  Synthetic Oligonucleotide; PD-L1 exon 3; Set C
aaaaagaaagaaggacaaucuucagaaa

SEQ ID NO: 19013 - RNA, 24 nt, Artificial Sequence
  Synthetic Oligonucleotide; PD-L1 exon 3; Set C
aaagaaagaaggacaaucuucaga

SEQ ID NO: 19014 - RNA, 20 nt, Artificial Sequence
  Synthetic Oligonucleotide; PD-L1 exon 3; Set C
agaaagaaggacaaucuuca

SEQ ID NO: 19015 - RNA, 18 nt, Artificial Sequence
  Synthetic Oligonucleotide; PD-L1 exon 3; Set C
gaaagaaggacaaucuuc

SEQ ID NO: 19016 - RNA, 22 nt, Artificial Sequence
  Synthetic Oligonucleotide; PD-L1 exon 3; Set C
aagaaagaaggacaaucuucag

SEQ ID NO: 19017 - RNA, 27 nt, Artificial Sequence
  Synthetic Oligonucleotide; PD-L1 exon 3; Set C
aaaaagaaagaaggacaaucuucagaa

SEQ ID NO: 19018 - RNA, 29 nt, Artificial Sequence
  Synthetic Oligonucleotide; PD-L1 exon 3; Set C
uaaaaagaaagaaggacaaucuucagaaa

SEQ ID NO: 19019 - RNA, 25 nt, Artificial Sequence
  Synthetic Oligonucleotide; PD-L1 exon 3; Set C
aaaagaaagaaggacaaucuucaga

SEQ ID NO: 19020 - RNA, 21 nt, Artificial Sequence
  Synthetic Oligonucleotide; PD-L1 exon 3; Set C
aagaaagaaggacaaucuuca

SEQ ID NO: 19021 - RNA, 19 nt, Artificial Sequence
  Synthetic Oligonucleotide; PD-L1 exon 3; Set C
agaaagaaggacaaucuuc

SEQ ID NO: 19022 - RNA, 23 nt, Artificial Sequence
  Synthetic Oligonucleotide; PD-L1 exon 3; Set C
aaagaaagaaggacaaucuucag

SEQ ID NO: 19023 - RNA, 28 nt, Artificial Sequence
  Synthetic Oligonucleotide; PD-L1 exon 3; Set C
uaaaaagaaagaaggacaaucuucagaa

SEQ ID NO: 19024 - RNA, 26 nt, Artificial Sequence
  Synthetic Oligonucleotide; PD-L1 exon 3; Set C
aaaaagaaagaaggacaaucuucaga

SEQ ID NO: 19025 - RNA, 22 nt, Artificial Sequence
  Synthetic Oligonucleotide; PD-L1 exon 3; Set C
aaagaaagaaggacaaucuuca

SEQ ID NO: 19026 - RNA, 20 nt, Artificial Sequence
  Synthetic Oligonucleotide; PD-L1 exon 3; Set C
aagaaagaaggacaaucuuc

SEQ ID NO: 19027 - RNA, 24 nt, Artificial Sequence
  Synthetic Oligonucleotide; PD-L1 exon 3; Set C
aaaagaaagaaggacaaucuucag

SEQ ID NO: 19028 - RNA, 18 nt, Artificial Sequence
  Synthetic Oligonucleotide; PD-L1 exon 3; Set C
agaaagaaggacaaucuu

SEQ ID NO: 19029 - RNA, 27 nt, Artificial Sequence
  Synthetic Oligonucleotide; PD-L1 exon 3; Set C
uaaaaagaaagaaggacaaucuucaga

SEQ ID NO: 19030 - RNA, 23 nt, Artificial Sequence
  Synthetic Oligonucleotide; PD-L1 exon 3; Set C
aaaagaaagaaggacaaucuuca

SEQ ID NO: 19031 - RNA, 21 nt, Artificial Sequence
  Synthetic Oligonucleotide; PD-L1 exon 3; Set C
aaagaaagaaggacaaucuuc

SEQ ID NO: 19032 - RNA, 25 nt, Artificial Sequence
  Synthetic Oligonucleotide; PD-L1 exon 3; Set C
aaaaagaaagaaggacaaucuucag

SEQ ID NO: 19033 - RNA, 19 nt, Artificial Sequence
  Synthetic Oligonucleotide; PD-L1 exon 3; Set C
aagaaagaaggacaaucuu

SEQ ID NO: 19034 - RNA, 24 nt, Artificial Sequence
  Synthetic Oligonucleotide; PD-L1 exon 3; Set C
aaaaagaaagaaggacaaucuuca

SEQ ID NO: 19035 - RNA, 22 nt, Artificial Sequence
  Synthetic Oligonucleotide; PD-L1 exon 3; Set C
aaaagaaagaaggacaaucuuc

SEQ ID NO: 19036 - RNA, 26 nt, Artificial Sequence
  Synthetic Oligonucleotide; PD-L1 exon 3; Set C
uaaaaagaaagaaggacaaucuucag

SEQ ID NO: 19037 - RNA, 20 nt, Artificial Sequence
  Synthetic Oligonucleotide; PD-L1 exon 3; Set C
aaagaaagaaggacaaucuu

SEQ ID NO: 19038 - RNA, 25 nt, Artificial Sequence
  Synthetic Oligonucleotide; PD-L1 exon 3; Set C
uaaaaagaaagaaggacaaucuuca

SEQ ID NO: 19039 - RNA, 23 nt, Artificial Sequence
  Synthetic Oligonucleotide; PD-L1 exon 3; Set C
aaaaagaaagaaggacaaucuuc

SEQ ID NO: 19040 - RNA, 21 nt, Artificial Sequence
  Synthetic Oligonucleotide; PD-L1 exon 3; Set C
aaaagaaagaaggacaaucuu

SEQ ID NO: 19041 - RNA, 24 nt, Artificial Sequence
  Synthetic Oligonucleotide; PD-L1 exon 3; Set C
uaaaaagaaagaaggacaaucuuc

SEQ ID NO: 19042 - RNA, 22 nt, Artificial Sequence
  Synthetic Oligonucleotide; PD-L1 exon 3; Set C
aaaaagaaagaaggacaaucuu

SEQ ID NO: 19043 - RNA, 15 nt, Artificial Sequence
  Synthetic Oligonucleotide; PD-L1 exon 3; Set C
aagaaagaaggacaa

SEQ ID NO: 19044 - RNA, 23 nt, Artificial Sequence
  Synthetic Oligonucleotide; PD-L1 exon 3; Set C
uaaaaagaaagaaggacaaucuu

SEQ ID NO: 19045 - RNA, 16 nt, Artificial Sequence
  Synthetic Oligonucleotide; PD-L1 exon 3; Set C
aaagaaagaaggacaa

SEQ ID NO: 19046 - RNA, 17 nt, Artificial Sequence
  Synthetic Oligonucleotide; PD-L1 exon 3; Set C
aaaagaaagaaggacaa

SEQ ID NO: 19047 - RNA, 15 nt, Artificial Sequence
  Synthetic Oligonucleotide; PD-L1 exon 3; Set C
aaagaaagaaggaca

SEQ ID NO: 19048 - RNA, 18 nt, Artificial Sequence
  Synthetic Oligonucleotide; PD-L1 exon 3; Set C
aaaaagaaagaaggacaa

SEQ ID NO: 19049 - RNA, 16 nt, Artificial Sequence
  Synthetic Oligonucleotide; PD-L1 exon 3; Set C
aaaagaaagaaggaca

SEQ ID NO: 19050 - RNA, 19 nt, Artificial Sequence
  Synthetic Oligonucleotide; PD-L1 exon 3; Set C
uaaaaagaaagaaggacaa

SEQ ID NO: 19051 - RNA, 17 nt, Artificial Sequence
  Synthetic Oligonucleotide; PD-L1 exon 3; Set C
aaaaagaaagaaggaca

SEQ ID NO: 19052 - RNA, 15 nt, Artificial Sequence
  Synthetic Oligonucleotide; PD-L1 exon 3; Set C
aaaagaaagaaggac

SEQ ID NO: 19053 - RNA, 18 nt, Artificial Sequence
  Synthetic Oligonucleotide; PD-L1 exon 3; Set C
uaaaaagaaagaaggaca

SEQ ID NO: 19054 - RNA, 16 nt, Artificial Sequence
  Synthetic Oligonucleotide; PD-L1 exon 3; Set C
aaaaagaaagaaggac

SEQ ID NO: 19055 - RNA, 15 nt, Artificial Sequence
  Synthetic Oligonucleotide; PD-L1 exon 3; Set C
aaaaagaaagaagga

SEQ ID NO: 19056 - RNA, 17 nt, Artificial Sequence
  Synthetic Oligonucleotide; PD-L1 exon 3; Set C
uaaaaagaaagaaggac

SEQ ID NO: 19057 - RNA, 16 nt, Artificial Sequence
  Synthetic Oligonucleotide; PD-L1 exon 3; Set C
uaaaaagaaagaagga

SEQ ID NO: 19058 - RNA, 15 nt, Artificial Sequence
  Synthetic Oligonucleotide; PD-L1 exon 3; Set C
uaaaaagaaagaagg

SEQ ID NO: 19059 - RNA, 15 nt, Artificial Sequence
  Synthetic Oligonucleotide; PD-L1 exon 3; Set C
ucuauaauaauucuu

SEQ ID NO: 19060 - RNA, 17 nt, Artificial Sequence
  Synthetic Oligonucleotide; PD-L1 exon 3; Set C
aauauguuuucaauaaa

SEQ ID NO: 19061 - RNA, 18 nt, Artificial Sequence
  Synthetic Oligonucleotide; PD-L1 exon 3; Set C
gaauauguuuucaauaaa

SEQ ID NO: 19062 - RNA, 16 nt, Artificial Sequence
  Synthetic Oligonucleotide; PD-L1 exon 3; Set C
aauauguuuucaauaa

SEQ ID NO: 19063 - RNA, 19 nt, Artificial Sequence
  Synthetic Oligonucleotide; PD-L1 exon 3; Set C
ggaauauguuuucaauaaa

SEQ ID NO: 19064 - RNA, 17 nt, Artificial Sequence
  Synthetic Oligonucleotide; PD-L1 exon 3; Set C
gaauauguuuucaauaa

SEQ ID NO: 19065 - RNA, 15 nt, Artificial Sequence
  Synthetic Oligonucleotide; PD-L1 exon 3; Set C
aauauguuuucaaua

SEQ ID NO: 19066 - RNA, 18 nt, Artificial Sequence
  Synthetic Oligonucleotide; PD-L1 exon 3; Set C
ggaauauguuuucaauaa

SEQ ID NO: 19067 - RNA, 16 nt, Artificial Sequence
  Synthetic Oligonucleotide; PD-L1 exon 3; Set C
gaauauguuuucaaua

SEQ ID NO: 19068 - RNA, 17 nt, Artificial Sequence
  Synthetic Oligonucleotide; PD-L1 exon 3; Set C
ggaauauguuuucaaua

SEQ ID NO: 19069 - RNA, 15 nt, Artificial Sequence
  Synthetic Oligonucleotide; PD-L1 exon 3; Set C
gaauauguuuucaau

SEQ ID NO: 19070 - RNA, 16 nt, Artificial Sequence
  Synthetic Oligonucleotide; PD-L1 exon 3; Set C
ggaauauguuuucaau

SEQ ID NO: 19071 - RNA, 16 nt, Artificial Sequence
  Synthetic Oligonucleotide; PD-L1 exon 3; Set C
cagaaaagggaaaauu

SEQ ID NO: 19072 - RNA, 19 nt, Artificial Sequence
  Synthetic Oligonucleotide; PD-L1 exon 3; Set C
cuucagaaaagggaaaauu

SEQ ID NO: 19073 - RNA, 20 nt, Artificial Sequence
  Synthetic Oligonucleotide; PD-L1 exon 3; Set C
ucuucagaaaagggaaaauu

SEQ ID NO: 19074 - RNA, 19 nt, Artificial Sequence
  Synthetic Oligonucleotide; PD-L1 exon 3; Set C
ucuucagaaaagggaaaau

SEQ ID NO: 19075 - RNA, 21 nt, Artificial Sequence
  Synthetic Oligonucleotide; PD-L1 exon 3; Set C
aucuucagaaaagggaaaauu

SEQ ID NO: 19076 - RNA, 18 nt, Artificial Sequence
  Synthetic Oligonucleotide; PD-L1 exon 3; Set C
ucuucagaaaagggaaaa

SEQ ID NO: 19077 - RNA, 20 nt, Artificial Sequence
  Synthetic Oligonucleotide; PD-L1 exon 3; Set C
aucuucagaaaagggaaaau

SEQ ID NO: 19078 - RNA, 22 nt, Artificial Sequence
  Synthetic Oligonucleotide; PD-L1 exon 3; Set C
aaucuucagaaaagggaaaauu

SEQ ID NO: 19079 - RNA, 17 nt, Artificial Sequence
  Synthetic Oligonucleotide; PD-L1 exon 3; Set C
ucuucagaaaagggaaa

SEQ ID NO: 19080 - RNA, 19 nt, Artificial Sequence
  Synthetic Oligonucleotide; PD-L1 exon 3; Set C
aucuucagaaaagggaaaa

SEQ ID NO: 19081 - RNA, 21 nt, Artificial Sequence
  Synthetic Oligonucleotide; PD-L1 exon 3; Set C
aaucuucagaaaagggaaaau

SEQ ID NO: 19082 - RNA, 18 nt, Artificial Sequence
  Synthetic Oligonucleotide; PD-L1 exon 3; Set C
aucuucagaaaagggaaa

SEQ ID NO: 19083 - RNA, 20 nt, Artificial Sequence
  Synthetic Oligonucleotide; PD-L1 exon 3; Set C
aaucuucagaaaagggaaaa

SEQ ID NO: 19084 - RNA, 16 nt, Artificial Sequence
  Synthetic Oligonucleotide; PD-L1 exon 3; Set C
ucuucagaaaagggaa

SEQ ID NO: 19085 - RNA, 24 nt, Artificial Sequence
  Synthetic Oligonucleotide; PD-L1 exon 3; Set C
acaaucuucagaaaagggaaaauu

SEQ ID NO: 19086 - RNA, 19 nt, Artificial Sequence
  Synthetic Oligonucleotide; PD-L1 exon 3; Set C
aaucuucagaaaagggaaa

SEQ ID NO: 19087 - RNA, 17 nt, Artificial Sequence
  Synthetic Oligonucleotide; PD-L1 exon 3; Set C
aucuucagaaaagggaa

SEQ ID NO: 19088 - RNA, 15 nt, Artificial Sequence
  Synthetic Oligonucleotide; PD-L1 exon 3; Set C
ucuucagaaaaggga

SEQ ID NO: 19089 - RNA, 25 nt, Artificial Sequence
  Synthetic Oligonucleotide; PD-L1 exon 3; Set C
gacaaucuucagaaaagggaaaauu

SEQ ID NO: 19090 - RNA, 18 nt, Artificial Sequence
  Synthetic Oligonucleotide; PD-L1 exon 3; Set C
aaucuucagaaaagggaa

SEQ ID NO: 19091 - RNA, 16 nt, Artificial Sequence
  Synthetic Oligonucleotide; PD-L1 exon 3; Set C
aucuucagaaaaggga

SEQ ID NO: 19092 - RNA, 26 nt, Artificial Sequence
  Synthetic Oligonucleotide; PD-L1 exon 3; Set C
ggacaaucuucagaaaagggaaaauu

SEQ ID NO: 19093 - RNA, 17 nt, Artificial Sequence
  Synthetic Oligonucleotide; PD-L1 exon 3; Set C
aaucuucagaaaaggga

SEQ ID NO: 19094 - RNA, 15 nt, Artificial Sequence
  Synthetic Oligonucleotide; PD-L1 exon 3; Set C
aucuucagaaaaggg

SEQ ID NO: 19095 - RNA, 27 nt, Artificial Sequence
  Synthetic Oligonucleotide; PD-L1 exon 3; Set C
aggacaaucuucagaaaagggaaaauu

SEQ ID NO: 19096 - RNA, 16 nt, Artificial Sequence
  Synthetic Oligonucleotide; PD-L1 exon 3; Set C
aaucuucagaaaaggg

SEQ ID NO: 19097 - RNA, 28 nt, Artificial Sequence
  Synthetic Oligonucleotide; PD-L1 exon 3; Set C
aaggacaaucuucagaaaagggaaaauu

SEQ ID NO: 19098 - RNA, 15 nt, Artificial Sequence
  Synthetic Oligonucleotide; PD-L1 exon 3; Set C
aaucuucagaaaagg

SEQ ID NO: 19099 - RNA, 29 nt, Artificial Sequence
  Synthetic Oligonucleotide; PD-L1 exon 3; Set C
gaaggacaaucuucagaaaagggaaaauu

SEQ ID NO: 19100 - RNA, 18 nt, Artificial Sequence
  Synthetic Oligonucleotide; PD-L1 exon 3; Set C
acaaucuucagaaaaggg

SEQ ID NO: 19101 - RNA, 30 nt, Artificial Sequence
  Synthetic Oligonucleotide; PD-L1 exon 3; Set C
agaaggacaaucuucagaaaagggaaaauu

SEQ ID NO: 19102 - RNA, 19 nt, Artificial Sequence
  Synthetic Oligonucleotide; PD-L1 exon 3; Set C
gacaaucuucagaaaaggg

SEQ ID NO: 19103 - RNA, 31 nt, Artificial Sequence
  Synthetic Oligonucleotide; PD-L1 exon 3; Set C
aagaaggacaaucuucagaaaagggaaaauu

SEQ ID NO: 19104 - RNA, 20 nt, Artificial Sequence
  Synthetic Oligonucleotide; PD-L1 exon 3; Set C
ggacaaucuucagaaaaggg

SEQ ID NO: 19105 - RNA, 23 nt, Artificial Sequence
  Synthetic Oligonucleotide; PD-L1 exon 3; Set C
aaggacaaucuucagaaaaggga

SEQ ID NO: 19106 - RNA, 21 nt, Artificial Sequence
  Synthetic Oligonucleotide; PD-L1 exon 3; Set C
aggacaaucuucagaaaaggg

SEQ ID NO: 19107 - RNA, 22 nt, Artificial Sequence
  Synthetic Oligonucleotide; PD-L1 exon 3; Set C
aaggacaaucuucagaaaaggg

SEQ ID NO: 19108 - RNA, 23 nt, Artificial Sequence
  Synthetic Oligonucleotide; PD-L1 exon 3; Set C
gaaggacaaucuucagaaaaggg

SEQ ID NO: 19109 - RNA, 15 nt, Artificial Sequence
  Synthetic Oligonucleotide; PD-L1 exon 3; Set C
aaggacaaucuucag

SEQ ID NO: 19110 - RNA, 16 nt, Artificial Sequence
  Synthetic Oligonucleotide; PD-L1 exon 3; Set C
gaaggacaaucuucag

SEQ ID NO: 19111 - RNA, 15 nt, Artificial Sequence
  Synthetic Oligonucleotide; PD-L1 exon 3; Set C
gaaggacaaucuuca

SEQ ID NO: 19112 - RNA, 17 nt, Artificial Sequence
  Synthetic Oligonucleotide; PD-L1 exon 3; Set C
agaaggacaaucuucag

SEQ ID NO: 19113 - RNA, 16 nt, Artificial Sequence
  Synthetic Oligonucleotide; PD-L1 exon 3; Set C
agaaggacaaucuuca

SEQ ID NO: 19114 - RNA, 18 nt, Artificial Sequence
  Synthetic Oligonucleotide; PD-L1 exon 3; Set C
aagaaggacaaucuucag

SEQ ID NO: 19115 - RNA, 17 nt, Artificial Sequence
  Synthetic Oligonucleotide; PD-L1 exon 3; Set C
aagaaggacaaucuuca

SEQ ID NO: 19116 - RNA, 15 nt, Artificial Sequence
  Synthetic Oligonucleotide; PD-L1 exon 3; Set C
agaaggacaaucuuc

SEQ ID NO: 19117 - RNA, 16 nt, Artificial Sequence
  Synthetic Oligonucleotide; PD-L1 exon 3; Set C
aagaaggacaaucuuc

SEQ ID NO: 19118 - RNA, 15 nt, Artificial Sequence
  Synthetic Oligonucleotide; PD-L1 exon 3; Set C
aagaaggacaaucuu

SEQ ID NO: 19119 - RNA, 16 nt, Artificial Sequence
  Synthetic Oligonucleotide; PD-L1 exon 3; Set C
aaagaaggacaaucuu

SEQ ID NO: 19120 - RNA, 17 nt, Artificial Sequence
  Synthetic Oligonucleotide; PD-L1 exon 3; Set C
gaaagaaggacaaucuu

SEQ ID NO: 19121 - RNA, 15 nt, Artificial Sequence
  Synthetic Oligonucleotide; PD-L1 exon 3; Set C
aaagaaggacaaucu

SEQ ID NO: 19122 - RNA, 16 nt, Artificial Sequence
  Synthetic Oligonucleotide; PD-L1 exon 3; Set C
gaaagaaggacaaucu

SEQ ID NO: 19123 - RNA, 17 nt, Artificial Sequence
  Synthetic Oligonucleotide; PD-L1 exon 3; Set C
agaaagaaggacaaucu

SEQ ID NO: 19124 - RNA, 15 nt, Artificial Sequence
  Synthetic Oligonucleotide; PD-L1 exon 3; Set C
gaaagaaggacaauc

SEQ ID NO: 19125 - RNA, 18 nt, Artificial Sequence
  Synthetic Oligonucleotide; PD-L1 exon 3; Set C
aagaaagaaggacaaucu

SEQ ID NO: 19126 - RNA, 16 nt, Artificial Sequence
  Synthetic Oligonucleotide; PD-L1 exon 3; Set C
agaaagaaggacaauc

SEQ ID NO: 19127 - RNA, 19 nt, Artificial Sequence
  Synthetic Oligonucleotide; PD-L1 exon 3; Set C
aaagaaagaaggacaaucu

SEQ ID NO: 19128 - RNA, 15 nt, Artificial Sequence
  Synthetic Oligonucleotide; PD-L1 exon 3; Set C
agaaagaaggacaau

SEQ ID NO: 19129 - RNA, 17 nt, Artificial Sequence
  Synthetic Oligonucleotide; PD-L1 exon 3; Set C
aagaaagaaggacaauc

SEQ ID NO: 19130 - RNA, 20 nt, Artificial Sequence
  Synthetic Oligonucleotide; PD-L1 exon 3; Set C
aaaagaaagaaggacaaucu

SEQ ID NO: 19131 - RNA, 16 nt, Artificial Sequence
  Synthetic Oligonucleotide; PD-L1 exon 3; Set C
aagaaagaaggacaau

SEQ ID NO: 19132 - RNA, 18 nt, Artificial Sequence
  Synthetic Oligonucleotide; PD-L1 exon 3; Set C
aaagaaagaaggacaauc

SEQ ID NO: 19133 - RNA, 21 nt, Artificial Sequence
  Synthetic Oligonucleotide; PD-L1 exon 3; Set C
aaaaagaaagaaggacaaucu

SEQ ID NO: 19134 - RNA, 17 nt, Artificial Sequence
  Synthetic Oligonucleotide; PD-L1 exon 3; Set C
aaagaaagaaggacaau

SEQ ID NO: 19135 - RNA, 19 nt, Artificial Sequence
  Synthetic Oligonucleotide; PD-L1 exon 3; Set C
aaaagaaagaaggacaauc

SEQ ID NO: 19136 - RNA, 22 nt, Artificial Sequence
  Synthetic Oligonucleotide; PD-L1 exon 3; Set C
uaaaaagaaagaaggacaaucu

SEQ ID NO: 19137 - RNA, 18 nt, Artificial Sequence
  Synthetic Oligonucleotide; PD-L1 exon 3; Set C
aaaagaaagaaggacaau

SEQ ID NO: 19138 - RNA, 20 nt, Artificial Sequence
  Synthetic Oligonucleotide; PD-L1 exon 3; Set C
aaaaagaaagaaggacaauc

SEQ ID NO: 19139 - RNA, 19 nt, Artificial Sequence
  Synthetic Oligonucleotide; PD-L1 exon 3; Set C
aaaaagaaagaaggacaau

SEQ ID NO: 19140 - RNA, 21 nt, Artificial Sequence
  Synthetic Oligonucleotide; PD-L1 exon 3; Set C
uaaaaagaaagaaggacaauc

SEQ ID NO: 19141 - RNA, 20 nt, Artificial Sequence
  Synthetic Oligonucleotide; PD-L1 exon 3; Set C
uaaaaagaaagaaggacaau

SEQ ID NO: 19142 - RNA, 21 nt, Artificial Sequence
  Synthetic Oligonucleotide; PD-L1 exon 3; Set C
uuugcauucaauugucauauu

SEQ ID NO: 19143 - RNA, 20 nt, Artificial Sequence
  Synthetic Oligonucleotide; PD-L1 exon 3; Set C
uuugcauucaauugucauau

SEQ ID NO: 19144 - RNA, 15 nt, Artificial Sequence
  Synthetic Oligonucleotide; PD-L1 exon 3; Set C
aauugaauaauguuc

SEQ ID NO: 19145 - RNA, 16 nt, Artificial Sequence
  Synthetic Oligonucleotide; PD-L1 exon 3; Set C
aaauugaauaauguuc

SEQ ID NO: 19146 - RNA, 15 nt, Artificial Sequence
  Synthetic Oligonucleotide; PD-L1 exon 3; Set C
aaauugaauaauguu

SEQ ID NO: 19147 - RNA, 38 nt, Artificial Sequence
  Synthetic Oligonucleotide; PD-L1 exon 3; Set A
ucaggucuuccucuccaugcacaaauugaauaauguuc

SEQ ID NO: 19148 - RNA, 37 nt, Artificial Sequence
  Synthetic Oligonucleotide; PD-L1 exon 3; Set A
ucaggucuuccucuccaugcacaaauugaauaauguu

SEQ ID NO: 19149 - RNA, 36 nt, Artificial Sequence
  Synthetic Oligonucleotide; PD-L1 exon 3; Set A
ucaggucuuccucuccaugcacaaauugaauaaugu

SEQ ID NO: 19150 - RNA, 27 nt, Artificial Sequence
  Synthetic Oligonucleotide; PD-L1 exon 3; Set A
ucaggucuuccucuccaugcacaaauu

SEQ ID NO: 19151 - RNA, 26 nt, Artificial Sequence
  Synthetic Oligonucleotide; PD-L1 exon 3; Set A
ucaggucuuccucuccaugcacaaau

SEQ ID NO: 19152 - RNA, 17 nt, Artificial Sequence
  Synthetic Oligonucleotide; PD-L1 exon 3; Set C
acuaugcugaaccuuca

SEQ ID NO: 19153 - RNA, 18 nt, Artificial Sequence
  Synthetic Oligonucleotide; PD-L1 exon 3; Set C
uacuaugcugaaccuuca

SEQ ID NO: 19154 - RNA, 16 nt, Artificial Sequence
  Synthetic Oligonucleotide; PD-L1 exon 3; Set C
uucgcuuguagucggc

SEQ ID NO: 19155 - RNA, 15 nt, Artificial Sequence
  Synthetic Oligonucleotide; PD-L1 exon 3; Set C
uucgcuuguagucgg

SEQ ID NO: 19156 - RNA, 17 nt, Artificial Sequence
  Synthetic Oligonucleotide; PD-L1 exon 3; Set C
auucgcuuguagucggc

SEQ ID NO: 19157 - RNA, 16 nt, Artificial Sequence
  Synthetic Oligonucleotide; PD-L1 exon 3; Set C
auucgcuuguagucgg

SEQ ID NO: 19158 - RNA, 40 nt, Artificial Sequence
  Synthetic Oligonucleotide; PD-L1 exon 3; Set C
uucuuaccauugacuuucacaguaauucgcuuguagucgg

SEQ ID NO: 19159 - RNA, 27 nt, Artificial Sequence
  Synthetic Oligonucleotide; PD-L1 exon 3; Set C
cuuaccauugacuuucacaguaauucg

SEQ ID NO: 19160 - RNA, 26 nt, Artificial Sequence
  Synthetic Oligonucleotide; PD-L1 exon 3; Set C
cuuaccauugacuuucacaguaauuc

SEQ ID NO: 19161 - RNA, 28 nt, Artificial Sequence
  Synthetic Oligonucleotide; PD-L1 exon 3; Set B
ucuuaccauugacuuucacaguaauucg

SEQ ID NO: 19162 - RNA, 34 nt, Artificial Sequence
  Synthetic Oligonucleotide; PD-L1 exon 3; Set B
aauucuuaccauugacuuucacaguaauucgcuu

SEQ ID NO: 19163 - RNA, 27 nt, Artificial Sequence
  Synthetic Oligonucleotide; PD-L1 exon 3; Set C
ucuuaccauugacuuucacaguaauuc

SEQ ID NO: 19164 - RNA, 25 nt, Artificial Sequence
  Synthetic Oligonucleotide; PD-L1 exon 3; Set C
cuuaccauugacuuucacaguaauu

SEQ ID NO: 19165 - RNA, 29 nt, Artificial Sequence
  Synthetic Oligonucleotide; PD-L1 exon 3; Set B
uucuuaccauugacuuucacaguaauucg

SEQ ID NO: 19166 - RNA, 35 nt, Artificial Sequence
  Synthetic Oligonucleotide; PD-L1 exon 3; Set B
uaauucuuaccauugacuuucacaguaauucgcuu

SEQ ID NO: 19167 - RNA, 28 nt, Artificial Sequence
  Synthetic Oligonucleotide; PD-L1 exon 3; Set C
uucuuaccauugacuuucacaguaauuc

SEQ ID NO: 19168 - RNA, 26 nt, Artificial Sequence
  Synthetic Oligonucleotide; PD-L1 exon 3; Set C
ucuuaccauugacuuucacaguaauu

SEQ ID NO: 19169 - RNA, 30 nt, Artificial Sequence
  Synthetic Oligonucleotide; PD-L1 exon 3; Set B
auucuuaccauugacuuucacaguaauucg

SEQ ID NO: 19170 - RNA, 36 nt, Artificial Sequence
  Synthetic Oligonucleotide; PD-L1 exon 3; Set B
auaauucuuaccauugacuuucacaguaauucgcuu

SEQ ID NO: 19171 - RNA, 34 nt, Artificial Sequence
  Synthetic Oligonucleotide; PD-L1 exon 3; Set B
uaauucuuaccauugacuuucacaguaauucgcu

SEQ ID NO: 19172 - RNA, 29 nt, Artificial Sequence
  Synthetic Oligonucleotide; PD-L1 exon 3; Set C
auucuuaccauugacuuucacaguaauuc

SEQ ID NO: 19173 - RNA, 27 nt, Artificial Sequence
  Synthetic Oligonucleotide; PD-L1 exon 3; Set C
uucuuaccauugacuuucacaguaauu

SEQ ID NO: 19174 - RNA, 31 nt, Artificial Sequence
  Synthetic Oligonucleotide; PD-L1 exon 3; Set B
aauucuuaccauugacuuucacaguaauucg

SEQ ID NO: 19175 - RNA, 37 nt, Artificial Sequence
  Synthetic Oligonucleotide; PD-L1 exon 3; Set B
aauaauucuuaccauugacuuucacaguaauucgcuu

SEQ ID NO: 19176 - RNA, 35 nt, Artificial Sequence
  Synthetic Oligonucleotide; PD-L1 exon 3; Set B
auaauucuuaccauugacuuucacaguaauucgcu

SEQ ID NO: 19177 - RNA, 30 nt, Artificial Sequence
  Synthetic Oligonucleotide; PD-L1 exon 3; Set C
aauucuuaccauugacuuucacaguaauuc

SEQ ID NO: 19178 - RNA, 28 nt, Artificial Sequence
  Synthetic Oligonucleotide; PD-L1 exon 3; Set C
auucuuaccauugacuuucacaguaauu

SEQ ID NO: 19179 - RNA, 32 nt, Artificial Sequence
  Synthetic Oligonucleotide; PD-L1 exon 3; Set B
uaauucuuaccauugacuuucacaguaauucg

SEQ ID NO: 19180 - RNA, 36 nt, Artificial Sequence
  Synthetic Oligonucleotide; PD-L1 exon 3; Set B
aauaauucuuaccauugacuuucacaguaauucgcu

SEQ ID NO: 19181 - RNA, 34 nt, Artificial Sequence
  Synthetic Oligonucleotide; PD-L1 exon 3; Set B
auaauucuuaccauugacuuucacaguaauucgc

SEQ ID NO: 19182 - RNA, 31 nt, Artificial Sequence
  Synthetic Oligonucleotide; PD-L1 exon 3; Set C
uaauucuuaccauugacuuucacaguaauuc

SEQ ID NO: 19183 - RNA, 29 nt, Artificial Sequence
  Synthetic Oligonucleotide; PD-L1 exon 3; Set C
aauucuuaccauugacuuucacaguaauu

SEQ ID NO: 19184 - RNA, 33 nt, Artificial Sequence
  Synthetic Oligonucleotide; PD-L1 exon 3; Set B
auaauucuuaccauugacuuucacaguaauucg

SEQ ID NO: 19185 - RNA, 35 nt, Artificial Sequence
  Synthetic Oligonucleotide; PD-L1 exon 3; Set B
aauaauucuuaccauugacuuucacaguaauucgc

SEQ ID NO: 19186 - RNA, 32 nt, Artificial Sequence
  Synthetic Oligonucleotide; PD-L1 exon 3; Set C
auaauucuuaccauugacuuucacaguaauuc

SEQ ID NO: 19187 - RNA, 30 nt, Artificial Sequence
  Synthetic Oligonucleotide; PD-L1 exon 3; Set C
uaauucuuaccauugacuuucacaguaauu

SEQ ID NO: 19188 - RNA, 34 nt, Artificial Sequence
  Synthetic Oligonucleotide; PD-L1 exon 3; Set B
aauaauucuuaccauugacuuucacaguaauucg

SEQ ID NO: 19189 - RNA, 33 nt, Artificial Sequence
  Synthetic Oligonucleotide; PD-L1 exon 3; Set C
aauaauucuuaccauugacuuucacaguaauuc

SEQ ID NO: 19190 - RNA, 31 nt, Artificial Sequence
  Synthetic Oligonucleotide; PD-L1 exon 3; Set C
auaauucuuaccauugacuuucacaguaauu

SEQ ID NO: 19191 - RNA, 35 nt, Artificial Sequence
  Synthetic Oligonucleotide; PD-L1 exon 3; Set B
uaauaauucuuaccauugacuuucacaguaauucg

SEQ ID NO: 19192 - RNA, 34 nt, Artificial Sequence
  Synthetic Oligonucleotide; PD-L1 exon 3; Set C
uaauaauucuuaccauugacuuucacaguaauuc

SEQ ID NO: 19193 - RNA, 32 nt, Artificial Sequence
  Synthetic Oligonucleotide; PD-L1 exon 3; Set C
aauaauucuuaccauugacuuucacaguaauu

SEQ ID NO: 19194 - RNA, 36 nt, Artificial Sequence
  Synthetic Oligonucleotide; PD-L1 exon 3; Set B
auaauaauucuuaccauugacuuucacaguaauucg

SEQ ID NO: 19195 - RNA, 35 nt, Artificial Sequence
  Synthetic Oligonucleotide; PD-L1 exon 3; Set C
auaauaauucuuaccauugacuuucacaguaauuc

SEQ ID NO: 19196 - RNA, 33 nt, Artificial Sequence
  Synthetic Oligonucleotide; PD-L1 exon 3; Set C
uaauaauucuuaccauugacuuucacaguaauu

SEQ ID NO: 19197 - RNA, 37 nt, Artificial Sequence
  Synthetic Oligonucleotide; PD-L1 exon 3; Set B
uauaauaauucuuaccauugacuuucacaguaauucg

SEQ ID NO: 19198 - RNA, 36 nt, Artificial Sequence
  Synthetic Oligonucleotide; PD-L1 exon 3; Set C
uauaauaauucuuaccauugacuuucacaguaauuc

SEQ ID NO: 19199 - RNA, 34 nt, Artificial Sequence
  Synthetic Oligonucleotide; PD-L1 exon 3; Set C
auaauaauucuuaccauugacuuucacaguaauu

SEQ ID NO: 19200 - RNA, 38 nt, Artificial Sequence
  Synthetic Oligonucleotide; PD-L1 exon 3; Set B
cuauaauaauucuuaccauugacuuucacaguaauucg

SEQ ID NO: 19201 - RNA, 40 nt, Artificial Sequence
  Synthetic Oligonucleotide; PD-L1 exon 3; Set B
ucuauaauaauucuuaccauugacuuucacaguaauucgc

SEQ ID NO: 19202 - RNA, 37 nt, Artificial Sequence
  Synthetic Oligonucleotide; PD-L1 exon 3; Set B
cuauaauaauucuuaccauugacuuucacaguaauuc

SEQ ID NO: 19203 - RNA, 35 nt, Artificial Sequence
  Synthetic Oligonucleotide; PD-L1 exon 3; Set C
uauaauaauucuuaccauugacuuucacaguaauu

SEQ ID NO: 19204 - RNA, 39 nt, Artificial Sequence
  Synthetic Oligonucleotide; PD-L1 exon 3; Set B
ucuauaauaauucuuaccauugacuuucacaguaauucg

SEQ ID NO: 19205 - RNA, 38 nt, Artificial Sequence
  Synthetic Oligonucleotide; PD-L1 exon 3; Set B
ucuauaauaauucuuaccauugacuuucacaguaauuc

SEQ ID NO: 19206 - RNA, 36 nt, Artificial Sequence
  Synthetic Oligonucleotide; PD-L1 exon 3; Set B
cuauaauaauucuuaccauugacuuucacaguaauu

SEQ ID NO: 19207 - RNA, 16 nt, Artificial Sequence
  Synthetic Oligonucleotide; PD-L1 exon 3; Set C
ucuuaccauugacuuu

SEQ ID NO: 19208 - RNA, 37 nt, Artificial Sequence
  Synthetic Oligonucleotide; PD-L1 exon 3; Set B
ucuauaauaauucuuaccauugacuuucacaguaauu

SEQ ID NO: 19209 - RNA, 17 nt, Artificial Sequence
  Synthetic Oligonucleotide; PD-L1 exon 3; Set C
uucuuaccauugacuuu

SEQ ID NO: 19210 - RNA, 18 nt, Artificial Sequence
  Synthetic Oligonucleotide; PD-L1 exon 3; Set C
auucuuaccauugacuuu

SEQ ID NO: 19211 - RNA, 16 nt, Artificial Sequence
  Synthetic Oligonucleotide; PD-L1 exon 3; Set C
uucuuaccauugacuu

SEQ ID NO: 19212 - RNA, 19 nt, Artificial Sequence
  Synthetic Oligonucleotide; PD-L1 exon 3; Set C
aauucuuaccauugacuuu

SEQ ID NO: 19213 - RNA, 17 nt, Artificial Sequence
  Synthetic Oligonucleotide; PD-L1 exon 3; Set C
auucuuaccauugacuu

SEQ ID NO: 19214 - RNA, 20 nt, Artificial Sequence
  Synthetic Oligonucleotide; PD-L1 exon 3; Set C
uaauucuuaccauugacuuu

SEQ ID NO: 19215 - RNA, 18 nt, Artificial Sequence
  Synthetic Oligonucleotide; PD-L1 exon 3; Set C
aauucuuaccauugacuu

SEQ ID NO: 19216 - RNA, 21 nt, Artificial Sequence
  Synthetic Oligonucleotide; PD-L1 exon 3; Set C
auaauucuuaccauugacuuu

SEQ ID NO: 19217 - RNA, 19 nt, Artificial Sequence
  Synthetic Oligonucleotide; PD-L1 exon 3; Set C
uaauucuuaccauugacuu

SEQ ID NO: 19218 - RNA, 22 nt, Artificial Sequence
  Synthetic Oligonucleotide; PD-L1 exon 3; Set C
aauaauucuuaccauugacuuu

SEQ ID NO: 19219 - RNA, 20 nt, Artificial Sequence
  Synthetic Oligonucleotide; PD-L1 exon 3; Set C
auaauucuuaccauugacuu

SEQ ID NO: 19220 - RNA, 23 nt, Artificial Sequence
  Synthetic Oligonucleotide; PD-L1 exon 3; Set C
uaauaauucuuaccauugacuuu

SEQ ID NO: 19221 - RNA, 21 nt, Artificial Sequence
  Synthetic Oligonucleotide; PD-L1 exon 3; Set C
aauaauucuuaccauugacuu

SEQ ID NO: 19222 - RNA, 24 nt, Artificial Sequence
  Synthetic Oligonucleotide; PD-L1 exon 3; Set C
auaauaauucuuaccauugacuuu

SEQ ID NO: 19223 - RNA, 22 nt, Artificial Sequence
  Synthetic Oligonucleotide; PD-L1 exon 3; Set C
uaauaauucuuaccauugacuu

SEQ ID NO: 19224 - RNA, 25 nt, Artificial Sequence
  Synthetic Oligonucleotide; PD-L1 exon 3; Set C
uauaauaauucuuaccauugacuuu

SEQ ID NO: 19225 - RNA, 23 nt, Artificial Sequence
  Synthetic Oligonucleotide; PD-L1 exon 3; Set C
auaauaauucuuaccauugacuu

SEQ ID NO: 19226 - RNA, 26 nt, Artificial Sequence
  Synthetic Oligonucleotide; PD-L1 exon 3; Set C
cuauaauaauucuuaccauugacuuu

SEQ ID NO: 19227 - RNA, 24 nt, Artificial Sequence
  Synthetic Oligonucleotide; PD-L1 exon 3; Set C
uauaauaauucuuaccauugacuu

SEQ ID NO: 19228 - RNA, 27 nt, Artificial Sequence
  Synthetic Oligonucleotide; PD-L1 exon 3; Set C
ucuauaauaauucuuaccauugacuuu

SEQ ID NO: 19229 - RNA, 25 nt, Artificial Sequence
  Synthetic Oligonucleotide; PD-L1 exon 3; Set C
cuauaauaauucuuaccauugacuu

SEQ ID NO: 19230 - RNA, 26 nt, Artificial Sequence
  Synthetic Oligonucleotide; PD-L1 exon 3; Set C
ucuauaauaauucuuaccauugacuu

SEQ ID NO: 19231 - RNA, 15 nt, Artificial Sequence
  Synthetic Oligonucleotide; PD-L1 exon 3; Set C
cuauaauaauucuua

SEQ ID NO: 19232 - RNA, 16 nt, Artificial Sequence
  Synthetic Oligonucleotide; PD-L1 exon 3; Set C
ucuauaauaauucuua

SEQ ID NO: 19233 - RNA, 32 nt, Artificial Sequence
  Synthetic Oligonucleotide; PD-L1 exon 3; Set C
aaagaucaggccucucaucuauaauaauucuu

SEQ ID NO: 19234 - RNA, 31 nt, Artificial Sequence
  Synthetic Oligonucleotide; PD-L1 exon 3; Set C
aaagaucaggccucucaucuauaauaauucu

SEQ ID NO: 19235 - RNA, 33 nt, Artificial Sequence
  Synthetic Oligonucleotide; PD-L1 exon 3; Set B
uaaagaucaggccucucaucuauaauaauucuu

SEQ ID NO: 19236 - RNA, 30 nt, Artificial Sequence
  Synthetic Oligonucleotide; PD-L1 exon 3; Set C
aaagaucaggccucucaucuauaauaauuc

SEQ ID NO: 19237 - RNA, 32 nt, Artificial Sequence
  Synthetic Oligonucleotide; PD-L1 exon 3; Set C
uaaagaucaggccucucaucuauaauaauucu

SEQ ID NO: 19238 - RNA, 34 nt, Artificial Sequence
  Synthetic Oligonucleotide; PD-L1 exon 3; Set B
auaaagaucaggccucucaucuauaauaauucuu

SEQ ID NO: 19239 - RNA, 29 nt, Artificial Sequence
  Synthetic Oligonucleotide; PD-L1 exon 3; Set C
aaagaucaggccucucaucuauaauaauu

SEQ ID NO: 19240 - RNA, 31 nt, Artificial Sequence
  Synthetic Oligonucleotide; PD-L1 exon 3; Set C
uaaagaucaggccucucaucuauaauaauuc

SEQ ID NO: 19241 - RNA, 33 nt, Artificial Sequence
  Synthetic Oligonucleotide; PD-L1 exon 3; Set C
auaaagaucaggccucucaucuauaauaauucu

SEQ ID NO: 19242 - RNA, 35 nt, Artificial Sequence
  Synthetic Oligonucleotide; PD-L1 exon 3; Set C
aauaaagaucaggccucucaucuauaauaauucuu

SEQ ID NO: 19243 - RNA, 28 nt, Artificial Sequence
  Synthetic Oligonucleotide; PD-L1 exon 3; Set C
aaagaucaggccucucaucuauaauaau

SEQ ID NO: 19244 - RNA, 30 nt, Artificial Sequence
  Synthetic Oligonucleotide; PD-L1 exon 3; Set C
uaaagaucaggccucucaucuauaauaauu

SEQ ID NO: 19245 - RNA, 32 nt, Artificial Sequence
  Synthetic Oligonucleotide; PD-L1 exon 3; Set C
auaaagaucaggccucucaucuauaauaauuc

SEQ ID NO: 19246 - RNA, 34 nt, Artificial Sequence
  Synthetic Oligonucleotide; PD-L1 exon 3; Set C
aauaaagaucaggccucucaucuauaauaauucu

SEQ ID NO: 19247 - RNA, 27 nt, Artificial Sequence
  Synthetic Oligonucleotide; PD-L1 exon 3; Set C
aaagaucaggccucucaucuauaauaa

SEQ ID NO: 19248 - RNA, 29 nt, Artificial Sequence
  Synthetic Oligonucleotide; PD-L1 exon 3; Set C
uaaagaucaggccucucaucuauaauaau

SEQ ID NO: 19249 - RNA, 31 nt, Artificial Sequence
  Synthetic Oligonucleotide; PD-L1 exon 3; Set C
auaaagaucaggccucucaucuauaauaauu

SEQ ID NO: 19250 - RNA, 33 nt, Artificial Sequence
  Synthetic Oligonucleotide; PD-L1 exon 3; Set C
aauaaagaucaggccucucaucuauaauaauuc

SEQ ID NO: 19251 - RNA, 26 nt, Artificial Sequence
  Synthetic Oligonucleotide; PD-L1 exon 3; Set C
aaagaucaggccucucaucuauaaua

SEQ ID NO: 19252 - RNA, 28 nt, Artificial Sequence
  Synthetic Oligonucleotide; PD-L1 exon 3; Set C
uaaagaucaggccucucaucuauaauaa

SEQ ID NO: 19253 - RNA, 30 nt, Artificial Sequence
  Synthetic Oligonucleotide; PD-L1 exon 3; Set C
auaaagaucaggccucucaucuauaauaau

SEQ ID NO: 19254 - RNA, 32 nt, Artificial Sequence
  Synthetic Oligonucleotide; PD-L1 exon 3; Set C
aauaaagaucaggccucucaucuauaauaauu

SEQ ID NO: 19255 - RNA, 25 nt, Artificial Sequence
  Synthetic Oligonucleotide; PD-L1 exon 3; Set C
aaagaucaggccucucaucuauaau

SEQ ID NO: 19256 - RNA, 27 nt, Artificial Sequence
  Synthetic Oligonucleotide; PD-L1 exon 3; Set C
uaaagaucaggccucucaucuauaaua

SEQ ID NO: 19257 - RNA, 29 nt, Artificial Sequence
  Synthetic Oligonucleotide; PD-L1 exon 3; Set C
auaaagaucaggccucucaucuauaauaa

SEQ ID NO: 19258 - RNA, 31 nt, Artificial Sequence
  Synthetic Oligonucleotide; PD-L1 exon 3; Set C
aauaaagaucaggccucucaucuauaauaau

SEQ ID NO: 19259 - RNA, 26 nt, Artificial Sequence
  Synthetic Oligonucleotide; PD-L1 exon 3; Set C
uaaagaucaggccucucaucuauaau

SEQ ID NO: 19260 - RNA, 28 nt, Artificial Sequence
  Synthetic Oligonucleotide; PD-L1 exon 3; Set C
auaaagaucaggccucucaucuauaaua

SEQ ID NO: 19261 - RNA, 30 nt, Artificial Sequence
  Synthetic Oligonucleotide; PD-L1 exon 3; Set C
aauaaagaucaggccucucaucuauaauaa

SEQ ID NO: 19262 - RNA, 27 nt, Artificial Sequence
  Synthetic Oligonucleotide; PD-L1 exon 3; Set C
auaaagaucaggccucucaucuauaau

SEQ ID NO: 19263 - RNA, 29 nt, Artificial Sequence
  Synthetic Oligonucleotide; PD-L1 exon 3; Set C
aauaaagaucaggccucucaucuauaaua

SEQ ID NO: 19264 - RNA, 28 nt, Artificial Sequence
  Synthetic Oligonucleotide; PD-L1 exon 3; Set C
aauaaagaucaggccucucaucuauaau

SEQ ID NO: 19265 - RNA, 26 nt, Artificial Sequence
  Synthetic Oligonucleotide; PD-L1 exon 3; Set C
auaaagaucaggccucucaucuauaa

SEQ ID NO: 19266 - RNA, 20 nt, Artificial Sequence
  Synthetic Oligonucleotide; PD-L1 exon 3; Set C
aaagaucaggccucucaucu

SEQ ID NO: 19267 - RNA, 21 nt, Artificial Sequence
  Synthetic Oligonucleotide; PD-L1 exon 3; Set C
uaaagaucaggccucucaucu

SEQ ID NO: 19268 - RNA, 22 nt, Artificial Sequence
  Synthetic Oligonucleotide; PD-L1 exon 3; Set C
auaaagaucaggccucucaucu

SEQ ID NO: 19269 - RNA, 40 nt, Artificial Sequence
  Synthetic Oligonucleotide; PD-L1 exon 3; Set B
auguuuucaauaaagaucaggccucucaucuauaauaauu

SEQ ID NO: 19270 - RNA, 39 nt, Artificial Sequence
  Synthetic Oligonucleotide; PD-L1 exon 3; Set B
auguuuucaauaaagaucaggccucucaucuauaauaau

SEQ ID NO: 19271 - RNA, 23 nt, Artificial Sequence
  Synthetic Oligonucleotide; PD-L1 exon 3; Set C
aauaaagaucaggccucucaucu

SEQ ID NO: 19272 - RNA, 40 nt, Artificial Sequence
  Synthetic Oligonucleotide; PD-L1 exon 3; Set B
uauguuuucaauaaagaucaggccucucaucuauaauaau

SEQ ID NO: 19273 - RNA, 38 nt, Artificial Sequence
  Synthetic Oligonucleotide; PD-L1 exon 3; Set B
auguuuucaauaaagaucaggccucucaucuauaauaa

SEQ ID NO: 19274 - RNA, 39 nt, Artificial Sequence
  Synthetic Oligonucleotide; PD-L1 exon 3; Set B
uauguuuucaauaaagaucaggccucucaucuauaauaa

SEQ ID NO: 19275 - RNA, 37 nt, Artificial Sequence
  Synthetic Oligonucleotide; PD-L1 exon 3; Set B
auguuuucaauaaagaucaggccucucaucuauaaua

SEQ ID NO: 19276 - RNA, 40 nt, Artificial Sequence
  Synthetic Oligonucleotide; PD-L1 exon 3; Set B
auauguuuucaauaaagaucaggccucucaucuauaauaa

SEQ ID NO: 19277 - RNA, 38 nt, Artificial Sequence
  Synthetic Oligonucleotide; PD-L1 exon 3; Set B
uauguuuucaauaaagaucaggccucucaucuauaaua

SEQ ID NO: 19278 - RNA, 36 nt, Artificial Sequence
  Synthetic Oligonucleotide; PD-L1 exon 3; Set B
auguuuucaauaaagaucaggccucucaucuauaau

SEQ ID NO: 19279 - RNA, 39 nt, Artificial Sequence
  Synthetic Oligonucleotide; PD-L1 exon 3; Set B
auauguuuucaauaaagaucaggccucucaucuauaaua

SEQ ID NO: 19280 - RNA, 37 nt, Artificial Sequence
  Synthetic Oligonucleotide; PD-L1 exon 3; Set B
uauguuuucaauaaagaucaggccucucaucuauaau

SEQ ID NO: 19281 - RNA, 40 nt, Artificial Sequence
  Synthetic Oligonucleotide; PD-L1 exon 3; Set B
aauauguuuucaauaaagaucaggccucucaucuauaaua

SEQ ID NO: 19282 - RNA, 38 nt, Artificial Sequence
  Synthetic Oligonucleotide; PD-L1 exon 3; Set B
auauguuuucaauaaagaucaggccucucaucuauaau

SEQ ID NO: 19283 - RNA, 39 nt, Artificial Sequence
  Synthetic Oligonucleotide; PD-L1 exon 3; Set B
aauauguuuucaauaaagaucaggccucucaucuauaau

SEQ ID NO: 19284 - RNA, 40 nt, Artificial Sequence
  Synthetic Oligonucleotide; PD-L1 exon 3; Set B
gaauauguuuucaauaaagaucaggccucucaucuauaau

SEQ ID NO: 19285 - RNA, 38 nt, Artificial Sequence
  Synthetic Oligonucleotide; PD-L1 exon 3; Set B
aauauguuuucaauaaagaucaggccucucaucuauaa

SEQ ID NO: 19286 - RNA, 39 nt, Artificial Sequence
  Synthetic Oligonucleotide; PD-L1 exon 3; Set B
gaauauguuuucaauaaagaucaggccucucaucuauaa

SEQ ID NO: 19287 - RNA, 37 nt, Artificial Sequence
  Synthetic Oligonucleotide; PD-L1 exon 3; Set B
aauauguuuucaauaaagaucaggccucucaucuaua

SEQ ID NO: 19288 - RNA, 40 nt, Artificial Sequence
  Synthetic Oligonucleotide; PD-L1 exon 3; Set B
ggaauauguuuucaauaaagaucaggccucucaucuauaa

SEQ ID NO: 19289 - RNA, 36 nt, Artificial Sequence
  Synthetic Oligonucleotide; PD-L1 exon 3; Set B
aauauguuuucaauaaagaucaggccucucaucuau

SEQ ID NO: 19290 - RNA, 38 nt, Artificial Sequence
  Synthetic Oligonucleotide; PD-L1 exon 3; Set B
gaauauguuuucaauaaagaucaggccucucaucuaua

SEQ ID NO: 19291 - RNA, 37 nt, Artificial Sequence
  Synthetic Oligonucleotide; PD-L1 exon 3; Set B
gaauauguuuucaauaaagaucaggccucucaucuau

SEQ ID NO: 19292 - RNA, 39 nt, Artificial Sequence
  Synthetic Oligonucleotide; PD-L1 exon 3; Set B
ggaauauguuuucaauaaagaucaggccucucaucuaua

SEQ ID NO: 19293 - RNA, 35 nt, Artificial Sequence
  Synthetic Oligonucleotide; PD-L1 exon 3; Set B
aauauguuuucaauaaagaucaggccucucaucua

SEQ ID NO: 19294 - RNA, 34 nt, Artificial Sequence
  Synthetic Oligonucleotide; PD-L1 exon 3; Set B
aauauguuuucaauaaagaucaggccucucaucu

SEQ ID NO: 19295 - RNA, 38 nt, Artificial Sequence
  Synthetic Oligonucleotide; PD-L1 exon 3; Set B
ggaauauguuuucaauaaagaucaggccucucaucuau

SEQ ID NO: 19296 - RNA, 36 nt, Artificial Sequence
  Synthetic Oligonucleotide; PD-L1 exon 3; Set B
gaauauguuuucaauaaagaucaggccucucaucua

SEQ ID NO: 19297 - RNA, 35 nt, Artificial Sequence
  Synthetic Oligonucleotide; PD-L1 exon 3; Set B
gaauauguuuucaauaaagaucaggccucucaucu

SEQ ID NO: 19298 - RNA, 37 nt, Artificial Sequence
  Synthetic Oligonucleotide; PD-L1 exon 3; Set B
ggaauauguuuucaauaaagaucaggccucucaucua

SEQ ID NO: 19299 - RNA, 36 nt, Artificial Sequence
  Synthetic Oligonucleotide; PD-L1 exon 3; Set B
ggaauauguuuucaauaaagaucaggccucucaucu

SEQ ID NO: 19300 - RNA, 15 nt, Artificial Sequence
  Synthetic Oligonucleotide; PD-L1 exon 3; Set C
uauguuuucaauaaa

SEQ ID NO: 19301 - RNA, 16 nt, Artificial Sequence
  Synthetic Oligonucleotide; PD-L1 exon 3; Set C
auauguuuucaauaaa

SEQ ID NO: 19302 - RNA, 15 nt, Artificial Sequence
  Synthetic Oligonucleotide; PD-L1 exon 3; Set C
auauguuuucaauaa

SEQ ID NO: 19303 - RNA, 40 nt, Artificial Sequence
  Synthetic Oligonucleotide; PD-L1 exon 3; Set C
caguaaaugcuaaaaagaaagaaggacaaucuucagaaaa

SEQ ID NO: 19304 - RNA, 39 nt, Artificial Sequence
  Synthetic Oligonucleotide; PD-L1 exon 3; Set C
caguaaaugcuaaaaagaaagaaggacaaucuucagaaa

SEQ ID NO: 19305 - RNA, 38 nt, Artificial Sequence
  Synthetic Oligonucleotide; PD-L1 exon 3; Set C
caguaaaugcuaaaaagaaagaaggacaaucuucagaa

SEQ ID NO: 19306 - RNA, 40 nt, Artificial Sequence
  Synthetic Oligonucleotide; PD-L1 exon 3; Set C
acaguaaaugcuaaaaagaaagaaggacaaucuucagaaa

SEQ ID NO: 19307 - RNA, 39 nt, Artificial Sequence
  Synthetic Oligonucleotide; PD-L1 exon 3; Set C
acaguaaaugcuaaaaagaaagaaggacaaucuucagaa

SEQ ID NO: 19308 - RNA, 37 nt, Artificial Sequence
  Synthetic Oligonucleotide; PD-L1 exon 3; Set C
caguaaaugcuaaaaagaaagaaggacaaucuucaga

SEQ ID NO: 19309 - RNA, 40 nt, Artificial Sequence
  Synthetic Oligonucleotide; PD-L1 exon 3; Set A
gacaguaaaugcuaaaaagaaagaaggacaaucuucagaa

SEQ ID NO: 19310 - RNA, 38 nt, Artificial Sequence
  Synthetic Oligonucleotide; PD-L1 exon 3; Set C
acaguaaaugcuaaaaagaaagaaggacaaucuucaga

SEQ ID NO: 19311 - RNA, 36 nt, Artificial Sequence
  Synthetic Oligonucleotide; PD-L1 exon 3; Set C
caguaaaugcuaaaaagaaagaaggacaaucuucag

SEQ ID NO: 19312 - RNA, 39 nt, Artificial Sequence
  Synthetic Oligonucleotide; PD-L1 exon 3; Set A
gacaguaaaugcuaaaaagaaagaaggacaaucuucaga

SEQ ID NO: 19313 - RNA, 35 nt, Artificial Sequence
  Synthetic Oligonucleotide; PD-L1 exon 3; Set C
caguaaaugcuaaaaagaaagaaggacaaucuuca

SEQ ID NO: 19314 - RNA, 37 nt, Artificial Sequence
  Synthetic Oligonucleotide; PD-L1 exon 3; Set C
acaguaaaugcuaaaaagaaagaaggacaaucuucag

SEQ ID NO: 19315 - RNA, 40 nt, Artificial Sequence
  Synthetic Oligonucleotide; PD-L1 exon 3; Set A
ugacaguaaaugcuaaaaagaaagaaggacaaucuucaga

SEQ ID NO: 19316 - RNA, 36 nt, Artificial Sequence
  Synthetic Oligonucleotide; PD-L1 exon 3; Set C
acaguaaaugcuaaaaagaaagaaggacaaucuuca

SEQ ID NO: 19317 - RNA, 34 nt, Artificial Sequence
  Synthetic Oligonucleotide; PD-L1 exon 3; Set C
caguaaaugcuaaaaagaaagaaggacaaucuuc

SEQ ID NO: 19318 - RNA, 38 nt, Artificial Sequence
  Synthetic Oligonucleotide; PD-L1 exon 3; Set C
gacaguaaaugcuaaaaagaaagaaggacaaucuucag

SEQ ID NO: 19319 - RNA, 37 nt, Artificial Sequence
  Synthetic Oligonucleotide; PD-L1 exon 3; Set C
gacaguaaaugcuaaaaagaaagaaggacaaucuuca

SEQ ID NO: 19320 - RNA, 35 nt, Artificial Sequence
  Synthetic Oligonucleotide; PD-L1 exon 3; Set C
acaguaaaugcuaaaaagaaagaaggacaaucuuc

SEQ ID NO: 19321 - RNA, 39 nt, Artificial Sequence
  Synthetic Oligonucleotide; PD-L1 exon 3; Set A
ugacaguaaaugcuaaaaagaaagaaggacaaucuucag

SEQ ID NO: 19322 - RNA, 38 nt, Artificial Sequence
  Synthetic Oligonucleotide; PD-L1 exon 3; Set A
ugacaguaaaugcuaaaaagaaagaaggacaaucuuca

SEQ ID NO: 19323 - RNA, 36 nt, Artificial Sequence
  Synthetic Oligonucleotide; PD-L1 exon 3; Set C
gacaguaaaugcuaaaaagaaagaaggacaaucuuc

SEQ ID NO: 19324 - RNA, 40 nt, Artificial Sequence
  Synthetic Oligonucleotide; PD-L1 exon 3; Set A
gugacaguaaaugcuaaaaagaaagaaggacaaucuucag

SEQ ID NO: 19325 - RNA, 34 nt, Artificial Sequence
  Synthetic Oligonucleotide; PD-L1 exon 3; Set C
acaguaaaugcuaaaaagaaagaaggacaaucuu

SEQ ID NO: 19326 - RNA, 39 nt, Artificial Sequence
  Synthetic Oligonucleotide; PD-L1 exon 3; Set A
gugacaguaaaugcuaaaaagaaagaaggacaaucuuca

SEQ ID NO: 19327 - RNA, 37 nt, Artificial Sequence
  Synthetic Oligonucleotide; PD-L1 exon 3; Set C
ugacaguaaaugcuaaaaagaaagaaggacaaucuuc

SEQ ID NO: 19328 - RNA, 35 nt, Artificial Sequence
  Synthetic Oligonucleotide; PD-L1 exon 3; Set C
gacaguaaaugcuaaaaagaaagaaggacaaucuu

SEQ ID NO: 19329 - RNA, 40 nt, Artificial Sequence
  Synthetic Oligonucleotide; PD-L1 exon 3; Set A
cgugacaguaaaugcuaaaaagaaagaaggacaaucuuca

SEQ ID NO: 19330 - RNA, 38 nt, Artificial Sequence
  Synthetic Oligonucleotide; PD-L1 exon 3; Set A
gugacaguaaaugcuaaaaagaaagaaggacaaucuuc

SEQ ID NO: 19331 - RNA, 36 nt, Artificial Sequence
  Synthetic Oligonucleotide; PD-L1 exon 3; Set C
ugacaguaaaugcuaaaaagaaagaaggacaaucuu

SEQ ID NO: 19332 - RNA, 39 nt, Artificial Sequence
  Synthetic Oligonucleotide; PD-L1 exon 3; Set A
cgugacaguaaaugcuaaaaagaaagaaggacaaucuuc

SEQ ID NO: 19333 - RNA, 37 nt, Artificial Sequence
  Synthetic Oligonucleotide; PD-L1 exon 3; Set C
gugacaguaaaugcuaaaaagaaagaaggacaaucuu

SEQ ID NO: 19334 - RNA, 30 nt, Artificial Sequence
  Synthetic Oligonucleotide; PD-L1 exon 3; Set C
acaguaaaugcuaaaaagaaagaaggacaa

SEQ ID NO: 19335 - RNA, 38 nt, Artificial Sequence
  Synthetic Oligonucleotide; PD-L1 exon 3; Set A
cgugacaguaaaugcuaaaaagaaagaaggacaaucuu

SEQ ID NO: 19336 - RNA, 36 nt, Artificial Sequence
  Synthetic Oligonucleotide; PD-L1 exon 3; Set C
gugacaguaaaugcuaaaaagaaagaaggacaaucu

SEQ ID NO: 19337 - RNA, 31 nt, Artificial Sequence
  Synthetic Oligonucleotide; PD-L1 exon 3; Set C
gacaguaaaugcuaaaaagaaagaaggacaa

SEQ ID NO: 19338 - RNA, 32 nt, Artificial Sequence
  Synthetic Oligonucleotide; PD-L1 exon 3; Set C
ugacaguaaaugcuaaaaagaaagaaggacaa

SEQ ID NO: 19339 - RNA, 33 nt, Artificial Sequence
  Synthetic Oligonucleotide; PD-L1 exon 3; Set C
gugacaguaaaugcuaaaaagaaagaaggacaa

SEQ ID NO: 19340 - RNA, 31 nt, Artificial Sequence
  Synthetic Oligonucleotide; PD-L1 exon 3; Set C
ugacaguaaaugcuaaaaagaaagaaggaca

SEQ ID NO: 19341 - RNA, 34 nt, Artificial Sequence
  Synthetic Oligonucleotide; PD-L1 exon 3; Set C
cgugacaguaaaugcuaaaaagaaagaaggacaa

SEQ ID NO: 19342 - RNA, 32 nt, Artificial Sequence
  Synthetic Oligonucleotide; PD-L1 exon 3; Set C
gugacaguaaaugcuaaaaagaaagaaggaca

SEQ ID NO: 19343 - RNA, 30 nt, Artificial Sequence
  Synthetic Oligonucleotide; PD-L1 exon 3; Set C
ugacaguaaaugcuaaaaagaaagaaggac

SEQ ID NO: 19344 - RNA, 31 nt, Artificial Sequence
  Synthetic Oligonucleotide; PD-L1 exon 3; Set C
gugacaguaaaugcuaaaaagaaagaaggac

SEQ ID NO: 19345 - RNA, 30 nt, Artificial Sequence
  Synthetic Oligonucleotide; PD-L1 exon 3; Set C
gugacaguaaaugcuaaaaagaaagaagga

SEQ ID NO: 19346 - RNA, 29 nt, Artificial Sequence
  Synthetic Oligonucleotide; PD-L1 exon 3; Set C
gugacaguaaaugcuaaaaagaaagaagg

SEQ ID NO: 19347 - RNA, 28 nt, Artificial Sequence
  Synthetic Oligonucleotide; PD-L1 exon 3; Set C
gugacaguaaaugcuaaaaagaaagaag

SEQ ID NO: 19348 - RNA, 40 nt, Artificial Sequence
  Synthetic Oligonucleotide; PD-L1 exon 3; Set A
gggaaccgugacaguaaaugcuaaaaagaaagaaggacaa

SEQ ID NO: 19349 - RNA, 26 nt, Artificial Sequence
  Synthetic Oligonucleotide; PD-L1 exon 3; Set C
gugacaguaaaugcuaaaaagaaaga

SEQ ID NO: 19350 - RNA, 24 nt, Artificial Sequence
  Synthetic Oligonucleotide; PD-L1 exon 3; Set C
gugacaguaaaugcuaaaaagaaa

SEQ ID NO: 19351 - RNA, 40 nt, Artificial Sequence
  Synthetic Oligonucleotide; PD-L1 exon 3; Set A
ugggaaccgugacaguaaaugcuaaaaagaaagaaggaca

SEQ ID NO: 19352 - RNA, 39 nt, Artificial Sequence
  Synthetic Oligonucleotide; PD-L1 exon 3; Set A
ugggaaccgugacaguaaaugcuaaaaagaaagaaggac

SEQ ID NO: 19353 - RNA, 38 nt, Artificial Sequence
  Synthetic Oligonucleotide; PD-L1 exon 3; Set A
ugggaaccgugacaguaaaugcuaaaaagaaagaagga

SEQ ID NO: 19354 - RNA, 40 nt, Artificial Sequence
  Synthetic Oligonucleotide; PD-L1 exon 3; Set A
uugggaaccgugacaguaaaugcuaaaaagaaagaaggac

SEQ ID NO: 19355 - RNA, 39 nt, Artificial Sequence
  Synthetic Oligonucleotide; PD-L1 exon 3; Set A
uugggaaccgugacaguaaaugcuaaaaagaaagaagga

SEQ ID NO: 19356 - RNA, 38 nt, Artificial Sequence
  Synthetic Oligonucleotide; PD-L1 exon 3; Set A
uugggaaccgugacaguaaaugcuaaaaagaaagaagg

SEQ ID NO: 19357 - RNA, 37 nt, Artificial Sequence
  Synthetic Oligonucleotide; PD-L1 exon 3; Set A
uugggaaccgugacaguaaaugcuaaaaagaaagaag

SEQ ID NO: 19358 - RNA, 40 nt, Artificial Sequence
  Synthetic Oligonucleotide; PD-L1 exon 3; Set A
ccuugggaaccgugacaguaaaugcuaaaaagaaagaagg

SEQ ID NO: 19359 - RNA, 35 nt, Artificial Sequence
  Synthetic Oligonucleotide; PD-L1 exon 3; Set A
uugggaaccgugacaguaaaugcuaaaaagaaaga

SEQ ID NO: 19360 - RNA, 39 nt, Artificial Sequence
  Synthetic Oligonucleotide; PD-L1 exon 3; Set A
ccuugggaaccgugacaguaaaugcuaaaaagaaagaag

SEQ ID NO: 19361 - RNA, 38 nt, Artificial Sequence
  Synthetic Oligonucleotide; PD-L1 exon 3; Set A
ccuugggaaccgugacaguaaaugcuaaaaagaaagaa

SEQ ID NO: 19362 - RNA, 33 nt, Artificial Sequence
  Synthetic Oligonucleotide; PD-L1 exon 3; Set A
uugggaaccgugacaguaaaugcuaaaaagaaa

SEQ ID NO: 19363 - RNA, 37 nt, Artificial Sequence
  Synthetic Oligonucleotide; PD-L1 exon 3; Set A
ccuugggaaccgugacaguaaaugcuaaaaagaaaga

SEQ ID NO: 19364 - RNA, 32 nt, Artificial Sequence
  Synthetic Oligonucleotide; PD-L1 exon 3; Set A
uugggaaccgugacaguaaaugcuaaaaagaa

SEQ ID NO: 19365 - RNA, 36 nt, Artificial Sequence
  Synthetic Oligonucleotide; PD-L1 exon 3; Set A
ccuugggaaccgugacaguaaaugcuaaaaagaaag

SEQ ID NO: 19366 - RNA, 35 nt, Artificial Sequence
  Synthetic Oligonucleotide; PD-L1 exon 3; Set A
ccuugggaaccgugacaguaaaugcuaaaaagaaa

SEQ ID NO: 19367 - RNA, 34 nt, Artificial Sequence
  Synthetic Oligonucleotide; PD-L1 exon 3; Set A
ccuugggaaccgugacaguaaaugcuaaaaagaa

SEQ ID NO: 19368 - RNA, 33 nt, Artificial Sequence
  Synthetic Oligonucleotide; PD-L1 exon 3; Set A
ccuugggaaccgugacaguaaaugcuaaaaaga

SEQ ID NO: 19369 - RNA, 32 nt, Artificial Sequence
  Synthetic Oligonucleotide; PD-L1 exon 3; Set A
ccuugggaaccgugacaguaaaugcuaaaaag

SEQ ID NO: 19370 - RNA, 31 nt, Artificial Sequence
  Synthetic Oligonucleotide; PD-L1 exon 3; Set A
ccuugggaaccgugacaguaaaugcuaaaaa

SEQ ID NO: 19371 - RNA, 30 nt, Artificial Sequence
  Synthetic Oligonucleotide; PD-L1 exon 3; Set A
ccuugggaaccgugacaguaaaugcuaaaa

SEQ ID NO: 19372 - RNA, 40 nt, Artificial Sequence
  Synthetic Oligonucleotide; PD-L1 exon 3; Set A
auauagguccuugggaaccgugacaguaaaugcuaaaaag

SEQ ID NO: 19373 - RNA, 39 nt, Artificial Sequence
  Synthetic Oligonucleotide; PD-L1 exon 3; Set A
auauagguccuugggaaccgugacaguaaaugcuaaaaa

SEQ ID NO: 19374 - RNA, 40 nt, Artificial Sequence
  Synthetic Oligonucleotide; PD-L1 exon 3; Set C
cauauagguccuugggaaccgugacaguaaaugcuaaaaa

SEQ ID NO: 19375 - RNA, 38 nt, Artificial Sequence
  Synthetic Oligonucleotide; PD-L1 exon 3; Set A
auauagguccuugggaaccgugacaguaaaugcuaaaa

SEQ ID NO: 19376 - RNA, 39 nt, Artificial Sequence
  Synthetic Oligonucleotide; PD-L1 exon 3; Set C
cauauagguccuugggaaccgugacaguaaaugcuaaaa

SEQ ID NO: 19377 - RNA, 15 nt, Artificial Sequence
  Synthetic Oligonucleotide; PD-L1 exon 3; Set C
ugggaaccgugacag

SEQ ID NO: 19378 - RNA, 38 nt, Artificial Sequence
  Synthetic Oligonucleotide; PD-L1 exon 3; Set C
cauauagguccuugggaaccgugacaguaaaugcuaaa

SEQ ID NO: 19379 - RNA, 40 nt, Artificial Sequence
  Synthetic Oligonucleotide; PD-L1 exon 3; Set C
acauauagguccuugggaaccgugacaguaaaugcuaaaa

SEQ ID NO: 19380 - RNA, 16 nt, Artificial Sequence
  Synthetic Oligonucleotide; PD-L1 exon 3; Set C
uugggaaccgugacag

SEQ ID NO: 19381 - RNA, 37 nt, Artificial Sequence
  Synthetic Oligonucleotide; PD-L1 exon 3; Set C
cauauagguccuugggaaccgugacaguaaaugcuaa

SEQ ID NO: 19382 - RNA, 39 nt, Artificial Sequence
  Synthetic Oligonucleotide; PD-L1 exon 3; Set C
acauauagguccuugggaaccgugacaguaaaugcuaaa

SEQ ID NO: 19383 - RNA, 15 nt, Artificial Sequence
  Synthetic Oligonucleotide; PD-L1 exon 3; Set C
uugggaaccgugaca

SEQ ID NO: 19384 - RNA, 17 nt, Artificial Sequence
  Synthetic Oligonucleotide; PD-L1 exon 3; Set C
cuugggaaccgugacag

SEQ ID NO: 19385 - RNA, 38 nt, Artificial Sequence
  Synthetic Oligonucleotide; PD-L1 exon 3; Set C
acauauagguccuugggaaccgugacaguaaaugcuaa

SEQ ID NO: 19386 - RNA, 40 nt, Artificial Sequence
  Synthetic Oligonucleotide; PD-L1 exon 3; Set C
cacauauagguccuugggaaccgugacaguaaaugcuaaa

SEQ ID NO: 19387 - RNA, 16 nt, Artificial Sequence
  Synthetic Oligonucleotide; PD-L1 exon 3; Set C
cuugggaaccgugaca

SEQ ID NO: 19388 - RNA, 18 nt, Artificial Sequence
  Synthetic Oligonucleotide; PD-L1 exon 3; Set C
ccuugggaaccgugacag

SEQ ID NO: 19389 - RNA, 39 nt, Artificial Sequence
  Synthetic Oligonucleotide; PD-L1 exon 3; Set C
cacauauagguccuugggaaccgugacaguaaaugcuaa

SEQ ID NO: 19390 - RNA, 15 nt, Artificial Sequence
  Synthetic Oligonucleotide; PD-L1 exon 3; Set C
cuugggaaccgugac

SEQ ID NO: 19391 - RNA, 17 nt, Artificial Sequence
  Synthetic Oligonucleotide; PD-L1 exon 3; Set C
ccuugggaaccgugaca

SEQ ID NO: 19392 - RNA, 16 nt, Artificial Sequence
  Synthetic Oligonucleotide; PD-L1 exon 3; Set C
ccuugggaaccgugac

SEQ ID NO: 19393 - RNA, 15 nt, Artificial Sequence
  Synthetic Oligonucleotide; PD-L1 exon 3; Set C
ccuugggaaccguga

SEQ ID NO: 19394 - RNA, 25 nt, Artificial Sequence
  Synthetic Oligonucleotide; PD-L1 exon 3; Set A
auauagguccuugggaaccgugaca

SEQ ID NO: 19395 - RNA, 27 nt, Artificial Sequence
  Synthetic Oligonucleotide; PD-L1 exon 3; Set A
cauauagguccuugggaaccgugacag

SEQ ID NO: 19396 - RNA, 24 nt, Artificial Sequence
  Synthetic Oligonucleotide; PD-L1 exon 3; Set A
auauagguccuugggaaccgugac

SEQ ID NO: 19397 - RNA, 26 nt, Artificial Sequence
  Synthetic Oligonucleotide; PD-L1 exon 3; Set A
cauauagguccuugggaaccgugaca

SEQ ID NO: 19398 - RNA, 28 nt, Artificial Sequence
  Synthetic Oligonucleotide; PD-L1 exon 3; Set C
acauauagguccuugggaaccgugacag

SEQ ID NO: 19399 - RNA, 23 nt, Artificial Sequence
  Synthetic Oligonucleotide; PD-L1 exon 3; Set A
auauagguccuugggaaccguga

SEQ ID NO: 19400 - RNA, 25 nt, Artificial Sequence
  Synthetic Oligonucleotide; PD-L1 exon 3; Set A
cauauagguccuugggaaccgugac

SEQ ID NO: 19401 - RNA, 27 nt, Artificial Sequence
  Synthetic Oligonucleotide; PD-L1 exon 3; Set C
acauauagguccuugggaaccgugaca

SEQ ID NO: 19402 - RNA, 29 nt, Artificial Sequence
  Synthetic Oligonucleotide; PD-L1 exon 3; Set C
cacauauagguccuugggaaccgugacag

SEQ ID NO: 19403 - RNA, 22 nt, Artificial Sequence
  Synthetic Oligonucleotide; PD-L1 exon 3; Set A
auauagguccuugggaaccgug

SEQ ID NO: 19404 - RNA, 24 nt, Artificial Sequence
  Synthetic Oligonucleotide; PD-L1 exon 3; Set A
cauauagguccuugggaaccguga

SEQ ID NO: 19405 - RNA, 26 nt, Artificial Sequence
  Synthetic Oligonucleotide; PD-L1 exon 3; Set A
acauauagguccuugggaaccgugac

SEQ ID NO: 19406 - RNA, 28 nt, Artificial Sequence
  Synthetic Oligonucleotide; PD-L1 exon 3; Set C
cacauauagguccuugggaaccgugaca

SEQ ID NO: 19407 - RNA, 23 nt, Artificial Sequence
  Synthetic Oligonucleotide; PD-L1 exon 3; Set A
cauauagguccuugggaaccgug

SEQ ID NO: 19408 - RNA, 25 nt, Artificial Sequence
  Synthetic Oligonucleotide; PD-L1 exon 3; Set A
acauauagguccuugggaaccguga

SEQ ID NO: 19409 - RNA, 27 nt, Artificial Sequence
  Synthetic Oligonucleotide; PD-L1 exon 3; Set C
cacauauagguccuugggaaccgugac

SEQ ID NO: 19410 - RNA, 24 nt, Artificial Sequence
  Synthetic Oligonucleotide; PD-L1 exon 3; Set A
acauauagguccuugggaaccgug

SEQ ID NO: 19411 - RNA, 26 nt, Artificial Sequence
  Synthetic Oligonucleotide; PD-L1 exon 3; Set A
cacauauagguccuugggaaccguga

SEQ ID NO: 19412 - RNA, 25 nt, Artificial Sequence
  Synthetic Oligonucleotide; PD-L1 exon 3; Set A
cacauauagguccuugggaaccgug

SEQ ID NO: 19413 - RNA, 15 nt, Artificial Sequence
  Synthetic Oligonucleotide; PD-L1 exon 3; Set C
auauagguccuuggg

SEQ ID NO: 19414 - RNA, 16 nt, Artificial Sequence
  Synthetic Oligonucleotide; PD-L1 exon 3; Set C
cauauagguccuuggg

SEQ ID NO: 19415 - RNA, 15 nt, Artificial Sequence
  Synthetic Oligonucleotide; PD-L1 exon 3; Set C
cauauagguccuugg

SEQ ID NO: 19416 - RNA, 17 nt, Artificial Sequence
  Synthetic Oligonucleotide; PD-L1 exon 3; Set C
acauauagguccuuggg

SEQ ID NO: 19417 - RNA, 16 nt, Artificial Sequence
  Synthetic Oligonucleotide; PD-L1 exon 3; Set C
acauauagguccuugg

SEQ ID NO: 19418 - RNA, 18 nt, Artificial Sequence
  Synthetic Oligonucleotide; PD-L1 exon 3; Set C
cacauauagguccuuggg

SEQ ID NO: 19419 - RNA, 15 nt, Artificial Sequence
  Synthetic Oligonucleotide; PD-L1 exon 3; Set C
acauauagguccuug

SEQ ID NO: 19420 - RNA, 17 nt, Artificial Sequence
  Synthetic Oligonucleotide; PD-L1 exon 3; Set C
cacauauagguccuugg

SEQ ID NO: 19421 - RNA, 16 nt, Artificial Sequence
  Synthetic Oligonucleotide; PD-L1 exon 3; Set C
cacauauagguccuug

SEQ ID NO: 19422 - RNA, 15 nt, Artificial Sequence
  Synthetic Oligonucleotide; PD-L1 exon 3; Set C
cacauauagguccuu

SEQ ID NO: 19423 - RNA, 36 nt, Artificial Sequence
  Synthetic Oligonucleotide; PD-L1 exon 3; Set C
auugcuaccauacucuaccacauauagguccuuggg

SEQ ID NO: 19424 - RNA, 35 nt, Artificial Sequence
  Synthetic Oligonucleotide; PD-L1 exon 3; Set C
auugcuaccauacucuaccacauauagguccuugg

SEQ ID NO: 19425 - RNA, 37 nt, Artificial Sequence
  Synthetic Oligonucleotide; PD-L1 exon 3; Set C
uauugcuaccauacucuaccacauauagguccuuggg

SEQ ID NO: 19426 - RNA, 34 nt, Artificial Sequence
  Synthetic Oligonucleotide; PD-L1 exon 3; Set C
auugcuaccauacucuaccacauauagguccuug

SEQ ID NO: 19427 - RNA, 36 nt, Artificial Sequence
  Synthetic Oligonucleotide; PD-L1 exon 3; Set C
uauugcuaccauacucuaccacauauagguccuugg

SEQ ID NO: 19428 - RNA, 35 nt, Artificial Sequence
  Synthetic Oligonucleotide; PD-L1 exon 3; Set C
uauugcuaccauacucuaccacauauagguccuug

SEQ ID NO: 19429 - RNA, 32 nt, Artificial Sequence
  Synthetic Oligonucleotide; PD-L1 exon 3; Set C
auugcuaccauacucuaccacauauagguccu

SEQ ID NO: 19430 - RNA, 33 nt, Artificial Sequence
  Synthetic Oligonucleotide; PD-L1 exon 3; Set C
uauugcuaccauacucuaccacauauagguccu

SEQ ID NO: 19431 - RNA, 26 nt, Artificial Sequence
  Synthetic Oligonucleotide; PD-L1 exon 3; Set A
auugcuaccauacucuaccacauaua

SEQ ID NO: 19432 - RNA, 27 nt, Artificial Sequence
  Synthetic Oligonucleotide; PD-L1 exon 3; Set A
uauugcuaccauacucuaccacauaua

SEQ ID NO: 19433 - RNA, 25 nt, Artificial Sequence
  Synthetic Oligonucleotide; PD-L1 exon 3; Set A
auugcuaccauacucuaccacauau

SEQ ID NO: 19434 - RNA, 24 nt, Artificial Sequence
  Synthetic Oligonucleotide; PD-L1 exon 3; Set A
auugcuaccauacucuaccacaua

SEQ ID NO: 19435 - RNA, 26 nt, Artificial Sequence
  Synthetic Oligonucleotide; PD-L1 exon 3; Set A
uauugcuaccauacucuaccacauau

SEQ ID NO: 19436 - RNA, 23 nt, Artificial Sequence
  Synthetic Oligonucleotide; PD-L1 exon 3; Set A
auugcuaccauacucuaccacau

SEQ ID NO: 19437 - RNA, 25 nt, Artificial Sequence
  Synthetic Oligonucleotide; PD-L1 exon 3; Set A
uauugcuaccauacucuaccacaua

SEQ ID NO: 19438 - RNA, 24 nt, Artificial Sequence
  Synthetic Oligonucleotide; PD-L1 exon 3; Set A
uauugcuaccauacucuaccacau

SEQ ID NO: 19439 - RNA, 22 nt, Artificial Sequence
  Synthetic Oligonucleotide; PD-L1 exon 3; Set A
auugcuaccauacucuaccaca

SEQ ID NO: 19440 - RNA, 23 nt, Artificial Sequence
  Synthetic Oligonucleotide; PD-L1 exon 3; Set A
uauugcuaccauacucuaccaca

SEQ ID NO: 19441 - RNA, 40 nt, Artificial Sequence
  Synthetic Oligonucleotide; PD-L1 exon 3; Set C
uuugcauucaauugucauauugcuaccauacucuaccaca

SEQ ID NO: 19442 - RNA, 39 nt, Artificial Sequence
  Synthetic Oligonucleotide; PD-L1 exon 3; Set C
uuugcauucaauugucauauugcuaccauacucuaccac

SEQ ID NO: 19443 - RNA, 20 nt, Artificial Sequence
  Synthetic Oligonucleotide; PD-L1 exon 3; Set C
gcacaaauugaauaauguuc

SEQ ID NO: 19444 - RNA, 19 nt, Artificial Sequence
  Synthetic Oligonucleotide; PD-L1 exon 3; Set C
gcacaaauugaauaauguu

SEQ ID NO: 19445 - RNA, 18 nt, Artificial Sequence
  Synthetic Oligonucleotide; PD-L1 exon 3; Set C
gcacaaauugaauaaugu

SEQ ID NO: 19446 - RNA, 35 nt, Artificial Sequence
  Synthetic Oligonucleotide; PD-L1 exon 3; Set A
ggucuuccucuccaugcacaaauugaauaauguuc

SEQ ID NO: 19447 - RNA, 36 nt, Artificial Sequence
  Synthetic Oligonucleotide; PD-L1 exon 3; Set A
aggucuuccucuccaugcacaaauugaauaauguuc

SEQ ID NO: 19448 - RNA, 34 nt, Artificial Sequence
  Synthetic Oligonucleotide; PD-L1 exon 3; Set A
ggucuuccucuccaugcacaaauugaauaauguu

SEQ ID NO: 19449 - RNA, 37 nt, Artificial Sequence
  Synthetic Oligonucleotide; PD-L1 exon 3; Set A
caggucuuccucuccaugcacaaauugaauaauguuc

SEQ ID NO: 19450 - RNA, 35 nt, Artificial Sequence
  Synthetic Oligonucleotide; PD-L1 exon 3; Set A
aggucuuccucuccaugcacaaauugaauaauguu

SEQ ID NO: 19451 - RNA, 33 nt, Artificial Sequence
  Synthetic Oligonucleotide; PD-L1 exon 3; Set A
ggucuuccucuccaugcacaaauugaauaaugu

SEQ ID NO: 19452 - RNA, 34 nt, Artificial Sequence
  Synthetic Oligonucleotide; PD-L1 exon 3; Set A
aggucuuccucuccaugcacaaauugaauaaugu

SEQ ID NO: 19453 - RNA, 36 nt, Artificial Sequence
  Synthetic Oligonucleotide; PD-L1 exon 3; Set A
caggucuuccucuccaugcacaaauugaauaauguu

SEQ ID NO: 19454 - RNA, 35 nt, Artificial Sequence
  Synthetic Oligonucleotide; PD-L1 exon 3; Set A
caggucuuccucuccaugcacaaauugaauaaugu

SEQ ID NO: 19455 - RNA, 35 nt, Artificial Sequence
  Synthetic Oligonucleotide; PD-L1 exon 3; Set A
ucaggucuuccucuccaugcacaaauugaauaaug

SEQ ID NO: 19456 - RNA, 31 nt, Artificial Sequence
  Synthetic Oligonucleotide; PD-L1 exon 3; Set A
ucaggucuuccucuccaugcacaaauugaau

SEQ ID NO: 19457 - RNA, 24 nt, Artificial Sequence
  Synthetic Oligonucleotide; PD-L1 exon 3; Set A
ggucuuccucuccaugcacaaauu

SEQ ID NO: 19458 - RNA, 25 nt, Artificial Sequence
  Synthetic Oligonucleotide; PD-L1 exon 3; Set A
aggucuuccucuccaugcacaaauu

SEQ ID NO: 19459 - RNA, 23 nt, Artificial Sequence
  Synthetic Oligonucleotide; PD-L1 exon 3; Set A
ggucuuccucuccaugcacaaau

SEQ ID NO: 19460 - RNA, 26 nt, Artificial Sequence
  Synthetic Oligonucleotide; PD-L1 exon 3; Set A
caggucuuccucuccaugcacaaauu

SEQ ID NO: 19461 - RNA, 24 nt, Artificial Sequence
  Synthetic Oligonucleotide; PD-L1 exon 3; Set A
aggucuuccucuccaugcacaaau

SEQ ID NO: 19462 - RNA, 25 nt, Artificial Sequence
  Synthetic Oligonucleotide; PD-L1 exon 3; Set A
caggucuuccucuccaugcacaaau

SEQ ID NO: 19463 - RNA, 24 nt, Artificial Sequence
  Synthetic Oligonucleotide; PD-L1 exon 3; Set A
caggucuuccucuccaugcacaaa

SEQ ID NO: 19464 - RNA, 25 nt, Artificial Sequence
  Synthetic Oligonucleotide; PD-L1 exon 3; Set A
ucaggucuuccucuccaugcacaaa

SEQ ID NO: 19465 - RNA, 40 nt, Artificial Sequence
  Synthetic Oligonucleotide; PD-L1 exon 3; Set C
acuaugcugaaccuucaggucuuccucuccaugcacaaau

SEQ ID NO: 19466 - RNA, 39 nt, Artificial Sequence
  Synthetic Oligonucleotide; PD-L1 exon 3; Set C
acuaugcugaaccuucaggucuuccucuccaugcacaaa

SEQ ID NO: 19467 - RNA, 40 nt, Artificial Sequence
  Synthetic Oligonucleotide; PD-L1 exon 3; Set C
uacuaugcugaaccuucaggucuuccucuccaugcacaaa

SEQ ID NO: 19468 - RNA, 20 nt, Artificial Sequence
  Synthetic Oligonucleotide; PD-L1 exon 3; Set C
acuaugcugaaccuucaggu

SEQ ID NO: 19469 - RNA, 19 nt, Artificial Sequence
  Synthetic Oligonucleotide; PD-L1 exon 3; Set C
acuaugcugaaccuucagg

SEQ ID NO: 19470 - RNA, 21 nt, Artificial Sequence
  Synthetic Oligonucleotide; PD-L1 exon 3; Set C
uacuaugcugaaccuucaggu

SEQ ID NO: 19471 - RNA, 20 nt, Artificial Sequence
  Synthetic Oligonucleotide; PD-L1 exon 3; Set C
uacuaugcugaaccuucagg

SEQ ID NO: 19472 - RNA, 18 nt, Artificial Sequence
  Synthetic Oligonucleotide; PD-L1 exon 3; Set C
acuaugcugaaccuucag

SEQ ID NO: 19473 - RNA, 19 nt, Artificial Sequence
  Synthetic Oligonucleotide; PD-L1 exon 3; Set C
uacuaugcugaaccuucag

SEQ ID NO: 19474 - RNA, 31 nt, Artificial Sequence
  Synthetic Oligonucleotide; PD-L1 exon 3; Set C
ugucuguagcuacuaugcugaaccuucaggu

SEQ ID NO: 19475 - RNA, 28 nt, Artificial Sequence
  Synthetic Oligonucleotide; PD-L1 exon 3; Set A
ugucuguagcuacuaugcugaaccuuca

SEQ ID NO: 19476 - RNA, 31 nt, Artificial Sequence
  Synthetic Oligonucleotide; PD-L1 exon 3; Set C
ucgcuuguagucggcaccaccauagcugauc

SEQ ID NO: 19477 - RNA, 32 nt, Artificial Sequence
  Synthetic Oligonucleotide; PD-L1 exon 3; Set C
uucgcuuguagucggcaccaccauagcugauc

SEQ ID NO: 19478 - RNA, 33 nt, Artificial Sequence
  Synthetic Oligonucleotide; PD-L1 exon 3; Set C
auucgcuuguagucggcaccaccauagcugauc

SEQ ID NO: 19479 - RNA, 15 nt, Artificial Sequence
  Synthetic Oligonucleotide; PD-L1 exon 3; Set C
ucgcuuguagucggc

SEQ ID NO: 19480 - RNA, 27 nt, Artificial Sequence
  Synthetic Oligonucleotide; PD-L1 exon 3; Set B
uuucacaguaauucgcuuguagucggc

SEQ ID NO: 19481 - RNA, 26 nt, Artificial Sequence
  Synthetic Oligonucleotide; PD-L1 exon 3; Set B
uuucacaguaauucgcuuguagucgg

SEQ ID NO: 19482 - RNA, 28 nt, Artificial Sequence
  Synthetic Oligonucleotide; PD-L1 exon 3; Set B
cuuucacaguaauucgcuuguagucggc

SEQ ID NO: 19483 - RNA, 27 nt, Artificial Sequence
  Synthetic Oligonucleotide; PD-L1 exon 3; Set B
cuuucacaguaauucgcuuguagucgg

SEQ ID NO: 19484 - RNA, 21 nt, Artificial Sequence
  Synthetic Oligonucleotide; PD-L1 exon 3; Set C
uuucacaguaauucgcuugua

SEQ ID NO: 19485 - RNA, 20 nt, Artificial Sequence
  Synthetic Oligonucleotide; PD-L1 exon 3; Set C
uuucacaguaauucgcuugu

SEQ ID NO: 19486 - RNA, 22 nt, Artificial Sequence
  Synthetic Oligonucleotide; PD-L1 exon 3; Set C
cuuucacaguaauucgcuugua

SEQ ID NO: 19487 - RNA, 21 nt, Artificial Sequence
  Synthetic Oligonucleotide; PD-L1 exon 3; Set C
cuuucacaguaauucgcuugu

SEQ ID NO: 19488 - RNA, 19 nt, Artificial Sequence
  Synthetic Oligonucleotide; PD-L1 exon 3; Set C
uuucacaguaauucgcuug

SEQ ID NO: 19489 - RNA, 18 nt, Artificial Sequence
  Synthetic Oligonucleotide; PD-L1 exon 3; Set C
uuucacaguaauucgcuu

SEQ ID NO: 19490 - RNA, 20 nt, Artificial Sequence
  Synthetic Oligonucleotide; PD-L1 exon 3; Set C
cuuucacaguaauucgcuug

SEQ ID NO: 19491 - RNA, 17 nt, Artificial Sequence
  Synthetic Oligonucleotide; PD-L1 exon 3; Set C
uuucacaguaauucgcu

SEQ ID NO: 19492 - RNA, 19 nt, Artificial Sequence
  Synthetic Oligonucleotide; PD-L1 exon 3; Set C
cuuucacaguaauucgcuu

SEQ ID NO: 19493 - RNA, 16 nt, Artificial Sequence
  Synthetic Oligonucleotide; PD-L1 exon 3; Set C
uuucacaguaauucgc

SEQ ID NO: 19494 - RNA, 18 nt, Artificial Sequence
  Synthetic Oligonucleotide; PD-L1 exon 3; Set C
cuuucacaguaauucgcu

SEQ ID NO: 19495 - RNA, 15 nt, Artificial Sequence
  Synthetic Oligonucleotide; PD-L1 exon 3; Set C
uuucacaguaauucg

SEQ ID NO: 19496 - RNA, 37 nt, Artificial Sequence
  Synthetic Oligonucleotide; PD-L1 exon 3; Set C
uuaccauugacuuucacaguaauucgcuuguagucgg

SEQ ID NO: 19497 - RNA, 39 nt, Artificial Sequence
  Synthetic Oligonucleotide; PD-L1 exon 3; Set C
cuuaccauugacuuucacaguaauucgcuuguagucggc

SEQ ID NO: 19498 - RNA, 17 nt, Artificial Sequence
  Synthetic Oligonucleotide; PD-L1 exon 3; Set C
cuuucacaguaauucgc

SEQ ID NO: 19499 - RNA, 16 nt, Artificial Sequence
  Synthetic Oligonucleotide; PD-L1 exon 3; Set C
cuuucacaguaauucg

SEQ ID NO: 19500 - RNA, 38 nt, Artificial Sequence
  Synthetic Oligonucleotide; PD-L1 exon 3; Set C
cuuaccauugacuuucacaguaauucgcuuguagucgg

SEQ ID NO: 19501 - RNA, 40 nt, Artificial Sequence
  Synthetic Oligonucleotide; PD-L1 exon 3; Set C
ucuuaccauugacuuucacaguaauucgcuuguagucggc

SEQ ID NO: 19502 - RNA, 15 nt, Artificial Sequence
  Synthetic Oligonucleotide; PD-L1 exon 3; Set C
cuuucacaguaauuc

SEQ ID NO: 19503 - RNA, 39 nt, Artificial Sequence
  Synthetic Oligonucleotide; PD-L1 exon 3; Set C
ucuuaccauugacuuucacaguaauucgcuuguagucgg

SEQ ID NO: 19504 - RNA, 34 nt, Artificial Sequence
  Synthetic Oligonucleotide; PD-L1 exon 3; Set B
cuuaccauugacuuucacaguaauucgcuuguag

SEQ ID NO: 19505 - RNA, 33 nt, Artificial Sequence
  Synthetic Oligonucleotide; PD-L1 exon 3; Set B
cuuaccauugacuuucacaguaauucgcuugua

SEQ ID NO: 19506 - RNA, 35 nt, Artificial Sequence
  Synthetic Oligonucleotide; PD-L1 exon 3; Set B
ucuuaccauugacuuucacaguaauucgcuuguag

SEQ ID NO: 19507 - RNA, 32 nt, Artificial Sequence
  Synthetic Oligonucleotide; PD-L1 exon 3; Set B
cuuaccauugacuuucacaguaauucgcuugu

SEQ ID NO: 19508 - RNA, 34 nt, Artificial Sequence
  Synthetic Oligonucleotide; PD-L1 exon 3; Set B
ucuuaccauugacuuucacaguaauucgcuugua

SEQ ID NO: 19509 - RNA, 36 nt, Artificial Sequence
  Synthetic Oligonucleotide; PD-L1 exon 3; Set B
uucuuaccauugacuuucacaguaauucgcuuguag

SEQ ID NO: 19510 - RNA, 33 nt, Artificial Sequence
  Synthetic Oligonucleotide; PD-L1 exon 3; Set B
ucuuaccauugacuuucacaguaauucgcuugu

SEQ ID NO: 19511 - RNA, 35 nt, Artificial Sequence
  Synthetic Oligonucleotide; PD-L1 exon 3; Set B
uucuuaccauugacuuucacaguaauucgcuugua

SEQ ID NO: 19512 - RNA, 31 nt, Artificial Sequence
  Synthetic Oligonucleotide; PD-L1 exon 3; Set B
cuuaccauugacuuucacaguaauucgcuug

SEQ ID NO: 19513 - RNA, 37 nt, Artificial Sequence
  Synthetic Oligonucleotide; PD-L1 exon 3; Set B
auucuuaccauugacuuucacaguaauucgcuuguag

SEQ ID NO: 19514 - RNA, 30 nt, Artificial Sequence
  Synthetic Oligonucleotide; PD-L1 exon 3; Set B
cuuaccauugacuuucacaguaauucgcuu

SEQ ID NO: 19515 - RNA, 34 nt, Artificial Sequence
  Synthetic Oligonucleotide; PD-L1 exon 3; Set B
uucuuaccauugacuuucacaguaauucgcuugu

SEQ ID NO: 19516 - RNA, 36 nt, Artificial Sequence
  Synthetic Oligonucleotide; PD-L1 exon 3; Set B
auucuuaccauugacuuucacaguaauucgcuugua

SEQ ID NO: 19517 - RNA, 32 nt, Artificial Sequence
  Synthetic Oligonucleotide; PD-L1 exon 3; Set B
ucuuaccauugacuuucacaguaauucgcuug

SEQ ID NO: 19518 - RNA, 38 nt, Artificial Sequence
  Synthetic Oligonucleotide; PD-L1 exon 3; Set B
aauucuuaccauugacuuucacaguaauucgcuuguag

SEQ ID NO: 19519 - RNA, 31 nt, Artificial Sequence
  Synthetic Oligonucleotide; PD-L1 exon 3; Set B
ucuuaccauugacuuucacaguaauucgcuu

SEQ ID NO: 19520 - RNA, 29 nt, Artificial Sequence
  Synthetic Oligonucleotide; PD-L1 exon 3; Set B
cuuaccauugacuuucacaguaauucgcu

SEQ ID NO: 19521 - RNA, 35 nt, Artificial Sequence
  Synthetic Oligonucleotide; PD-L1 exon 3; Set B
auucuuaccauugacuuucacaguaauucgcuugu

SEQ ID NO: 19522 - RNA, 37 nt, Artificial Sequence
  Synthetic Oligonucleotide; PD-L1 exon 3; Set B
aauucuuaccauugacuuucacaguaauucgcuugua

SEQ ID NO: 19523 - RNA, 33 nt, Artificial Sequence
  Synthetic Oligonucleotide; PD-L1 exon 3; Set B
uucuuaccauugacuuucacaguaauucgcuug

SEQ ID NO: 19524 - RNA, 39 nt, Artificial Sequence
  Synthetic Oligonucleotide; PD-L1 exon 3; Set B
uaauucuuaccauugacuuucacaguaauucgcuuguag

SEQ ID NO: 19525 - RNA, 26 nt, Artificial Sequence
  Synthetic Oligonucleotide; PD-L1 exon 3; Set C
uuaccauugacuuucacaguaauucg

SEQ ID NO: 19526 - RNA, 32 nt, Artificial Sequence
  Synthetic Oligonucleotide; PD-L1 exon 3; Set B
uucuuaccauugacuuucacaguaauucgcuu

SEQ ID NO: 19527 - RNA, 30 nt, Artificial Sequence
  Synthetic Oligonucleotide; PD-L1 exon 3; Set B
ucuuaccauugacuuucacaguaauucgcu

SEQ ID NO: 19528 - RNA, 28 nt, Artificial Sequence
  Synthetic Oligonucleotide; PD-L1 exon 3; Set B
cuuaccauugacuuucacaguaauucgc

SEQ ID NO: 19529 - RNA, 36 nt, Artificial Sequence
  Synthetic Oligonucleotide; PD-L1 exon 3; Set B
aauucuuaccauugacuuucacaguaauucgcuugu

SEQ ID NO: 19530 - RNA, 38 nt, Artificial Sequence
  Synthetic Oligonucleotide; PD-L1 exon 3; Set B
uaauucuuaccauugacuuucacaguaauucgcuugua

SEQ ID NO: 19531 - RNA, 34 nt, Artificial Sequence
  Synthetic Oligonucleotide; PD-L1 exon 3; Set B
auucuuaccauugacuuucacaguaauucgcuug

SEQ ID NO: 19532 - RNA, 40 nt, Artificial Sequence
  Synthetic Oligonucleotide; PD-L1 exon 3; Set B
auaauucuuaccauugacuuucacaguaauucgcuuguag

SEQ ID NO: 19533 - RNA, 25 nt, Artificial Sequence
  Synthetic Oligonucleotide; PD-L1 exon 3; Set C
uuaccauugacuuucacaguaauuc

SEQ ID NO: 19534 - RNA, 33 nt, Artificial Sequence
  Synthetic Oligonucleotide; PD-L1 exon 3; Set B
auucuuaccauugacuuucacaguaauucgcuu

SEQ ID NO: 19535 - RNA, 31 nt, Artificial Sequence
  Synthetic Oligonucleotide; PD-L1 exon 3; Set B
uucuuaccauugacuuucacaguaauucgcu

SEQ ID NO: 19536 - RNA, 29 nt, Artificial Sequence
  Synthetic Oligonucleotide; PD-L1 exon 3; Set B
ucuuaccauugacuuucacaguaauucgc

SEQ ID NO: 19537 - RNA, 37 nt, Artificial Sequence
  Synthetic Oligonucleotide; PD-L1 exon 3; Set B
uaauucuuaccauugacuuucacaguaauucgcuugu

SEQ ID NO: 19538 - RNA, 39 nt, Artificial Sequence
  Synthetic Oligonucleotide; PD-L1 exon 3; Set B
auaauucuuaccauugacuuucacaguaauucgcuugua

SEQ ID NO: 19539 - RNA, 35 nt, Artificial Sequence
  Synthetic Oligonucleotide; PD-L1 exon 3; Set B
aauucuuaccauugacuuucacaguaauucgcuug

SEQ ID NO: 19540 - RNA, 24 nt, Artificial Sequence
  Synthetic Oligonucleotide; PD-L1 exon 3; Set C
uuaccauugacuuucacaguaauu

SEQ ID NO: 19541 - RNA, 32 nt, Artificial Sequence
  Synthetic Oligonucleotide; PD-L1 exon 3; Set B
auucuuaccauugacuuucacaguaauucgcu

SEQ ID NO: 19542 - RNA, 30 nt, Artificial Sequence
  Synthetic Oligonucleotide; PD-L1 exon 3; Set B
uucuuaccauugacuuucacaguaauucgc

SEQ ID NO: 19543 - RNA, 38 nt, Artificial Sequence
  Synthetic Oligonucleotide; PD-L1 exon 3; Set B
auaauucuuaccauugacuuucacaguaauucgcuugu

SEQ ID NO: 19544 - RNA, 40 nt, Artificial Sequence
  Synthetic Oligonucleotide; PD-L1 exon 3; Set B
aauaauucuuaccauugacuuucacaguaauucgcuugua

SEQ ID NO: 19545 - RNA, 36 nt, Artificial Sequence
  Synthetic Oligonucleotide; PD-L1 exon 3; Set B
uaauucuuaccauugacuuucacaguaauucgcuug

SEQ ID NO: 19546 - RNA, 33 nt, Artificial Sequence
  Synthetic Oligonucleotide; PD-L1 exon 3; Set B
aauucuuaccauugacuuucacaguaauucgcu

SEQ ID NO: 19547 - RNA, 31 nt, Artificial Sequence
  Synthetic Oligonucleotide; PD-L1 exon 3; Set B
auucuuaccauugacuuucacaguaauucgc

SEQ ID NO: 19548 - RNA, 39 nt, Artificial Sequence
  Synthetic Oligonucleotide; PD-L1 exon 3; Set B
aauaauucuuaccauugacuuucacaguaauucgcuugu

SEQ ID NO: 19549 - RNA, 37 nt, Artificial Sequence
  Synthetic Oligonucleotide; PD-L1 exon 3; Set B
auaauucuuaccauugacuuucacaguaauucgcuug

SEQ ID NO: 19550 - RNA, 32 nt, Artificial Sequence
  Synthetic Oligonucleotide; PD-L1 exon 3; Set B
aauucuuaccauugacuuucacaguaauucgc

SEQ ID NO: 19551 - RNA, 40 nt, Artificial Sequence
  Synthetic Oligonucleotide; PD-L1 exon 3; Set B
uaauaauucuuaccauugacuuucacaguaauucgcuugu

SEQ ID NO: 19552 - RNA, 38 nt, Artificial Sequence
  Synthetic Oligonucleotide; PD-L1 exon 3; Set B
aauaauucuuaccauugacuuucacaguaauucgcuug

SEQ ID NO: 19553 - RNA, 33 nt, Artificial Sequence
  Synthetic Oligonucleotide; PD-L1 exon 3; Set B
uaauucuuaccauugacuuucacaguaauucgc

SEQ ID NO: 19554 - RNA, 39 nt, Artificial Sequence
  Synthetic Oligonucleotide; PD-L1 exon 3; Set B
uaauaauucuuaccauugacuuucacaguaauucgcuug

SEQ ID NO: 19555 - RNA, 25 nt, Artificial Sequence
  Synthetic Oligonucleotide; PD-L1 exon 3; Set C
ucuuaccauugacuuucacaguaau

SEQ ID NO: 19556 - RNA, 38 nt, Artificial Sequence
  Synthetic Oligonucleotide; PD-L1 exon 3; Set B
uaauaauucuuaccauugacuuucacaguaauucgcuu

SEQ ID NO: 19557 - RNA, 40 nt, Artificial Sequence
  Synthetic Oligonucleotide; PD-L1 exon 3; Set B
auaauaauucuuaccauugacuuucacaguaauucgcuug

SEQ ID NO: 19558 - RNA, 26 nt, Artificial Sequence
  Synthetic Oligonucleotide; PD-L1 exon 3; Set C
uucuuaccauugacuuucacaguaau

SEQ ID NO: 19559 - RNA, 37 nt, Artificial Sequence
  Synthetic Oligonucleotide; PD-L1 exon 3; Set B
uaauaauucuuaccauugacuuucacaguaauucgcu

SEQ ID NO: 19560 - RNA, 39 nt, Artificial Sequence
  Synthetic Oligonucleotide; PD-L1 exon 3; Set B
auaauaauucuuaccauugacuuucacaguaauucgcuu

SEQ ID NO: 19561 - RNA, 27 nt, Artificial Sequence
  Synthetic Oligonucleotide; PD-L1 exon 3; Set C
auucuuaccauugacuuucacaguaau

SEQ ID NO: 19562 - RNA, 36 nt, Artificial Sequence
  Synthetic Oligonucleotide; PD-L1 exon 3; Set B
uaauaauucuuaccauugacuuucacaguaauucgc

SEQ ID NO: 19563 - RNA, 40 nt, Artificial Sequence
  Synthetic Oligonucleotide; PD-L1 exon 3; Set B
uauaauaauucuuaccauugacuuucacaguaauucgcuu

SEQ ID NO: 19564 - RNA, 38 nt, Artificial Sequence
  Synthetic Oligonucleotide; PD-L1 exon 3; Set B
auaauaauucuuaccauugacuuucacaguaauucgcu

SEQ ID NO: 19565 - RNA, 28 nt, Artificial Sequence
  Synthetic Oligonucleotide; PD-L1 exon 3; Set C
aauucuuaccauugacuuucacaguaau

SEQ ID NO: 19566 - RNA, 26 nt, Artificial Sequence
  Synthetic Oligonucleotide; PD-L1 exon 3; Set C
auucuuaccauugacuuucacaguaa

SEQ ID NO: 19567 - RNA, 39 nt, Artificial Sequence
  Synthetic Oligonucleotide; PD-L1 exon 3; Set B
uauaauaauucuuaccauugacuuucacaguaauucgcu

SEQ ID NO: 19568 - RNA, 37 nt, Artificial Sequence
  Synthetic Oligonucleotide; PD-L1 exon 3; Set B
auaauaauucuuaccauugacuuucacaguaauucgc

SEQ ID NO: 19569 - RNA, 29 nt, Artificial Sequence
  Synthetic Oligonucleotide; PD-L1 exon 3; Set C
uaauucuuaccauugacuuucacaguaau

SEQ ID NO: 19570 - RNA, 27 nt, Artificial Sequence
  Synthetic Oligonucleotide; PD-L1 exon 3; Set C
aauucuuaccauugacuuucacaguaa

SEQ ID NO: 19571 - RNA, 38 nt, Artificial Sequence
  Synthetic Oligonucleotide; PD-L1 exon 3; Set B
uauaauaauucuuaccauugacuuucacaguaauucgc

SEQ ID NO: 19572 - RNA, 40 nt, Artificial Sequence
  Synthetic Oligonucleotide; PD-L1 exon 3; Set B
cuauaauaauucuuaccauugacuuucacaguaauucgcu

SEQ ID NO: 19573 - RNA, 30 nt, Artificial Sequence
  Synthetic Oligonucleotide; PD-L1 exon 3; Set C
auaauucuuaccauugacuuucacaguaau

SEQ ID NO: 19574 - RNA, 28 nt, Artificial Sequence
  Synthetic Oligonucleotide; PD-L1 exon 3; Set C
uaauucuuaccauugacuuucacaguaa

SEQ ID NO: 19575 - RNA, 39 nt, Artificial Sequence
  Synthetic Oligonucleotide; PD-L1 exon 3; Set B
cuauaauaauucuuaccauugacuuucacaguaauucgc

SEQ ID NO: 19576 - RNA, 31 nt, Artificial Sequence
  Synthetic Oligonucleotide; PD-L1 exon 3; Set C
aauaauucuuaccauugacuuucacaguaau

SEQ ID NO: 19577 - RNA, 29 nt, Artificial Sequence
  Synthetic Oligonucleotide; PD-L1 exon 3; Set C
auaauucuuaccauugacuuucacaguaa

SEQ ID NO: 19578 - RNA, 32 nt, Artificial Sequence
  Synthetic Oligonucleotide; PD-L1 exon 3; Set C
uaauaauucuuaccauugacuuucacaguaau

SEQ ID NO: 19579 - RNA, 30 nt, Artificial Sequence
  Synthetic Oligonucleotide; PD-L1 exon 3; Set C
aauaauucuuaccauugacuuucacaguaa

SEQ ID NO: 19580 - RNA, 15 nt, Artificial Sequence
  Synthetic Oligonucleotide; PD-L1 exon 3; Set C
cuuaccauugacuuu

SEQ ID NO: 19581 - RNA, 33 nt, Artificial Sequence
  Synthetic Oligonucleotide; PD-L1 exon 3; Set C
auaauaauucuuaccauugacuuucacaguaau

SEQ ID NO: 19582 - RNA, 34 nt, Artificial Sequence
  Synthetic Oligonucleotide; PD-L1 exon 3; Set C
uauaauaauucuuaccauugacuuucacaguaau

SEQ ID NO: 19583 - RNA, 15 nt, Artificial Sequence
  Synthetic Oligonucleotide; PD-L1 exon 3; Set C
ucuuaccauugacuu

SEQ ID NO: 19584 - RNA, 35 nt, Artificial Sequence
  Synthetic Oligonucleotide; PD-L1 exon 3; Set C
cuauaauaauucuuaccauugacuuucacaguaau

SEQ ID NO: 19585 - RNA, 36 nt, Artificial Sequence
  Synthetic Oligonucleotide; PD-L1 exon 3; Set B
ucuauaauaauucuuaccauugacuuucacaguaau

SEQ ID NO: 19586 - RNA, 35 nt, Artificial Sequence
  Synthetic Oligonucleotide; PD-L1 exon 3; Set B
ucuauaauaauucuuaccauugacuuucacaguaa

SEQ ID NO: 19587 - RNA, 16 nt, Artificial Sequence
  Synthetic Oligonucleotide; PD-L1 exon 3; Set C
aucuauaauaauucuu

SEQ ID NO: 19588 - RNA, 15 nt, Artificial Sequence
  Synthetic Oligonucleotide; PD-L1 exon 3; Set C
aucuauaauaauucu

SEQ ID NO: 19589 - RNA, 20 nt, Artificial Sequence
  Synthetic Oligonucleotide; PD-L1 exon 3; Set C
ucucaucuauaauaauucuu

SEQ ID NO: 19590 - RNA, 19 nt, Artificial Sequence
  Synthetic Oligonucleotide; PD-L1 exon 3; Set C
ucucaucuauaauaauucu

SEQ ID NO: 19591 - RNA, 21 nt, Artificial Sequence
  Synthetic Oligonucleotide; PD-L1 exon 3; Set C
cucucaucuauaauaauucuu

SEQ ID NO: 19592 - RNA, 18 nt, Artificial Sequence
  Synthetic Oligonucleotide; PD-L1 exon 3; Set C
ucucaucuauaauaauuc

SEQ ID NO: 19593 - RNA, 17 nt, Artificial Sequence
  Synthetic Oligonucleotide; PD-L1 exon 3; Set C
ucucaucuauaauaauu

SEQ ID NO: 19594 - RNA, 19 nt, Artificial Sequence
  Synthetic Oligonucleotide; PD-L1 exon 3; Set C
cucucaucuauaauaauuc

SEQ ID NO: 19595 - RNA, 16 nt, Artificial Sequence
  Synthetic Oligonucleotide; PD-L1 exon 3; Set C
ucucaucuauaauaau

SEQ ID NO: 19596 - RNA, 18 nt, Artificial Sequence
  Synthetic Oligonucleotide; PD-L1 exon 3; Set C
cucucaucuauaauaauu

SEQ ID NO: 19597 - RNA, 15 nt, Artificial Sequence
  Synthetic Oligonucleotide; PD-L1 exon 3; Set C
ucucaucuauaauaa

SEQ ID NO: 19598 - RNA, 17 nt, Artificial Sequence
  Synthetic Oligonucleotide; PD-L1 exon 3; Set C
cucucaucuauaauaau

SEQ ID NO: 19599 - RNA, 16 nt, Artificial Sequence
  Synthetic Oligonucleotide; PD-L1 exon 3; Set C
cucucaucuauaauaa

SEQ ID NO: 19600 - RNA, 15 nt, Artificial Sequence
  Synthetic Oligonucleotide; PD-L1 exon 3; Set C
cucucaucuauaaua

SEQ ID NO: 19601 - RNA, 33 nt, Artificial Sequence
  Synthetic Oligonucleotide; PD-L1 exon 3; Set B
aaagaucaggccucucaucuauaauaauucuua

SEQ ID NO: 19602 - RNA, 34 nt, Artificial Sequence
  Synthetic Oligonucleotide; PD-L1 exon 3; Set B
uaaagaucaggccucucaucuauaauaauucuua

SEQ ID NO: 19603 - RNA, 35 nt, Artificial Sequence
  Synthetic Oligonucleotide; PD-L1 exon 3; Set B
auaaagaucaggccucucaucuauaauaauucuua

SEQ ID NO: 19604 - RNA, 36 nt, Artificial Sequence
  Synthetic Oligonucleotide; PD-L1 exon 3; Set B
aauaaagaucaggccucucaucuauaauaauucuua

SEQ ID NO: 19605 - RNA, 39 nt, Artificial Sequence
  Synthetic Oligonucleotide; PD-L1 exon 3; Set B
uuucaauaaagaucaggccucucaucuauaauaauucuu

SEQ ID NO: 19606 - RNA, 38 nt, Artificial Sequence
  Synthetic Oligonucleotide; PD-L1 exon 3; Set B
uuucaauaaagaucaggccucucaucuauaauaauucu

SEQ ID NO: 19607 - RNA, 40 nt, Artificial Sequence
  Synthetic Oligonucleotide; PD-L1 exon 3; Set B
uuuucaauaaagaucaggccucucaucuauaauaauucuu

SEQ ID NO: 19608 - RNA, 24 nt, Artificial Sequence
  Synthetic Oligonucleotide; PD-L1 exon 3; Set C
aaagaucaggccucucaucuauaa

SEQ ID NO: 19609 - RNA, 37 nt, Artificial Sequence
  Synthetic Oligonucleotide; PD-L1 exon 3; Set B
uuucaauaaagaucaggccucucaucuauaauaauuc

SEQ ID NO: 19610 - RNA, 39 nt, Artificial Sequence
  Synthetic Oligonucleotide; PD-L1 exon 3; Set B
uuuucaauaaagaucaggccucucaucuauaauaauucu

SEQ ID NO: 19611 - RNA, 25 nt, Artificial Sequence
  Synthetic Oligonucleotide; PD-L1 exon 3; Set C
uaaagaucaggccucucaucuauaa

SEQ ID NO: 19612 - RNA, 23 nt, Artificial Sequence
  Synthetic Oligonucleotide; PD-L1 exon 3; Set C
aaagaucaggccucucaucuaua

SEQ ID NO: 19613 - RNA, 36 nt, Artificial Sequence
  Synthetic Oligonucleotide; PD-L1 exon 3; Set B
uuucaauaaagaucaggccucucaucuauaauaauu

SEQ ID NO: 19614 - RNA, 38 nt, Artificial Sequence
  Synthetic Oligonucleotide; PD-L1 exon 3; Set B
uuuucaauaaagaucaggccucucaucuauaauaauuc

SEQ ID NO: 19615 - RNA, 40 nt, Artificial Sequence
  Synthetic Oligonucleotide; PD-L1 exon 3; Set B
guuuucaauaaagaucaggccucucaucuauaauaauucu

SEQ ID NO: 19616 - RNA, 22 nt, Artificial Sequence
  Synthetic Oligonucleotide; PD-L1 exon 3; Set C
aaagaucaggccucucaucuau

SEQ ID NO: 19617 - RNA, 24 nt, Artificial Sequence
  Synthetic Oligonucleotide; PD-L1 exon 3; Set C
uaaagaucaggccucucaucuaua

SEQ ID NO: 19618 - RNA, 35 nt, Artificial Sequence
  Synthetic Oligonucleotide; PD-L1 exon 3; Set B
uuucaauaaagaucaggccucucaucuauaauaau

SEQ ID NO: 19619 - RNA, 37 nt, Artificial Sequence
  Synthetic Oligonucleotide; PD-L1 exon 3; Set B
uuuucaauaaagaucaggccucucaucuauaauaauu

SEQ ID NO: 19620 - RNA, 39 nt, Artificial Sequence
  Synthetic Oligonucleotide; PD-L1 exon 3; Set B
guuuucaauaaagaucaggccucucaucuauaauaauuc

SEQ ID NO: 19621 - RNA, 27 nt, Artificial Sequence
  Synthetic Oligonucleotide; PD-L1 exon 3; Set C
aauaaagaucaggccucucaucuauaa

SEQ ID NO: 19622 - RNA, 23 nt, Artificial Sequence
  Synthetic Oligonucleotide; PD-L1 exon 3; Set C
uaaagaucaggccucucaucuau

SEQ ID NO: 19623 - RNA, 25 nt, Artificial Sequence
  Synthetic Oligonucleotide; PD-L1 exon 3; Set C
auaaagaucaggccucucaucuaua

SEQ ID NO: 19624 - RNA, 21 nt, Artificial Sequence
  Synthetic Oligonucleotide; PD-L1 exon 3; Set C
aaagaucaggccucucaucua

SEQ ID NO: 19625 - RNA, 34 nt, Artificial Sequence
  Synthetic Oligonucleotide; PD-L1 exon 3; Set B
uuucaauaaagaucaggccucucaucuauaauaa

SEQ ID NO: 19626 - RNA, 36 nt, Artificial Sequence
  Synthetic Oligonucleotide; PD-L1 exon 3; Set B
uuuucaauaaagaucaggccucucaucuauaauaau

SEQ ID NO: 19627 - RNA, 40 nt, Artificial Sequence
  Synthetic Oligonucleotide; PD-L1 exon 3; Set B
uguuuucaauaaagaucaggccucucaucuauaauaauuc

SEQ ID NO: 19628 - RNA, 38 nt, Artificial Sequence
  Synthetic Oligonucleotide; PD-L1 exon 3; Set B
guuuucaauaaagaucaggccucucaucuauaauaauu

SEQ ID NO: 19629 - RNA, 24 nt, Artificial Sequence
  Synthetic Oligonucleotide; PD-L1 exon 3; Set C
auaaagaucaggccucucaucuau

SEQ ID NO: 19630 - RNA, 26 nt, Artificial Sequence
  Synthetic Oligonucleotide; PD-L1 exon 3; Set C
aauaaagaucaggccucucaucuaua

SEQ ID NO: 19631 - RNA, 22 nt, Artificial Sequence
  Synthetic Oligonucleotide; PD-L1 exon 3; Set C
uaaagaucaggccucucaucua

SEQ ID NO: 19632 - RNA, 33 nt, Artificial Sequence
  Synthetic Oligonucleotide; PD-L1 exon 3; Set B
uuucaauaaagaucaggccucucaucuauaaua

SEQ ID NO: 19633 - RNA, 35 nt, Artificial Sequence
  Synthetic Oligonucleotide; PD-L1 exon 3; Set B
uuuucaauaaagaucaggccucucaucuauaauaa

SEQ ID NO: 19634 - RNA, 37 nt, Artificial Sequence
  Synthetic Oligonucleotide; PD-L1 exon 3; Set B
guuuucaauaaagaucaggccucucaucuauaauaau

SEQ ID NO: 19635 - RNA, 39 nt, Artificial Sequence
  Synthetic Oligonucleotide; PD-L1 exon 3; Set B
uguuuucaauaaagaucaggccucucaucuauaauaauu

SEQ ID NO: 19636 - RNA, 25 nt, Artificial Sequence
  Synthetic Oligonucleotide; PD-L1 exon 3; Set C
aauaaagaucaggccucucaucuau

SEQ ID NO: 19637 - RNA, 23 nt, Artificial Sequence
  Synthetic Oligonucleotide; PD-L1 exon 3; Set C
auaaagaucaggccucucaucua

SEQ ID NO: 19638 - RNA, 32 nt, Artificial Sequence
  Synthetic Oligonucleotide; PD-L1 exon 3; Set B
uuucaauaaagaucaggccucucaucuauaau

SEQ ID NO: 19639 - RNA, 34 nt, Artificial Sequence
  Synthetic Oligonucleotide; PD-L1 exon 3; Set B
uuuucaauaaagaucaggccucucaucuauaaua

SEQ ID NO: 19640 - RNA, 38 nt, Artificial Sequence
  Synthetic Oligonucleotide; PD-L1 exon 3; Set B
uguuuucaauaaagaucaggccucucaucuauaauaau

SEQ ID NO: 19641 - RNA, 36 nt, Artificial Sequence
  Synthetic Oligonucleotide; PD-L1 exon 3; Set B
guuuucaauaaagaucaggccucucaucuauaauaa

SEQ ID NO: 19642 - RNA, 24 nt, Artificial Sequence
  Synthetic Oligonucleotide; PD-L1 exon 3; Set C
aauaaagaucaggccucucaucua

SEQ ID NO: 19643 - RNA, 33 nt, Artificial Sequence
  Synthetic Oligonucleotide; PD-L1 exon 3; Set B
uuuucaauaaagaucaggccucucaucuauaau

SEQ ID NO: 19644 - RNA, 37 nt, Artificial Sequence
  Synthetic Oligonucleotide; PD-L1 exon 3; Set B
uguuuucaauaaagaucaggccucucaucuauaauaa

SEQ ID NO: 19645 - RNA, 35 nt, Artificial Sequence
  Synthetic Oligonucleotide; PD-L1 exon 3; Set B
guuuucaauaaagaucaggccucucaucuauaaua

SEQ ID NO: 19646 - RNA, 36 nt, Artificial Sequence
  Synthetic Oligonucleotide; PD-L1 exon 3; Set B
uguuuucaauaaagaucaggccucucaucuauaaua

SEQ ID NO: 19647 - RNA, 34 nt, Artificial Sequence
  Synthetic Oligonucleotide; PD-L1 exon 3; Set B
guuuucaauaaagaucaggccucucaucuauaau

SEQ ID NO: 19648 - RNA, 35 nt, Artificial Sequence
  Synthetic Oligonucleotide; PD-L1 exon 3; Set B
uguuuucaauaaagaucaggccucucaucuauaau

SEQ ID NO: 19649 - RNA, 27 nt, Artificial Sequence
  Synthetic Oligonucleotide; PD-L1 exon 3; Set C
uuucaauaaagaucaggccucucaucu

SEQ ID NO: 19650 - RNA, 35 nt, Artificial Sequence
  Synthetic Oligonucleotide; PD-L1 exon 3; Set B
auguuuucaauaaagaucaggccucucaucuauaa

SEQ ID NO: 19651 - RNA, 28 nt, Artificial Sequence
  Synthetic Oligonucleotide; PD-L1 exon 3; Set B
uuuucaauaaagaucaggccucucaucu

SEQ ID NO: 19652 - RNA, 36 nt, Artificial Sequence
  Synthetic Oligonucleotide; PD-L1 exon 3; Set B
uauguuuucaauaaagaucaggccucucaucuauaa

SEQ ID NO: 19653 - RNA, 34 nt, Artificial Sequence
  Synthetic Oligonucleotide; PD-L1 exon 3; Set B
auguuuucaauaaagaucaggccucucaucuaua

SEQ ID NO: 19654 - RNA, 29 nt, Artificial Sequence
  Synthetic Oligonucleotide; PD-L1 exon 3; Set B
guuuucaauaaagaucaggccucucaucu

SEQ ID NO: 19655 - RNA, 37 nt, Artificial Sequence
  Synthetic Oligonucleotide; PD-L1 exon 3; Set B
auauguuuucaauaaagaucaggccucucaucuauaa

SEQ ID NO: 19656 - RNA, 35 nt, Artificial Sequence
  Synthetic Oligonucleotide; PD-L1 exon 3; Set B
uauguuuucaauaaagaucaggccucucaucuaua

SEQ ID NO: 19657 - RNA, 33 nt, Artificial Sequence
  Synthetic Oligonucleotide; PD-L1 exon 3; Set B
auguuuucaauaaagaucaggccucucaucuau

SEQ ID NO: 19658 - RNA, 30 nt, Artificial Sequence
  Synthetic Oligonucleotide; PD-L1 exon 3; Set B
uguuuucaauaaagaucaggccucucaucu

SEQ ID NO: 19659 - RNA, 36 nt, Artificial Sequence
  Synthetic Oligonucleotide; PD-L1 exon 3; Set B
auauguuuucaauaaagaucaggccucucaucuaua

SEQ ID NO: 19660 - RNA, 34 nt, Artificial Sequence
  Synthetic Oligonucleotide; PD-L1 exon 3; Set B
uauguuuucaauaaagaucaggccucucaucuau

SEQ ID NO: 19661 - RNA, 32 nt, Artificial Sequence
  Synthetic Oligonucleotide; PD-L1 exon 3; Set B
auguuuucaauaaagaucaggccucucaucua

SEQ ID NO: 19662 - RNA, 31 nt, Artificial Sequence
  Synthetic Oligonucleotide; PD-L1 exon 3; Set B
auguuuucaauaaagaucaggccucucaucu

SEQ ID NO: 19663 - RNA, 35 nt, Artificial Sequence
  Synthetic Oligonucleotide; PD-L1 exon 3; Set B
auauguuuucaauaaagaucaggccucucaucuau

SEQ ID NO: 19664 - RNA, 33 nt, Artificial Sequence
  Synthetic Oligonucleotide; PD-L1 exon 3; Set B
uauguuuucaauaaagaucaggccucucaucua

SEQ ID NO: 19665 - RNA, 32 nt, Artificial Sequence
  Synthetic Oligonucleotide; PD-L1 exon 3; Set B
uauguuuucaauaaagaucaggccucucaucu

SEQ ID NO: 19666 - RNA, 34 nt, Artificial Sequence
  Synthetic Oligonucleotide; PD-L1 exon 3; Set B
auauguuuucaauaaagaucaggccucucaucua

SEQ ID NO: 19667 - RNA, 33 nt, Artificial Sequence
  Synthetic Oligonucleotide; PD-L1 exon 3; Set B
auauguuuucaauaaagaucaggccucucaucu

SEQ ID NO: 19668 - RNA, 15 nt, Artificial Sequence
  Synthetic Oligonucleotide; PD-L1 exon 3; Set C
ggaauauguuuucaa

SEQ ID NO: 19669 - RNA, 38 nt, Artificial Sequence
  Synthetic Oligonucleotide; PD-L1 exon 3; Set A
aaagaaggacaaucuucagaaaagggaaaauuccucga

SEQ ID NO: 19670 - RNA, 39 nt, Artificial Sequence
  Synthetic Oligonucleotide; PD-L1 exon 3; Set A
gaaagaaggacaaucuucagaaaagggaaaauuccucga

SEQ ID NO: 19671 - RNA, 40 nt, Artificial Sequence
  Synthetic Oligonucleotide; PD-L1 exon 3; Set A
agaaagaaggacaaucuucagaaaagggaaaauuccucga

SEQ ID NO: 19672 - RNA, 33 nt, Artificial Sequence
  Synthetic Oligonucleotide; PD-L1 exon 3; Set C
caguaaaugcuaaaaagaaagaaggacaaucuu

SEQ ID NO: 19673 - RNA, 32 nt, Artificial Sequence
  Synthetic Oligonucleotide; PD-L1 exon 3; Set C
caguaaaugcuaaaaagaaagaaggacaaucu

SEQ ID NO: 19674 - RNA, 33 nt, Artificial Sequence
  Synthetic Oligonucleotide; PD-L1 exon 3; Set C
acaguaaaugcuaaaaagaaagaaggacaaucu

SEQ ID NO: 19675 - RNA, 31 nt, Artificial Sequence
  Synthetic Oligonucleotide; PD-L1 exon 3; Set C
caguaaaugcuaaaaagaaagaaggacaauc

SEQ ID NO: 19676 - RNA, 34 nt, Artificial Sequence
  Synthetic Oligonucleotide; PD-L1 exon 3; Set C
gacaguaaaugcuaaaaagaaagaaggacaaucu

SEQ ID NO: 19677 - RNA, 30 nt, Artificial Sequence
  Synthetic Oligonucleotide; PD-L1 exon 3; Set C
caguaaaugcuaaaaagaaagaaggacaau

SEQ ID NO: 19678 - RNA, 32 nt, Artificial Sequence
  Synthetic Oligonucleotide; PD-L1 exon 3; Set C
acaguaaaugcuaaaaagaaagaaggacaauc

SEQ ID NO: 19679 - RNA, 29 nt, Artificial Sequence
  Synthetic Oligonucleotide; PD-L1 exon 3; Set C
caguaaaugcuaaaaagaaagaaggacaa

SEQ ID NO: 19680 - RNA, 35 nt, Artificial Sequence
  Synthetic Oligonucleotide; PD-L1 exon 3; Set C
ugacaguaaaugcuaaaaagaaagaaggacaaucu

SEQ ID NO: 19681 - RNA, 31 nt, Artificial Sequence
  Synthetic Oligonucleotide; PD-L1 exon 3; Set C
acaguaaaugcuaaaaagaaagaaggacaau

SEQ ID NO: 19682 - RNA, 33 nt, Artificial Sequence
  Synthetic Oligonucleotide; PD-L1 exon 3; Set C
gacaguaaaugcuaaaaagaaagaaggacaauc

SEQ ID NO: 19683 - RNA, 28 nt, Artificial Sequence
  Synthetic Oligonucleotide; PD-L1 exon 3; Set C
caguaaaugcuaaaaagaaagaaggaca

SEQ ID NO: 19684 - RNA, 32 nt, Artificial Sequence
  Synthetic Oligonucleotide; PD-L1 exon 3; Set C
gacaguaaaugcuaaaaagaaagaaggacaau

SEQ ID NO: 19685 - RNA, 34 nt, Artificial Sequence
  Synthetic Oligonucleotide; PD-L1 exon 3; Set C
ugacaguaaaugcuaaaaagaaagaaggacaauc

SEQ ID NO: 19686 - RNA, 29 nt, Artificial Sequence
  Synthetic Oligonucleotide; PD-L1 exon 3; Set C
acaguaaaugcuaaaaagaaagaaggaca

SEQ ID NO: 19687 - RNA, 27 nt, Artificial Sequence
  Synthetic Oligonucleotide; PD-L1 exon 3; Set C
caguaaaugcuaaaaagaaagaaggac

SEQ ID NO: 19688 - RNA, 37 nt, Artificial Sequence
  Synthetic Oligonucleotide; PD-L1 exon 3; Set A
cgugacaguaaaugcuaaaaagaaagaaggacaaucu

SEQ ID NO: 19689 - RNA, 33 nt, Artificial Sequence
  Synthetic Oligonucleotide; PD-L1 exon 3; Set C
ugacaguaaaugcuaaaaagaaagaaggacaau

SEQ ID NO: 19690 - RNA, 35 nt, Artificial Sequence
  Synthetic Oligonucleotide; PD-L1 exon 3; Set C
gugacaguaaaugcuaaaaagaaagaaggacaauc

SEQ ID NO: 19691 - RNA, 26 nt, Artificial Sequence
  Synthetic Oligonucleotide; PD-L1 exon 3; Set C
caguaaaugcuaaaaagaaagaagga

SEQ ID NO: 19692 - RNA, 30 nt, Artificial Sequence
  Synthetic Oligonucleotide; PD-L1 exon 3; Set C
gacaguaaaugcuaaaaagaaagaaggaca

SEQ ID NO: 19693 - RNA, 28 nt, Artificial Sequence
  Synthetic Oligonucleotide; PD-L1 exon 3; Set C
acaguaaaugcuaaaaagaaagaaggac

SEQ ID NO: 19694 - RNA, 34 nt, Artificial Sequence
  Synthetic Oligonucleotide; PD-L1 exon 3; Set C
gugacaguaaaugcuaaaaagaaagaaggacaau

SEQ ID NO: 19695 - RNA, 36 nt, Artificial Sequence
  Synthetic Oligonucleotide; PD-L1 exon 3; Set C
cgugacaguaaaugcuaaaaagaaagaaggacaauc

SEQ ID NO: 19696 - RNA, 27 nt, Artificial Sequence
  Synthetic Oligonucleotide; PD-L1 exon 3; Set C
acaguaaaugcuaaaaagaaagaagga

SEQ ID NO: 19697 - RNA, 25 nt, Artificial Sequence
  Synthetic Oligonucleotide; PD-L1 exon 3; Set C
caguaaaugcuaaaaagaaagaagg

SEQ ID NO: 19698 - RNA, 29 nt, Artificial Sequence
  Synthetic Oligonucleotide; PD-L1 exon 3; Set C
gacaguaaaugcuaaaaagaaagaaggac

SEQ ID NO: 19699 - RNA, 35 nt, Artificial Sequence
  Synthetic Oligonucleotide; PD-L1 exon 3; Set C
cgugacaguaaaugcuaaaaagaaagaaggacaau

SEQ ID NO: 19700 - RNA, 28 nt, Artificial Sequence
  Synthetic Oligonucleotide; PD-L1 exon 3; Set C
gacaguaaaugcuaaaaagaaagaagga

SEQ ID NO: 19701 - RNA, 26 nt, Artificial Sequence
  Synthetic Oligonucleotide; PD-L1 exon 3; Set C
acaguaaaugcuaaaaagaaagaagg

SEQ ID NO: 19702 - RNA, 24 nt, Artificial Sequence
  Synthetic Oligonucleotide; PD-L1 exon 3; Set C
caguaaaugcuaaaaagaaagaag

SEQ ID NO: 19703 - RNA, 23 nt, Artificial Sequence
  Synthetic Oligonucleotide; PD-L1 exon 3; Set C
caguaaaugcuaaaaagaaagaa

SEQ ID NO: 19704 - RNA, 29 nt, Artificial Sequence
  Synthetic Oligonucleotide; PD-L1 exon 3; Set C
ugacaguaaaugcuaaaaagaaagaagga

SEQ ID NO: 19705 - RNA, 27 nt, Artificial Sequence
  Synthetic Oligonucleotide; PD-L1 exon 3; Set C
gacaguaaaugcuaaaaagaaagaagg

SEQ ID NO: 19706 - RNA, 25 nt, Artificial Sequence
  Synthetic Oligonucleotide; PD-L1 exon 3; Set C
acaguaaaugcuaaaaagaaagaag

SEQ ID NO: 19707 - RNA, 33 nt, Artificial Sequence
  Synthetic Oligonucleotide; PD-L1 exon 3; Set C
cgugacaguaaaugcuaaaaagaaagaaggaca

SEQ ID NO: 19708 - RNA, 22 nt, Artificial Sequence
  Synthetic Oligonucleotide; PD-L1 exon 3; Set C
caguaaaugcuaaaaagaaaga

SEQ ID NO: 19709 - RNA, 24 nt, Artificial Sequence
  Synthetic Oligonucleotide; PD-L1 exon 3; Set C
acaguaaaugcuaaaaagaaagaa

SEQ ID NO: 19710 - RNA, 28 nt, Artificial Sequence
  Synthetic Oligonucleotide; PD-L1 exon 3; Set C
ugacaguaaaugcuaaaaagaaagaagg

SEQ ID NO: 19711 - RNA, 26 nt, Artificial Sequence
  Synthetic Oligonucleotide; PD-L1 exon 3; Set C
gacaguaaaugcuaaaaagaaagaag

SEQ ID NO: 19712 - RNA, 32 nt, Artificial Sequence
  Synthetic Oligonucleotide; PD-L1 exon 3; Set C
cgugacaguaaaugcuaaaaagaaagaaggac

SEQ ID NO: 19713 - RNA, 23 nt, Artificial Sequence
  Synthetic Oligonucleotide; PD-L1 exon 3; Set C
acaguaaaugcuaaaaagaaaga

SEQ ID NO: 19714 - RNA, 21 nt, Artificial Sequence
  Synthetic Oligonucleotide; PD-L1 exon 3; Set C
caguaaaugcuaaaaagaaag

SEQ ID NO: 19715 - RNA, 25 nt, Artificial Sequence
  Synthetic Oligonucleotide; PD-L1 exon 3; Set C
gacaguaaaugcuaaaaagaaagaa

SEQ ID NO: 19716 - RNA, 31 nt, Artificial Sequence
  Synthetic Oligonucleotide; PD-L1 exon 3; Set C
cgugacaguaaaugcuaaaaagaaagaagga

SEQ ID NO: 19717 - RNA, 27 nt, Artificial Sequence
  Synthetic Oligonucleotide; PD-L1 exon 3; Set C
ugacaguaaaugcuaaaaagaaagaag

SEQ ID NO: 19718 - RNA, 20 nt, Artificial Sequence
  Synthetic Oligonucleotide; PD-L1 exon 3; Set C
caguaaaugcuaaaaagaaa

SEQ ID NO: 19719 - RNA, 24 nt, Artificial Sequence
  Synthetic Oligonucleotide; PD-L1 exon 3; Set C
gacaguaaaugcuaaaaagaaaga

SEQ ID NO: 19720 - RNA, 22 nt, Artificial Sequence
  Synthetic Oligonucleotide; PD-L1 exon 3; Set C
acaguaaaugcuaaaaagaaag

SEQ ID NO: 19721 - RNA, 26 nt, Artificial Sequence
  Synthetic Oligonucleotide; PD-L1 exon 3; Set C
ugacaguaaaugcuaaaaagaaagaa

SEQ ID NO: 19722 - RNA, 30 nt, Artificial Sequence
  Synthetic Oligonucleotide; PD-L1 exon 3; Set C
cgugacaguaaaugcuaaaaagaaagaagg

SEQ ID NO: 19723 - RNA, 21 nt, Artificial Sequence
  Synthetic Oligonucleotide; PD-L1 exon 3; Set C
acaguaaaugcuaaaaagaaa

SEQ ID NO: 19724 - RNA, 19 nt, Artificial Sequence
  Synthetic Oligonucleotide; PD-L1 exon 3; Set C
caguaaaugcuaaaaagaa

SEQ ID NO: 19725 - RNA, 25 nt, Artificial Sequence
  Synthetic Oligonucleotide; PD-L1 exon 3; Set C
ugacaguaaaugcuaaaaagaaaga

SEQ ID NO: 19726 - RNA, 23 nt, Artificial Sequence
  Synthetic Oligonucleotide; PD-L1 exon 3; Set C
gacaguaaaugcuaaaaagaaag

SEQ ID NO: 19727 - RNA, 27 nt, Artificial Sequence
  Synthetic Oligonucleotide; PD-L1 exon 3; Set C
gugacaguaaaugcuaaaaagaaagaa

SEQ ID NO: 19728 - RNA, 29 nt, Artificial Sequence
  Synthetic Oligonucleotide; PD-L1 exon 3; Set C
cgugacaguaaaugcuaaaaagaaagaag

SEQ ID NO: 19729 - RNA, 18 nt, Artificial Sequence
  Synthetic Oligonucleotide; PD-L1 exon 3; Set C
caguaaaugcuaaaaaga

SEQ ID NO: 19730 - RNA, 22 nt, Artificial Sequence
  Synthetic Oligonucleotide; PD-L1 exon 3; Set C
gacaguaaaugcuaaaaagaaa

SEQ ID NO: 19731 - RNA, 20 nt, Artificial Sequence
  Synthetic Oligonucleotide; PD-L1 exon 3; Set C
acaguaaaugcuaaaaagaa

SEQ ID NO: 19732 - RNA, 24 nt, Artificial Sequence
  Synthetic Oligonucleotide; PD-L1 exon 3; Set C
ugacaguaaaugcuaaaaagaaag

SEQ ID NO: 19733 - RNA, 28 nt, Artificial Sequence
  Synthetic Oligonucleotide; PD-L1 exon 3; Set C
cgugacaguaaaugcuaaaaagaaagaa

SEQ ID NO: 19734 - RNA, 19 nt, Artificial Sequence
  Synthetic Oligonucleotide; PD-L1 exon 3; Set C
acaguaaaugcuaaaaaga

SEQ ID NO: 19735 - RNA, 23 nt, Artificial Sequence
  Synthetic Oligonucleotide; PD-L1 exon 3; Set C
ugacaguaaaugcuaaaaagaaa

SEQ ID NO: 19736 - RNA, 21 nt, Artificial Sequence
  Synthetic Oligonucleotide; PD-L1 exon 3; Set C
gacaguaaaugcuaaaaagaa

SEQ ID NO: 19737 - RNA, 27 nt, Artificial Sequence
  Synthetic Oligonucleotide; PD-L1 exon 3; Set C
cgugacaguaaaugcuaaaaagaaaga

SEQ ID NO: 19738 - RNA, 25 nt, Artificial Sequence
  Synthetic Oligonucleotide; PD-L1 exon 3; Set C
gugacaguaaaugcuaaaaagaaag

SEQ ID NO: 19739 - RNA, 39 nt, Artificial Sequence
  Synthetic Oligonucleotide; PD-L1 exon 3; Set A
gggaaccgugacaguaaaugcuaaaaagaaagaaggaca

SEQ ID NO: 19740 - RNA, 18 nt, Artificial Sequence
  Synthetic Oligonucleotide; PD-L1 exon 3; Set C
acaguaaaugcuaaaaag

SEQ ID NO: 19741 - RNA, 20 nt, Artificial Sequence
  Synthetic Oligonucleotide; PD-L1 exon 3; Set C
gacaguaaaugcuaaaaaga

SEQ ID NO: 19742 - RNA, 22 nt, Artificial Sequence
  Synthetic Oligonucleotide; PD-L1 exon 3; Set C
ugacaguaaaugcuaaaaagaa

SEQ ID NO: 19743 - RNA, 26 nt, Artificial Sequence
  Synthetic Oligonucleotide; PD-L1 exon 3; Set C
cgugacaguaaaugcuaaaaagaaag

SEQ ID NO: 19744 - RNA, 38 nt, Artificial Sequence
  Synthetic Oligonucleotide; PD-L1 exon 3; Set A
gggaaccgugacaguaaaugcuaaaaagaaagaaggac

SEQ ID NO: 19745 - RNA, 17 nt, Artificial Sequence
  Synthetic Oligonucleotide; PD-L1 exon 3; Set C
acaguaaaugcuaaaaa

SEQ ID NO: 19746 - RNA, 19 nt, Artificial Sequence
  Synthetic Oligonucleotide; PD-L1 exon 3; Set C
gacaguaaaugcuaaaaag

SEQ ID NO: 19747 - RNA, 21 nt, Artificial Sequence
  Synthetic Oligonucleotide; PD-L1 exon 3; Set C
ugacaguaaaugcuaaaaaga

SEQ ID NO: 19748 - RNA, 23 nt, Artificial Sequence
  Synthetic Oligonucleotide; PD-L1 exon 3; Set C
gugacaguaaaugcuaaaaagaa

SEQ ID NO: 19749 - RNA, 25 nt, Artificial Sequence
  Synthetic Oligonucleotide; PD-L1 exon 3; Set C
cgugacaguaaaugcuaaaaagaaa

SEQ ID NO: 19750 - RNA, 37 nt, Artificial Sequence
  Synthetic Oligonucleotide; PD-L1 exon 3; Set A
gggaaccgugacaguaaaugcuaaaaagaaagaagga

SEQ ID NO: 19751 - RNA, 18 nt, Artificial Sequence
  Synthetic Oligonucleotide; PD-L1 exon 3; Set C
gacaguaaaugcuaaaaa

SEQ ID NO: 19752 - RNA, 20 nt, Artificial Sequence
  Synthetic Oligonucleotide; PD-L1 exon 3; Set C
ugacaguaaaugcuaaaaag

SEQ ID NO: 19753 - RNA, 22 nt, Artificial Sequence
  Synthetic Oligonucleotide; PD-L1 exon 3; Set C
gugacaguaaaugcuaaaaaga

SEQ ID NO: 19754 - RNA, 24 nt, Artificial Sequence
  Synthetic Oligonucleotide; PD-L1 exon 3; Set C
cgugacaguaaaugcuaaaaagaa

SEQ ID NO: 19755 - RNA, 36 nt, Artificial Sequence
  Synthetic Oligonucleotide; PD-L1 exon 3; Set A
gggaaccgugacaguaaaugcuaaaaagaaagaagg

SEQ ID NO: 19756 - RNA, 19 nt, Artificial Sequence
  Synthetic Oligonucleotide; PD-L1 exon 3; Set C
ugacaguaaaugcuaaaaa

SEQ ID NO: 19757 - RNA, 17 nt, Artificial Sequence
  Synthetic Oligonucleotide; PD-L1 exon 3; Set C
gacaguaaaugcuaaaa

SEQ ID NO: 19758 - RNA, 21 nt, Artificial Sequence
  Synthetic Oligonucleotide; PD-L1 exon 3; Set C
gugacaguaaaugcuaaaaag

SEQ ID NO: 19759 - RNA, 23 nt, Artificial Sequence
  Synthetic Oligonucleotide; PD-L1 exon 3; Set C
cgugacaguaaaugcuaaaaaga

SEQ ID NO: 19760 - RNA, 37 nt, Artificial Sequence
  Synthetic Oligonucleotide; PD-L1 exon 3; Set A
ugggaaccgugacaguaaaugcuaaaaagaaagaagg

SEQ ID NO: 19761 - RNA, 35 nt, Artificial Sequence
  Synthetic Oligonucleotide; PD-L1 exon 3; Set A
gggaaccgugacaguaaaugcuaaaaagaaagaag

SEQ ID NO: 19762 - RNA, 20 nt, Artificial Sequence
  Synthetic Oligonucleotide; PD-L1 exon 3; Set C
gugacaguaaaugcuaaaaa

SEQ ID NO: 19763 - RNA, 18 nt, Artificial Sequence
  Synthetic Oligonucleotide; PD-L1 exon 3; Set C
ugacaguaaaugcuaaaa

SEQ ID NO: 19764 - RNA, 22 nt, Artificial Sequence
  Synthetic Oligonucleotide; PD-L1 exon 3; Set C
cgugacaguaaaugcuaaaaag

SEQ ID NO: 19765 - RNA, 34 nt, Artificial Sequence
  Synthetic Oligonucleotide; PD-L1 exon 3; Set A
gggaaccgugacaguaaaugcuaaaaagaaagaa

SEQ ID NO: 19766 - RNA, 40 nt, Artificial Sequence
  Synthetic Oligonucleotide; PD-L1 exon 3; Set A
cuugggaaccgugacaguaaaugcuaaaaagaaagaagga

SEQ ID NO: 19767 - RNA, 36 nt, Artificial Sequence
  Synthetic Oligonucleotide; PD-L1 exon 3; Set A
ugggaaccgugacaguaaaugcuaaaaagaaagaag

SEQ ID NO: 19768 - RNA, 19 nt, Artificial Sequence
  Synthetic Oligonucleotide; PD-L1 exon 3; Set C
gugacaguaaaugcuaaaa

SEQ ID NO: 19769 - RNA, 17 nt, Artificial Sequence
  Synthetic Oligonucleotide; PD-L1 exon 3; Set C
ugacaguaaaugcuaaa

SEQ ID NO: 19770 - RNA, 21 nt, Artificial Sequence
  Synthetic Oligonucleotide; PD-L1 exon 3; Set C
cgugacaguaaaugcuaaaaa

SEQ ID NO: 19771 - RNA, 33 nt, Artificial Sequence
  Synthetic Oligonucleotide; PD-L1 exon 3; Set A
gggaaccgugacaguaaaugcuaaaaagaaaga

SEQ ID NO: 19772 - RNA, 35 nt, Artificial Sequence
  Synthetic Oligonucleotide; PD-L1 exon 3; Set A
ugggaaccgugacaguaaaugcuaaaaagaaagaa

SEQ ID NO: 19773 - RNA, 39 nt, Artificial Sequence
  Synthetic Oligonucleotide; PD-L1 exon 3; Set A
cuugggaaccgugacaguaaaugcuaaaaagaaagaagg

SEQ ID NO: 19774 - RNA, 18 nt, Artificial Sequence
  Synthetic Oligonucleotide; PD-L1 exon 3; Set C
gugacaguaaaugcuaaa

SEQ ID NO: 19775 - RNA, 16 nt, Artificial Sequence
  Synthetic Oligonucleotide; PD-L1 exon 3; Set C
ugacaguaaaugcuaa

SEQ ID NO: 19776 - RNA, 20 nt, Artificial Sequence
  Synthetic Oligonucleotide; PD-L1 exon 3; Set C
cgugacaguaaaugcuaaaa

SEQ ID NO: 19777 - RNA, 34 nt, Artificial Sequence
  Synthetic Oligonucleotide; PD-L1 exon 3; Set A
ugggaaccgugacaguaaaugcuaaaaagaaaga

SEQ ID NO: 19778 - RNA, 32 nt, Artificial Sequence
  Synthetic Oligonucleotide; PD-L1 exon 3; Set C
gggaaccgugacaguaaaugcuaaaaagaaag

SEQ ID NO: 19779 - RNA, 36 nt, Artificial Sequence
  Synthetic Oligonucleotide; PD-L1 exon 3; Set A
uugggaaccgugacaguaaaugcuaaaaagaaagaa

SEQ ID NO: 19780 - RNA, 38 nt, Artificial Sequence
  Synthetic Oligonucleotide; PD-L1 exon 3; Set A
cuugggaaccgugacaguaaaugcuaaaaagaaagaag

SEQ ID NO: 19781 - RNA, 17 nt, Artificial Sequence
  Synthetic Oligonucleotide; PD-L1 exon 3; Set C
gugacaguaaaugcuaa

SEQ ID NO: 19782 - RNA, 19 nt, Artificial Sequence
  Synthetic Oligonucleotide; PD-L1 exon 3; Set C
cgugacaguaaaugcuaaa

SEQ ID NO: 19783 - RNA, 31 nt, Artificial Sequence
  Synthetic Oligonucleotide; PD-L1 exon 3; Set C
gggaaccgugacaguaaaugcuaaaaagaaa

SEQ ID NO: 19784 - RNA, 33 nt, Artificial Sequence
  Synthetic Oligonucleotide; PD-L1 exon 3; Set A
ugggaaccgugacaguaaaugcuaaaaagaaag

SEQ ID NO: 19785 - RNA, 37 nt, Artificial Sequence
  Synthetic Oligonucleotide; PD-L1 exon 3; Set A
cuugggaaccgugacaguaaaugcuaaaaagaaagaa

SEQ ID NO: 19786 - RNA, 18 nt, Artificial Sequence
  Synthetic Oligonucleotide; PD-L1 exon 3; Set C
cgugacaguaaaugcuaa

SEQ ID NO: 19787 - RNA, 32 nt, Artificial Sequence
  Synthetic Oligonucleotide; PD-L1 exon 3; Set A
ugggaaccgugacaguaaaugcuaaaaagaaa

SEQ ID NO: 19788 - RNA, 30 nt, Artificial Sequence
  Synthetic Oligonucleotide; PD-L1 exon 3; Set A
gggaaccgugacaguaaaugcuaaaaagaa

SEQ ID NO: 19789 - RNA, 36 nt, Artificial Sequence
  Synthetic Oligonucleotide; PD-L1 exon 3; Set A
cuugggaaccgugacaguaaaugcuaaaaagaaaga

SEQ ID NO: 19790 - RNA, 34 nt, Artificial Sequence
  Synthetic Oligonucleotide; PD-L1 exon 3; Set A
uugggaaccgugacaguaaaugcuaaaaagaaag

SEQ ID NO: 19791 - RNA, 29 nt, Artificial Sequence
  Synthetic Oligonucleotide; PD-L1 exon 3; Set A
gggaaccgugacaguaaaugcuaaaaaga

SEQ ID NO: 19792 - RNA, 31 nt, Artificial Sequence
  Synthetic Oligonucleotide; PD-L1 exon 3; Set A
ugggaaccgugacaguaaaugcuaaaaagaa

SEQ ID NO: 19793 - RNA, 35 nt, Artificial Sequence
  Synthetic Oligonucleotide; PD-L1 exon 3; Set A
cuugggaaccgugacaguaaaugcuaaaaagaaag

SEQ ID NO: 19794 - RNA, 28 nt, Artificial Sequence
  Synthetic Oligonucleotide; PD-L1 exon 3; Set C
gggaaccgugacaguaaaugcuaaaaag

SEQ ID NO: 19795 - RNA, 30 nt, Artificial Sequence
  Synthetic Oligonucleotide; PD-L1 exon 3; Set A
ugggaaccgugacaguaaaugcuaaaaaga

SEQ ID NO: 19796 - RNA, 34 nt, Artificial Sequence
  Synthetic Oligonucleotide; PD-L1 exon 3; Set A
cuugggaaccgugacaguaaaugcuaaaaagaaa

SEQ ID NO: 19797 - RNA, 27 nt, Artificial Sequence
  Synthetic Oligonucleotide; PD-L1 exon 3; Set C
gggaaccgugacaguaaaugcuaaaaa

SEQ ID NO: 19798 - RNA, 29 nt, Artificial Sequence
  Synthetic Oligonucleotide; PD-L1 exon 3; Set C
ugggaaccgugacaguaaaugcuaaaaag

SEQ ID NO: 19799 - RNA, 31 nt, Artificial Sequence
  Synthetic Oligonucleotide; PD-L1 exon 3; Set A
uugggaaccgugacaguaaaugcuaaaaaga

SEQ ID NO: 19800 - RNA, 33 nt, Artificial Sequence
  Synthetic Oligonucleotide; PD-L1 exon 3; Set A
cuugggaaccgugacaguaaaugcuaaaaagaa

SEQ ID NO: 19801 - RNA, 28 nt, Artificial Sequence
  Synthetic Oligonucleotide; PD-L1 exon 3; Set C
ugggaaccgugacaguaaaugcuaaaaa

SEQ ID NO: 19802 - RNA, 26 nt, Artificial Sequence
  Synthetic Oligonucleotide; PD-L1 exon 3; Set C
gggaaccgugacaguaaaugcuaaaa

SEQ ID NO: 19803 - RNA, 30 nt, Artificial Sequence
  Synthetic Oligonucleotide; PD-L1 exon 3; Set A
uugggaaccgugacaguaaaugcuaaaaag

SEQ ID NO: 19804 - RNA, 32 nt, Artificial Sequence
  Synthetic Oligonucleotide; PD-L1 exon 3; Set A
cuugggaaccgugacaguaaaugcuaaaaaga

SEQ ID NO: 19805 - RNA, 29 nt, Artificial Sequence
  Synthetic Oligonucleotide; PD-L1 exon 3; Set A
uugggaaccgugacaguaaaugcuaaaaa

SEQ ID NO: 19806 - RNA, 27 nt, Artificial Sequence
  Synthetic Oligonucleotide; PD-L1 exon 3; Set A
ugggaaccgugacaguaaaugcuaaaa

SEQ ID NO: 19807 - RNA, 25 nt, Artificial Sequence
  Synthetic Oligonucleotide; PD-L1 exon 3; Set A
gggaaccgugacaguaaaugcuaaa

SEQ ID NO: 19808 - RNA, 31 nt, Artificial Sequence
  Synthetic Oligonucleotide; PD-L1 exon 3; Set A
cuugggaaccgugacaguaaaugcuaaaaag

SEQ ID NO: 19809 - RNA, 28 nt, Artificial Sequence
  Synthetic Oligonucleotide; PD-L1 exon 3; Set A
uugggaaccgugacaguaaaugcuaaaa

SEQ ID NO: 19810 - RNA, 26 nt, Artificial Sequence
  Synthetic Oligonucleotide; PD-L1 exon 3; Set A
ugggaaccgugacaguaaaugcuaaa

SEQ ID NO: 19811 - RNA, 24 nt, Artificial Sequence
  Synthetic Oligonucleotide; PD-L1 exon 3; Set A
gggaaccgugacaguaaaugcuaa

SEQ ID NO: 19812 - RNA, 30 nt, Artificial Sequence
  Synthetic Oligonucleotide; PD-L1 exon 3; Set A
cuugggaaccgugacaguaaaugcuaaaaa

SEQ ID NO: 19813 - RNA, 27 nt, Artificial Sequence
  Synthetic Oligonucleotide; PD-L1 exon 3; Set A
uugggaaccgugacaguaaaugcuaaa

SEQ ID NO: 19814 - RNA, 25 nt, Artificial Sequence
  Synthetic Oligonucleotide; PD-L1 exon 3; Set A
ugggaaccgugacaguaaaugcuaa

SEQ ID NO: 19815 - RNA, 29 nt, Artificial Sequence
  Synthetic Oligonucleotide; PD-L1 exon 3; Set A
cuugggaaccgugacaguaaaugcuaaaa

SEQ ID NO: 19816 - RNA, 26 nt, Artificial Sequence
  Synthetic Oligonucleotide; PD-L1 exon 3; Set A
uugggaaccgugacaguaaaugcuaa

SEQ ID NO: 19817 - RNA, 28 nt, Artificial Sequence
  Synthetic Oligonucleotide; PD-L1 exon 3; Set A
cuugggaaccgugacaguaaaugcuaaa

SEQ ID NO: 19818 - RNA, 29 nt, Artificial Sequence
  Synthetic Oligonucleotide; PD-L1 exon 3; Set A
ccuugggaaccgugacaguaaaugcuaaa

SEQ ID NO: 19819 - RNA, 27 nt, Artificial Sequence
  Synthetic Oligonucleotide; PD-L1 exon 3; Set A
cuugggaaccgugacaguaaaugcuaa

SEQ ID NO: 19820 - RNA, 28 nt, Artificial Sequence
  Synthetic Oligonucleotide; PD-L1 exon 3; Set A
ccuugggaaccgugacaguaaaugcuaa

SEQ ID NO: 19821 - RNA, 40 nt, Artificial Sequence
  Synthetic Oligonucleotide; PD-L1 exon 3; Set A
auagguccuugggaaccgugacaguaaaugcuaaaaagaa

SEQ ID NO: 19822 - RNA, 39 nt, Artificial Sequence
  Synthetic Oligonucleotide; PD-L1 exon 3; Set A
auagguccuugggaaccgugacaguaaaugcuaaaaaga

SEQ ID NO: 19823 - RNA, 38 nt, Artificial Sequence
  Synthetic Oligonucleotide; PD-L1 exon 3; Set A
auagguccuugggaaccgugacaguaaaugcuaaaaag

SEQ ID NO: 19824 - RNA, 40 nt, Artificial Sequence
  Synthetic Oligonucleotide; PD-L1 exon 3; Set C
uauagguccuugggaaccgugacaguaaaugcuaaaaaga

SEQ ID NO: 19825 - RNA, 37 nt, Artificial Sequence
  Synthetic Oligonucleotide; PD-L1 exon 3; Set A
auagguccuugggaaccgugacaguaaaugcuaaaaa

SEQ ID NO: 19826 - RNA, 39 nt, Artificial Sequence
  Synthetic Oligonucleotide; PD-L1 exon 3; Set A
uauagguccuugggaaccgugacaguaaaugcuaaaaag

SEQ ID NO: 19827 - RNA, 38 nt, Artificial Sequence
  Synthetic Oligonucleotide; PD-L1 exon 3; Set A
uauagguccuugggaaccgugacaguaaaugcuaaaaa

SEQ ID NO: 19828 - RNA, 36 nt, Artificial Sequence
  Synthetic Oligonucleotide; PD-L1 exon 3; Set A
auagguccuugggaaccgugacaguaaaugcuaaaa

SEQ ID NO: 19829 - RNA, 37 nt, Artificial Sequence
  Synthetic Oligonucleotide; PD-L1 exon 3; Set A
uauagguccuugggaaccgugacaguaaaugcuaaaa

SEQ ID NO: 19830 - RNA, 35 nt, Artificial Sequence
  Synthetic Oligonucleotide; PD-L1 exon 3; Set C
auagguccuugggaaccgugacaguaaaugcuaaa

SEQ ID NO: 19831 - RNA, 36 nt, Artificial Sequence
  Synthetic Oligonucleotide; PD-L1 exon 3; Set C
uauagguccuugggaaccgugacaguaaaugcuaaa

SEQ ID NO: 19832 - RNA, 34 nt, Artificial Sequence
  Synthetic Oligonucleotide; PD-L1 exon 3; Set C
auagguccuugggaaccgugacaguaaaugcuaa

SEQ ID NO: 19833 - RNA, 37 nt, Artificial Sequence
  Synthetic Oligonucleotide; PD-L1 exon 3; Set C
auauagguccuugggaaccgugacaguaaaugcuaaa

SEQ ID NO: 19834 - RNA, 35 nt, Artificial Sequence
  Synthetic Oligonucleotide; PD-L1 exon 3; Set C
uauagguccuugggaaccgugacaguaaaugcuaa

SEQ ID NO: 19835 - RNA, 36 nt, Artificial Sequence
  Synthetic Oligonucleotide; PD-L1 exon 3; Set C
auauagguccuugggaaccgugacaguaaaugcuaa

SEQ ID NO: 19836 - RNA, 24 nt, Artificial Sequence
  Synthetic Oligonucleotide; PD-L1 exon 3; Set A
auagguccuugggaaccgugacag

SEQ ID NO: 19837 - RNA, 23 nt, Artificial Sequence
  Synthetic Oligonucleotide; PD-L1 exon 3; Set A
auagguccuugggaaccgugaca

SEQ ID NO: 19838 - RNA, 25 nt, Artificial Sequence
  Synthetic Oligonucleotide; PD-L1 exon 3; Set A
uauagguccuugggaaccgugacag

SEQ ID NO: 19839 - RNA, 22 nt, Artificial Sequence
  Synthetic Oligonucleotide; PD-L1 exon 3; Set A
auagguccuugggaaccgugac

SEQ ID NO: 19840 - RNA, 24 nt, Artificial Sequence
  Synthetic Oligonucleotide; PD-L1 exon 3; Set A
uauagguccuugggaaccgugaca

SEQ ID NO: 19841 - RNA, 26 nt, Artificial Sequence
  Synthetic Oligonucleotide; PD-L1 exon 3; Set A
auauagguccuugggaaccgugacag

SEQ ID NO: 19842 - RNA, 21 nt, Artificial Sequence
  Synthetic Oligonucleotide; PD-L1 exon 3; Set A
auagguccuugggaaccguga

SEQ ID NO: 19843 - RNA, 23 nt, Artificial Sequence
  Synthetic Oligonucleotide; PD-L1 exon 3; Set A
uauagguccuugggaaccgugac

SEQ ID NO: 19844 - RNA, 20 nt, Artificial Sequence
  Synthetic Oligonucleotide; PD-L1 exon 3; Set A
auagguccuugggaaccgug

SEQ ID NO: 19845 - RNA, 22 nt, Artificial Sequence
  Synthetic Oligonucleotide; PD-L1 exon 3; Set A
uauagguccuugggaaccguga

SEQ ID NO: 19846 - RNA, 21 nt, Artificial Sequence
  Synthetic Oligonucleotide; PD-L1 exon 3; Set A
uauagguccuugggaaccgug

SEQ ID NO: 19847 - RNA, 19 nt, Artificial Sequence
  Synthetic Oligonucleotide; PD-L1 exon 3; Set C
auagguccuugggaaccgu

SEQ ID NO: 19848 - RNA, 20 nt, Artificial Sequence
  Synthetic Oligonucleotide; PD-L1 exon 3; Set A
uauagguccuugggaaccgu

SEQ ID NO: 19849 - RNA, 21 nt, Artificial Sequence
  Synthetic Oligonucleotide; PD-L1 exon 3; Set A
auauagguccuugggaaccgu

SEQ ID NO: 19850 - RNA, 22 nt, Artificial Sequence
  Synthetic Oligonucleotide; PD-L1 exon 3; Set A
cauauagguccuugggaaccgu

SEQ ID NO: 19851 - RNA, 23 nt, Artificial Sequence
  Synthetic Oligonucleotide; PD-L1 exon 3; Set A
acauauagguccuugggaaccgu

SEQ ID NO: 19852 - RNA, 24 nt, Artificial Sequence
  Synthetic Oligonucleotide; PD-L1 exon 3; Set A
cacauauagguccuugggaaccgu

SEQ ID NO: 19853 - RNA, 33 nt, Artificial Sequence
  Synthetic Oligonucleotide; PD-L1 exon 3; Set C
auugcuaccauacucuaccacauauagguccuu

SEQ ID NO: 19854 - RNA, 34 nt, Artificial Sequence
  Synthetic Oligonucleotide; PD-L1 exon 3; Set C
uauugcuaccauacucuaccacauauagguccuu

SEQ ID NO: 19855 - RNA, 21 nt, Artificial Sequence
  Synthetic Oligonucleotide; PD-L1 exon 3; Set C
auugcuaccauacucuaccac

SEQ ID NO: 19856 - RNA, 22 nt, Artificial Sequence
  Synthetic Oligonucleotide; PD-L1 exon 3; Set A
uauugcuaccauacucuaccac

SEQ ID NO: 19857 - RNA, 22 nt, Artificial Sequence
  Synthetic Oligonucleotide; PD-L1 exon 3; Set C
uuugcauucaauugucauauug

SEQ ID NO: 19858 - RNA, 19 nt, Artificial Sequence
  Synthetic Oligonucleotide; PD-L1 exon 3; Set C
uuugcauucaauugucaua

SEQ ID NO: 19859 - RNA, 36 nt, Artificial Sequence
  Synthetic Oligonucleotide; PD-L1 exon 3; Set A
uuuuucuacugggaauuugcauucaauugucauauu

SEQ ID NO: 19860 - RNA, 18 nt, Artificial Sequence
  Synthetic Oligonucleotide; PD-L1 exon 3; Set C
gccaggucuaauuguuuu

SEQ ID NO: 19861 - RNA, 19 nt, Artificial Sequence
  Synthetic Oligonucleotide; PD-L1 exon 3; Set C
agccaggucuaauuguuuu

SEQ ID NO: 19862 - RNA, 20 nt, Artificial Sequence
  Synthetic Oligonucleotide; PD-L1 exon 3; Set C
cagccaggucuaauuguuuu

SEQ ID NO: 19863 - RNA, 18 nt, Artificial Sequence
  Synthetic Oligonucleotide; PD-L1 exon 3; Set C
agccaggucuaauuguuu

SEQ ID NO: 19864 - RNA, 21 nt, Artificial Sequence
  Synthetic Oligonucleotide; PD-L1 exon 3; Set C
gcagccaggucuaauuguuuu

SEQ ID NO: 19865 - RNA, 19 nt, Artificial Sequence
  Synthetic Oligonucleotide; PD-L1 exon 3; Set C
cagccaggucuaauuguuu

SEQ ID NO: 19866 - RNA, 22 nt, Artificial Sequence
  Synthetic Oligonucleotide; PD-L1 exon 3; Set C
ugcagccaggucuaauuguuuu

SEQ ID NO: 19867 - RNA, 20 nt, Artificial Sequence
  Synthetic Oligonucleotide; PD-L1 exon 3; Set C
gcagccaggucuaauuguuu

SEQ ID NO: 19868 - RNA, 21 nt, Artificial Sequence
  Synthetic Oligonucleotide; PD-L1 exon 3; Set C
ugcagccaggucuaauuguuu

SEQ ID NO: 19869 - RNA, 17 nt, Artificial Sequence
  Synthetic Oligonucleotide; PD-L1 exon 3; Set C
caaauugaauaauguuc

SEQ ID NO: 19870 - RNA, 18 nt, Artificial Sequence
  Synthetic Oligonucleotide; PD-L1 exon 3; Set C
acaaauugaauaauguuc

SEQ ID NO: 19871 - RNA, 16 nt, Artificial Sequence
  Synthetic Oligonucleotide; PD-L1 exon 3; Set C
caaauugaauaauguu

SEQ ID NO: 19872 - RNA, 15 nt, Artificial Sequence
  Synthetic Oligonucleotide; PD-L1 exon 3; Set C
caaauugaauaaugu

SEQ ID NO: 19873 - RNA, 17 nt, Artificial Sequence
  Synthetic Oligonucleotide; PD-L1 exon 3; Set C
acaaauugaauaauguu

SEQ ID NO: 19874 - RNA, 16 nt, Artificial Sequence
  Synthetic Oligonucleotide; PD-L1 exon 3; Set C
acaaauugaauaaugu

SEQ ID NO: 19875 - RNA, 21 nt, Artificial Sequence
  Synthetic Oligonucleotide; PD-L1 exon 3; Set C
ugcacaaauugaauaauguuc

SEQ ID NO: 19876 - RNA, 22 nt, Artificial Sequence
  Synthetic Oligonucleotide; PD-L1 exon 3; Set C
augcacaaauugaauaauguuc

SEQ ID NO: 19877 - RNA, 20 nt, Artificial Sequence
  Synthetic Oligonucleotide; PD-L1 exon 3; Set C
ugcacaaauugaauaauguu

SEQ ID NO: 19878 - RNA, 19 nt, Artificial Sequence
  Synthetic Oligonucleotide; PD-L1 exon 3; Set C
ugcacaaauugaauaaugu

SEQ ID NO: 19879 - RNA, 17 nt, Artificial Sequence
  Synthetic Oligonucleotide; PD-L1 exon 3; Set C
gcacaaauugaauaaug

SEQ ID NO: 19880 - RNA, 34 nt, Artificial Sequence
  Synthetic Oligonucleotide; PD-L1 exon 3; Set A
gucuuccucuccaugcacaaauugaauaauguuc

SEQ ID NO: 19881 - RNA, 33 nt, Artificial Sequence
  Synthetic Oligonucleotide; PD-L1 exon 3; Set A
gucuuccucuccaugcacaaauugaauaauguu

SEQ ID NO: 19882 - RNA, 32 nt, Artificial Sequence
  Synthetic Oligonucleotide; PD-L1 exon 3; Set A
ggucuuccucuccaugcacaaauugaauaaug

SEQ ID NO: 19883 - RNA, 39 nt, Artificial Sequence
  Synthetic Oligonucleotide; PD-L1 exon 3; Set C
uucaggucuuccucuccaugcacaaauugaauaauguuc

SEQ ID NO: 19884 - RNA, 33 nt, Artificial Sequence
  Synthetic Oligonucleotide; PD-L1 exon 3; Set A
aggucuuccucuccaugcacaaauugaauaaug

SEQ ID NO: 19885 - RNA, 31 nt, Artificial Sequence
  Synthetic Oligonucleotide; PD-L1 exon 3; Set A
ggucuuccucuccaugcacaaauugaauaau

SEQ ID NO: 19886 - RNA, 38 nt, Artificial Sequence
  Synthetic Oligonucleotide; PD-L1 exon 3; Set A
uucaggucuuccucuccaugcacaaauugaauaauguu

SEQ ID NO: 19887 - RNA, 34 nt, Artificial Sequence
  Synthetic Oligonucleotide; PD-L1 exon 3; Set A
caggucuuccucuccaugcacaaauugaauaaug

SEQ ID NO: 19888 - RNA, 30 nt, Artificial Sequence
  Synthetic Oligonucleotide; PD-L1 exon 3; Set A
ggucuuccucuccaugcacaaauugaauaa

SEQ ID NO: 19889 - RNA, 32 nt, Artificial Sequence
  Synthetic Oligonucleotide; PD-L1 exon 3; Set A
aggucuuccucuccaugcacaaauugaauaau

SEQ ID NO: 19890 - RNA, 37 nt, Artificial Sequence
  Synthetic Oligonucleotide; PD-L1 exon 3; Set A
uucaggucuuccucuccaugcacaaauugaauaaugu

SEQ ID NO: 19891 - RNA, 31 nt, Artificial Sequence
  Synthetic Oligonucleotide; PD-L1 exon 3; Set A
aggucuuccucuccaugcacaaauugaauaa

SEQ ID NO: 19892 - RNA, 33 nt, Artificial Sequence
  Synthetic Oligonucleotide; PD-L1 exon 3; Set A
caggucuuccucuccaugcacaaauugaauaau

SEQ ID NO: 19893 - RNA, 28 nt, Artificial Sequence
  Synthetic Oligonucleotide; PD-L1 exon 3; Set A
ggucuuccucuccaugcacaaauugaau

SEQ ID NO: 19894 - RNA, 32 nt, Artificial Sequence
  Synthetic Oligonucleotide; PD-L1 exon 3; Set A
caggucuuccucuccaugcacaaauugaauaa

SEQ ID NO: 19895 - RNA, 34 nt, Artificial Sequence
  Synthetic Oligonucleotide; PD-L1 exon 3; Set A
ucaggucuuccucuccaugcacaaauugaauaau

SEQ ID NO: 19896 - RNA, 29 nt, Artificial Sequence
  Synthetic Oligonucleotide; PD-L1 exon 3; Set A
aggucuuccucuccaugcacaaauugaau

SEQ ID NO: 19897 - RNA, 33 nt, Artificial Sequence
  Synthetic Oligonucleotide; PD-L1 exon 3; Set A
ucaggucuuccucuccaugcacaaauugaauaa

SEQ ID NO: 19898 - RNA, 30 nt, Artificial Sequence
  Synthetic Oligonucleotide; PD-L1 exon 3; Set A
caggucuuccucuccaugcacaaauugaau

SEQ ID NO: 19899 - RNA, 32 nt, Artificial Sequence
  Synthetic Oligonucleotide; PD-L1 exon 3; Set A
ucaggucuuccucuccaugcacaaauugaaua

SEQ ID NO: 19900 - RNA, 22 nt, Artificial Sequence
  Synthetic Oligonucleotide; PD-L1 exon 3; Set A
ggucuuccucuccaugcacaaa

SEQ ID NO: 19901 - RNA, 28 nt, Artificial Sequence
  Synthetic Oligonucleotide; PD-L1 exon 3; Set A
ucaggucuuccucuccaugcacaaauug

SEQ ID NO: 19902 - RNA, 23 nt, Artificial Sequence
  Synthetic Oligonucleotide; PD-L1 exon 3; Set A
aggucuuccucuccaugcacaaa

SEQ ID NO: 19903 - RNA, 28 nt, Artificial Sequence
  Synthetic Oligonucleotide; PD-L1 exon 3; Set A
uucaggucuuccucuccaugcacaaauu

SEQ ID NO: 19904 - RNA, 32 nt, Artificial Sequence
  Synthetic Oligonucleotide; PD-L1 exon 3; Set C
aaccuucaggucuuccucuccaugcacaaauu

SEQ ID NO: 19905 - RNA, 31 nt, Artificial Sequence
  Synthetic Oligonucleotide; PD-L1 exon 3; Set C
aaccuucaggucuuccucuccaugcacaaau

SEQ ID NO: 19906 - RNA, 21 nt, Artificial Sequence
  Synthetic Oligonucleotide; PD-L1 exon 3; Set A
ucaggucuuccucuccaugca

SEQ ID NO: 19907 - RNA, 40 nt, Artificial Sequence
  Synthetic Oligonucleotide; PD-L1 exon 3; Set C
cuaugcugaaccuucaggucuuccucuccaugcacaaauu

SEQ ID NO: 19908 - RNA, 39 nt, Artificial Sequence
  Synthetic Oligonucleotide; PD-L1 exon 3; Set C
cuaugcugaaccuucaggucuuccucuccaugcacaaau

SEQ ID NO: 19909 - RNA, 38 nt, Artificial Sequence
  Synthetic Oligonucleotide; PD-L1 exon 3; Set C
cuaugcugaaccuucaggucuuccucuccaugcacaaa

SEQ ID NO: 19910 - RNA, 35 nt, Artificial Sequence
  Synthetic Oligonucleotide; PD-L1 exon 3; Set C
acuaugcugaaccuucaggucuuccucuccaugca

SEQ ID NO: 19911 - RNA, 36 nt, Artificial Sequence
  Synthetic Oligonucleotide; PD-L1 exon 3; Set C
uacuaugcugaaccuucaggucuuccucuccaugca

SEQ ID NO: 19912 - RNA, 19 nt, Artificial Sequence
  Synthetic Oligonucleotide; PD-L1 exon 3; Set C
cuaugcugaaccuucaggu

SEQ ID NO: 19913 - RNA, 21 nt, Artificial Sequence
  Synthetic Oligonucleotide; PD-L1 exon 3; Set C
acuaugcugaaccuucagguc

SEQ ID NO: 19914 - RNA, 18 nt, Artificial Sequence
  Synthetic Oligonucleotide; PD-L1 exon 3; Set C
cuaugcugaaccuucagg

SEQ ID NO: 19915 - RNA, 17 nt, Artificial Sequence
  Synthetic Oligonucleotide; PD-L1 exon 3; Set C
cuaugcugaaccuucag

SEQ ID NO: 19916 - RNA, 16 nt, Artificial Sequence
  Synthetic Oligonucleotide; PD-L1 exon 3; Set C
cuaugcugaaccuuca

SEQ ID NO: 19917 - RNA, 22 nt, Artificial Sequence
  Synthetic Oligonucleotide; PD-L1 exon 3; Set A
cuacuaugcugaaccuucaggu

SEQ ID NO: 19918 - RNA, 16 nt, Artificial Sequence
  Synthetic Oligonucleotide; PD-L1 exon 3; Set C
acuaugcugaaccuuc

SEQ ID NO: 19919 - RNA, 19 nt, Artificial Sequence
  Synthetic Oligonucleotide; PD-L1 exon 3; Set C
cuacuaugcugaaccuuca

SEQ ID NO: 19920 - RNA, 17 nt, Artificial Sequence
  Synthetic Oligonucleotide; PD-L1 exon 3; Set C
uacuaugcugaaccuuc

SEQ ID NO: 19921 - RNA, 24 nt, Artificial Sequence
  Synthetic Oligonucleotide; PD-L1 exon 3; Set A
uguagcuacuaugcugaaccuuca

SEQ ID NO: 19922 - RNA, 30 nt, Artificial Sequence
  Synthetic Oligonucleotide; PD-L1 exon 3; Set A
ugucuguagcuacuaugcugaaccuucagg

SEQ ID NO: 19923 - RNA, 29 nt, Artificial Sequence
  Synthetic Oligonucleotide; PD-L1 exon 3; Set A
ugucuguagcuacuaugcugaaccuucag

SEQ ID NO: 19924 - RNA, 15 nt, Artificial Sequence
  Synthetic Oligonucleotide; PD-L1 exon 3; Set C
ugucuguagcuacua

SEQ ID NO: 19925 - RNA, 22 nt, Artificial Sequence
  Synthetic Oligonucleotide; PD-L1 exon 3; Set C
ugugaucugaagugcagcauuu

SEQ ID NO: 19926 - RNA, 21 nt, Artificial Sequence
  Synthetic Oligonucleotide; PD-L1 exon 3; Set C
ugugaucugaagugcagcauu

SEQ ID NO: 19927 - RNA, 22 nt, Artificial Sequence
  Synthetic Oligonucleotide; PD-L1 exon 3; Set C
cugugaucugaagugcagcauu

SEQ ID NO: 19928 - RNA, 20 nt, Artificial Sequence
  Synthetic Oligonucleotide; PD-L1 exon 3; Set C
ugugaucugaagugcagcau

SEQ ID NO: 19929 - RNA, 24 nt, Artificial Sequence
  Synthetic Oligonucleotide; PD-L1 exon 3; Set A
ucugugaucugaagugcagcauuu

SEQ ID NO: 19930 - RNA, 23 nt, Artificial Sequence
  Synthetic Oligonucleotide; PD-L1 exon 3; Set A
ucugugaucugaagugcagcauu

SEQ ID NO: 19931 - RNA, 21 nt, Artificial Sequence
  Synthetic Oligonucleotide; PD-L1 exon 3; Set C
cugugaucugaagugcagcau

SEQ ID NO: 19932 - RNA, 22 nt, Artificial Sequence
  Synthetic Oligonucleotide; PD-L1 exon 3; Set A
ucugugaucugaagugcagcau

SEQ ID NO: 19933 - RNA, 16 nt, Artificial Sequence
  Synthetic Oligonucleotide; PD-L1 exon 3; Set C
ucugugaucugaagug

SEQ ID NO: 19934 - RNA, 16 nt, Artificial Sequence
  Synthetic Oligonucleotide; PD-L1 exon 3; Set C
aucaugcagcgguaca

SEQ ID NO: 19935 - RNA, 15 nt, Artificial Sequence
  Synthetic Oligonucleotide; PD-L1 exon 3; Set C
aucaugcagcgguac

SEQ ID NO: 19936 - RNA, 24 nt, Artificial Sequence
  Synthetic Oligonucleotide; PD-L1 exon 3; Set B
cauagcugaucaugcagcgguaca

SEQ ID NO: 19937 - RNA, 23 nt, Artificial Sequence
  Synthetic Oligonucleotide; PD-L1 exon 3; Set B
cauagcugaucaugcagcgguac

SEQ ID NO: 19938 - RNA, 19 nt, Artificial Sequence
  Synthetic Oligonucleotide; PD-L1 exon 3; Set B
ggcaccaccauagcugauc

SEQ ID NO: 19939 - RNA, 20 nt, Artificial Sequence
  Synthetic Oligonucleotide; PD-L1 exon 3; Set B
cggcaccaccauagcugauc

SEQ ID NO: 19940 - RNA, 25 nt, Artificial Sequence
  Synthetic Oligonucleotide; PD-L1 exon 3; Set C
guagucggcaccaccauagcugauc

SEQ ID NO: 19941 - RNA, 26 nt, Artificial Sequence
  Synthetic Oligonucleotide; PD-L1 exon 3; Set C
uguagucggcaccaccauagcugauc

SEQ ID NO: 19942 - RNA, 27 nt, Artificial Sequence
  Synthetic Oligonucleotide; PD-L1 exon 3; Set C
uuguagucggcaccaccauagcugauc

SEQ ID NO: 19943 - RNA, 28 nt, Artificial Sequence
  Synthetic Oligonucleotide; PD-L1 exon 3; Set C
cuuguagucggcaccaccauagcugauc

SEQ ID NO: 19944 - RNA, 29 nt, Artificial Sequence
  Synthetic Oligonucleotide; PD-L1 exon 3; Set C
gcuuguagucggcaccaccauagcugauc

SEQ ID NO: 19945 - RNA, 30 nt, Artificial Sequence
  Synthetic Oligonucleotide; PD-L1 exon 3; Set C
cgcuuguagucggcaccaccauagcugauc

SEQ ID NO: 19946 - RNA, 31 nt, Artificial Sequence
  Synthetic Oligonucleotide; PD-L1 exon 3; Set C
uucgcuuguagucggcaccaccauagcugau

SEQ ID NO: 19947 - RNA, 34 nt, Artificial Sequence
  Synthetic Oligonucleotide; PD-L1 exon 3; Set C
aauucgcuuguagucggcaccaccauagcugauc

SEQ ID NO: 19948 - RNA, 32 nt, Artificial Sequence
  Synthetic Oligonucleotide; PD-L1 exon 3; Set C
auucgcuuguagucggcaccaccauagcugau

SEQ ID NO: 19949 - RNA, 35 nt, Artificial Sequence
  Synthetic Oligonucleotide; PD-L1 exon 3; Set C
uaauucgcuuguagucggcaccaccauagcugauc

SEQ ID NO: 19950 - RNA, 23 nt, Artificial Sequence
  Synthetic Oligonucleotide; PD-L1 exon 3; Set C
ucgcuuguagucggcaccaccau

SEQ ID NO: 19951 - RNA, 24 nt, Artificial Sequence
  Synthetic Oligonucleotide; PD-L1 exon 3; Set C
uucgcuuguagucggcaccaccau

SEQ ID NO: 19952 - RNA, 25 nt, Artificial Sequence
  Synthetic Oligonucleotide; PD-L1 exon 3; Set C
auucgcuuguagucggcaccaccau

SEQ ID NO: 19953 - RNA, 18 nt, Artificial Sequence
  Synthetic Oligonucleotide; PD-L1 exon 3; Set C
aauucgcuuguagucggc

SEQ ID NO: 19954 - RNA, 17 nt, Artificial Sequence
  Synthetic Oligonucleotide; PD-L1 exon 3; Set C
aauucgcuuguagucgg

SEQ ID NO: 19955 - RNA, 19 nt, Artificial Sequence
  Synthetic Oligonucleotide; PD-L1 exon 3; Set C
uaauucgcuuguagucggc

SEQ ID NO: 19956 - RNA, 35 nt, Artificial Sequence
  Synthetic Oligonucleotide; PD-L1 exon 3; Set C
uuucacaguaauucgcuuguagucggcaccaccau

SEQ ID NO: 19957 - RNA, 18 nt, Artificial Sequence
  Synthetic Oligonucleotide; PD-L1 exon 3; Set C
uaauucgcuuguagucgg

SEQ ID NO: 19958 - RNA, 36 nt, Artificial Sequence
  Synthetic Oligonucleotide; PD-L1 exon 3; Set C
cuuucacaguaauucgcuuguagucggcaccaccau

SEQ ID NO: 19959 - RNA, 22 nt, Artificial Sequence
  Synthetic Oligonucleotide; PD-L1 exon 3; Set C
uuucacaguaauucgcuuguag

SEQ ID NO: 19960 - RNA, 23 nt, Artificial Sequence
  Synthetic Oligonucleotide; PD-L1 exon 3; Set C
cuuucacaguaauucgcuuguag

SEQ ID NO: 19961 - RNA, 38 nt, Artificial Sequence
  Synthetic Oligonucleotide; PD-L1 exon 3; Set C
uuaccauugacuuucacaguaauucgcuuguagucggc

SEQ ID NO: 19962 - RNA, 33 nt, Artificial Sequence
  Synthetic Oligonucleotide; PD-L1 exon 3; Set B
uuaccauugacuuucacaguaauucgcuuguag

SEQ ID NO: 19963 - RNA, 32 nt, Artificial Sequence
  Synthetic Oligonucleotide; PD-L1 exon 3; Set B
uuaccauugacuuucacaguaauucgcuugua

SEQ ID NO: 19964 - RNA, 31 nt, Artificial Sequence
  Synthetic Oligonucleotide; PD-L1 exon 3; Set B
uuaccauugacuuucacaguaauucgcuugu

SEQ ID NO: 19965 - RNA, 30 nt, Artificial Sequence
  Synthetic Oligonucleotide; PD-L1 exon 3; Set B
uuaccauugacuuucacaguaauucgcuug

SEQ ID NO: 19966 - RNA, 29 nt, Artificial Sequence
  Synthetic Oligonucleotide; PD-L1 exon 3; Set B
uuaccauugacuuucacaguaauucgcuu

SEQ ID NO: 19967 - RNA, 28 nt, Artificial Sequence
  Synthetic Oligonucleotide; PD-L1 exon 3; Set B
uuaccauugacuuucacaguaauucgcu

SEQ ID NO: 19968 - RNA, 27 nt, Artificial Sequence
  Synthetic Oligonucleotide; PD-L1 exon 3; Set B
uuaccauugacuuucacaguaauucgc

SEQ ID NO: 19969 - RNA, 23 nt, Artificial Sequence
  Synthetic Oligonucleotide; PD-L1 exon 3; Set C
uuaccauugacuuucacaguaau

SEQ ID NO: 19970 - RNA, 24 nt, Artificial Sequence
  Synthetic Oligonucleotide; PD-L1 exon 3; Set C
cuuaccauugacuuucacaguaau

SEQ ID NO: 19971 - RNA, 23 nt, Artificial Sequence
  Synthetic Oligonucleotide; PD-L1 exon 3; Set C
cuuaccauugacuuucacaguaa

SEQ ID NO: 19972 - RNA, 24 nt, Artificial Sequence
  Synthetic Oligonucleotide; PD-L1 exon 3; Set C
ucuuaccauugacuuucacaguaa

SEQ ID NO: 19973 - RNA, 25 nt, Artificial Sequence
  Synthetic Oligonucleotide; PD-L1 exon 3; Set C
uucuuaccauugacuuucacaguaa

SEQ ID NO: 19974 - RNA, 24 nt, Artificial Sequence
  Synthetic Oligonucleotide; PD-L1 exon 3; Set C
uucuuaccauugacuuucacagua

SEQ ID NO: 19975 - RNA, 25 nt, Artificial Sequence
  Synthetic Oligonucleotide; PD-L1 exon 3; Set C
auucuuaccauugacuuucacagua

SEQ ID NO: 19976 - RNA, 26 nt, Artificial Sequence
  Synthetic Oligonucleotide; PD-L1 exon 3; Set C
aauucuuaccauugacuuucacagua

SEQ ID NO: 19977 - RNA, 27 nt, Artificial Sequence
  Synthetic Oligonucleotide; PD-L1 exon 3; Set C
uaauucuuaccauugacuuucacagua

SEQ ID NO: 19978 - RNA, 23 nt, Artificial Sequence
  Synthetic Oligonucleotide; PD-L1 exon 3; Set C
auucuuaccauugacuuucacag

SEQ ID NO: 19979 - RNA, 16 nt, Artificial Sequence
  Synthetic Oligonucleotide; PD-L1 exon 3; Set C
cuuaccauugacuuuc

SEQ ID NO: 19980 - RNA, 28 nt, Artificial Sequence
  Synthetic Oligonucleotide; PD-L1 exon 3; Set C
auaauucuuaccauugacuuucacagua

SEQ ID NO: 19981 - RNA, 24 nt, Artificial Sequence
  Synthetic Oligonucleotide; PD-L1 exon 3; Set C
aauucuuaccauugacuuucacag

SEQ ID NO: 19982 - RNA, 31 nt, Artificial Sequence
  Synthetic Oligonucleotide; PD-L1 exon 3; Set C
uaauaauucuuaccauugacuuucacaguaa

SEQ ID NO: 19983 - RNA, 17 nt, Artificial Sequence
  Synthetic Oligonucleotide; PD-L1 exon 3; Set C
ucuuaccauugacuuuc

SEQ ID NO: 19984 - RNA, 29 nt, Artificial Sequence
  Synthetic Oligonucleotide; PD-L1 exon 3; Set C
aauaauucuuaccauugacuuucacagua

SEQ ID NO: 19985 - RNA, 25 nt, Artificial Sequence
  Synthetic Oligonucleotide; PD-L1 exon 3; Set C
uaauucuuaccauugacuuucacag

SEQ ID NO: 19986 - RNA, 40 nt, Artificial Sequence
  Synthetic Oligonucleotide; PD-L1 exon 3; Set B
aucuauaauaauucuuaccauugacuuucacaguaauucg

SEQ ID NO: 19987 - RNA, 32 nt, Artificial Sequence
  Synthetic Oligonucleotide; PD-L1 exon 3; Set C
auaauaauucuuaccauugacuuucacaguaa

SEQ ID NO: 19988 - RNA, 18 nt, Artificial Sequence
  Synthetic Oligonucleotide; PD-L1 exon 3; Set C
uucuuaccauugacuuuc

SEQ ID NO: 19989 - RNA, 26 nt, Artificial Sequence
  Synthetic Oligonucleotide; PD-L1 exon 3; Set C
auaauucuuaccauugacuuucacag

SEQ ID NO: 19990 - RNA, 39 nt, Artificial Sequence
  Synthetic Oligonucleotide; PD-L1 exon 3; Set B
aucuauaauaauucuuaccauugacuuucacaguaauuc

SEQ ID NO: 19991 - RNA, 33 nt, Artificial Sequence
  Synthetic Oligonucleotide; PD-L1 exon 3; Set C
uauaauaauucuuaccauugacuuucacaguaa

SEQ ID NO: 19992 - RNA, 19 nt, Artificial Sequence
  Synthetic Oligonucleotide; PD-L1 exon 3; Set C
auucuuaccauugacuuuc

SEQ ID NO: 19993 - RNA, 27 nt, Artificial Sequence
  Synthetic Oligonucleotide; PD-L1 exon 3; Set C
aauaauucuuaccauugacuuucacag

SEQ ID NO: 19994 - RNA, 40 nt, Artificial Sequence
  Synthetic Oligonucleotide; PD-L1 exon 3; Set B
caucuauaauaauucuuaccauugacuuucacaguaauuc

SEQ ID NO: 19995 - RNA, 38 nt, Artificial Sequence
  Synthetic Oligonucleotide; PD-L1 exon 3; Set B
aucuauaauaauucuuaccauugacuuucacaguaauu

SEQ ID NO: 19996 - RNA, 34 nt, Artificial Sequence
  Synthetic Oligonucleotide; PD-L1 exon 3; Set C
cuauaauaauucuuaccauugacuuucacaguaa

SEQ ID NO: 19997 - RNA, 20 nt, Artificial Sequence
  Synthetic Oligonucleotide; PD-L1 exon 3; Set C
aauucuuaccauugacuuuc

SEQ ID NO: 19998 - RNA, 39 nt, Artificial Sequence
  Synthetic Oligonucleotide; PD-L1 exon 3; Set B
caucuauaauaauucuuaccauugacuuucacaguaauu

SEQ ID NO: 19999 - RNA, 21 nt, Artificial Sequence
  Synthetic Oligonucleotide; PD-L1 exon 3; Set C
uaauucuuaccauugacuuuc

SEQ ID NO: 20000 - RNA, 40 nt, Artificial Sequence
  Synthetic Oligonucleotide; PD-L1 exon 3; Set B
ucaucuauaauaauucuuaccauugacuuucacaguaauu

SEQ ID NO: 20001 - RNA, 22 nt, Artificial Sequence
  Synthetic Oligonucleotide; PD-L1 exon 3; Set C
auaauucuuaccauugacuuuc

SEQ ID NO: 20002 - RNA, 34 nt, Artificial Sequence
  Synthetic Oligonucleotide; PD-L1 exon 3; Set B
ucuauaauaauucuuaccauugacuuucacagua

SEQ ID NO: 20003 - RNA, 23 nt, Artificial Sequence
  Synthetic Oligonucleotide; PD-L1 exon 3; Set C
aauaauucuuaccauugacuuuc

SEQ ID NO: 20004 - RNA, 24 nt, Artificial Sequence
  Synthetic Oligonucleotide; PD-L1 exon 3; Set C
uaauaauucuuaccauugacuuuc

SEQ ID NO: 20005 - RNA, 32 nt, Artificial Sequence
  Synthetic Oligonucleotide; PD-L1 exon 3; Set C
ucuauaauaauucuuaccauugacuuucacag

SEQ ID NO: 20006 - RNA, 25 nt, Artificial Sequence
  Synthetic Oligonucleotide; PD-L1 exon 3; Set C
auaauaauucuuaccauugacuuuc

SEQ ID NO: 20007 - RNA, 26 nt, Artificial Sequence
  Synthetic Oligonucleotide; PD-L1 exon 3; Set C
uauaauaauucuuaccauugacuuuc

SEQ ID NO: 20008 - RNA, 20 nt, Artificial Sequence
  Synthetic Oligonucleotide; PD-L1 exon 3; Set C
aauaauucuuaccauugacu

SEQ ID NO: 20009 - RNA, 27 nt, Artificial Sequence
  Synthetic Oligonucleotide; PD-L1 exon 3; Set C
cuauaauaauucuuaccauugacuuuc

SEQ ID NO: 20010 - RNA, 28 nt, Artificial Sequence
  Synthetic Oligonucleotide; PD-L1 exon 3; Set C
ucuauaauaauucuuaccauugacuuuc

SEQ ID NO: 20011 - RNA, 28 nt, Artificial Sequence
  Synthetic Oligonucleotide; PD-L1 exon 3; Set C
aucuauaauaauucuuaccauugacuuu

SEQ ID NO: 20012 - RNA, 27 nt, Artificial Sequence
  Synthetic Oligonucleotide; PD-L1 exon 3; Set C
aucuauaauaauucuuaccauugacuu

SEQ ID NO: 20013 - RNA, 25 nt, Artificial Sequence
  Synthetic Oligonucleotide; PD-L1 exon 3; Set C
ucuauaauaauucuuaccauugacu

SEQ ID NO: 20014 - RNA, 24 nt, Artificial Sequence
  Synthetic Oligonucleotide; PD-L1 exon 3; Set C
ucuauaauaauucuuaccauugac

SEQ ID NO: 20015 - RNA, 23 nt, Artificial Sequence
  Synthetic Oligonucleotide; PD-L1 exon 3; Set C
ucuauaauaauucuuaccauuga

SEQ ID NO: 20016 - RNA, 32 nt, Artificial Sequence
  Synthetic Oligonucleotide; PD-L1 exon 3; Set C
ucucaucuauaauaauucuuaccauugacuuu

SEQ ID NO: 20017 - RNA, 33 nt, Artificial Sequence
  Synthetic Oligonucleotide; PD-L1 exon 3; Set C
cucucaucuauaauaauucuuaccauugacuuu

SEQ ID NO: 20018 - RNA, 31 nt, Artificial Sequence
  Synthetic Oligonucleotide; PD-L1 exon 3; Set C
ucucaucuauaauaauucuuaccauugacuu

SEQ ID NO: 20019 - RNA, 34 nt, Artificial Sequence
  Synthetic Oligonucleotide; PD-L1 exon 3; Set B
ccucucaucuauaauaauucuuaccauugacuuu

SEQ ID NO: 20020 - RNA, 32 nt, Artificial Sequence
  Synthetic Oligonucleotide; PD-L1 exon 3; Set C
cucucaucuauaauaauucuuaccauugacuu

SEQ ID NO: 20021 - RNA, 17 nt, Artificial Sequence
  Synthetic Oligonucleotide; PD-L1 exon 3; Set C
aucuauaauaauucuua

SEQ ID NO: 20022 - RNA, 18 nt, Artificial Sequence
  Synthetic Oligonucleotide; PD-L1 exon 3; Set C
caucuauaauaauucuua

SEQ ID NO: 20023 - RNA, 17 nt, Artificial Sequence
  Synthetic Oligonucleotide; PD-L1 exon 3; Set C
caucuauaauaauucuu

SEQ ID NO: 20024 - RNA, 16 nt, Artificial Sequence
  Synthetic Oligonucleotide; PD-L1 exon 3; Set C
caucuauaauaauucu

SEQ ID NO: 20025 - RNA, 18 nt, Artificial Sequence
  Synthetic Oligonucleotide; PD-L1 exon 3; Set C
ucaucuauaauaauucuu

SEQ ID NO: 20026 - RNA, 15 nt, Artificial Sequence
  Synthetic Oligonucleotide; PD-L1 exon 3; Set C
caucuauaauaauuc

SEQ ID NO: 20027 - RNA, 19 nt, Artificial Sequence
  Synthetic Oligonucleotide; PD-L1 exon 3; Set C
cucaucuauaauaauucuu

SEQ ID NO: 20028 - RNA, 17 nt, Artificial Sequence
  Synthetic Oligonucleotide; PD-L1 exon 3; Set C
ucaucuauaauaauucu

SEQ ID NO: 20029 - RNA, 21 nt, Artificial Sequence
  Synthetic Oligonucleotide; PD-L1 exon 3; Set C
ucucaucuauaauaauucuua

SEQ ID NO: 20030 - RNA, 16 nt, Artificial Sequence
  Synthetic Oligonucleotide; PD-L1 exon 3; Set C
ucaucuauaauaauuc

SEQ ID NO: 20031 - RNA, 18 nt, Artificial Sequence
  Synthetic Oligonucleotide; PD-L1 exon 3; Set C
cucaucuauaauaauucu

SEQ ID NO: 20032 - RNA, 22 nt, Artificial Sequence
  Synthetic Oligonucleotide; PD-L1 exon 3; Set C
cucucaucuauaauaauucuua

SEQ ID NO: 20033 - RNA, 17 nt, Artificial Sequence
  Synthetic Oligonucleotide; PD-L1 exon 3; Set C
cucaucuauaauaauuc

SEQ ID NO: 20034 - RNA, 15 nt, Artificial Sequence
  Synthetic Oligonucleotide; PD-L1 exon 3; Set C
ucaucuauaauaauu

SEQ ID NO: 20035 - RNA, 23 nt, Artificial Sequence
  Synthetic Oligonucleotide; PD-L1 exon 3; Set C
ccucucaucuauaauaauucuua

SEQ ID NO: 20036 - RNA, 16 nt, Artificial Sequence
  Synthetic Oligonucleotide; PD-L1 exon 3; Set C
cucaucuauaauaauu

SEQ ID NO: 20037 - RNA, 20 nt, Artificial Sequence
  Synthetic Oligonucleotide; PD-L1 exon 3; Set C
cucucaucuauaauaauucu

SEQ ID NO: 20038 - RNA, 22 nt, Artificial Sequence
  Synthetic Oligonucleotide; PD-L1 exon 3; Set C
ccucucaucuauaauaauucuu

SEQ ID NO: 20039 - RNA, 15 nt, Artificial Sequence
  Synthetic Oligonucleotide; PD-L1 exon 3; Set C
cucaucuauaauaau

SEQ ID NO: 20040 - RNA, 21 nt, Artificial Sequence
  Synthetic Oligonucleotide; PD-L1 exon 3; Set C
ccucucaucuauaauaauucu

SEQ ID NO: 20041 - RNA, 23 nt, Artificial Sequence
  Synthetic Oligonucleotide; PD-L1 exon 3; Set C
gccucucaucuauaauaauucuu

SEQ ID NO: 20042 - RNA, 20 nt, Artificial Sequence
  Synthetic Oligonucleotide; PD-L1 exon 3; Set C
ccucucaucuauaauaauuc

SEQ ID NO: 20043 - RNA, 22 nt, Artificial Sequence
  Synthetic Oligonucleotide; PD-L1 exon 3; Set C
gccucucaucuauaauaauucu

SEQ ID NO: 20044 - RNA, 19 nt, Artificial Sequence
  Synthetic Oligonucleotide; PD-L1 exon 3; Set C
ccucucaucuauaauaauu

SEQ ID NO: 20045 - RNA, 21 nt, Artificial Sequence
  Synthetic Oligonucleotide; PD-L1 exon 3; Set C
gccucucaucuauaauaauuc

SEQ ID NO: 20046 - RNA, 18 nt, Artificial Sequence
  Synthetic Oligonucleotide; PD-L1 exon 3; Set C
ccucucaucuauaauaau

SEQ ID NO: 20047 - RNA, 20 nt, Artificial Sequence
  Synthetic Oligonucleotide; PD-L1 exon 3; Set C
gccucucaucuauaauaauu

SEQ ID NO: 20048 - RNA, 17 nt, Artificial Sequence
  Synthetic Oligonucleotide; PD-L1 exon 3; Set C
ccucucaucuauaauaa

SEQ ID NO: 20049 - RNA, 19 nt, Artificial Sequence
  Synthetic Oligonucleotide; PD-L1 exon 3; Set C
gccucucaucuauaauaau

SEQ ID NO: 20050 - RNA, 16 nt, Artificial Sequence
  Synthetic Oligonucleotide; PD-L1 exon 3; Set C
ccucucaucuauaaua

SEQ ID NO: 20051 - RNA, 18 nt, Artificial Sequence
  Synthetic Oligonucleotide; PD-L1 exon 3; Set C
gccucucaucuauaauaa

SEQ ID NO: 20052 - RNA, 15 nt, Artificial Sequence
  Synthetic Oligonucleotide; PD-L1 exon 3; Set C
ccucucaucuauaau

SEQ ID NO: 20053 - RNA, 17 nt, Artificial Sequence
  Synthetic Oligonucleotide; PD-L1 exon 3; Set C
gccucucaucuauaaua

SEQ ID NO: 20054 - RNA, 16 nt, Artificial Sequence
  Synthetic Oligonucleotide; PD-L1 exon 3; Set C
gccucucaucuauaau

SEQ ID NO: 20055 - RNA, 15 nt, Artificial Sequence
  Synthetic Oligonucleotide; PD-L1 exon 3; Set C
gccucucaucuauaa

SEQ ID NO: 20056 - RNA, 36 nt, Artificial Sequence
  Synthetic Oligonucleotide; PD-L1 exon 3; Set B
caauaaagaucaggccucucaucuauaauaauucuu

SEQ ID NO: 20057 - RNA, 37 nt, Artificial Sequence
  Synthetic Oligonucleotide; PD-L1 exon 3; Set B
ucaauaaagaucaggccucucaucuauaauaauucuu

SEQ ID NO: 20058 - RNA, 35 nt, Artificial Sequence
  Synthetic Oligonucleotide; PD-L1 exon 3; Set B
caauaaagaucaggccucucaucuauaauaauucu

SEQ ID NO: 20059 - RNA, 34 nt, Artificial Sequence
  Synthetic Oligonucleotide; PD-L1 exon 3; Set C
caauaaagaucaggccucucaucuauaauaauuc

SEQ ID NO: 20060 - RNA, 38 nt, Artificial Sequence
  Synthetic Oligonucleotide; PD-L1 exon 3; Set B
uucaauaaagaucaggccucucaucuauaauaauucuu

SEQ ID NO: 20061 - RNA, 36 nt, Artificial Sequence
  Synthetic Oligonucleotide; PD-L1 exon 3; Set B
ucaauaaagaucaggccucucaucuauaauaauucu

SEQ ID NO: 20062 - RNA, 40 nt, Artificial Sequence
  Synthetic Oligonucleotide; PD-L1 exon 3; Set B
uuucaauaaagaucaggccucucaucuauaauaauucuua

SEQ ID NO: 20063 - RNA, 35 nt, Artificial Sequence
  Synthetic Oligonucleotide; PD-L1 exon 3; Set B
ucaauaaagaucaggccucucaucuauaauaauuc

SEQ ID NO: 20064 - RNA, 33 nt, Artificial Sequence
  Synthetic Oligonucleotide; PD-L1 exon 3; Set C
caauaaagaucaggccucucaucuauaauaauu

SEQ ID NO: 20065 - RNA, 37 nt, Artificial Sequence
  Synthetic Oligonucleotide; PD-L1 exon 3; Set B
uucaauaaagaucaggccucucaucuauaauaauucu

SEQ ID NO: 20066 - RNA, 32 nt, Artificial Sequence
  Synthetic Oligonucleotide; PD-L1 exon 3; Set C
caauaaagaucaggccucucaucuauaauaau

SEQ ID NO: 20067 - RNA, 36 nt, Artificial Sequence
  Synthetic Oligonucleotide; PD-L1 exon 3; Set B
uucaauaaagaucaggccucucaucuauaauaauuc

SEQ ID NO: 20068 - RNA, 34 nt, Artificial Sequence
  Synthetic Oligonucleotide; PD-L1 exon 3; Set C
ucaauaaagaucaggccucucaucuauaauaauu

SEQ ID NO: 20069 - RNA, 33 nt, Artificial Sequence
  Synthetic Oligonucleotide; PD-L1 exon 3; Set C
ucaauaaagaucaggccucucaucuauaauaau

SEQ ID NO: 20070 - RNA, 31 nt, Artificial Sequence
  Synthetic Oligonucleotide; PD-L1 exon 3; Set C
caauaaagaucaggccucucaucuauaauaa

SEQ ID NO: 20071 - RNA, 35 nt, Artificial Sequence
  Synthetic Oligonucleotide; PD-L1 exon 3; Set B
uucaauaaagaucaggccucucaucuauaauaauu

SEQ ID NO: 20072 - RNA, 34 nt, Artificial Sequence
  Synthetic Oligonucleotide; PD-L1 exon 3; Set C
uucaauaaagaucaggccucucaucuauaauaau

SEQ ID NO: 20073 - RNA, 32 nt, Artificial Sequence
  Synthetic Oligonucleotide; PD-L1 exon 3; Set C
ucaauaaagaucaggccucucaucuauaauaa

SEQ ID NO: 20074 - RNA, 30 nt, Artificial Sequence
  Synthetic Oligonucleotide; PD-L1 exon 3; Set C
caauaaagaucaggccucucaucuauaaua

SEQ ID NO: 20075 - RNA, 33 nt, Artificial Sequence
  Synthetic Oligonucleotide; PD-L1 exon 3; Set C
uucaauaaagaucaggccucucaucuauaauaa

SEQ ID NO: 20076 - RNA, 31 nt, Artificial Sequence
  Synthetic Oligonucleotide; PD-L1 exon 3; Set B
ucaauaaagaucaggccucucaucuauaaua

SEQ ID NO: 20077 - RNA, 29 nt, Artificial Sequence
  Synthetic Oligonucleotide; PD-L1 exon 3; Set C
caauaaagaucaggccucucaucuauaau

SEQ ID NO: 20078 - RNA, 32 nt, Artificial Sequence
  Synthetic Oligonucleotide; PD-L1 exon 3; Set B
uucaauaaagaucaggccucucaucuauaaua

SEQ ID NO: 20079 - RNA, 30 nt, Artificial Sequence
  Synthetic Oligonucleotide; PD-L1 exon 3; Set C
ucaauaaagaucaggccucucaucuauaau

SEQ ID NO: 20080 - RNA, 28 nt, Artificial Sequence
  Synthetic Oligonucleotide; PD-L1 exon 3; Set C
caauaaagaucaggccucucaucuauaa

SEQ ID NO: 20081 - RNA, 31 nt, Artificial Sequence
  Synthetic Oligonucleotide; PD-L1 exon 3; Set C
uucaauaaagaucaggccucucaucuauaau

SEQ ID NO: 20082 - RNA, 29 nt, Artificial Sequence
  Synthetic Oligonucleotide; PD-L1 exon 3; Set C
ucaauaaagaucaggccucucaucuauaa

SEQ ID NO: 20083 - RNA, 27 nt, Artificial Sequence
  Synthetic Oligonucleotide; PD-L1 exon 3; Set C
caauaaagaucaggccucucaucuaua

SEQ ID NO: 20084 - RNA, 30 nt, Artificial Sequence
  Synthetic Oligonucleotide; PD-L1 exon 3; Set C
uucaauaaagaucaggccucucaucuauaa

SEQ ID NO: 20085 - RNA, 28 nt, Artificial Sequence
  Synthetic Oligonucleotide; PD-L1 exon 3; Set B
ucaauaaagaucaggccucucaucuaua

SEQ ID NO: 20086 - RNA, 26 nt, Artificial Sequence
  Synthetic Oligonucleotide; PD-L1 exon 3; Set C
caauaaagaucaggccucucaucuau

SEQ ID NO: 20087 - RNA, 31 nt, Artificial Sequence
  Synthetic Oligonucleotide; PD-L1 exon 3; Set B
uuucaauaaagaucaggccucucaucuauaa

SEQ ID NO: 20088 - RNA, 29 nt, Artificial Sequence
  Synthetic Oligonucleotide; PD-L1 exon 3; Set B
uucaauaaagaucaggccucucaucuaua

SEQ ID NO: 20089 - RNA, 27 nt, Artificial Sequence
  Synthetic Oligonucleotide; PD-L1 exon 3; Set C
ucaauaaagaucaggccucucaucuau

SEQ ID NO: 20090 - RNA, 24 nt, Artificial Sequence
  Synthetic Oligonucleotide; PD-L1 exon 3; Set C
caauaaagaucaggccucucaucu

SEQ ID NO: 20091 - RNA, 32 nt, Artificial Sequence
  Synthetic Oligonucleotide; PD-L1 exon 3; Set B
uuuucaauaaagaucaggccucucaucuauaa

SEQ ID NO: 20092 - RNA, 30 nt, Artificial Sequence
  Synthetic Oligonucleotide; PD-L1 exon 3; Set B
uuucaauaaagaucaggccucucaucuaua

SEQ ID NO: 20093 - RNA, 28 nt, Artificial Sequence
  Synthetic Oligonucleotide; PD-L1 exon 3; Set C
uucaauaaagaucaggccucucaucuau

SEQ ID NO: 20094 - RNA, 25 nt, Artificial Sequence
  Synthetic Oligonucleotide; PD-L1 exon 3; Set C
ucaauaaagaucaggccucucaucu

SEQ ID NO: 20095 - RNA, 33 nt, Artificial Sequence
  Synthetic Oligonucleotide; PD-L1 exon 3; Set B
guuuucaauaaagaucaggccucucaucuauaa

SEQ ID NO: 20096 - RNA, 29 nt, Artificial Sequence
  Synthetic Oligonucleotide; PD-L1 exon 3; Set B
uuucaauaaagaucaggccucucaucuau

SEQ ID NO: 20097 - RNA, 31 nt, Artificial Sequence
  Synthetic Oligonucleotide; PD-L1 exon 3; Set B
uuuucaauaaagaucaggccucucaucuaua

SEQ ID NO: 20098 - RNA, 27 nt, Artificial Sequence
  Synthetic Oligonucleotide; PD-L1 exon 3; Set C
uucaauaaagaucaggccucucaucua

SEQ ID NO: 20099 - RNA, 26 nt, Artificial Sequence
  Synthetic Oligonucleotide; PD-L1 exon 3; Set C
uucaauaaagaucaggccucucaucu

SEQ ID NO: 20100 - RNA, 34 nt, Artificial Sequence
  Synthetic Oligonucleotide; PD-L1 exon 3; Set B
uguuuucaauaaagaucaggccucucaucuauaa

SEQ ID NO: 20101 - RNA, 30 nt, Artificial Sequence
  Synthetic Oligonucleotide; PD-L1 exon 3; Set B
uuuucaauaaagaucaggccucucaucuau

SEQ ID NO: 20102 - RNA, 32 nt, Artificial Sequence
  Synthetic Oligonucleotide; PD-L1 exon 3; Set B
guuuucaauaaagaucaggccucucaucuaua

SEQ ID NO: 20103 - RNA, 28 nt, Artificial Sequence
  Synthetic Oligonucleotide; PD-L1 exon 3; Set B
uuucaauaaagaucaggccucucaucua

SEQ ID NO: 20104 - RNA, 33 nt, Artificial Sequence
  Synthetic Oligonucleotide; PD-L1 exon 3; Set B
uguuuucaauaaagaucaggccucucaucuaua

SEQ ID NO: 20105 - RNA, 31 nt, Artificial Sequence
  Synthetic Oligonucleotide; PD-L1 exon 3; Set B
guuuucaauaaagaucaggccucucaucuau

SEQ ID NO: 20106 - RNA, 29 nt, Artificial Sequence
  Synthetic Oligonucleotide; PD-L1 exon 3; Set B
uuuucaauaaagaucaggccucucaucua

SEQ ID NO: 20107 - RNA, 17 nt, Artificial Sequence
  Synthetic Oligonucleotide; PD-L1 exon 3; Set C
auaaagaucaggccucu

SEQ ID NO: 20108 - RNA, 32 nt, Artificial Sequence
  Synthetic Oligonucleotide; PD-L1 exon 3; Set B
uguuuucaauaaagaucaggccucucaucuau

SEQ ID NO: 20109 - RNA, 30 nt, Artificial Sequence
  Synthetic Oligonucleotide; PD-L1 exon 3; Set B
guuuucaauaaagaucaggccucucaucua

SEQ ID NO: 20110 - RNA, 18 nt, Artificial Sequence
  Synthetic Oligonucleotide; PD-L1 exon 3; Set C
aauaaagaucaggccucu

SEQ ID NO: 20111 - RNA, 31 nt, Artificial Sequence
  Synthetic Oligonucleotide; PD-L1 exon 3; Set B
uguuuucaauaaagaucaggccucucaucua

SEQ ID NO: 20112 - RNA, 33 nt, Artificial Sequence
  Synthetic Oligonucleotide; PD-L1 exon 3; Set B
aauauguuuucaauaaagaucaggccucucauc

SEQ ID NO: 20113 - RNA, 34 nt, Artificial Sequence
  Synthetic Oligonucleotide; PD-L1 exon 3; Set B
gaauauguuuucaauaaagaucaggccucucauc

SEQ ID NO: 20114 - RNA, 32 nt, Artificial Sequence
  Synthetic Oligonucleotide; PD-L1 exon 3; Set B
aauauguuuucaauaaagaucaggccucucau

SEQ ID NO: 20115 - RNA, 35 nt, Artificial Sequence
  Synthetic Oligonucleotide; PD-L1 exon 3; Set B
ggaauauguuuucaauaaagaucaggccucucauc

SEQ ID NO: 20116 - RNA, 33 nt, Artificial Sequence
  Synthetic Oligonucleotide; PD-L1 exon 3; Set B
gaauauguuuucaauaaagaucaggccucucau

SEQ ID NO: 20117 - RNA, 29 nt, Artificial Sequence
  Synthetic Oligonucleotide; PD-L1 exon 3; Set C
aauauguuuucaauaaagaucaggccucu

SEQ ID NO: 20118 - RNA, 30 nt, Artificial Sequence
  Synthetic Oligonucleotide; PD-L1 exon 3; Set C
gaauauguuuucaauaaagaucaggccucu

SEQ ID NO: 20119 - RNA, 28 nt, Artificial Sequence
  Synthetic Oligonucleotide; PD-L1 exon 3; Set C
aauauguuuucaauaaagaucaggccuc

SEQ ID NO: 20120 - RNA, 31 nt, Artificial Sequence
  Synthetic Oligonucleotide; PD-L1 exon 3; Set B
ggaauauguuuucaauaaagaucaggccucu

SEQ ID NO: 20121 - RNA, 29 nt, Artificial Sequence
  Synthetic Oligonucleotide; PD-L1 exon 3; Set C
gaauauguuuucaauaaagaucaggccuc

SEQ ID NO: 20122 - RNA, 27 nt, Artificial Sequence
  Synthetic Oligonucleotide; PD-L1 exon 3; Set C
aauauguuuucaauaaagaucaggccu

SEQ ID NO: 20123 - RNA, 30 nt, Artificial Sequence
  Synthetic Oligonucleotide; PD-L1 exon 3; Set B
ggaauauguuuucaauaaagaucaggccuc

SEQ ID NO: 20124 - RNA, 28 nt, Artificial Sequence
  Synthetic Oligonucleotide; PD-L1 exon 3; Set C
gaauauguuuucaauaaagaucaggccu

SEQ ID NO: 20125 - RNA, 29 nt, Artificial Sequence
  Synthetic Oligonucleotide; PD-L1 exon 3; Set C
ggaauauguuuucaauaaagaucaggccu

SEQ ID NO: 20126 - RNA, 18 nt, Artificial Sequence
  Synthetic Oligonucleotide; PD-L1 exon 3; Set C
aauauguuuucaauaaag

SEQ ID NO: 20127 - RNA, 19 nt, Artificial Sequence
  Synthetic Oligonucleotide; PD-L1 exon 3; Set C
gaauauguuuucaauaaag

SEQ ID NO: 20128 - RNA, 20 nt, Artificial Sequence
  Synthetic Oligonucleotide; PD-L1 exon 3; Set C
ggaauauguuuucaauaaag

SEQ ID NO: 20129 - RNA, 15 nt, Artificial Sequence
  Synthetic Oligonucleotide; PD-L1 exon 3; Set C
gggaaaauuccucga

SEQ ID NO: 20130 - RNA, 16 nt, Artificial Sequence
  Synthetic Oligonucleotide; PD-L1 exon 3; Set C
agggaaaauuccucga

SEQ ID NO: 20131 - RNA, 17 nt, Artificial Sequence
  Synthetic Oligonucleotide; PD-L1 exon 3; Set C
aagggaaaauuccucga

SEQ ID NO: 20132 - RNA, 15 nt, Artificial Sequence
  Synthetic Oligonucleotide; PD-L1 exon 3; Set C
agggaaaauuccucg

SEQ ID NO: 20133 - RNA, 18 nt, Artificial Sequence
  Synthetic Oligonucleotide; PD-L1 exon 3; Set C
aaagggaaaauuccucga

SEQ ID NO: 20134 - RNA, 16 nt, Artificial Sequence
  Synthetic Oligonucleotide; PD-L1 exon 3; Set C
aagggaaaauuccucg

SEQ ID NO: 20135 - RNA, 19 nt, Artificial Sequence
  Synthetic Oligonucleotide; PD-L1 exon 3; Set C
aaaagggaaaauuccucga

SEQ ID NO: 20136 - RNA, 17 nt, Artificial Sequence
  Synthetic Oligonucleotide; PD-L1 exon 3; Set C
aaagggaaaauuccucg

SEQ ID NO: 20137 - RNA, 20 nt, Artificial Sequence
  Synthetic Oligonucleotide; PD-L1 exon 3; Set C
gaaaagggaaaauuccucga

SEQ ID NO: 20138 - RNA, 18 nt, Artificial Sequence
  Synthetic Oligonucleotide; PD-L1 exon 3; Set C
aaaagggaaaauuccucg

SEQ ID NO: 20139 - RNA, 21 nt, Artificial Sequence
  Synthetic Oligonucleotide; PD-L1 exon 3; Set C
agaaaagggaaaauuccucga

SEQ ID NO: 20140 - RNA, 19 nt, Artificial Sequence
  Synthetic Oligonucleotide; PD-L1 exon 3; Set C
gaaaagggaaaauuccucg

SEQ ID NO: 20141 - RNA, 22 nt, Artificial Sequence
  Synthetic Oligonucleotide; PD-L1 exon 3; Set C
cagaaaagggaaaauuccucga

SEQ ID NO: 20142 - RNA, 20 nt, Artificial Sequence
  Synthetic Oligonucleotide; PD-L1 exon 3; Set C
agaaaagggaaaauuccucg

SEQ ID NO: 20143 - RNA, 23 nt, Artificial Sequence
  Synthetic Oligonucleotide; PD-L1 exon 3; Set C
ucagaaaagggaaaauuccucga

SEQ ID NO: 20144 - RNA, 21 nt, Artificial Sequence
  Synthetic Oligonucleotide; PD-L1 exon 3; Set C
cagaaaagggaaaauuccucg

SEQ ID NO: 20145 - RNA, 24 nt, Artificial Sequence
  Synthetic Oligonucleotide; PD-L1 exon 3; Set C
uucagaaaagggaaaauuccucga

SEQ ID NO: 20146 - RNA, 22 nt, Artificial Sequence
  Synthetic Oligonucleotide; PD-L1 exon 3; Set C
ucagaaaagggaaaauuccucg

SEQ ID NO: 20147 - RNA, 25 nt, Artificial Sequence
  Synthetic Oligonucleotide; PD-L1 exon 3; Set C
cuucagaaaagggaaaauuccucga

SEQ ID NO: 20148 - RNA, 23 nt, Artificial Sequence
  Synthetic Oligonucleotide; PD-L1 exon 3; Set C
uucagaaaagggaaaauuccucg

SEQ ID NO: 20149 - RNA, 26 nt, Artificial Sequence
  Synthetic Oligonucleotide; PD-L1 exon 3; Set C
ucuucagaaaagggaaaauuccucga

SEQ ID NO: 20150 - RNA, 24 nt, Artificial Sequence
  Synthetic Oligonucleotide; PD-L1 exon 3; Set C
cuucagaaaagggaaaauuccucg

SEQ ID NO: 20151 - RNA, 27 nt, Artificial Sequence
  Synthetic Oligonucleotide; PD-L1 exon 3; Set C
aucuucagaaaagggaaaauuccucga

SEQ ID NO: 20152 - RNA, 28 nt, Artificial Sequence
  Synthetic Oligonucleotide; PD-L1 exon 3; Set C
aaucuucagaaaagggaaaauuccucga

SEQ ID NO: 20153 - RNA, 29 nt, Artificial Sequence
  Synthetic Oligonucleotide; PD-L1 exon 3; Set C
caaucuucagaaaagggaaaauuccucga

SEQ ID NO: 20154 - RNA, 27 nt, Artificial Sequence
  Synthetic Oligonucleotide; PD-L1 exon 3; Set C
aaucuucagaaaagggaaaauuccucg

SEQ ID NO: 20155 - RNA, 30 nt, Artificial Sequence
  Synthetic Oligonucleotide; PD-L1 exon 3; Set C
acaaucuucagaaaagggaaaauuccucga

SEQ ID NO: 20156 - RNA, 28 nt, Artificial Sequence
  Synthetic Oligonucleotide; PD-L1 exon 3; Set C
caaucuucagaaaagggaaaauuccucg

SEQ ID NO: 20157 - RNA, 31 nt, Artificial Sequence
  Synthetic Oligonucleotide; PD-L1 exon 3; Set A
gacaaucuucagaaaagggaaaauuccucga

SEQ ID NO: 20158 - RNA, 29 nt, Artificial Sequence
  Synthetic Oligonucleotide; PD-L1 exon 3; Set C
acaaucuucagaaaagggaaaauuccucg

SEQ ID NO: 20159 - RNA, 32 nt, Artificial Sequence
  Synthetic Oligonucleotide; PD-L1 exon 3; Set A
ggacaaucuucagaaaagggaaaauuccucga

SEQ ID NO: 20160 - RNA, 30 nt, Artificial Sequence
  Synthetic Oligonucleotide; PD-L1 exon 3; Set C
gacaaucuucagaaaagggaaaauuccucg

SEQ ID NO: 20161 - RNA, 33 nt, Artificial Sequence
  Synthetic Oligonucleotide; PD-L1 exon 3; Set A
aggacaaucuucagaaaagggaaaauuccucga

SEQ ID NO: 20162 - RNA, 31 nt, Artificial Sequence
  Synthetic Oligonucleotide; PD-L1 exon 3; Set A
ggacaaucuucagaaaagggaaaauuccucg

SEQ ID NO: 20163 - RNA, 34 nt, Artificial Sequence
  Synthetic Oligonucleotide; PD-L1 exon 3; Set A
aaggacaaucuucagaaaagggaaaauuccucga

SEQ ID NO: 20164 - RNA, 32 nt, Artificial Sequence
  Synthetic Oligonucleotide; PD-L1 exon 3; Set A
aggacaaucuucagaaaagggaaaauuccucg

SEQ ID NO: 20165 - RNA, 35 nt, Artificial Sequence
  Synthetic Oligonucleotide; PD-L1 exon 3; Set A
gaaggacaaucuucagaaaagggaaaauuccucga

SEQ ID NO: 20166 - RNA, 33 nt, Artificial Sequence
  Synthetic Oligonucleotide; PD-L1 exon 3; Set C
aaggacaaucuucagaaaagggaaaauuccucg

SEQ ID NO: 20167 - RNA, 36 nt, Artificial Sequence
  Synthetic Oligonucleotide; PD-L1 exon 3; Set A
agaaggacaaucuucagaaaagggaaaauuccucga

SEQ ID NO: 20168 - RNA, 34 nt, Artificial Sequence
  Synthetic Oligonucleotide; PD-L1 exon 3; Set A
gaaggacaaucuucagaaaagggaaaauuccucg

SEQ ID NO: 20169 - RNA, 37 nt, Artificial Sequence
  Synthetic Oligonucleotide; PD-L1 exon 3; Set A
aagaaggacaaucuucagaaaagggaaaauuccucga

SEQ ID NO: 20170 - RNA, 35 nt, Artificial Sequence
  Synthetic Oligonucleotide; PD-L1 exon 3; Set A
agaaggacaaucuucagaaaagggaaaauuccucg

SEQ ID NO: 20171 - RNA, 36 nt, Artificial Sequence
  Synthetic Oligonucleotide; PD-L1 exon 3; Set A
aagaaggacaaucuucagaaaagggaaaauuccucg

SEQ ID NO: 20172 - RNA, 37 nt, Artificial Sequence
  Synthetic Oligonucleotide; PD-L1 exon 3; Set A
aaagaaggacaaucuucagaaaagggaaaauuccucg

SEQ ID NO: 20173 - RNA, 38 nt, Artificial Sequence
  Synthetic Oligonucleotide; PD-L1 exon 3; Set A
gaaagaaggacaaucuucagaaaagggaaaauuccucg

SEQ ID NO: 20174 - RNA, 39 nt, Artificial Sequence
  Synthetic Oligonucleotide; PD-L1 exon 3; Set A
agaaagaaggacaaucuucagaaaagggaaaauuccucg

SEQ ID NO: 20175 - RNA, 40 nt, Artificial Sequence
  Synthetic Oligonucleotide; PD-L1 exon 3; Set A
aagaaagaaggacaaucuucagaaaagggaaaauuccucg

SEQ ID NO: 20176 - RNA, 17 nt, Artificial Sequence
  Synthetic Oligonucleotide; PD-L1 exon 3; Set C
caguaaaugcuaaaaag

SEQ ID NO: 20177 - RNA, 16 nt, Artificial Sequence
  Synthetic Oligonucleotide; PD-L1 exon 3; Set C
caguaaaugcuaaaaa

SEQ ID NO: 20178 - RNA, 15 nt, Artificial Sequence
  Synthetic Oligonucleotide; PD-L1 exon 3; Set C
caguaaaugcuaaaa

SEQ ID NO: 20179 - RNA, 16 nt, Artificial Sequence
  Synthetic Oligonucleotide; PD-L1 exon 3; Set C
acaguaaaugcuaaaa

SEQ ID NO: 20180 - RNA, 15 nt, Artificial Sequence
  Synthetic Oligonucleotide; PD-L1 exon 3; Set C
acaguaaaugcuaaa

SEQ ID NO: 20181 - RNA, 16 nt, Artificial Sequence
  Synthetic Oligonucleotide; PD-L1 exon 3; Set C
gacaguaaaugcuaaa

SEQ ID NO: 20182 - RNA, 15 nt, Artificial Sequence
  Synthetic Oligonucleotide; PD-L1 exon 3; Set C
gacaguaaaugcuaa

SEQ ID NO: 20183 - RNA, 35 nt, Artificial Sequence
  Synthetic Oligonucleotide; PD-L1 exon 3; Set C
uugcuaccauacucuaccacauauagguccuuggg

SEQ ID NO: 20184 - RNA, 34 nt, Artificial Sequence
  Synthetic Oligonucleotide; PD-L1 exon 3; Set C
uugcuaccauacucuaccacauauagguccuugg

SEQ ID NO: 20185 - RNA, 33 nt, Artificial Sequence
  Synthetic Oligonucleotide; PD-L1 exon 3; Set C
uugcuaccauacucuaccacauauagguccuug

SEQ ID NO: 20186 - RNA, 38 nt, Artificial Sequence
  Synthetic Oligonucleotide; PD-L1 exon 3; Set C
auauugcuaccauacucuaccacauauagguccuuggg

SEQ ID NO: 20187 - RNA, 31 nt, Artificial Sequence
  Synthetic Oligonucleotide; PD-L1 exon 3; Set C
uugcuaccauacucuaccacauauagguccu

SEQ ID NO: 20188 - RNA, 37 nt, Artificial Sequence
  Synthetic Oligonucleotide; PD-L1 exon 3; Set C
auauugcuaccauacucuaccacauauagguccuugg

SEQ ID NO: 20189 - RNA, 36 nt, Artificial Sequence
  Synthetic Oligonucleotide; PD-L1 exon 3; Set C
auauugcuaccauacucuaccacauauagguccuug

SEQ ID NO: 20190 - RNA, 35 nt, Artificial Sequence
  Synthetic Oligonucleotide; PD-L1 exon 3; Set C
auauugcuaccauacucuaccacauauagguccuu

SEQ ID NO: 20191 - RNA, 34 nt, Artificial Sequence
  Synthetic Oligonucleotide; PD-L1 exon 3; Set C
auauugcuaccauacucuaccacauauagguccu

SEQ ID NO: 20192 - RNA, 40 nt, Artificial Sequence
  Synthetic Oligonucleotide; PD-L1 exon 3; Set C
ugucauauugcuaccauacucuaccacauauagguccuug

SEQ ID NO: 20193 - RNA, 25 nt, Artificial Sequence
  Synthetic Oligonucleotide; PD-L1 exon 3; Set A
uugcuaccauacucuaccacauaua

SEQ ID NO: 20194 - RNA, 38 nt, Artificial Sequence
  Synthetic Oligonucleotide; PD-L1 exon 3; Set C
ugucauauugcuaccauacucuaccacauauagguccu

SEQ ID NO: 20195 - RNA, 24 nt, Artificial Sequence
  Synthetic Oligonucleotide; PD-L1 exon 3; Set A
uugcuaccauacucuaccacauau

SEQ ID NO: 20196 - RNA, 40 nt, Artificial Sequence
  Synthetic Oligonucleotide; PD-L1 exon 3; Set C
uugucauauugcuaccauacucuaccacauauagguccuu

SEQ ID NO: 20197 - RNA, 23 nt, Artificial Sequence
  Synthetic Oligonucleotide; PD-L1 exon 3; Set A
uugcuaccauacucuaccacaua

SEQ ID NO: 20198 - RNA, 39 nt, Artificial Sequence
  Synthetic Oligonucleotide; PD-L1 exon 3; Set C
uugucauauugcuaccauacucuaccacauauagguccu

SEQ ID NO: 20199 - RNA, 22 nt, Artificial Sequence
  Synthetic Oligonucleotide; PD-L1 exon 3; Set A
uugcuaccauacucuaccacau

SEQ ID NO: 20200 - RNA, 40 nt, Artificial Sequence
  Synthetic Oligonucleotide; PD-L1 exon 3; Set C
auugucauauugcuaccauacucuaccacauauagguccu

SEQ ID NO: 20201 - RNA, 28 nt, Artificial Sequence
  Synthetic Oligonucleotide; PD-L1 exon 3; Set A
auauugcuaccauacucuaccacauaua

SEQ ID NO: 20202 - RNA, 21 nt, Artificial Sequence
  Synthetic Oligonucleotide; PD-L1 exon 3; Set A
uugcuaccauacucuaccaca

SEQ ID NO: 20203 - RNA, 27 nt, Artificial Sequence
  Synthetic Oligonucleotide; PD-L1 exon 3; Set A
auauugcuaccauacucuaccacauau

SEQ ID NO: 20204 - RNA, 26 nt, Artificial Sequence
  Synthetic Oligonucleotide; PD-L1 exon 3; Set A
auauugcuaccauacucuaccacaua

SEQ ID NO: 20205 - RNA, 25 nt, Artificial Sequence
  Synthetic Oligonucleotide; PD-L1 exon 3; Set A
auauugcuaccauacucuaccacau

SEQ ID NO: 20206 - RNA, 24 nt, Artificial Sequence
  Synthetic Oligonucleotide; PD-L1 exon 3; Set A
auauugcuaccauacucuaccaca

SEQ ID NO: 20207 - RNA, 32 nt, Artificial Sequence
  Synthetic Oligonucleotide; PD-L1 exon 3; Set A
ugucauauugcuaccauacucuaccacauaua

SEQ ID NO: 20208 - RNA, 23 nt, Artificial Sequence
  Synthetic Oligonucleotide; PD-L1 exon 3; Set A
auauugcuaccauacucuaccac

SEQ ID NO: 20209 - RNA, 33 nt, Artificial Sequence
  Synthetic Oligonucleotide; PD-L1 exon 3; Set A
uugucauauugcuaccauacucuaccacauaua

SEQ ID NO: 20210 - RNA, 31 nt, Artificial Sequence
  Synthetic Oligonucleotide; PD-L1 exon 3; Set A
ugucauauugcuaccauacucuaccacauau

SEQ ID NO: 20211 - RNA, 30 nt, Artificial Sequence
  Synthetic Oligonucleotide; PD-L1 exon 3; Set A
ugucauauugcuaccauacucuaccacaua

SEQ ID NO: 20212 - RNA, 32 nt, Artificial Sequence
  Synthetic Oligonucleotide; PD-L1 exon 3; Set A
uugucauauugcuaccauacucuaccacauau

SEQ ID NO: 20213 - RNA, 34 nt, Artificial Sequence
  Synthetic Oligonucleotide; PD-L1 exon 3; Set A
auugucauauugcuaccauacucuaccacauaua

SEQ ID NO: 20214 - RNA, 29 nt, Artificial Sequence
  Synthetic Oligonucleotide; PD-L1 exon 3; Set A
ugucauauugcuaccauacucuaccacau

SEQ ID NO: 20215 - RNA, 31 nt, Artificial Sequence
  Synthetic Oligonucleotide; PD-L1 exon 3; Set A
uugucauauugcuaccauacucuaccacaua

SEQ ID NO: 20216 - RNA, 33 nt, Artificial Sequence
  Synthetic Oligonucleotide; PD-L1 exon 3; Set A
auugucauauugcuaccauacucuaccacauau

SEQ ID NO: 20217 - RNA, 30 nt, Artificial Sequence
  Synthetic Oligonucleotide; PD-L1 exon 3; Set A
uugucauauugcuaccauacucuaccacau

SEQ ID NO: 20218 - RNA, 32 nt, Artificial Sequence
  Synthetic Oligonucleotide; PD-L1 exon 3; Set A
auugucauauugcuaccauacucuaccacaua

SEQ ID NO: 20219 - RNA, 28 nt, Artificial Sequence
  Synthetic Oligonucleotide; PD-L1 exon 3; Set A
ugucauauugcuaccauacucuaccaca

SEQ ID NO: 20220 - RNA, 31 nt, Artificial Sequence
  Synthetic Oligonucleotide; PD-L1 exon 3; Set A
auugucauauugcuaccauacucuaccacau

SEQ ID NO: 20221 - RNA, 29 nt, Artificial Sequence
  Synthetic Oligonucleotide; PD-L1 exon 3; Set A
uugucauauugcuaccauacucuaccaca

SEQ ID NO: 20222 - RNA, 30 nt, Artificial Sequence
  Synthetic Oligonucleotide; PD-L1 exon 3; Set A
auugucauauugcuaccauacucuaccaca

SEQ ID NO: 20223 - RNA, 28 nt, Artificial Sequence
  Synthetic Oligonucleotide; PD-L1 exon 3; Set A
uugucauauugcuaccauacucuaccac

SEQ ID NO: 20224 - RNA, 29 nt, Artificial Sequence
  Synthetic Oligonucleotide; PD-L1 exon 3; Set A
auugucauauugcuaccauacucuaccac

SEQ ID NO: 20225 - RNA, 40 nt, Artificial Sequence
  Synthetic Oligonucleotide; PD-L1 exon 3; Set C
uugcauucaauugucauauugcuaccauacucuaccacau

SEQ ID NO: 20226 - RNA, 25 nt, Artificial Sequence
  Synthetic Oligonucleotide; PD-L1 exon 3; Set C
uuugcauucaauugucauauugcua

SEQ ID NO: 20227 - RNA, 20 nt, Artificial Sequence
  Synthetic Oligonucleotide; PD-L1 exon 3; Set C
uugcauucaauugucauauu

SEQ ID NO: 20228 - RNA, 19 nt, Artificial Sequence
  Synthetic Oligonucleotide; PD-L1 exon 3; Set C
uugcauucaauugucauau

SEQ ID NO: 20229 - RNA, 15 nt, Artificial Sequence
  Synthetic Oligonucleotide; PD-L1 exon 3; Set C
uuugcauucaauugu

SEQ ID NO: 20230 - RNA, 35 nt, Artificial Sequence
  Synthetic Oligonucleotide; PD-L1 exon 3; Set A
uuuucuacugggaauuugcauucaauugucauauu

SEQ ID NO: 20231 - RNA, 34 nt, Artificial Sequence
  Synthetic Oligonucleotide; PD-L1 exon 3; Set A
uuuucuacugggaauuugcauucaauugucauau

SEQ ID NO: 20232 - RNA, 35 nt, Artificial Sequence
  Synthetic Oligonucleotide; PD-L1 exon 3; Set A
uuuuucuacugggaauuugcauucaauugucauau

SEQ ID NO: 20233 - RNA, 36 nt, Artificial Sequence
  Synthetic Oligonucleotide; PD-L1 exon 3; Set C
ugcagccaggucuaauuguuuuucuacugggaauuu

SEQ ID NO: 20234 - RNA, 15 nt, Artificial Sequence
  Synthetic Oligonucleotide; PD-L1 exon 3; Set C
aggucuaauuguuuu

SEQ ID NO: 20235 - RNA, 16 nt, Artificial Sequence
  Synthetic Oligonucleotide; PD-L1 exon 3; Set C
caggucuaauuguuuu

SEQ ID NO: 20236 - RNA, 17 nt, Artificial Sequence
  Synthetic Oligonucleotide; PD-L1 exon 3; Set C
ccaggucuaauuguuuu

SEQ ID NO: 20237 - RNA, 15 nt, Artificial Sequence
  Synthetic Oligonucleotide; PD-L1 exon 3; Set C
caggucuaauuguuu

SEQ ID NO: 20238 - RNA, 16 nt, Artificial Sequence
  Synthetic Oligonucleotide; PD-L1 exon 3; Set C
ccaggucuaauuguuu

SEQ ID NO: 20239 - RNA, 17 nt, Artificial Sequence
  Synthetic Oligonucleotide; PD-L1 exon 3; Set C
gccaggucuaauuguuu

SEQ ID NO: 20240 - RNA, 25 nt, Artificial Sequence
  Synthetic Oligonucleotide; PD-L1 exon 3; Set C
auugaauaauguucuuauccuccau

SEQ ID NO: 20241 - RNA, 24 nt, Artificial Sequence
  Synthetic Oligonucleotide; PD-L1 exon 3; Set C
auugaauaauguucuuauccucca

SEQ ID NO: 20242 - RNA, 19 nt, Artificial Sequence
  Synthetic Oligonucleotide; PD-L1 exon 3; Set C
cacaaauugaauaauguuc

SEQ ID NO: 20243 - RNA, 18 nt, Artificial Sequence
  Synthetic Oligonucleotide; PD-L1 exon 3; Set C
cacaaauugaauaauguu

SEQ ID NO: 20244 - RNA, 17 nt, Artificial Sequence
  Synthetic Oligonucleotide; PD-L1 exon 3; Set C
cacaaauugaauaaugu

SEQ ID NO: 20245 - RNA, 15 nt, Artificial Sequence
  Synthetic Oligonucleotide; PD-L1 exon 3; Set C
acaaauugaauaaug

SEQ ID NO: 20246 - RNA, 21 nt, Artificial Sequence
  Synthetic Oligonucleotide; PD-L1 exon 3; Set C
augcacaaauugaauaauguu

SEQ ID NO: 20247 - RNA, 20 nt, Artificial Sequence
  Synthetic Oligonucleotide; PD-L1 exon 3; Set C
augcacaaauugaauaaugu

SEQ ID NO: 20248 - RNA, 18 nt, Artificial Sequence
  Synthetic Oligonucleotide; PD-L1 exon 3; Set C
ugcacaaauugaauaaug

SEQ ID NO: 20249 - RNA, 16 nt, Artificial Sequence
  Synthetic Oligonucleotide; PD-L1 exon 3; Set C
gcacaaauugaauaau

SEQ ID NO: 20250 - RNA, 15 nt, Artificial Sequence
  Synthetic Oligonucleotide; PD-L1 exon 3; Set C
gcacaaauugaauaa

SEQ ID NO: 20251 - RNA, 17 nt, Artificial Sequence
  Synthetic Oligonucleotide; PD-L1 exon 3; Set C
ugcacaaauugaauaau

SEQ ID NO: 20252 - RNA, 16 nt, Artificial Sequence
  Synthetic Oligonucleotide; PD-L1 exon 3; Set C
ugcacaaauugaauaa

SEQ ID NO: 20253 - RNA, 31 nt, Artificial Sequence
  Synthetic Oligonucleotide; PD-L1 exon 3; Set A
uuccucuccaugcacaaauugaauaauguuc

SEQ ID NO: 20254 - RNA, 32 nt, Artificial Sequence
  Synthetic Oligonucleotide; PD-L1 exon 3; Set A
cuuccucuccaugcacaaauugaauaauguuc

SEQ ID NO: 20255 - RNA, 30 nt, Artificial Sequence
  Synthetic Oligonucleotide; PD-L1 exon 3; Set A
uuccucuccaugcacaaauugaauaauguu

SEQ ID NO: 20256 - RNA, 33 nt, Artificial Sequence
  Synthetic Oligonucleotide; PD-L1 exon 3; Set A
ucuuccucuccaugcacaaauugaauaauguuc

SEQ ID NO: 20257 - RNA, 29 nt, Artificial Sequence
  Synthetic Oligonucleotide; PD-L1 exon 3; Set A
uuccucuccaugcacaaauugaauaaugu

SEQ ID NO: 20258 - RNA, 31 nt, Artificial Sequence
  Synthetic Oligonucleotide; PD-L1 exon 3; Set A
cuuccucuccaugcacaaauugaauaauguu

SEQ ID NO: 20259 - RNA, 32 nt, Artificial Sequence
  Synthetic Oligonucleotide; PD-L1 exon 3; Set A
ucuuccucuccaugcacaaauugaauaauguu

SEQ ID NO: 20260 - RNA, 30 nt, Artificial Sequence
  Synthetic Oligonucleotide; PD-L1 exon 3; Set A
cuuccucuccaugcacaaauugaauaaugu

SEQ ID NO: 20261 - RNA, 31 nt, Artificial Sequence
  Synthetic Oligonucleotide; PD-L1 exon 3; Set A
ucuuccucuccaugcacaaauugaauaaugu

SEQ ID NO: 20262 - RNA, 32 nt, Artificial Sequence
  Synthetic Oligonucleotide; PD-L1 exon 3; Set A
gucuuccucuccaugcacaaauugaauaaugu

SEQ ID NO: 20263 - RNA, 40 nt, Artificial Sequence
  Synthetic Oligonucleotide; PD-L1 exon 3; Set C
cuucaggucuuccucuccaugcacaaauugaauaauguuc

SEQ ID NO: 20264 - RNA, 39 nt, Artificial Sequence
  Synthetic Oligonucleotide; PD-L1 exon 3; Set C
cuucaggucuuccucuccaugcacaaauugaauaauguu

SEQ ID NO: 20265 - RNA, 29 nt, Artificial Sequence
  Synthetic Oligonucleotide; PD-L1 exon 3; Set A
ggucuuccucuccaugcacaaauugaaua

SEQ ID NO: 20266 - RNA, 38 nt, Artificial Sequence
  Synthetic Oligonucleotide; PD-L1 exon 3; Set C
cuucaggucuuccucuccaugcacaaauugaauaaugu

SEQ ID NO: 20267 - RNA, 20 nt, Artificial Sequence
  Synthetic Oligonucleotide; PD-L1 exon 3; Set C
uuccucuccaugcacaaauu

SEQ ID NO: 20268 - RNA, 36 nt, Artificial Sequence
  Synthetic Oligonucleotide; PD-L1 exon 3; Set A
uucaggucuuccucuccaugcacaaauugaauaaug

SEQ ID NO: 20269 - RNA, 30 nt, Artificial Sequence
  Synthetic Oligonucleotide; PD-L1 exon 3; Set A
aggucuuccucuccaugcacaaauugaaua

SEQ ID NO: 20270 - RNA, 19 nt, Artificial Sequence
  Synthetic Oligonucleotide; PD-L1 exon 3; Set C
uuccucuccaugcacaaau

SEQ ID NO: 20271 - RNA, 31 nt, Artificial Sequence
  Synthetic Oligonucleotide; PD-L1 exon 3; Set A
caggucuuccucuccaugcacaaauugaaua

SEQ ID NO: 20272 - RNA, 27 nt, Artificial Sequence
  Synthetic Oligonucleotide; PD-L1 exon 3; Set A
ggucuuccucuccaugcacaaauugaa

SEQ ID NO: 20273 - RNA, 22 nt, Artificial Sequence
  Synthetic Oligonucleotide; PD-L1 exon 3; Set C
ucuuccucuccaugcacaaauu

SEQ ID NO: 20274 - RNA, 28 nt, Artificial Sequence
  Synthetic Oligonucleotide; PD-L1 exon 3; Set A
aggucuuccucuccaugcacaaauugaa

SEQ ID NO: 20275 - RNA, 26 nt, Artificial Sequence
  Synthetic Oligonucleotide; PD-L1 exon 3; Set A
ggucuuccucuccaugcacaaauuga

SEQ ID NO: 20276 - RNA, 23 nt, Artificial Sequence
  Synthetic Oligonucleotide; PD-L1 exon 3; Set A
gucuuccucuccaugcacaaauu

SEQ ID NO: 20277 - RNA, 25 nt, Artificial Sequence
  Synthetic Oligonucleotide; PD-L1 exon 3; Set A
ggucuuccucuccaugcacaaauug

SEQ ID NO: 20278 - RNA, 29 nt, Artificial Sequence
  Synthetic Oligonucleotide; PD-L1 exon 3; Set A
caggucuuccucuccaugcacaaauugaa

SEQ ID NO: 20279 - RNA, 27 nt, Artificial Sequence
  Synthetic Oligonucleotide; PD-L1 exon 3; Set A
aggucuuccucuccaugcacaaauuga

SEQ ID NO: 20280 - RNA, 22 nt, Artificial Sequence
  Synthetic Oligonucleotide; PD-L1 exon 3; Set A
gucuuccucuccaugcacaaau

SEQ ID NO: 20281 - RNA, 32 nt, Artificial Sequence
  Synthetic Oligonucleotide; PD-L1 exon 3; Set A
uucaggucuuccucuccaugcacaaauugaau

SEQ ID NO: 20282 - RNA, 40 nt, Artificial Sequence
  Synthetic Oligonucleotide; PD-L1 exon 3; Set C
aaccuucaggucuuccucuccaugcacaaauugaauaaug

SEQ ID NO: 20283 - RNA, 26 nt, Artificial Sequence
  Synthetic Oligonucleotide; PD-L1 exon 3; Set A
aggucuuccucuccaugcacaaauug

SEQ ID NO: 20284 - RNA, 30 nt, Artificial Sequence
  Synthetic Oligonucleotide; PD-L1 exon 3; Set A
ucaggucuuccucuccaugcacaaauugaa

SEQ ID NO: 20285 - RNA, 28 nt, Artificial Sequence
  Synthetic Oligonucleotide; PD-L1 exon 3; Set A
caggucuuccucuccaugcacaaauuga

SEQ ID NO: 20286 - RNA, 21 nt, Artificial Sequence
  Synthetic Oligonucleotide; PD-L1 exon 3; Set A
gucuuccucuccaugcacaaa

SEQ ID NO: 20287 - RNA, 27 nt, Artificial Sequence
  Synthetic Oligonucleotide; PD-L1 exon 3; Set A
caggucuuccucuccaugcacaaauug

SEQ ID NO: 20288 - RNA, 29 nt, Artificial Sequence
  Synthetic Oligonucleotide; PD-L1 exon 3; Set A
ucaggucuuccucuccaugcacaaauuga

SEQ ID NO: 20289 - RNA, 21 nt, Artificial Sequence
  Synthetic Oligonucleotide; PD-L1 exon 3; Set A
ggucuuccucuccaugcacaa

SEQ ID NO: 20290 - RNA, 36 nt, Artificial Sequence
  Synthetic Oligonucleotide; PD-L1 exon 3; Set C
aaccuucaggucuuccucuccaugcacaaauugaau

SEQ ID NO: 20291 - RNA, 22 nt, Artificial Sequence
  Synthetic Oligonucleotide; PD-L1 exon 3; Set A
aggucuuccucuccaugcacaa

SEQ ID NO: 20292 - RNA, 27 nt, Artificial Sequence
  Synthetic Oligonucleotide; PD-L1 exon 3; Set A
uucaggucuuccucuccaugcacaaau

SEQ ID NO: 20293 - RNA, 23 nt, Artificial Sequence
  Synthetic Oligonucleotide; PD-L1 exon 3; Set A
caggucuuccucuccaugcacaa

SEQ ID NO: 20294 - RNA, 26 nt, Artificial Sequence
  Synthetic Oligonucleotide; PD-L1 exon 3; Set A
uucaggucuuccucuccaugcacaaa

SEQ ID NO: 20295 - RNA, 18 nt, Artificial Sequence
  Synthetic Oligonucleotide; PD-L1 exon 3; Set A
ggucuuccucuccaugca

SEQ ID NO: 20296 - RNA, 24 nt, Artificial Sequence
  Synthetic Oligonucleotide; PD-L1 exon 3; Set A
ucaggucuuccucuccaugcacaa

SEQ ID NO: 20297 - RNA, 19 nt, Artificial Sequence
  Synthetic Oligonucleotide; PD-L1 exon 3; Set A
aggucuuccucuccaugca

SEQ ID NO: 20298 - RNA, 23 nt, Artificial Sequence
  Synthetic Oligonucleotide; PD-L1 exon 3; Set A
ucaggucuuccucuccaugcaca

SEQ ID NO: 20299 - RNA, 20 nt, Artificial Sequence
  Synthetic Oligonucleotide; PD-L1 exon 3; Set A
caggucuuccucuccaugca

SEQ ID NO: 20300 - RNA, 30 nt, Artificial Sequence
  Synthetic Oligonucleotide; PD-L1 exon 3; Set C
aaccuucaggucuuccucuccaugcacaaa

SEQ ID NO: 20301 - RNA, 20 nt, Artificial Sequence
  Synthetic Oligonucleotide; PD-L1 exon 3; Set A
ucaggucuuccucuccaugc

SEQ ID NO: 20302 - RNA, 39 nt, Artificial Sequence
  Synthetic Oligonucleotide; PD-L1 exon 3; Set C
uaugcugaaccuucaggucuuccucuccaugcacaaauu

SEQ ID NO: 20303 - RNA, 38 nt, Artificial Sequence
  Synthetic Oligonucleotide; PD-L1 exon 3; Set C
uaugcugaaccuucaggucuuccucuccaugcacaaau

SEQ ID NO: 20304 - RNA, 38 nt, Artificial Sequence
  Synthetic Oligonucleotide; PD-L1 exon 3; Set C
acuaugcugaaccuucaggucuuccucuccaugcacaa

SEQ ID NO: 20305 - RNA, 39 nt, Artificial Sequence
  Synthetic Oligonucleotide; PD-L1 exon 3; Set C
uacuaugcugaaccuucaggucuuccucuccaugcacaa

SEQ ID NO: 20306 - RNA, 37 nt, Artificial Sequence
  Synthetic Oligonucleotide; PD-L1 exon 3; Set C
acuaugcugaaccuucaggucuuccucuccaugcaca

SEQ ID NO: 20307 - RNA, 38 nt, Artificial Sequence
  Synthetic Oligonucleotide; PD-L1 exon 3; Set C
uacuaugcugaaccuucaggucuuccucuccaugcaca

SEQ ID NO: 20308 - RNA, 34 nt, Artificial Sequence
  Synthetic Oligonucleotide; PD-L1 exon 3; Set C
acuaugcugaaccuucaggucuuccucuccaugc

SEQ ID NO: 20309 - RNA, 35 nt, Artificial Sequence
  Synthetic Oligonucleotide; PD-L1 exon 3; Set C
uacuaugcugaaccuucaggucuuccucuccaugc

SEQ ID NO: 20310 - RNA, 24 nt, Artificial Sequence
  Synthetic Oligonucleotide; PD-L1 exon 3; Set A
acuaugcugaaccuucaggucuuc

SEQ ID NO: 20311 - RNA, 25 nt, Artificial Sequence
  Synthetic Oligonucleotide; PD-L1 exon 3; Set A
uacuaugcugaaccuucaggucuuc

SEQ ID NO: 20312 - RNA, 23 nt, Artificial Sequence
  Synthetic Oligonucleotide; PD-L1 exon 3; Set A
acuaugcugaaccuucaggucuu

SEQ ID NO: 20313 - RNA, 18 nt, Artificial Sequence
  Synthetic Oligonucleotide; PD-L1 exon 3; Set C
uaugcugaaccuucaggu

SEQ ID NO: 20314 - RNA, 22 nt, Artificial Sequence
  Synthetic Oligonucleotide; PD-L1 exon 3; Set A
acuaugcugaaccuucaggucu

SEQ ID NO: 20315 - RNA, 24 nt, Artificial Sequence
  Synthetic Oligonucleotide; PD-L1 exon 3; Set A
uacuaugcugaaccuucaggucuu

SEQ ID NO: 20316 - RNA, 23 nt, Artificial Sequence
  Synthetic Oligonucleotide; PD-L1 exon 3; Set A
uacuaugcugaaccuucaggucu

SEQ ID NO: 20317 - RNA, 22 nt, Artificial Sequence
  Synthetic Oligonucleotide; PD-L1 exon 3; Set C
uacuaugcugaaccuucagguc

SEQ ID NO: 20318 - RNA, 15 nt, Artificial Sequence
  Synthetic Oligonucleotide; PD-L1 exon 3; Set C
uaugcugaaccuuca

SEQ ID NO: 20319 - RNA, 21 nt, Artificial Sequence
  Synthetic Oligonucleotide; PD-L1 exon 3; Set C
cuacuaugcugaaccuucagg

SEQ ID NO: 20320 - RNA, 20 nt, Artificial Sequence
  Synthetic Oligonucleotide; PD-L1 exon 3; Set C
cuacuaugcugaaccuucag

SEQ ID NO: 20321 - RNA, 27 nt, Artificial Sequence
  Synthetic Oligonucleotide; PD-L1 exon 3; Set A
uguagcuacuaugcugaaccuucaggu

SEQ ID NO: 20322 - RNA, 35 nt, Artificial Sequence
  Synthetic Oligonucleotide; PD-L1 exon 3; Set C
ugucuguagcuacuaugcugaaccuucaggucuuc

SEQ ID NO: 20323 - RNA, 26 nt, Artificial Sequence
  Synthetic Oligonucleotide; PD-L1 exon 3; Set A
uguagcuacuaugcugaaccuucagg

SEQ ID NO: 20324 - RNA, 25 nt, Artificial Sequence
  Synthetic Oligonucleotide; PD-L1 exon 3; Set A
uguagcuacuaugcugaaccuucag

SEQ ID NO: 20325 - RNA, 32 nt, Artificial Sequence
  Synthetic Oligonucleotide; PD-L1 exon 3; Set C
ugucuguagcuacuaugcugaaccuucagguc

SEQ ID NO: 20326 - RNA, 27 nt, Artificial Sequence
  Synthetic Oligonucleotide; PD-L1 exon 3; Set A
ugucuguagcuacuaugcugaaccuuc

SEQ ID NO: 20327 - RNA, 23 nt, Artificial Sequence
  Synthetic Oligonucleotide; PD-L1 exon 3; Set A
ugucuguagcuacuaugcugaac

SEQ ID NO: 20328 - RNA, 16 nt, Artificial Sequence
  Synthetic Oligonucleotide; PD-L1 exon 3; Set C
ugucuguagcuacuau

SEQ ID NO: 20329 - RNA, 29 nt, Artificial Sequence
  Synthetic Oligonucleotide; PD-L1 exon 3; Set C
aacagccgggcccucugucuguagcuacu

SEQ ID NO: 20330 - RNA, 30 nt, Artificial Sequence
  Synthetic Oligonucleotide; PD-L1 exon 3; Set C
caacagccgggcccucugucuguagcuacu

SEQ ID NO: 20331 - RNA, 28 nt, Artificial Sequence
  Synthetic Oligonucleotide; PD-L1 exon 3; Set C
aacagccgggcccucugucuguagcuac

SEQ ID NO: 20332 - RNA, 31 nt, Artificial Sequence
  Synthetic Oligonucleotide; PD-L1 exon 3; Set C
ucaacagccgggcccucugucuguagcuacu

SEQ ID NO: 20333 - RNA, 29 nt, Artificial Sequence
  Synthetic Oligonucleotide; PD-L1 exon 3; Set C
caacagccgggcccucugucuguagcuac

SEQ ID NO: 20334 - RNA, 32 nt, Artificial Sequence
  Synthetic Oligonucleotide; PD-L1 exon 3; Set C
uucaacagccgggcccucugucuguagcuacu

SEQ ID NO: 20335 - RNA, 30 nt, Artificial Sequence
  Synthetic Oligonucleotide; PD-L1 exon 3; Set C
ucaacagccgggcccucugucuguagcuac

SEQ ID NO: 20336 - RNA, 31 nt, Artificial Sequence
  Synthetic Oligonucleotide; PD-L1 exon 3; Set C
uucaacagccgggcccucugucuguagcuac

SEQ ID NO: 20337 - RNA, 28 nt, Artificial Sequence
  Synthetic Oligonucleotide; PD-L1 exon 3; Set C
auuucccagggagagcugguccuucaac

SEQ ID NO: 20338 - RNA, 29 nt, Artificial Sequence
  Synthetic Oligonucleotide; PD-L1 exon 3; Set C
cauuucccagggagagcugguccuucaac

SEQ ID NO: 20339 - RNA, 27 nt, Artificial Sequence
  Synthetic Oligonucleotide; PD-L1 exon 3; Set C
auuucccagggagagcugguccuucaa

SEQ ID NO: 20340 - RNA, 28 nt, Artificial Sequence
  Synthetic Oligonucleotide; PD-L1 exon 3; Set C
cauuucccagggagagcugguccuucaa

SEQ ID NO: 20341 - RNA, 26 nt, Artificial Sequence
  Synthetic Oligonucleotide; PD-L1 exon 3; Set C
auuucccagggagagcugguccuuca

SEQ ID NO: 20342 - RNA, 27 nt, Artificial Sequence
  Synthetic Oligonucleotide; PD-L1 exon 3; Set C
cauuucccagggagagcugguccuuca

SEQ ID NO: 20343 - RNA, 25 nt, Artificial Sequence
  Synthetic Oligonucleotide; PD-L1 exon 3; Set C
auuucccagggagagcugguccuuc

SEQ ID NO: 20344 - RNA, 26 nt, Artificial Sequence
  Synthetic Oligonucleotide; PD-L1 exon 3; Set C
cauuucccagggagagcugguccuuc

SEQ ID NO: 20345 - RNA, 23 nt, Artificial Sequence
  Synthetic Oligonucleotide; PD-L1 exon 3; Set C
ugugaucugaagugcagcauuuc

SEQ ID NO: 20346 - RNA, 24 nt, Artificial Sequence
  Synthetic Oligonucleotide; PD-L1 exon 3; Set A
cugugaucugaagugcagcauuuc

SEQ ID NO: 20347 - RNA, 23 nt, Artificial Sequence
  Synthetic Oligonucleotide; PD-L1 exon 3; Set A
cugugaucugaagugcagcauuu

SEQ ID NO: 20348 - RNA, 25 nt, Artificial Sequence
  Synthetic Oligonucleotide; PD-L1 exon 3; Set A
ucugugaucugaagugcagcauuuc

SEQ ID NO: 20349 - RNA, 24 nt, Artificial Sequence
  Synthetic Oligonucleotide; PD-L1 exon 3; Set A
aucugugaucugaagugcagcauu

SEQ ID NO: 20350 - RNA, 25 nt, Artificial Sequence
  Synthetic Oligonucleotide; PD-L1 exon 3; Set A
caucugugaucugaagugcagcauu

SEQ ID NO: 20351 - RNA, 23 nt, Artificial Sequence
  Synthetic Oligonucleotide; PD-L1 exon 3; Set A
aucugugaucugaagugcagcau

SEQ ID NO: 20352 - RNA, 24 nt, Artificial Sequence
  Synthetic Oligonucleotide; PD-L1 exon 3; Set A
caucugugaucugaagugcagcau

SEQ ID NO: 20353 - RNA, 15 nt, Artificial Sequence
  Synthetic Oligonucleotide; PD-L1 exon 3; Set C
cugugaucugaagug

SEQ ID NO: 20354 - RNA, 31 nt, Artificial Sequence
  Synthetic Oligonucleotide; PD-L1 exon 3; Set C
acaccccugcauccugcaauuucacaucugu

SEQ ID NO: 20355 - RNA, 32 nt, Artificial Sequence
  Synthetic Oligonucleotide; PD-L1 exon 3; Set C
uacaccccugcauccugcaauuucacaucugu

SEQ ID NO: 20356 - RNA, 30 nt, Artificial Sequence
  Synthetic Oligonucleotide; PD-L1 exon 3; Set C
acaccccugcauccugcaauuucacaucug

SEQ ID NO: 20357 - RNA, 29 nt, Artificial Sequence
  Synthetic Oligonucleotide; PD-L1 exon 3; Set C
acaccccugcauccugcaauuucacaucu

SEQ ID NO: 20358 - RNA, 31 nt, Artificial Sequence
  Synthetic Oligonucleotide; PD-L1 exon 3; Set C
uacaccccugcauccugcaauuucacaucug

SEQ ID NO: 20359 - RNA, 30 nt, Artificial Sequence
  Synthetic Oligonucleotide; PD-L1 exon 3; Set C
uacaccccugcauccugcaauuucacaucu

SEQ ID NO: 20360 - RNA, 23 nt, Artificial Sequence
  Synthetic Oligonucleotide; PD-L1 exon 3; Set B
auagcugaucaugcagcgguaca

SEQ ID NO: 20361 - RNA, 22 nt, Artificial Sequence
  Synthetic Oligonucleotide; PD-L1 exon 3; Set B
auagcugaucaugcagcgguac

SEQ ID NO: 20362 - RNA, 32 nt, Artificial Sequence
  Synthetic Oligonucleotide; PD-L1 exon 3; Set C
ggcaccaccauagcugaucaugcagcgguaca

SEQ ID NO: 20363 - RNA, 31 nt, Artificial Sequence
  Synthetic Oligonucleotide; PD-L1 exon 3; Set C
ggcaccaccauagcugaucaugcagcgguac

SEQ ID NO: 20364 - RNA, 33 nt, Artificial Sequence
  Synthetic Oligonucleotide; PD-L1 exon 3; Set C
cggcaccaccauagcugaucaugcagcgguaca

SEQ ID NO: 20365 - RNA, 32 nt, Artificial Sequence
  Synthetic Oligonucleotide; PD-L1 exon 3; Set C
cggcaccaccauagcugaucaugcagcgguac

SEQ ID NO: 20366 - RNA, 37 nt, Artificial Sequence
  Synthetic Oligonucleotide; PD-L1 exon 3; Set C
uagucggcaccaccauagcugaucaugcagcgguaca

SEQ ID NO: 20367 - RNA, 36 nt, Artificial Sequence
  Synthetic Oligonucleotide; PD-L1 exon 3; Set C
uagucggcaccaccauagcugaucaugcagcgguac

SEQ ID NO: 20368 - RNA, 38 nt, Artificial Sequence
  Synthetic Oligonucleotide; PD-L1 exon 3; Set C
guagucggcaccaccauagcugaucaugcagcgguaca

SEQ ID NO: 20369 - RNA, 37 nt, Artificial Sequence
  Synthetic Oligonucleotide; PD-L1 exon 3; Set C
guagucggcaccaccauagcugaucaugcagcgguac

SEQ ID NO: 20370 - RNA, 39 nt, Artificial Sequence
  Synthetic Oligonucleotide; PD-L1 exon 3; Set C
uguagucggcaccaccauagcugaucaugcagcgguaca

SEQ ID NO: 20371 - RNA, 38 nt, Artificial Sequence
  Synthetic Oligonucleotide; PD-L1 exon 3; Set C
uguagucggcaccaccauagcugaucaugcagcgguac

SEQ ID NO: 20372 - RNA, 40 nt, Artificial Sequence
  Synthetic Oligonucleotide; PD-L1 exon 3; Set C
uuguagucggcaccaccauagcugaucaugcagcgguaca

SEQ ID NO: 20373 - RNA, 39 nt, Artificial Sequence
  Synthetic Oligonucleotide; PD-L1 exon 3; Set C
uuguagucggcaccaccauagcugaucaugcagcgguac

SEQ ID NO: 20374 - RNA, 40 nt, Artificial Sequence
  Synthetic Oligonucleotide; PD-L1 exon 3; Set C
cuuguagucggcaccaccauagcugaucaugcagcgguac

SEQ ID NO: 20375 - RNA, 24 nt, Artificial Sequence
  Synthetic Oligonucleotide; PD-L1 exon 3; Set C
uagucggcaccaccauagcugauc

SEQ ID NO: 20376 - RNA, 29 nt, Artificial Sequence
  Synthetic Oligonucleotide; PD-L1 exon 3; Set C
cgcuuguagucggcaccaccauagcugau

SEQ ID NO: 20377 - RNA, 30 nt, Artificial Sequence
  Synthetic Oligonucleotide; PD-L1 exon 3; Set C
ucgcuuguagucggcaccaccauagcugau

SEQ ID NO: 20378 - RNA, 30 nt, Artificial Sequence
  Synthetic Oligonucleotide; PD-L1 exon 3; Set C
uucgcuuguagucggcaccaccauagcuga

SEQ ID NO: 20379 - RNA, 27 nt, Artificial Sequence
  Synthetic Oligonucleotide; PD-L1 exon 3; Set C
ucgcuuguagucggcaccaccauagcu

SEQ ID NO: 20380 - RNA, 31 nt, Artificial Sequence
  Synthetic Oligonucleotide; PD-L1 exon 3; Set C
auucgcuuguagucggcaccaccauagcuga

SEQ ID NO: 20381 - RNA, 36 nt, Artificial Sequence
  Synthetic Oligonucleotide; PD-L1 exon 3; Set C
guaauucgcuuguagucggcaccaccauagcugauc

SEQ ID NO: 20382 - RNA, 20 nt, Artificial Sequence
  Synthetic Oligonucleotide; PD-L1 exon 3; Set B
cuuguagucggcaccaccau

SEQ ID NO: 20383 - RNA, 28 nt, Artificial Sequence
  Synthetic Oligonucleotide; PD-L1 exon 3; Set C
uucgcuuguagucggcaccaccauagcu

SEQ ID NO: 20384 - RNA, 21 nt, Artificial Sequence
  Synthetic Oligonucleotide; PD-L1 exon 3; Set C
gcuuguagucggcaccaccau

SEQ ID NO: 20385 - RNA, 29 nt, Artificial Sequence
  Synthetic Oligonucleotide; PD-L1 exon 3; Set C
auucgcuuguagucggcaccaccauagcu

SEQ ID NO: 20386 - RNA, 38 nt, Artificial Sequence
  Synthetic Oligonucleotide; PD-L1 exon 3; Set C
caguaauucgcuuguagucggcaccaccauagcugauc

SEQ ID NO: 20387 - RNA, 22 nt, Artificial Sequence
  Synthetic Oligonucleotide; PD-L1 exon 3; Set C
cgcuuguagucggcaccaccau

SEQ ID NO: 20388 - RNA, 24 nt, Artificial Sequence
  Synthetic Oligonucleotide; PD-L1 exon 3; Set C
ucgcuuguagucggcaccaccaua

SEQ ID NO: 20389 - RNA, 28 nt, Artificial Sequence
  Synthetic Oligonucleotide; PD-L1 exon 3; Set C
auucgcuuguagucggcaccaccauagc

SEQ ID NO: 20390 - RNA, 25 nt, Artificial Sequence
  Synthetic Oligonucleotide; PD-L1 exon 3; Set C
uucgcuuguagucggcaccaccaua

SEQ ID NO: 20391 - RNA, 26 nt, Artificial Sequence
  Synthetic Oligonucleotide; PD-L1 exon 3; Set C
auucgcuuguagucggcaccaccaua

SEQ ID NO: 20392 - RNA, 26 nt, Artificial Sequence
  Synthetic Oligonucleotide; PD-L1 exon 3; Set C
aauucgcuuguagucggcaccaccau

SEQ ID NO: 20393 - RNA, 27 nt, Artificial Sequence
  Synthetic Oligonucleotide; PD-L1 exon 3; Set C
uaauucgcuuguagucggcaccaccau

SEQ ID NO: 20394 - RNA, 39 nt, Artificial Sequence
  Synthetic Oligonucleotide; PD-L1 exon 3; Set C
uuucacaguaauucgcuuguagucggcaccaccauagcu

SEQ ID NO: 20395 - RNA, 40 nt, Artificial Sequence
  Synthetic Oligonucleotide; PD-L1 exon 3; Set C
cuuucacaguaauucgcuuguagucggcaccaccauagcu

SEQ ID NO: 20396 - RNA, 36 nt, Artificial Sequence
  Synthetic Oligonucleotide; PD-L1 exon 3; Set C
uuucacaguaauucgcuuguagucggcaccaccaua

SEQ ID NO: 20397 - RNA, 37 nt, Artificial Sequence
  Synthetic Oligonucleotide; PD-L1 exon 3; Set C
cuuucacaguaauucgcuuguagucggcaccaccaua

SEQ ID NO: 20398 - RNA, 20 nt, Artificial Sequence
  Synthetic Oligonucleotide; PD-L1 exon 3; Set C
guaauucgcuuguagucggc

SEQ ID NO: 20399 - RNA, 19 nt, Artificial Sequence
  Synthetic Oligonucleotide; PD-L1 exon 3; Set C
guaauucgcuuguagucgg

SEQ ID NO: 20400 - RNA, 22 nt, Artificial Sequence
  Synthetic Oligonucleotide; PD-L1 exon 3; Set B
caguaauucgcuuguagucggc

SEQ ID NO: 20401 - RNA, 21 nt, Artificial Sequence
  Synthetic Oligonucleotide; PD-L1 exon 3; Set C
caguaauucgcuuguagucgg

SEQ ID NO: 20402 - RNA, 15 nt, Artificial Sequence
  Synthetic Oligonucleotide; PD-L1 exon 3; Set C
guaauucgcuuguag

SEQ ID NO: 20403 - RNA, 26 nt, Artificial Sequence
  Synthetic Oligonucleotide; PD-L1 exon 3; Set B
uucacaguaauucgcuuguagucggc

SEQ ID NO: 20404 - RNA, 25 nt, Artificial Sequence
  Synthetic Oligonucleotide; PD-L1 exon 3; Set B
uucacaguaauucgcuuguagucgg

SEQ ID NO: 20405 - RNA, 17 nt, Artificial Sequence
  Synthetic Oligonucleotide; PD-L1 exon 3; Set C
caguaauucgcuuguag

SEQ ID NO: 20406 - RNA, 16 nt, Artificial Sequence
  Synthetic Oligonucleotide; PD-L1 exon 3; Set C
caguaauucgcuugua

SEQ ID NO: 20407 - RNA, 15 nt, Artificial Sequence
  Synthetic Oligonucleotide; PD-L1 exon 3; Set C
caguaauucgcuugu

SEQ ID NO: 20408 - RNA, 21 nt, Artificial Sequence
  Synthetic Oligonucleotide; PD-L1 exon 3; Set C
uucacaguaauucgcuuguag

SEQ ID NO: 20409 - RNA, 20 nt, Artificial Sequence
  Synthetic Oligonucleotide; PD-L1 exon 3; Set C
uucacaguaauucgcuugua

SEQ ID NO: 20410 - RNA, 19 nt, Artificial Sequence
  Synthetic Oligonucleotide; PD-L1 exon 3; Set C
uucacaguaauucgcuugu

SEQ ID NO: 20411 - RNA, 18 nt, Artificial Sequence
  Synthetic Oligonucleotide; PD-L1 exon 3; Set C
uucacaguaauucgcuug

SEQ ID NO: 20412 - RNA, 17 nt, Artificial Sequence
  Synthetic Oligonucleotide; PD-L1 exon 3; Set C
uucacaguaauucgcuu

SEQ ID NO: 20413 - RNA, 16 nt, Artificial Sequence
  Synthetic Oligonucleotide; PD-L1 exon 3; Set C
uucacaguaauucgcu

SEQ ID NO: 20414 - RNA, 15 nt, Artificial Sequence
  Synthetic Oligonucleotide; PD-L1 exon 3; Set C
uucacaguaauucgc

SEQ ID NO: 20415 - RNA, 17 nt, Artificial Sequence
  Synthetic Oligonucleotide; PD-L1 exon 3; Set C
acuuucacaguaauucg

SEQ ID NO: 20416 - RNA, 16 nt, Artificial Sequence
  Synthetic Oligonucleotide; PD-L1 exon 3; Set C
acuuucacaguaauuc

SEQ ID NO: 20417 - RNA, 18 nt, Artificial Sequence
  Synthetic Oligonucleotide; PD-L1 exon 3; Set C
gacuuucacaguaauucg

SEQ ID NO: 20418 - RNA, 17 nt, Artificial Sequence
  Synthetic Oligonucleotide; PD-L1 exon 3; Set C
gacuuucacaguaauuc

SEQ ID NO: 20419 - RNA, 15 nt, Artificial Sequence
  Synthetic Oligonucleotide; PD-L1 exon 3; Set C
acuuucacaguaauu

SEQ ID NO: 20420 - RNA, 19 nt, Artificial Sequence
  Synthetic Oligonucleotide; PD-L1 exon 3; Set C
ugacuuucacaguaauucg

SEQ ID NO: 20421 - RNA, 18 nt, Artificial Sequence
  Synthetic Oligonucleotide; PD-L1 exon 3; Set C
ugacuuucacaguaauuc

SEQ ID NO: 20422 - RNA, 16 nt, Artificial Sequence
  Synthetic Oligonucleotide; PD-L1 exon 3; Set C
gacuuucacaguaauu

SEQ ID NO: 20423 - RNA, 17 nt, Artificial Sequence
  Synthetic Oligonucleotide; PD-L1 exon 3; Set C
ugacuuucacaguaauu

SEQ ID NO: 20424 - RNA, 22 nt, Artificial Sequence
  Synthetic Oligonucleotide; PD-L1 exon 3; Set C
uuaccauugacuuucacaguaa

SEQ ID NO: 20425 - RNA, 22 nt, Artificial Sequence
  Synthetic Oligonucleotide; PD-L1 exon 3; Set C
cuuaccauugacuuucacagua

SEQ ID NO: 20426 - RNA, 23 nt, Artificial Sequence
  Synthetic Oligonucleotide; PD-L1 exon 3; Set C
ucuuaccauugacuuucacagua

SEQ ID NO: 20427 - RNA, 20 nt, Artificial Sequence
  Synthetic Oligonucleotide; PD-L1 exon 3; Set C
cuuaccauugacuuucacag

SEQ ID NO: 20428 - RNA, 21 nt, Artificial Sequence
  Synthetic Oligonucleotide; PD-L1 exon 3; Set C
ucuuaccauugacuuucacag

SEQ ID NO: 20429 - RNA, 22 nt, Artificial Sequence
  Synthetic Oligonucleotide; PD-L1 exon 3; Set C
uucuuaccauugacuuucacag

SEQ ID NO: 20430 - RNA, 15 nt, Artificial Sequence
  Synthetic Oligonucleotide; PD-L1 exon 3; Set C
uuaccauugacuuuc

SEQ ID NO: 20431 - RNA, 25 nt, Artificial Sequence
  Synthetic Oligonucleotide; PD-L1 exon 3; Set C
aauucuuaccauugacuuucacagu

SEQ ID NO: 20432 - RNA, 26 nt, Artificial Sequence
  Synthetic Oligonucleotide; PD-L1 exon 3; Set C
uaauucuuaccauugacuuucacagu

SEQ ID NO: 20433 - RNA, 27 nt, Artificial Sequence
  Synthetic Oligonucleotide; PD-L1 exon 3; Set C
auaauucuuaccauugacuuucacagu

SEQ ID NO: 20434 - RNA, 30 nt, Artificial Sequence
  Synthetic Oligonucleotide; PD-L1 exon 3; Set C
uaauaauucuuaccauugacuuucacagua

SEQ ID NO: 20435 - RNA, 28 nt, Artificial Sequence
  Synthetic Oligonucleotide; PD-L1 exon 3; Set C
aauaauucuuaccauugacuuucacagu

SEQ ID NO: 20436 - RNA, 31 nt, Artificial Sequence
  Synthetic Oligonucleotide; PD-L1 exon 3; Set C
auaauaauucuuaccauugacuuucacagua

SEQ ID NO: 20437 - RNA, 32 nt, Artificial Sequence
  Synthetic Oligonucleotide; PD-L1 exon 3; Set C
uauaauaauucuuaccauugacuuucacagua

SEQ ID NO: 20438 - RNA, 28 nt, Artificial Sequence
  Synthetic Oligonucleotide; PD-L1 exon 3; Set C
uaauaauucuuaccauugacuuucacag

SEQ ID NO: 20439 - RNA, 37 nt, Artificial Sequence
  Synthetic Oligonucleotide; PD-L1 exon 3; Set B
aucuauaauaauucuuaccauugacuuucacaguaau

SEQ ID NO: 20440 - RNA, 33 nt, Artificial Sequence
  Synthetic Oligonucleotide; PD-L1 exon 3; Set B
cuauaauaauucuuaccauugacuuucacagua

SEQ ID NO: 20441 - RNA, 29 nt, Artificial Sequence
  Synthetic Oligonucleotide; PD-L1 exon 3; Set C
auaauaauucuuaccauugacuuucacag

SEQ ID NO: 20442 - RNA, 15 nt, Artificial Sequence
  Synthetic Oligonucleotide; PD-L1 exon 3; Set C
uucuuaccauugacu

SEQ ID NO: 20443 - RNA, 30 nt, Artificial Sequence
  Synthetic Oligonucleotide; PD-L1 exon 3; Set C
uauaauaauucuuaccauugacuuucacag

SEQ ID NO: 20444 - RNA, 16 nt, Artificial Sequence
  Synthetic Oligonucleotide; PD-L1 exon 3; Set C
auucuuaccauugacu

SEQ ID NO: 20445 - RNA, 31 nt, Artificial Sequence
  Synthetic Oligonucleotide; PD-L1 exon 3; Set C
cuauaauaauucuuaccauugacuuucacag

SEQ ID NO: 20446 - RNA, 17 nt, Artificial Sequence
  Synthetic Oligonucleotide; PD-L1 exon 3; Set C
aauucuuaccauugacu

SEQ ID NO: 20447 - RNA, 15 nt, Artificial Sequence
  Synthetic Oligonucleotide; PD-L1 exon 3; Set C
auucuuaccauugac

SEQ ID NO: 20448 - RNA, 33 nt, Artificial Sequence
  Synthetic Oligonucleotide; PD-L1 exon 3; Set B
ucuauaauaauucuuaccauugacuuucacagu

SEQ ID NO: 20449 - RNA, 18 nt, Artificial Sequence
  Synthetic Oligonucleotide; PD-L1 exon 3; Set C
uaauucuuaccauugacu

SEQ ID NO: 20450 - RNA, 16 nt, Artificial Sequence
  Synthetic Oligonucleotide; PD-L1 exon 3; Set C
aauucuuaccauugac

SEQ ID NO: 20451 - RNA, 15 nt, Artificial Sequence
  Synthetic Oligonucleotide; PD-L1 exon 3; Set C
aauucuuaccauuga

SEQ ID NO: 20452 - RNA, 19 nt, Artificial Sequence
  Synthetic Oligonucleotide; PD-L1 exon 3; Set C
auaauucuuaccauugacu

SEQ ID NO: 20453 - RNA, 17 nt, Artificial Sequence
  Synthetic Oligonucleotide; PD-L1 exon 3; Set C
uaauucuuaccauugac

SEQ ID NO: 20454 - RNA, 40 nt, Artificial Sequence
  Synthetic Oligonucleotide; PD-L1 exon 3; Set B
ucucaucuauaauaauucuuaccauugacuuucacaguaa

SEQ ID NO: 20455 - RNA, 16 nt, Artificial Sequence
  Synthetic Oligonucleotide; PD-L1 exon 3; Set C
uaauucuuaccauuga

SEQ ID NO: 20456 - RNA, 18 nt, Artificial Sequence
  Synthetic Oligonucleotide; PD-L1 exon 3; Set C
auaauucuuaccauugac

SEQ ID NO: 20457 - RNA, 17 nt, Artificial Sequence
  Synthetic Oligonucleotide; PD-L1 exon 3; Set C
auaauucuuaccauuga

SEQ ID NO: 20458 - RNA, 19 nt, Artificial Sequence
  Synthetic Oligonucleotide; PD-L1 exon 3; Set C
aauaauucuuaccauugac

SEQ ID NO: 20459 - RNA, 21 nt, Artificial Sequence
  Synthetic Oligonucleotide; PD-L1 exon 3; Set C
uaauaauucuuaccauugacu

SEQ ID NO: 20460 - RNA, 18 nt, Artificial Sequence
  Synthetic Oligonucleotide; PD-L1 exon 3; Set C
aauaauucuuaccauuga

SEQ ID NO: 20461 - RNA, 20 nt, Artificial Sequence
  Synthetic Oligonucleotide; PD-L1 exon 3; Set C
uaauaauucuuaccauugac

SEQ ID NO: 20462 - RNA, 22 nt, Artificial Sequence
  Synthetic Oligonucleotide; PD-L1 exon 3; Set C
auaauaauucuuaccauugacu

SEQ ID NO: 20463 - RNA, 19 nt, Artificial Sequence
  Synthetic Oligonucleotide; PD-L1 exon 3; Set C
uaauaauucuuaccauuga

SEQ ID NO: 20464 - RNA, 23 nt, Artificial Sequence
  Synthetic Oligonucleotide; PD-L1 exon 3; Set C
uauaauaauucuuaccauugacu

SEQ ID NO: 20465 - RNA, 21 nt, Artificial Sequence
  Synthetic Oligonucleotide; PD-L1 exon 3; Set C
auaauaauucuuaccauugac

SEQ ID NO: 20466 - RNA, 15 nt, Artificial Sequence
  Synthetic Oligonucleotide; PD-L1 exon 3; Set C
auaauucuuaccauu

SEQ ID NO: 20467 - RNA, 20 nt, Artificial Sequence
  Synthetic Oligonucleotide; PD-L1 exon 3; Set C
auaauaauucuuaccauuga

SEQ ID NO: 20468 - RNA, 22 nt, Artificial Sequence
  Synthetic Oligonucleotide; PD-L1 exon 3; Set C
uauaauaauucuuaccauugac

SEQ ID NO: 20469 - RNA, 24 nt, Artificial Sequence
  Synthetic Oligonucleotide; PD-L1 exon 3; Set C
cuauaauaauucuuaccauugacu

SEQ ID NO: 20470 - RNA, 16 nt, Artificial Sequence
  Synthetic Oligonucleotide; PD-L1 exon 3; Set C
aauaauucuuaccauu

SEQ ID NO: 20471 - RNA, 29 nt, Artificial Sequence
  Synthetic Oligonucleotide; PD-L1 exon 3; Set C
caucuauaauaauucuuaccauugacuuu

SEQ ID NO: 20472 - RNA, 21 nt, Artificial Sequence
  Synthetic Oligonucleotide; PD-L1 exon 3; Set C
uauaauaauucuuaccauuga

SEQ ID NO: 20473 - RNA, 23 nt, Artificial Sequence
  Synthetic Oligonucleotide; PD-L1 exon 3; Set C
cuauaauaauucuuaccauugac

SEQ ID NO: 20474 - RNA, 15 nt, Artificial Sequence
  Synthetic Oligonucleotide; PD-L1 exon 3; Set C
aauaauucuuaccau

SEQ ID NO: 20475 - RNA, 30 nt, Artificial Sequence
  Synthetic Oligonucleotide; PD-L1 exon 3; Set C
ucaucuauaauaauucuuaccauugacuuu

SEQ ID NO: 20476 - RNA, 28 nt, Artificial Sequence
  Synthetic Oligonucleotide; PD-L1 exon 3; Set C
caucuauaauaauucuuaccauugacuu

SEQ ID NO: 20477 - RNA, 22 nt, Artificial Sequence
  Synthetic Oligonucleotide; PD-L1 exon 3; Set C
cuauaauaauucuuaccauuga

SEQ ID NO: 20478 - RNA, 31 nt, Artificial Sequence
  Synthetic Oligonucleotide; PD-L1 exon 3; Set C
cucaucuauaauaauucuuaccauugacuuu

SEQ ID NO: 20479 - RNA, 29 nt, Artificial Sequence
  Synthetic Oligonucleotide; PD-L1 exon 3; Set C
ucaucuauaauaauucuuaccauugacuu

SEQ ID NO: 20480 - RNA, 30 nt, Artificial Sequence
  Synthetic Oligonucleotide; PD-L1 exon 3; Set C
cucaucuauaauaauucuuaccauugacuu

SEQ ID NO: 20481 - RNA, 21 nt, Artificial Sequence
  Synthetic Oligonucleotide; PD-L1 exon 3; Set C
ucuauaauaauucuuaccauu

SEQ ID NO: 20482 - RNA, 20 nt, Artificial Sequence
  Synthetic Oligonucleotide; PD-L1 exon 3; Set C
ucuauaauaauucuuaccau

SEQ ID NO: 20483 - RNA, 35 nt, Artificial Sequence
  Synthetic Oligonucleotide; PD-L1 exon 3; Set B
gccucucaucuauaauaauucuuaccauugacuuu

SEQ ID NO: 20484 - RNA, 33 nt, Artificial Sequence
  Synthetic Oligonucleotide; PD-L1 exon 3; Set B
ccucucaucuauaauaauucuuaccauugacuu

SEQ ID NO: 20485 - RNA, 34 nt, Artificial Sequence
  Synthetic Oligonucleotide; PD-L1 exon 3; Set B
gccucucaucuauaauaauucuuaccauugacuu

SEQ ID NO: 20486 - RNA, 19 nt, Artificial Sequence
  Synthetic Oligonucleotide; PD-L1 exon 3; Set C
ucaucuauaauaauucuua

SEQ ID NO: 20487 - RNA, 20 nt, Artificial Sequence
  Synthetic Oligonucleotide; PD-L1 exon 3; Set C
cucaucuauaauaauucuua

SEQ ID NO: 20488 - RNA, 24 nt, Artificial Sequence
  Synthetic Oligonucleotide; PD-L1 exon 3; Set C
gccucucaucuauaauaauucuua

SEQ ID NO: 20489 - RNA, 40 nt, Artificial Sequence
  Synthetic Oligonucleotide; PD-L1 exon 3; Set B
aaagaucaggccucucaucuauaauaauucuuaccauuga

SEQ ID NO: 20490 - RNA, 31 nt, Artificial Sequence
  Synthetic Oligonucleotide; PD-L1 exon 3; Set B
aagaucaggccucucaucuauaauaauucuu

SEQ ID NO: 20491 - RNA, 30 nt, Artificial Sequence
  Synthetic Oligonucleotide; PD-L1 exon 3; Set B
aagaucaggccucucaucuauaauaauucu

SEQ ID NO: 20492 - RNA, 29 nt, Artificial Sequence
  Synthetic Oligonucleotide; PD-L1 exon 3; Set C
aagaucaggccucucaucuauaauaauuc

SEQ ID NO: 20493 - RNA, 28 nt, Artificial Sequence
  Synthetic Oligonucleotide; PD-L1 exon 3; Set C
aagaucaggccucucaucuauaauaauu

SEQ ID NO: 20494 - RNA, 27 nt, Artificial Sequence
  Synthetic Oligonucleotide; PD-L1 exon 3; Set C
aagaucaggccucucaucuauaauaau

SEQ ID NO: 20495 - RNA, 37 nt, Artificial Sequence
  Synthetic Oligonucleotide; PD-L1 exon 3; Set B
caauaaagaucaggccucucaucuauaauaauucuua

SEQ ID NO: 20496 - RNA, 26 nt, Artificial Sequence
  Synthetic Oligonucleotide; PD-L1 exon 3; Set C
aagaucaggccucucaucuauaauaa

SEQ ID NO: 20497 - RNA, 38 nt, Artificial Sequence
  Synthetic Oligonucleotide; PD-L1 exon 3; Set B
ucaauaaagaucaggccucucaucuauaauaauucuua

SEQ ID NO: 20498 - RNA, 25 nt, Artificial Sequence
  Synthetic Oligonucleotide; PD-L1 exon 3; Set C
aagaucaggccucucaucuauaaua

SEQ ID NO: 20499 - RNA, 39 nt, Artificial Sequence
  Synthetic Oligonucleotide; PD-L1 exon 3; Set B
uucaauaaagaucaggccucucaucuauaauaauucuua

SEQ ID NO: 20500 - RNA, 24 nt, Artificial Sequence
  Synthetic Oligonucleotide; PD-L1 exon 3; Set C
aagaucaggccucucaucuauaau

SEQ ID NO: 20501 - RNA, 19 nt, Artificial Sequence
  Synthetic Oligonucleotide; PD-L1 exon 3; Set C
aagaucaggccucucaucu

SEQ ID NO: 20502 - RNA, 19 nt, Artificial Sequence
  Synthetic Oligonucleotide; PD-L1 exon 3; Set C
aaagaucaggccucucauc

SEQ ID NO: 20503 - RNA, 20 nt, Artificial Sequence
  Synthetic Oligonucleotide; PD-L1 exon 3; Set C
uaaagaucaggccucucauc

SEQ ID NO: 20504 - RNA, 18 nt, Artificial Sequence
  Synthetic Oligonucleotide; PD-L1 exon 3; Set C
aaagaucaggccucucau

SEQ ID NO: 20505 - RNA, 25 nt, Artificial Sequence
  Synthetic Oligonucleotide; PD-L1 exon 3; Set C
caauaaagaucaggccucucaucua

SEQ ID NO: 20506 - RNA, 21 nt, Artificial Sequence
  Synthetic Oligonucleotide; PD-L1 exon 3; Set C
auaaagaucaggccucucauc

SEQ ID NO: 20507 - RNA, 19 nt, Artificial Sequence
  Synthetic Oligonucleotide; PD-L1 exon 3; Set C
uaaagaucaggccucucau

SEQ ID NO: 20508 - RNA, 17 nt, Artificial Sequence
  Synthetic Oligonucleotide; PD-L1 exon 3; Set C
aaagaucaggccucuca

SEQ ID NO: 20509 - RNA, 26 nt, Artificial Sequence
  Synthetic Oligonucleotide; PD-L1 exon 3; Set C
ucaauaaagaucaggccucucaucua

SEQ ID NO: 20510 - RNA, 22 nt, Artificial Sequence
  Synthetic Oligonucleotide; PD-L1 exon 3; Set C
aauaaagaucaggccucucauc

SEQ ID NO: 20511 - RNA, 20 nt, Artificial Sequence
  Synthetic Oligonucleotide; PD-L1 exon 3; Set C
auaaagaucaggccucucau

SEQ ID NO: 20512 - RNA, 16 nt, Artificial Sequence
  Synthetic Oligonucleotide; PD-L1 exon 3; Set C
aaagaucaggccucuc

SEQ ID NO: 20513 - RNA, 18 nt, Artificial Sequence
  Synthetic Oligonucleotide; PD-L1 exon 3; Set C
uaaagaucaggccucuca

SEQ ID NO: 20514 - RNA, 15 nt, Artificial Sequence
  Synthetic Oligonucleotide; PD-L1 exon 3; Set C
aaagaucaggccucu

SEQ ID NO: 20515 - RNA, 21 nt, Artificial Sequence
  Synthetic Oligonucleotide; PD-L1 exon 3; Set C
aauaaagaucaggccucucau

SEQ ID NO: 20516 - RNA, 17 nt, Artificial Sequence
  Synthetic Oligonucleotide; PD-L1 exon 3; Set C
uaaagaucaggccucuc

SEQ ID NO: 20517 - RNA, 19 nt, Artificial Sequence
  Synthetic Oligonucleotide; PD-L1 exon 3; Set C
auaaagaucaggccucuca

SEQ ID NO: 20518 - RNA, 16 nt, Artificial Sequence
  Synthetic Oligonucleotide; PD-L1 exon 3; Set C
uaaagaucaggccucu

SEQ ID NO: 20519 - RNA, 18 nt, Artificial Sequence
  Synthetic Oligonucleotide; PD-L1 exon 3; Set C
auaaagaucaggccucuc

SEQ ID NO: 20520 - RNA, 20 nt, Artificial Sequence
  Synthetic Oligonucleotide; PD-L1 exon 3; Set C
aauaaagaucaggccucuca

SEQ ID NO: 20521 - RNA, 15 nt, Artificial Sequence
  Synthetic Oligonucleotide; PD-L1 exon 3; Set C
uaaagaucaggccuc

SEQ ID NO: 20522 - RNA, 19 nt, Artificial Sequence
  Synthetic Oligonucleotide; PD-L1 exon 3; Set C
aauaaagaucaggccucuc

SEQ ID NO: 20523 - RNA, 16 nt, Artificial Sequence
  Synthetic Oligonucleotide; PD-L1 exon 3; Set C
auaaagaucaggccuc

SEQ ID NO: 20524 - RNA, 17 nt, Artificial Sequence
  Synthetic Oligonucleotide; PD-L1 exon 3; Set C
aauaaagaucaggccuc

SEQ ID NO: 20525 - RNA, 15 nt, Artificial Sequence
  Synthetic Oligonucleotide; PD-L1 exon 3; Set C
auaaagaucaggccu

SEQ ID NO: 20526 - RNA, 16 nt, Artificial Sequence
  Synthetic Oligonucleotide; PD-L1 exon 3; Set C
aauaaagaucaggccu

SEQ ID NO: 20527 - RNA, 15 nt, Artificial Sequence
  Synthetic Oligonucleotide; PD-L1 exon 3; Set C
aauaaagaucaggcc

SEQ ID NO: 20528 - RNA, 22 nt, Artificial Sequence
  Synthetic Oligonucleotide; PD-L1 exon 3; Set C
uuucaauaaagaucaggccucu

SEQ ID NO: 20529 - RNA, 30 nt, Artificial Sequence
  Synthetic Oligonucleotide; PD-L1 exon 3; Set B
auguuuucaauaaagaucaggccucucauc

SEQ ID NO: 20530 - RNA, 23 nt, Artificial Sequence
  Synthetic Oligonucleotide; PD-L1 exon 3; Set C
uuuucaauaaagaucaggccucu

SEQ ID NO: 20531 - RNA, 31 nt, Artificial Sequence
  Synthetic Oligonucleotide; PD-L1 exon 3; Set B
uauguuuucaauaaagaucaggccucucauc

SEQ ID NO: 20532 - RNA, 29 nt, Artificial Sequence
  Synthetic Oligonucleotide; PD-L1 exon 3; Set B
auguuuucaauaaagaucaggccucucau

SEQ ID NO: 20533 - RNA, 24 nt, Artificial Sequence
  Synthetic Oligonucleotide; PD-L1 exon 3; Set C
guuuucaauaaagaucaggccucu

SEQ ID NO: 20534 - RNA, 32 nt, Artificial Sequence
  Synthetic Oligonucleotide; PD-L1 exon 3; Set B
auauguuuucaauaaagaucaggccucucauc

SEQ ID NO: 20535 - RNA, 30 nt, Artificial Sequence
  Synthetic Oligonucleotide; PD-L1 exon 3; Set B
uauguuuucaauaaagaucaggccucucau

SEQ ID NO: 20536 - RNA, 25 nt, Artificial Sequence
  Synthetic Oligonucleotide; PD-L1 exon 3; Set C
uguuuucaauaaagaucaggccucu

SEQ ID NO: 20537 - RNA, 31 nt, Artificial Sequence
  Synthetic Oligonucleotide; PD-L1 exon 3; Set B
auauguuuucaauaaagaucaggccucucau

SEQ ID NO: 20538 - RNA, 27 nt, Artificial Sequence
  Synthetic Oligonucleotide; PD-L1 exon 3; Set C
auguuuucaauaaagaucaggccucuc

SEQ ID NO: 20539 - RNA, 29 nt, Artificial Sequence
  Synthetic Oligonucleotide; PD-L1 exon 3; Set B
uauguuuucaauaaagaucaggccucuca

SEQ ID NO: 20540 - RNA, 26 nt, Artificial Sequence
  Synthetic Oligonucleotide; PD-L1 exon 3; Set C
auguuuucaauaaagaucaggccucu

SEQ ID NO: 20541 - RNA, 28 nt, Artificial Sequence
  Synthetic Oligonucleotide; PD-L1 exon 3; Set C
uauguuuucaauaaagaucaggccucuc

SEQ ID NO: 20542 - RNA, 30 nt, Artificial Sequence
  Synthetic Oligonucleotide; PD-L1 exon 3; Set B
auauguuuucaauaaagaucaggccucuca

SEQ ID NO: 20543 - RNA, 27 nt, Artificial Sequence
  Synthetic Oligonucleotide; PD-L1 exon 3; Set C
uauguuuucaauaaagaucaggccucu

SEQ ID NO: 20544 - RNA, 25 nt, Artificial Sequence
  Synthetic Oligonucleotide; PD-L1 exon 3; Set C
auguuuucaauaaagaucaggccuc

SEQ ID NO: 20545 - RNA, 29 nt, Artificial Sequence
  Synthetic Oligonucleotide; PD-L1 exon 3; Set C
auauguuuucaauaaagaucaggccucuc

SEQ ID NO: 20546 - RNA, 31 nt, Artificial Sequence
  Synthetic Oligonucleotide; PD-L1 exon 3; Set B
aauauguuuucaauaaagaucaggccucuca

SEQ ID NO: 20547 - RNA, 28 nt, Artificial Sequence
  Synthetic Oligonucleotide; PD-L1 exon 3; Set C
auauguuuucaauaaagaucaggccucu

SEQ ID NO: 20548 - RNA, 26 nt, Artificial Sequence
  Synthetic Oligonucleotide; PD-L1 exon 3; Set C
uauguuuucaauaaagaucaggccuc

SEQ ID NO: 20549 - RNA, 24 nt, Artificial Sequence
  Synthetic Oligonucleotide; PD-L1 exon 3; Set C
auguuuucaauaaagaucaggccu

SEQ ID NO: 20550 - RNA, 34 nt, Artificial Sequence
  Synthetic Oligonucleotide; PD-L1 exon 3; Set B
ggaauauguuuucaauaaagaucaggccucucau

SEQ ID NO: 20551 - RNA, 30 nt, Artificial Sequence
  Synthetic Oligonucleotide; PD-L1 exon 3; Set C
aauauguuuucaauaaagaucaggccucuc

SEQ ID NO: 20552 - RNA, 32 nt, Artificial Sequence
  Synthetic Oligonucleotide; PD-L1 exon 3; Set B
gaauauguuuucaauaaagaucaggccucuca

SEQ ID NO: 20553 - RNA, 27 nt, Artificial Sequence
  Synthetic Oligonucleotide; PD-L1 exon 3; Set C
auauguuuucaauaaagaucaggccuc

SEQ ID NO: 20554 - RNA, 25 nt, Artificial Sequence
  Synthetic Oligonucleotide; PD-L1 exon 3; Set C
uauguuuucaauaaagaucaggccu

SEQ ID NO: 20555 - RNA, 31 nt, Artificial Sequence
  Synthetic Oligonucleotide; PD-L1 exon 3; Set B
gaauauguuuucaauaaagaucaggccucuc

SEQ ID NO: 20556 - RNA, 33 nt, Artificial Sequence
  Synthetic Oligonucleotide; PD-L1 exon 3; Set B
ggaauauguuuucaauaaagaucaggccucuca

SEQ ID NO: 20557 - RNA, 26 nt, Artificial Sequence
  Synthetic Oligonucleotide; PD-L1 exon 3; Set C
auauguuuucaauaaagaucaggccu

SEQ ID NO: 20558 - RNA, 32 nt, Artificial Sequence
  Synthetic Oligonucleotide; PD-L1 exon 3; Set B
ggaauauguuuucaauaaagaucaggccucuc

SEQ ID NO: 20559 - RNA, 24 nt, Artificial Sequence
  Synthetic Oligonucleotide; PD-L1 exon 3; Set C
uauguuuucaauaaagaucaggcc

SEQ ID NO: 20560 - RNA, 25 nt, Artificial Sequence
  Synthetic Oligonucleotide; PD-L1 exon 3; Set C
auauguuuucaauaaagaucaggcc

SEQ ID NO: 20561 - RNA, 26 nt, Artificial Sequence
  Synthetic Oligonucleotide; PD-L1 exon 3; Set C
aauauguuuucaauaaagaucaggcc

SEQ ID NO: 20562 - RNA, 27 nt, Artificial Sequence
  Synthetic Oligonucleotide; PD-L1 exon 3; Set C
gaauauguuuucaauaaagaucaggcc

SEQ ID NO: 20563 - RNA, 28 nt, Artificial Sequence
  Synthetic Oligonucleotide; PD-L1 exon 3; Set C
ggaauauguuuucaauaaagaucaggcc

SEQ ID NO: 20564 - RNA, 15 nt, Artificial Sequence
  Synthetic Oligonucleotide; PD-L1 exon 3; Set C
auguuuucaauaaag

SEQ ID NO: 20565 - RNA, 16 nt, Artificial Sequence
  Synthetic Oligonucleotide; PD-L1 exon 3; Set C
uauguuuucaauaaag

SEQ ID NO: 20566 - RNA, 17 nt, Artificial Sequence
  Synthetic Oligonucleotide; PD-L1 exon 3; Set C
auauguuuucaauaaag

SEQ ID NO: 20567 - RNA, 15 nt, Artificial Sequence
  Synthetic Oligonucleotide; PD-L1 exons 4 and 5; Set C
gaagucagggcuuuu

SEQ ID NO: 20568 - RNA, 16 nt, Artificial Sequence
  Synthetic Oligonucleotide; PD-L1 exons 4 and 5; Set C
agaagucagggcuuuu

SEQ ID NO: 20569 - RNA, 15 nt, Artificial Sequence
  Synthetic Oligonucleotide; PD-L1 exons 4 and 5; Set C
agaagucagggcuuu

SEQ ID NO: 20570 - RNA, 30 nt, Artificial Sequence
  Synthetic Oligonucleotide; PD-L1 exons 4 and 5; Set C
ggacauaaacaaaaagaagucagggcuuuu

SEQ ID NO: 20571 - RNA, 31 nt, Artificial Sequence
  Synthetic Oligonucleotide; PD-L1 exons 4 and 5; Set C
aggacauaaacaaaaagaagucagggcuuuu

SEQ ID NO: 20572 - RNA, 32 nt, Artificial Sequence
  Synthetic Oligonucleotide; PD-L1 exons 4 and 5; Set C
uaggacauaaacaaaaagaagucagggcuuuu

SEQ ID NO: 20573 - RNA, 33 nt, Artificial Sequence
  Synthetic Oligonucleotide; PD-L1 exons 4 and 5; Set A
cuaggacauaaacaaaaagaagucagggcuuuu

SEQ ID NO: 20574 - RNA, 34 nt, Artificial Sequence
  Synthetic Oligonucleotide; PD-L1 exons 4 and 5; Set A
gcuaggacauaaacaaaaagaagucagggcuuuu

SEQ ID NO: 20575 - RNA, 35 nt, Artificial Sequence
  Synthetic Oligonucleotide; PD-L1 exons 4 and 5; Set A
ggcuaggacauaaacaaaaagaagucagggcuuuu

SEQ ID NO: 20576 - RNA, 36 nt, Artificial Sequence
  Synthetic Oligonucleotide; PD-L1 exons 4 and 5; Set A
gggcuaggacauaaacaaaaagaagucagggcuuuu

SEQ ID NO: 20577 - RNA, 20 nt, Artificial Sequence
  Synthetic Oligonucleotide; PD-L1 exons 4 and 5; Set C
cuaggacauaaacaaaaaga

SEQ ID NO: 20578 - RNA, 23 nt, Artificial Sequence
  Synthetic Oligonucleotide; PD-L1 exons 4 and 5; Set C
gggcuaggacauaaacaaaaaga

SEQ ID NO: 20579 - RNA, 29 nt, Artificial Sequence
  Synthetic Oligonucleotide; PD-L1 exons 4 and 5; Set A
uguauggggcuaggacauaaacaaaaaga

SEQ ID NO: 20580 - RNA, 30 nt, Artificial Sequence
  Synthetic Oligonucleotide; PD-L1 exons 4 and 5; Set A
uuguauggggcuaggacauaaacaaaaaga

SEQ ID NO: 20581 - RNA, 31 nt, Artificial Sequence
  Synthetic Oligonucleotide; PD-L1 exons 4 and 5; Set A
guuguauggggcuaggacauaaacaaaaaga

SEQ ID NO: 20582 - RNA, 32 nt, Artificial Sequence
  Synthetic Oligonucleotide; PD-L1 exons 4 and 5; Set A
uguuguauggggcuaggacauaaacaaaaaga

SEQ ID NO: 20583 - RNA, 33 nt, Artificial Sequence
  Synthetic Oligonucleotide; PD-L1 exons 4 and 5; Set A
uuguuguauggggcuaggacauaaacaaaaaga

SEQ ID NO: 20584 - RNA, 34 nt, Artificial Sequence
  Synthetic Oligonucleotide; PD-L1 exons 4 and 5; Set A
uuuguuguauggggcuaggacauaaacaaaaaga

SEQ ID NO: 20585 - RNA, 35 nt, Artificial Sequence
  Synthetic Oligonucleotide; PD-L1 exons 4 and 5; Set A
uuuuguuguauggggcuaggacauaaacaaaaaga

SEQ ID NO: 20586 - RNA, 36 nt, Artificial Sequence
  Synthetic Oligonucleotide; PD-L1 exons 4 and 5; Set A
auuuuguuguauggggcuaggacauaaacaaaaaga

SEQ ID NO: 20587 - RNA, 15 nt, Artificial Sequence
  Synthetic Oligonucleotide; PD-L1 exons 4 and 5; Set C
uguauggggcuagga

SEQ ID NO: 20588 - RNA, 16 nt, Artificial Sequence
  Synthetic Oligonucleotide; PD-L1 exons 4 and 5; Set C
uuguauggggcuagga

SEQ ID NO: 20589 - RNA, 15 nt, Artificial Sequence
  Synthetic Oligonucleotide; PD-L1 exons 4 and 5; Set C
uuguauggggcuagg

SEQ ID NO: 20590 - RNA, 17 nt, Artificial Sequence
  Synthetic Oligonucleotide; PD-L1 exons 4 and 5; Set C
guuguauggggcuagga

SEQ ID NO: 20591 - RNA, 16 nt, Artificial Sequence
  Synthetic Oligonucleotide; PD-L1 exons 4 and 5; Set C
guuguauggggcuagg

SEQ ID NO: 20592 - RNA, 18 nt, Artificial Sequence
  Synthetic Oligonucleotide; PD-L1 exons 4 and 5; Set C
uguuguauggggcuagga

SEQ ID NO: 20593 - RNA, 17 nt, Artificial Sequence
  Synthetic Oligonucleotide; PD-L1 exons 4 and 5; Set C
uguuguauggggcuagg

SEQ ID NO: 20594 - RNA, 15 nt, Artificial Sequence
  Synthetic Oligonucleotide; PD-L1 exons 4 and 5; Set C
guuguauggggcuag

SEQ ID NO: 20595 - RNA, 19 nt, Artificial Sequence
  Synthetic Oligonucleotide; PD-L1 exons 4 and 5; Set C
uuguuguauggggcuagga

SEQ ID NO: 20596 - RNA, 16 nt, Artificial Sequence
  Synthetic Oligonucleotide; PD-L1 exons 4 and 5; Set C
uguuguauggggcuag

SEQ ID NO: 20597 - RNA, 18 nt, Artificial Sequence
  Synthetic Oligonucleotide; PD-L1 exons 4 and 5; Set C
uuguuguauggggcuagg

SEQ ID NO: 20598 - RNA, 20 nt, Artificial Sequence
  Synthetic Oligonucleotide; PD-L1 exons 4 and 5; Set C
uuuguuguauggggcuagga

SEQ ID NO: 20599 - RNA, 15 nt, Artificial Sequence
  Synthetic Oligonucleotide; PD-L1 exons 4 and 5; Set C
uguuguauggggcua

SEQ ID NO: 20600 - RNA, 19 nt, Artificial Sequence
  Synthetic Oligonucleotide; PD-L1 exons 4 and 5; Set C
uuuguuguauggggcuagg

SEQ ID NO: 20601 - RNA, 17 nt, Artificial Sequence
  Synthetic Oligonucleotide; PD-L1 exons 4 and 5; Set C
uuguuguauggggcuag

SEQ ID NO: 20602 - RNA, 21 nt, Artificial Sequence
  Synthetic Oligonucleotide; PD-L1 exons 4 and 5; Set C
uuuuguuguauggggcuagga

SEQ ID NO: 20603 - RNA, 20 nt, Artificial Sequence
  Synthetic Oligonucleotide; PD-L1 exons 4 and 5; Set C
uuuuguuguauggggcuagg

SEQ ID NO: 20604 - RNA, 18 nt, Artificial Sequence
  Synthetic Oligonucleotide; PD-L1 exons 4 and 5; Set C
uuuguuguauggggcuag

SEQ ID NO: 20605 - RNA, 16 nt, Artificial Sequence
  Synthetic Oligonucleotide; PD-L1 exons 4 and 5; Set C
uuguuguauggggcua

SEQ ID NO: 20606 - RNA, 22 nt, Artificial Sequence
  Synthetic Oligonucleotide; PD-L1 exons 4 and 5; Set C
auuuuguuguauggggcuagga

SEQ ID NO: 20607 - RNA, 21 nt, Artificial Sequence
  Synthetic Oligonucleotide; PD-L1 exons 4 and 5; Set C
auuuuguuguauggggcuagg

SEQ ID NO: 20608 - RNA, 19 nt, Artificial Sequence
  Synthetic Oligonucleotide; PD-L1 exons 4 and 5; Set C
uuuuguuguauggggcuag

SEQ ID NO: 20609 - RNA, 17 nt, Artificial Sequence
  Synthetic Oligonucleotide; PD-L1 exons 4 and 5; Set C
uuuguuguauggggcua

SEQ ID NO: 20610 - RNA, 15 nt, Artificial Sequence
  Synthetic Oligonucleotide; PD-L1 exons 4 and 5; Set C
uuguuguauggggcu

SEQ ID NO: 20611 - RNA, 20 nt, Artificial Sequence
  Synthetic Oligonucleotide; PD-L1 exons 4 and 5; Set C
auuuuguuguauggggcuag

SEQ ID NO: 20612 - RNA, 18 nt, Artificial Sequence
  Synthetic Oligonucleotide; PD-L1 exons 4 and 5; Set C
uuuuguuguauggggcua

SEQ ID NO: 20613 - RNA, 16 nt, Artificial Sequence
  Synthetic Oligonucleotide; PD-L1 exons 4 and 5; Set C
uuuguuguauggggcu

SEQ ID NO: 20614 - RNA, 19 nt, Artificial Sequence
  Synthetic Oligonucleotide; PD-L1 exons 4 and 5; Set C
auuuuguuguauggggcua

SEQ ID NO: 20615 - RNA, 17 nt, Artificial Sequence
  Synthetic Oligonucleotide; PD-L1 exons 4 and 5; Set C
uuuuguuguauggggcu

SEQ ID NO: 20616 - RNA, 15 nt, Artificial Sequence
  Synthetic Oligonucleotide; PD-L1 exons 4 and 5; Set C
uuuguuguauggggc

SEQ ID NO: 20617 - RNA, 18 nt, Artificial Sequence
  Synthetic Oligonucleotide; PD-L1 exons 4 and 5; Set C
auuuuguuguauggggcu

SEQ ID NO: 20618 - RNA, 16 nt, Artificial Sequence
  Synthetic Oligonucleotide; PD-L1 exons 4 and 5; Set C
uuuuguuguauggggc

SEQ ID NO: 20619 - RNA, 17 nt, Artificial Sequence
  Synthetic Oligonucleotide; PD-L1 exons 4 and 5; Set C
auuuuguuguauggggc

SEQ ID NO: 20620 - RNA, 15 nt, Artificial Sequence
  Synthetic Oligonucleotide; PD-L1 exons 4 and 5; Set C
uuuuguuguaugggg

SEQ ID NO: 20621 - RNA, 16 nt, Artificial Sequence
  Synthetic Oligonucleotide; PD-L1 exons 4 and 5; Set C
auuuuguuguaugggg

SEQ ID NO: 20622 - RNA, 15 nt, Artificial Sequence
  Synthetic Oligonucleotide; PD-L1 exons 4 and 5; Set C
auuuuguuguauggg

SEQ ID NO: 20623 - RNA, 25 nt, Artificial Sequence
  Synthetic Oligonucleotide; PD-L1 exons 4 and 5; Set A
aguucauguucagaggugacuggau

SEQ ID NO: 20624 - RNA, 26 nt, Artificial Sequence
  Synthetic Oligonucleotide; PD-L1 exons 4 and 5; Set A
caguucauguucagaggugacuggau

SEQ ID NO: 20625 - RNA, 27 nt, Artificial Sequence
  Synthetic Oligonucleotide; PD-L1 exons 4 and 5; Set A
ucaguucauguucagaggugacuggau

SEQ ID NO: 20626 - RNA, 15 nt, Artificial Sequence
  Synthetic Oligonucleotide; PD-L1 exons 4 and 5; Set C
cucuuggaauuggug

SEQ ID NO: 20627 - RNA, 16 nt, Artificial Sequence
  Synthetic Oligonucleotide; PD-L1 exons 4 and 5; Set C
ucucuuggaauuggug

SEQ ID NO: 20628 - RNA, 15 nt, Artificial Sequence
  Synthetic Oligonucleotide; PD-L1 exons 4 and 5; Set C
ucucuuggaauuggu

SEQ ID NO: 20629 - RNA, 17 nt, Artificial Sequence
  Synthetic Oligonucleotide; PD-L1 exons 4 and 5; Set C
cucucuuggaauuggug

SEQ ID NO: 20630 - RNA, 16 nt, Artificial Sequence
  Synthetic Oligonucleotide; PD-L1 exons 4 and 5; Set C
cucucuuggaauuggu

SEQ ID NO: 20631 - RNA, 18 nt, Artificial Sequence
  Synthetic Oligonucleotide; PD-L1 exons 4 and 5; Set C
ucucucuuggaauuggug

SEQ ID NO: 20632 - RNA, 15 nt, Artificial Sequence
  Synthetic Oligonucleotide; PD-L1 exons 4 and 5; Set C
cucucuuggaauugg

SEQ ID NO: 20633 - RNA, 17 nt, Artificial Sequence
  Synthetic Oligonucleotide; PD-L1 exons 4 and 5; Set C
ucucucuuggaauuggu

SEQ ID NO: 20634 - RNA, 16 nt, Artificial Sequence
  Synthetic Oligonucleotide; PD-L1 exons 4 and 5; Set C
ucucucuuggaauugg

SEQ ID NO: 20635 - RNA, 15 nt, Artificial Sequence
  Synthetic Oligonucleotide; PD-L1 exons 4 and 5; Set C
ucucucuuggaauug

SEQ ID NO: 20636 - RNA, 32 nt, Artificial Sequence
  Synthetic Oligonucleotide; PD-L1 exons 4 and 5; Set A
uuaguuguuguguugauucucagugugcuggu

SEQ ID NO: 20637 - RNA, 31 nt, Artificial Sequence
  Synthetic Oligonucleotide; PD-L1 exons 4 and 5; Set A
uuaguuguuguguugauucucagugugcugg

SEQ ID NO: 20638 - RNA, 33 nt, Artificial Sequence
  Synthetic Oligonucleotide; PD-L1 exons 4 and 5; Set A
auuaguuguuguguugauucucagugugcuggu

SEQ ID NO: 20639 - RNA, 32 nt, Artificial Sequence
  Synthetic Oligonucleotide; PD-L1 exons 4 and 5; Set A
auuaguuguuguguugauucucagugugcugg

SEQ ID NO: 20640 - RNA, 34 nt, Artificial Sequence
  Synthetic Oligonucleotide; PD-L1 exons 4 and 5; Set C
cauuaguuguuguguugauucucagugugcuggu

SEQ ID NO: 20641 - RNA, 30 nt, Artificial Sequence
  Synthetic Oligonucleotide; PD-L1 exons 4 and 5; Set A
uuaguuguuguguugauucucagugugcug

SEQ ID NO: 20642 - RNA, 33 nt, Artificial Sequence
  Synthetic Oligonucleotide; PD-L1 exons 4 and 5; Set A
cauuaguuguuguguugauucucagugugcugg

SEQ ID NO: 20643 - RNA, 35 nt, Artificial Sequence
  Synthetic Oligonucleotide; PD-L1 exons 4 and 5; Set C
ucauuaguuguuguguugauucucagugugcuggu

SEQ ID NO: 20644 - RNA, 31 nt, Artificial Sequence
  Synthetic Oligonucleotide; PD-L1 exons 4 and 5; Set A
auuaguuguuguguugauucucagugugcug

SEQ ID NO: 20645 - RNA, 34 nt, Artificial Sequence
  Synthetic Oligonucleotide; PD-L1 exons 4 and 5; Set C
ucauuaguuguuguguugauucucagugugcugg

SEQ ID NO: 20646 - RNA, 32 nt, Artificial Sequence
  Synthetic Oligonucleotide; PD-L1 exons 4 and 5; Set A
cauuaguuguuguguugauucucagugugcug

SEQ ID NO: 20647 - RNA, 33 nt, Artificial Sequence
  Synthetic Oligonucleotide; PD-L1 exons 4 and 5; Set A
ucauuaguuguuguguugauucucagugugcug

SEQ ID NO: 20648 - RNA, 15 nt, Artificial Sequence
  Synthetic Oligonucleotide; PD-L1 exons 4 and 5; Set C
aguuguuguguugau

SEQ ID NO: 20649 - RNA, 16 nt, Artificial Sequence
  Synthetic Oligonucleotide; PD-L1 exons 4 and 5; Set C
uaguuguuguguugau

SEQ ID NO: 20650 - RNA, 15 nt, Artificial Sequence
  Synthetic Oligonucleotide; PD-L1 exons 4 and 5; Set C
uaguuguuguguuga

SEQ ID NO: 20651 - RNA, 17 nt, Artificial Sequence
  Synthetic Oligonucleotide; PD-L1 exons 4 and 5; Set C
uuaguuguuguguugau

SEQ ID NO: 20652 - RNA, 16 nt, Artificial Sequence
  Synthetic Oligonucleotide; PD-L1 exons 4 and 5; Set C
uuaguuguuguguuga

SEQ ID NO: 20653 - RNA, 18 nt, Artificial Sequence
  Synthetic Oligonucleotide; PD-L1 exons 4 and 5; Set C
auuaguuguuguguugau

SEQ ID NO: 20654 - RNA, 17 nt, Artificial Sequence
  Synthetic Oligonucleotide; PD-L1 exons 4 and 5; Set C
auuaguuguuguguuga

SEQ ID NO: 20655 - RNA, 15 nt, Artificial Sequence
  Synthetic Oligonucleotide; PD-L1 exons 4 and 5; Set C
uuaguuguuguguug

SEQ ID NO: 20656 - RNA, 19 nt, Artificial Sequence
  Synthetic Oligonucleotide; PD-L1 exons 4 and 5; Set C
cauuaguuguuguguugau

SEQ ID NO: 20657 - RNA, 18 nt, Artificial Sequence
  Synthetic Oligonucleotide; PD-L1 exons 4 and 5; Set C
cauuaguuguuguguuga

SEQ ID NO: 20658 - RNA, 16 nt, Artificial Sequence
  Synthetic Oligonucleotide; PD-L1 exons 4 and 5; Set C
auuaguuguuguguug

SEQ ID NO: 20659 - RNA, 20 nt, Artificial Sequence
  Synthetic Oligonucleotide; PD-L1 exons 4 and 5; Set C
ucauuaguuguuguguugau

SEQ ID NO: 20660 - RNA, 19 nt, Artificial Sequence
  Synthetic Oligonucleotide; PD-L1 exons 4 and 5; Set C
ucauuaguuguuguguuga

SEQ ID NO: 20661 - RNA, 15 nt, Artificial Sequence
  Synthetic Oligonucleotide; PD-L1 exons 4 and 5; Set C
auuaguuguuguguu

SEQ ID NO: 20662 - RNA, 17 nt, Artificial Sequence
  Synthetic Oligonucleotide; PD-L1 exons 4 and 5; Set C
cauuaguuguuguguug

SEQ ID NO: 20663 - RNA, 16 nt, Artificial Sequence
  Synthetic Oligonucleotide; PD-L1 exons 4 and 5; Set C
cauuaguuguuguguu

SEQ ID NO: 20664 - RNA, 18 nt, Artificial Sequence
  Synthetic Oligonucleotide; PD-L1 exons 4 and 5; Set C
ucauuaguuguuguguug

SEQ ID NO: 20665 - RNA, 15 nt, Artificial Sequence
  Synthetic Oligonucleotide; PD-L1 exons 4 and 5; Set C
cauuaguuguugugu

SEQ ID NO: 20666 - RNA, 17 nt, Artificial Sequence
  Synthetic Oligonucleotide; PD-L1 exons 4 and 5; Set C
ucauuaguuguuguguu

SEQ ID NO: 20667 - RNA, 16 nt, Artificial Sequence
  Synthetic Oligonucleotide; PD-L1 exons 4 and 5; Set C
ucauuaguuguugugu

SEQ ID NO: 20668 - RNA, 23 nt, Artificial Sequence
  Synthetic Oligonucleotide; PD-L1 exons 4 and 5; Set C
aaucucauuaguuguuguguuga

SEQ ID NO: 20669 - RNA, 15 nt, Artificial Sequence
  Synthetic Oligonucleotide; PD-L1 exons 4 and 5; Set C
ucauuaguuguugug

SEQ ID NO: 20670 - RNA, 22 nt, Artificial Sequence
  Synthetic Oligonucleotide; PD-L1 exons 4 and 5; Set C
aaucucauuaguuguuguguug

SEQ ID NO: 20671 - RNA, 21 nt, Artificial Sequence
  Synthetic Oligonucleotide; PD-L1 exons 4 and 5; Set C
aaucucauuaguuguuguguu

SEQ ID NO: 20672 - RNA, 20 nt, Artificial Sequence
  Synthetic Oligonucleotide; PD-L1 exons 4 and 5; Set C
aaucucauuaguuguugugu

SEQ ID NO: 20673 - RNA, 19 nt, Artificial Sequence
  Synthetic Oligonucleotide; PD-L1 exons 4 and 5; Set C
aaucucauuaguuguugug

SEQ ID NO: 20674 - RNA, 28 nt, Artificial Sequence
  Synthetic Oligonucleotide; PD-L1 exons 4 and 5; Set C
uagaaaaucucauuaguuguuguguuga

SEQ ID NO: 20675 - RNA, 18 nt, Artificial Sequence
  Synthetic Oligonucleotide; PD-L1 exons 4 and 5; Set C
aaucucauuaguuguugu

SEQ ID NO: 20676 - RNA, 30 nt, Artificial Sequence
  Synthetic Oligonucleotide; PD-L1 exons 4 and 5; Set C
guagaaaaucucauuaguuguuguguugau

SEQ ID NO: 20677 - RNA, 29 nt, Artificial Sequence
  Synthetic Oligonucleotide; PD-L1 exons 4 and 5; Set C
guagaaaaucucauuaguuguuguguuga

SEQ ID NO: 20678 - RNA, 17 nt, Artificial Sequence
  Synthetic Oligonucleotide; PD-L1 exons 4 and 5; Set C
aaucucauuaguuguug

SEQ ID NO: 20679 - RNA, 30 nt, Artificial Sequence
  Synthetic Oligonucleotide; PD-L1 exons 4 and 5; Set C
aguagaaaaucucauuaguuguuguguuga

SEQ ID NO: 20680 - RNA, 28 nt, Artificial Sequence
  Synthetic Oligonucleotide; PD-L1 exons 4 and 5; Set C
guagaaaaucucauuaguuguuguguug

SEQ ID NO: 20681 - RNA, 15 nt, Artificial Sequence
  Synthetic Oligonucleotide; PD-L1 exons 4 and 5; Set C
aaucucauuaguugu

SEQ ID NO: 20682 - RNA, 27 nt, Artificial Sequence
  Synthetic Oligonucleotide; PD-L1 exons 4 and 5; Set C
guagaaaaucucauuaguuguuguguu

SEQ ID NO: 20683 - RNA, 29 nt, Artificial Sequence
  Synthetic Oligonucleotide; PD-L1 exons 4 and 5; Set C
aguagaaaaucucauuaguuguuguguug

SEQ ID NO: 20684 - RNA, 26 nt, Artificial Sequence
  Synthetic Oligonucleotide; PD-L1 exons 4 and 5; Set C
guagaaaaucucauuaguuguugugu

SEQ ID NO: 20685 - RNA, 28 nt, Artificial Sequence
  Synthetic Oligonucleotide; PD-L1 exons 4 and 5; Set C
aguagaaaaucucauuaguuguuguguu

SEQ ID NO: 20686 - RNA, 25 nt, Artificial Sequence
  Synthetic Oligonucleotide; PD-L1 exons 4 and 5; Set C
guagaaaaucucauuaguuguugug

SEQ ID NO: 20687 - RNA, 27 nt, Artificial Sequence
  Synthetic Oligonucleotide; PD-L1 exons 4 and 5; Set C
aguagaaaaucucauuaguuguugugu

SEQ ID NO: 20688 - RNA, 24 nt, Artificial Sequence
  Synthetic Oligonucleotide; PD-L1 exons 4 and 5; Set C
guagaaaaucucauuaguuguugu

SEQ ID NO: 20689 - RNA, 26 nt, Artificial Sequence
  Synthetic Oligonucleotide; PD-L1 exons 4 and 5; Set C
aguagaaaaucucauuaguuguugug

SEQ ID NO: 20690 - RNA, 36 nt, Artificial Sequence
  Synthetic Oligonucleotide; PD-L1 exons 4 and 5; Set A
agugcaguagaaaaucucauuaguuguuguguugau

SEQ ID NO: 20691 - RNA, 35 nt, Artificial Sequence
  Synthetic Oligonucleotide; PD-L1 exons 4 and 5; Set A
agugcaguagaaaaucucauuaguuguuguguuga

SEQ ID NO: 20692 - RNA, 23 nt, Artificial Sequence
  Synthetic Oligonucleotide; PD-L1 exons 4 and 5; Set C
guagaaaaucucauuaguuguug

SEQ ID NO: 20693 - RNA, 25 nt, Artificial Sequence
  Synthetic Oligonucleotide; PD-L1 exons 4 and 5; Set C
aguagaaaaucucauuaguuguugu

SEQ ID NO: 20694 - RNA, 22 nt, Artificial Sequence
  Synthetic Oligonucleotide; PD-L1 exons 4 and 5; Set C
guagaaaaucucauuaguuguu

SEQ ID NO: 20695 - RNA, 24 nt, Artificial Sequence
  Synthetic Oligonucleotide; PD-L1 exons 4 and 5; Set C
aguagaaaaucucauuaguuguug

SEQ ID NO: 20696 - RNA, 34 nt, Artificial Sequence
  Synthetic Oligonucleotide; PD-L1 exons 4 and 5; Set A
agugcaguagaaaaucucauuaguuguuguguug

SEQ ID NO: 20697 - RNA, 21 nt, Artificial Sequence
  Synthetic Oligonucleotide; PD-L1 exons 4 and 5; Set C
guagaaaaucucauuaguugu

SEQ ID NO: 20698 - RNA, 33 nt, Artificial Sequence
  Synthetic Oligonucleotide; PD-L1 exons 4 and 5; Set A
agugcaguagaaaaucucauuaguuguuguguu

SEQ ID NO: 20699 - RNA, 23 nt, Artificial Sequence
  Synthetic Oligonucleotide; PD-L1 exons 4 and 5; Set C
aguagaaaaucucauuaguuguu

SEQ ID NO: 20700 - RNA, 20 nt, Artificial Sequence
  Synthetic Oligonucleotide; PD-L1 exons 4 and 5; Set C
guagaaaaucucauuaguug

SEQ ID NO: 20701 - RNA, 22 nt, Artificial Sequence
  Synthetic Oligonucleotide; PD-L1 exons 4 and 5; Set C
aguagaaaaucucauuaguugu

SEQ ID NO: 20702 - RNA, 32 nt, Artificial Sequence
  Synthetic Oligonucleotide; PD-L1 exons 4 and 5; Set A
agugcaguagaaaaucucauuaguuguugugu

SEQ ID NO: 20703 - RNA, 21 nt, Artificial Sequence
  Synthetic Oligonucleotide; PD-L1 exons 4 and 5; Set C
aguagaaaaucucauuaguug

SEQ ID NO: 20704 - RNA, 31 nt, Artificial Sequence
  Synthetic Oligonucleotide; PD-L1 exons 4 and 5; Set A
agugcaguagaaaaucucauuaguuguugug

SEQ ID NO: 20705 - RNA, 19 nt, Artificial Sequence
  Synthetic Oligonucleotide; PD-L1 exons 4 and 5; Set C
guagaaaaucucauuaguu

SEQ ID NO: 20706 - RNA, 30 nt, Artificial Sequence
  Synthetic Oligonucleotide; PD-L1 exons 4 and 5; Set C
agugcaguagaaaaucucauuaguuguugu

SEQ ID NO: 20707 - RNA, 18 nt, Artificial Sequence
  Synthetic Oligonucleotide; PD-L1 exons 4 and 5; Set C
guagaaaaucucauuagu

SEQ ID NO: 20708 - RNA, 20 nt, Artificial Sequence
  Synthetic Oligonucleotide; PD-L1 exons 4 and 5; Set C
aguagaaaaucucauuaguu

SEQ ID NO: 20709 - RNA, 29 nt, Artificial Sequence
  Synthetic Oligonucleotide; PD-L1 exons 4 and 5; Set C
agugcaguagaaaaucucauuaguuguug

SEQ ID NO: 20710 - RNA, 17 nt, Artificial Sequence
  Synthetic Oligonucleotide; PD-L1 exons 4 and 5; Set C
guagaaaaucucauuag

SEQ ID NO: 20711 - RNA, 19 nt, Artificial Sequence
  Synthetic Oligonucleotide; PD-L1 exons 4 and 5; Set C
aguagaaaaucucauuagu

SEQ ID NO: 20712 - RNA, 16 nt, Artificial Sequence
  Synthetic Oligonucleotide; PD-L1 exons 4 and 5; Set C
guagaaaaucucauua

SEQ ID NO: 20713 - RNA, 28 nt, Artificial Sequence
  Synthetic Oligonucleotide; PD-L1 exons 4 and 5; Set C
agugcaguagaaaaucucauuaguuguu

SEQ ID NO: 20714 - RNA, 18 nt, Artificial Sequence
  Synthetic Oligonucleotide; PD-L1 exons 4 and 5; Set C
aguagaaaaucucauuag

SEQ ID NO: 20715 - RNA, 17 nt, Artificial Sequence
  Synthetic Oligonucleotide; PD-L1 exons 4 and 5; Set C
aguagaaaaucucauua

SEQ ID NO: 20716 - RNA, 15 nt, Artificial Sequence
  Synthetic Oligonucleotide; PD-L1 exons 4 and 5; Set C
guagaaaaucucauu

SEQ ID NO: 20717 - RNA, 27 nt, Artificial Sequence
  Synthetic Oligonucleotide; PD-L1 exons 4 and 5; Set C
agugcaguagaaaaucucauuaguugu

SEQ ID NO: 20718 - RNA, 16 nt, Artificial Sequence
  Synthetic Oligonucleotide; PD-L1 exons 4 and 5; Set C
aguagaaaaucucauu

SEQ ID NO: 20719 - RNA, 26 nt, Artificial Sequence
  Synthetic Oligonucleotide; PD-L1 exons 4 and 5; Set C
agugcaguagaaaaucucauuaguug

SEQ ID NO: 20720 - RNA, 15 nt, Artificial Sequence
  Synthetic Oligonucleotide; PD-L1 exons 4 and 5; Set C
aguagaaaaucucau

SEQ ID NO: 20721 - RNA, 25 nt, Artificial Sequence
  Synthetic Oligonucleotide; PD-L1 exons 4 and 5; Set C
agugcaguagaaaaucucauuaguu

SEQ ID NO: 20722 - RNA, 24 nt, Artificial Sequence
  Synthetic Oligonucleotide; PD-L1 exons 4 and 5; Set C
agugcaguagaaaaucucauuagu

SEQ ID NO: 20723 - RNA, 23 nt, Artificial Sequence
  Synthetic Oligonucleotide; PD-L1 exons 4 and 5; Set C
agugcaguagaaaaucucauuag

SEQ ID NO: 20724 - RNA, 22 nt, Artificial Sequence
  Synthetic Oligonucleotide; PD-L1 exons 4 and 5; Set C
agugcaguagaaaaucucauua

SEQ ID NO: 20725 - RNA, 21 nt, Artificial Sequence
  Synthetic Oligonucleotide; PD-L1 exons 4 and 5; Set C
agugcaguagaaaaucucauu

SEQ ID NO: 20726 - RNA, 20 nt, Artificial Sequence
  Synthetic Oligonucleotide; PD-L1 exons 4 and 5; Set C
agugcaguagaaaaucucau

SEQ ID NO: 20727 - RNA, 19 nt, Artificial Sequence
  Synthetic Oligonucleotide; PD-L1 exons 4 and 5; Set C
agugcaguagaaaaucuca

SEQ ID NO: 20728 - RNA, 15 nt, Artificial Sequence
  Synthetic Oligonucleotide; PD-L1 exons 4 and 5; Set C
uuagacauauuuuaa

SEQ ID NO: 20729 - RNA, 23 nt, Artificial Sequence
  Synthetic Oligonucleotide; PD-L1 exons 4 and 5; Set C
ggacaguguuagacauauuuuaa

SEQ ID NO: 20730 - RNA, 24 nt, Artificial Sequence
  Synthetic Oligonucleotide; PD-L1 exons 4 and 5; Set C
gggacaguguuagacauauuuuaa

SEQ ID NO: 20731 - RNA, 22 nt, Artificial Sequence
  Synthetic Oligonucleotide; PD-L1 exons 4 and 5; Set C
ggacaguguuagacauauuuua

SEQ ID NO: 20732 - RNA, 23 nt, Artificial Sequence
  Synthetic Oligonucleotide; PD-L1 exons 4 and 5; Set C
gggacaguguuagacauauuuua

SEQ ID NO: 20733 - RNA, 25 nt, Artificial Sequence
  Synthetic Oligonucleotide; PD-L1 exons 4 and 5; Set C
ggggacaguguuagacauauuuuaa

SEQ ID NO: 20734 - RNA, 21 nt, Artificial Sequence
  Synthetic Oligonucleotide; PD-L1 exons 4 and 5; Set C
ggacaguguuagacauauuuu

SEQ ID NO: 20735 - RNA, 22 nt, Artificial Sequence
  Synthetic Oligonucleotide; PD-L1 exons 4 and 5; Set C
gggacaguguuagacauauuuu

SEQ ID NO: 20736 - RNA, 26 nt, Artificial Sequence
  Synthetic Oligonucleotide; PD-L1 exons 4 and 5; Set C
aggggacaguguuagacauauuuuaa

SEQ ID NO: 20737 - RNA, 24 nt, Artificial Sequence
  Synthetic Oligonucleotide; PD-L1 exons 4 and 5; Set C
ggggacaguguuagacauauuuua

SEQ ID NO: 20738 - RNA, 20 nt, Artificial Sequence
  Synthetic Oligonucleotide; PD-L1 exons 4 and 5; Set C
ggacaguguuagacauauuu

SEQ ID NO: 20739 - RNA, 21 nt, Artificial Sequence
  Synthetic Oligonucleotide; PD-L1 exons 4 and 5; Set C
gggacaguguuagacauauuu

SEQ ID NO: 20740 - RNA, 25 nt, Artificial Sequence
  Synthetic Oligonucleotide; PD-L1 exons 4 and 5; Set B
aggggacaguguuagacauauuuua

SEQ ID NO: 20741 - RNA, 23 nt, Artificial Sequence
  Synthetic Oligonucleotide; PD-L1 exons 4 and 5; Set C
ggggacaguguuagacauauuuu

SEQ ID NO: 20742 - RNA, 19 nt, Artificial Sequence
  Synthetic Oligonucleotide; PD-L1 exons 4 and 5; Set C
ggacaguguuagacauauu

SEQ ID NO: 20743 - RNA, 24 nt, Artificial Sequence
  Synthetic Oligonucleotide; PD-L1 exons 4 and 5; Set C
aggggacaguguuagacauauuuu

SEQ ID NO: 20744 - RNA, 22 nt, Artificial Sequence
  Synthetic Oligonucleotide; PD-L1 exons 4 and 5; Set C
ggggacaguguuagacauauuu

SEQ ID NO: 20745 - RNA, 20 nt, Artificial Sequence
  Synthetic Oligonucleotide; PD-L1 exons 4 and 5; Set C
gggacaguguuagacauauu

SEQ ID NO: 20746 - RNA, 23 nt, Artificial Sequence
  Synthetic Oligonucleotide; PD-L1 exons 4 and 5; Set C
aggggacaguguuagacauauuu

SEQ ID NO: 20747 - RNA, 21 nt, Artificial Sequence
  Synthetic Oligonucleotide; PD-L1 exons 4 and 5; Set C
ggggacaguguuagacauauu

SEQ ID NO: 20748 - RNA, 22 nt, Artificial Sequence
  Synthetic Oligonucleotide; PD-L1 exons 4 and 5; Set C
aggggacaguguuagacauauu

SEQ ID NO: 20749 - RNA, 17 nt, Artificial Sequence
  Synthetic Oligonucleotide; PD-L1 exons 4 and 5; Set C
agucagggcuuuugcug

SEQ ID NO: 20750 - RNA, 18 nt, Artificial Sequence
  Synthetic Oligonucleotide; PD-L1 exons 4 and 5; Set C
aagucagggcuuuugcug

SEQ ID NO: 20751 - RNA, 16 nt, Artificial Sequence
  Synthetic Oligonucleotide; PD-L1 exons 4 and 5; Set C
agucagggcuuuugcu

SEQ ID NO: 20752 - RNA, 19 nt, Artificial Sequence
  Synthetic Oligonucleotide; PD-L1 exons 4 and 5; Set C
gaagucagggcuuuugcug

SEQ ID NO: 20753 - RNA, 17 nt, Artificial Sequence
  Synthetic Oligonucleotide; PD-L1 exons 4 and 5; Set C
aagucagggcuuuugcu

SEQ ID NO: 20754 - RNA, 15 nt, Artificial Sequence
  Synthetic Oligonucleotide; PD-L1 exons 4 and 5; Set C
agucagggcuuuugc

SEQ ID NO: 20755 - RNA, 20 nt, Artificial Sequence
  Synthetic Oligonucleotide; PD-L1 exons 4 and 5; Set C
agaagucagggcuuuugcug

SEQ ID NO: 20756 - RNA, 18 nt, Artificial Sequence
  Synthetic Oligonucleotide; PD-L1 exons 4 and 5; Set C
gaagucagggcuuuugcu

SEQ ID NO: 20757 - RNA, 16 nt, Artificial Sequence
  Synthetic Oligonucleotide; PD-L1 exons 4 and 5; Set C
aagucagggcuuuugc

SEQ ID NO: 20758 - RNA, 15 nt, Artificial Sequence
  Synthetic Oligonucleotide; PD-L1 exons 4 and 5; Set C
aagucagggcuuuug

SEQ ID NO: 20759 - RNA, 19 nt, Artificial Sequence
  Synthetic Oligonucleotide; PD-L1 exons 4 and 5; Set C
agaagucagggcuuuugcu

SEQ ID NO: 20760 - RNA, 17 nt, Artificial Sequence
  Synthetic Oligonucleotide; PD-L1 exons 4 and 5; Set C
gaagucagggcuuuugc

SEQ ID NO: 20761 - RNA, 16 nt, Artificial Sequence
  Synthetic Oligonucleotide; PD-L1 exons 4 and 5; Set C
gaagucagggcuuuug

SEQ ID NO: 20762 - RNA, 18 nt, Artificial Sequence
  Synthetic Oligonucleotide; PD-L1 exons 4 and 5; Set C
agaagucagggcuuuugc

SEQ ID NO: 20763 - RNA, 17 nt, Artificial Sequence
  Synthetic Oligonucleotide; PD-L1 exons 4 and 5; Set C
agaagucagggcuuuug

SEQ ID NO: 20764 - RNA, 17 nt, Artificial Sequence
  Synthetic Oligonucleotide; PD-L1 exons 4 and 5; Set C
aagaagucagggcuuuu

SEQ ID NO: 20765 - RNA, 18 nt, Artificial Sequence
  Synthetic Oligonucleotide; PD-L1 exons 4 and 5; Set C
aaagaagucagggcuuuu

SEQ ID NO: 20766 - RNA, 16 nt, Artificial Sequence
  Synthetic Oligonucleotide; PD-L1 exons 4 and 5; Set C
aagaagucagggcuuu

SEQ ID NO: 20767 - RNA, 15 nt, Artificial Sequence
  Synthetic Oligonucleotide; PD-L1 exons 4 and 5; Set C
aagaagucagggcuu

SEQ ID NO: 20768 - RNA, 34 nt, Artificial Sequence
  Synthetic Oligonucleotide; PD-L1 exons 4 and 5; Set A
ggacauaaacaaaaagaagucagggcuuuugcug

SEQ ID NO: 20769 - RNA, 35 nt, Artificial Sequence
  Synthetic Oligonucleotide; PD-L1 exons 4 and 5; Set A
aggacauaaacaaaaagaagucagggcuuuugcug

SEQ ID NO: 20770 - RNA, 33 nt, Artificial Sequence
  Synthetic Oligonucleotide; PD-L1 exons 4 and 5; Set A
ggacauaaacaaaaagaagucagggcuuuugcu

SEQ ID NO: 20771 - RNA, 36 nt, Artificial Sequence
  Synthetic Oligonucleotide; PD-L1 exons 4 and 5; Set A
uaggacauaaacaaaaagaagucagggcuuuugcug

SEQ ID NO: 20772 - RNA, 34 nt, Artificial Sequence
  Synthetic Oligonucleotide; PD-L1 exons 4 and 5; Set A
aggacauaaacaaaaagaagucagggcuuuugcu

SEQ ID NO: 20773 - RNA, 32 nt, Artificial Sequence
  Synthetic Oligonucleotide; PD-L1 exons 4 and 5; Set A
ggacauaaacaaaaagaagucagggcuuuugc

SEQ ID NO: 20774 - RNA, 31 nt, Artificial Sequence
  Synthetic Oligonucleotide; PD-L1 exons 4 and 5; Set C
ggacauaaacaaaaagaagucagggcuuuug

SEQ ID NO: 20775 - RNA, 37 nt, Artificial Sequence
  Synthetic Oligonucleotide; PD-L1 exons 4 and 5; Set A
cuaggacauaaacaaaaagaagucagggcuuuugcug

SEQ ID NO: 20776 - RNA, 35 nt, Artificial Sequence
  Synthetic Oligonucleotide; PD-L1 exons 4 and 5; Set A
uaggacauaaacaaaaagaagucagggcuuuugcu

SEQ ID NO: 20777 - RNA, 33 nt, Artificial Sequence
  Synthetic Oligonucleotide; PD-L1 exons 4 and 5; Set A
aggacauaaacaaaaagaagucagggcuuuugc

SEQ ID NO: 20778 - RNA, 32 nt, Artificial Sequence
  Synthetic Oligonucleotide; PD-L1 exons 4 and 5; Set C
aggacauaaacaaaaagaagucagggcuuuug

SEQ ID NO: 20779 - RNA, 38 nt, Artificial Sequence
  Synthetic Oligonucleotide; PD-L1 exons 4 and 5; Set A
gcuaggacauaaacaaaaagaagucagggcuuuugcug

SEQ ID NO: 20780 - RNA, 36 nt, Artificial Sequence
  Synthetic Oligonucleotide; PD-L1 exons 4 and 5; Set A
cuaggacauaaacaaaaagaagucagggcuuuugcu

SEQ ID NO: 20781 - RNA, 34 nt, Artificial Sequence
  Synthetic Oligonucleotide; PD-L1 exons 4 and 5; Set A
uaggacauaaacaaaaagaagucagggcuuuugc

SEQ ID NO: 20782 - RNA, 29 nt, Artificial Sequence
  Synthetic Oligonucleotide; PD-L1 exons 4 and 5; Set C
ggacauaaacaaaaagaagucagggcuuu

SEQ ID NO: 20783 - RNA, 33 nt, Artificial Sequence
  Synthetic Oligonucleotide; PD-L1 exons 4 and 5; Set A
uaggacauaaacaaaaagaagucagggcuuuug

SEQ ID NO: 20784 - RNA, 39 nt, Artificial Sequence
  Synthetic Oligonucleotide; PD-L1 exons 4 and 5; Set C
ggcuaggacauaaacaaaaagaagucagggcuuuugcug

SEQ ID NO: 20785 - RNA, 35 nt, Artificial Sequence
  Synthetic Oligonucleotide; PD-L1 exons 4 and 5; Set A
cuaggacauaaacaaaaagaagucagggcuuuugc

SEQ ID NO: 20786 - RNA, 37 nt, Artificial Sequence
  Synthetic Oligonucleotide; PD-L1 exons 4 and 5; Set A
gcuaggacauaaacaaaaagaagucagggcuuuugcu

SEQ ID NO: 20787 - RNA, 30 nt, Artificial Sequence
  Synthetic Oligonucleotide; PD-L1 exons 4 and 5; Set C
aggacauaaacaaaaagaagucagggcuuu

SEQ ID NO: 20788 - RNA, 28 nt, Artificial Sequence
  Synthetic Oligonucleotide; PD-L1 exons 4 and 5; Set C
ggacauaaacaaaaagaagucagggcuu

SEQ ID NO: 20789 - RNA, 34 nt, Artificial Sequence
  Synthetic Oligonucleotide; PD-L1 exons 4 and 5; Set A
cuaggacauaaacaaaaagaagucagggcuuuug

SEQ ID NO: 20790 - RNA, 40 nt, Artificial Sequence
  Synthetic Oligonucleotide; PD-L1 exons 4 and 5; Set C
gggcuaggacauaaacaaaaagaagucagggcuuuugcug

SEQ ID NO: 20791 - RNA, 36 nt, Artificial Sequence
  Synthetic Oligonucleotide; PD-L1 exons 4 and 5; Set A
gcuaggacauaaacaaaaagaagucagggcuuuugc

SEQ ID NO: 20792 - RNA, 38 nt, Artificial Sequence
  Synthetic Oligonucleotide; PD-L1 exons 4 and 5; Set C
ggcuaggacauaaacaaaaagaagucagggcuuuugcu

SEQ ID NO: 20793 - RNA, 31 nt, Artificial Sequence
  Synthetic Oligonucleotide; PD-L1 exons 4 and 5; Set C
uaggacauaaacaaaaagaagucagggcuuu

SEQ ID NO: 20794 - RNA, 29 nt, Artificial Sequence
  Synthetic Oligonucleotide; PD-L1 exons 4 and 5; Set C
aggacauaaacaaaaagaagucagggcuu

SEQ ID NO: 20795 - RNA, 27 nt, Artificial Sequence
  Synthetic Oligonucleotide; PD-L1 exons 4 and 5; Set C
ggacauaaacaaaaagaagucagggcu

SEQ ID NO: 20796 - RNA, 35 nt, Artificial Sequence
  Synthetic Oligonucleotide; PD-L1 exons 4 and 5; Set A
gcuaggacauaaacaaaaagaagucagggcuuuug

SEQ ID NO: 20797 - RNA, 37 nt, Artificial Sequence
  Synthetic Oligonucleotide; PD-L1 exons 4 and 5; Set A
ggcuaggacauaaacaaaaagaagucagggcuuuugc

SEQ ID NO: 20798 - RNA, 39 nt, Artificial Sequence
  Synthetic Oligonucleotide; PD-L1 exons 4 and 5; Set C
gggcuaggacauaaacaaaaagaagucagggcuuuugcu

SEQ ID NO: 20799 - RNA, 32 nt, Artificial Sequence
  Synthetic Oligonucleotide; PD-L1 exons 4 and 5; Set A
cuaggacauaaacaaaaagaagucagggcuuu

SEQ ID NO: 20800 - RNA, 30 nt, Artificial Sequence
  Synthetic Oligonucleotide; PD-L1 exons 4 and 5; Set C
uaggacauaaacaaaaagaagucagggcuu

SEQ ID NO: 20801 - RNA, 28 nt, Artificial Sequence
  Synthetic Oligonucleotide; PD-L1 exons 4 and 5; Set C
aggacauaaacaaaaagaagucagggcu

SEQ ID NO: 20802 - RNA, 26 nt, Artificial Sequence
  Synthetic Oligonucleotide; PD-L1 exons 4 and 5; Set C
ggacauaaacaaaaagaagucagggc

SEQ ID NO: 20803 - RNA, 36 nt, Artificial Sequence
  Synthetic Oligonucleotide; PD-L1 exons 4 and 5; Set A
ggcuaggacauaaacaaaaagaagucagggcuuuug

SEQ ID NO: 20804 - RNA, 38 nt, Artificial Sequence
  Synthetic Oligonucleotide; PD-L1 exons 4 and 5; Set C
gggcuaggacauaaacaaaaagaagucagggcuuuugc

SEQ ID NO: 20805 - RNA, 40 nt, Artificial Sequence
  Synthetic Oligonucleotide; PD-L1 exons 4 and 5; Set C
ggggcuaggacauaaacaaaaagaagucagggcuuuugcu

SEQ ID NO: 20806 - RNA, 33 nt, Artificial Sequence
  Synthetic Oligonucleotide; PD-L1 exons 4 and 5; Set A
gcuaggacauaaacaaaaagaagucagggcuuu

SEQ ID NO: 20807 - RNA, 31 nt, Artificial Sequence
  Synthetic Oligonucleotide; PD-L1 exons 4 and 5; Set A
cuaggacauaaacaaaaagaagucagggcuu

SEQ ID NO: 20808 - RNA, 29 nt, Artificial Sequence
  Synthetic Oligonucleotide; PD-L1 exons 4 and 5; Set C
uaggacauaaacaaaaagaagucagggcu

SEQ ID NO: 20809 - RNA, 25 nt, Artificial Sequence
  Synthetic Oligonucleotide; PD-L1 exons 4 and 5; Set C
ggacauaaacaaaaagaagucaggg

SEQ ID NO: 20810 - RNA, 27 nt, Artificial Sequence
  Synthetic Oligonucleotide; PD-L1 exons 4 and 5; Set C
aggacauaaacaaaaagaagucagggc

SEQ ID NO: 20811 - RNA, 37 nt, Artificial Sequence
  Synthetic Oligonucleotide; PD-L1 exons 4 and 5; Set A
gggcuaggacauaaacaaaaagaagucagggcuuuug

SEQ ID NO: 20812 - RNA, 39 nt, Artificial Sequence
  Synthetic Oligonucleotide; PD-L1 exons 4 and 5; Set C
ggggcuaggacauaaacaaaaagaagucagggcuuuugc

SEQ ID NO: 20813 - RNA, 34 nt, Artificial Sequence
  Synthetic Oligonucleotide; PD-L1 exons 4 and 5; Set A
ggcuaggacauaaacaaaaagaagucagggcuuu

SEQ ID NO: 20814 - RNA, 32 nt, Artificial Sequence
  Synthetic Oligonucleotide; PD-L1 exons 4 and 5; Set A
gcuaggacauaaacaaaaagaagucagggcuu

SEQ ID NO: 20815 - RNA, 30 nt, Artificial Sequence
  Synthetic Oligonucleotide; PD-L1 exons 4 and 5; Set A
cuaggacauaaacaaaaagaagucagggcu

SEQ ID NO: 20816 - RNA, 26 nt, Artificial Sequence
  Synthetic Oligonucleotide; PD-L1 exons 4 and 5; Set C
aggacauaaacaaaaagaagucaggg

SEQ ID NO: 20817 - RNA, 28 nt, Artificial Sequence
  Synthetic Oligonucleotide; PD-L1 exons 4 and 5; Set C
uaggacauaaacaaaaagaagucagggc

SEQ ID NO: 20818 - RNA, 38 nt, Artificial Sequence
  Synthetic Oligonucleotide; PD-L1 exons 4 and 5; Set C
ggggcuaggacauaaacaaaaagaagucagggcuuuug

SEQ ID NO: 20819 - RNA, 40 nt, Artificial Sequence
  Synthetic Oligonucleotide; PD-L1 exons 4 and 5; Set C
uggggcuaggacauaaacaaaaagaagucagggcuuuugc

SEQ ID NO: 20820 - RNA, 37 nt, Artificial Sequence
  Synthetic Oligonucleotide; PD-L1 exons 4 and 5; Set C
ggggcuaggacauaaacaaaaagaagucagggcuuuu

SEQ ID NO: 20821 - RNA, 35 nt, Artificial Sequence
  Synthetic Oligonucleotide; PD-L1 exons 4 and 5; Set A
gggcuaggacauaaacaaaaagaagucagggcuuu

SEQ ID NO: 20822 - RNA, 33 nt, Artificial Sequence
  Synthetic Oligonucleotide; PD-L1 exons 4 and 5; Set A
ggcuaggacauaaacaaaaagaagucagggcuu

SEQ ID NO: 20823 - RNA, 31 nt, Artificial Sequence
  Synthetic Oligonucleotide; PD-L1 exons 4 and 5; Set A
gcuaggacauaaacaaaaagaagucagggcu

SEQ ID NO: 20824 - RNA, 27 nt, Artificial Sequence
  Synthetic Oligonucleotide; PD-L1 exons 4 and 5; Set C
uaggacauaaacaaaaagaagucaggg

SEQ ID NO: 20825 - RNA, 29 nt, Artificial Sequence
  Synthetic Oligonucleotide; PD-L1 exons 4 and 5; Set C
cuaggacauaaacaaaaagaagucagggc

SEQ ID NO: 20826 - RNA, 39 nt, Artificial Sequence
  Synthetic Oligonucleotide; PD-L1 exons 4 and 5; Set C
uggggcuaggacauaaacaaaaagaagucagggcuuuug

SEQ ID NO: 20827 - RNA, 38 nt, Artificial Sequence
  Synthetic Oligonucleotide; PD-L1 exons 4 and 5; Set C
uggggcuaggacauaaacaaaaagaagucagggcuuuu

SEQ ID NO: 20828 - RNA, 36 nt, Artificial Sequence
  Synthetic Oligonucleotide; PD-L1 exons 4 and 5; Set C
ggggcuaggacauaaacaaaaagaagucagggcuuu

SEQ ID NO: 20829 - RNA, 34 nt, Artificial Sequence
  Synthetic Oligonucleotide; PD-L1 exons 4 and 5; Set A
gggcuaggacauaaacaaaaagaagucagggcuu

SEQ ID NO: 20830 - RNA, 32 nt, Artificial Sequence
  Synthetic Oligonucleotide; PD-L1 exons 4 and 5; Set A
ggcuaggacauaaacaaaaagaagucagggcu

SEQ ID NO: 20831 - RNA, 28 nt, Artificial Sequence
  Synthetic Oligonucleotide; PD-L1 exons 4 and 5; Set C
cuaggacauaaacaaaaagaagucaggg

SEQ ID NO: 20832 - RNA, 30 nt, Artificial Sequence
  Synthetic Oligonucleotide; PD-L1 exons 4 and 5; Set A
gcuaggacauaaacaaaaagaagucagggc

SEQ ID NO: 20833 - RNA, 40 nt, Artificial Sequence
  Synthetic Oligonucleotide; PD-L1 exons 4 and 5; Set C
auggggcuaggacauaaacaaaaagaagucagggcuuuug

SEQ ID NO: 20834 - RNA, 39 nt, Artificial Sequence
  Synthetic Oligonucleotide; PD-L1 exons 4 and 5; Set C
auggggcuaggacauaaacaaaaagaagucagggcuuuu

SEQ ID NO: 20835 - RNA, 37 nt, Artificial Sequence
  Synthetic Oligonucleotide; PD-L1 exons 4 and 5; Set C
uggggcuaggacauaaacaaaaagaagucagggcuuu

SEQ ID NO: 20836 - RNA, 35 nt, Artificial Sequence
  Synthetic Oligonucleotide; PD-L1 exons 4 and 5; Set C
ggggcuaggacauaaacaaaaagaagucagggcuu

SEQ ID NO: 20837 - RNA, 33 nt, Artificial Sequence
  Synthetic Oligonucleotide; PD-L1 exons 4 and 5; Set A
gggcuaggacauaaacaaaaagaagucagggcu

SEQ ID NO: 20838 - RNA, 29 nt, Artificial Sequence
  Synthetic Oligonucleotide; PD-L1 exons 4 and 5; Set C
gcuaggacauaaacaaaaagaagucaggg

SEQ ID NO: 20839 - RNA, 31 nt, Artificial Sequence
  Synthetic Oligonucleotide; PD-L1 exons 4 and 5; Set A
ggcuaggacauaaacaaaaagaagucagggc

SEQ ID NO: 20840 - RNA, 40 nt, Artificial Sequence
  Synthetic Oligonucleotide; PD-L1 exons 4 and 5; Set C
uauggggcuaggacauaaacaaaaagaagucagggcuuuu

SEQ ID NO: 20841 - RNA, 38 nt, Artificial Sequence
  Synthetic Oligonucleotide; PD-L1 exons 4 and 5; Set C
auggggcuaggacauaaacaaaaagaagucagggcuuu

SEQ ID NO: 20842 - RNA, 36 nt, Artificial Sequence
  Synthetic Oligonucleotide; PD-L1 exons 4 and 5; Set C
uggggcuaggacauaaacaaaaagaagucagggcuu

SEQ ID NO: 20843 - RNA, 34 nt, Artificial Sequence
  Synthetic Oligonucleotide; PD-L1 exons 4 and 5; Set C
ggggcuaggacauaaacaaaaagaagucagggcu

SEQ ID NO: 20844 - RNA, 30 nt, Artificial Sequence
  Synthetic Oligonucleotide; PD-L1 exons 4 and 5; Set A
ggcuaggacauaaacaaaaagaagucaggg

SEQ ID NO: 20845 - RNA, 32 nt, Artificial Sequence
  Synthetic Oligonucleotide; PD-L1 exons 4 and 5; Set A
gggcuaggacauaaacaaaaagaagucagggc

SEQ ID NO: 20846 - RNA, 20 nt, Artificial Sequence
  Synthetic Oligonucleotide; PD-L1 exons 4 and 5; Set C
ggacauaaacaaaaagaagu

SEQ ID NO: 20847 - RNA, 39 nt, Artificial Sequence
  Synthetic Oligonucleotide; PD-L1 exons 4 and 5; Set C
uauggggcuaggacauaaacaaaaagaagucagggcuuu

SEQ ID NO: 20848 - RNA, 37 nt, Artificial Sequence
  Synthetic Oligonucleotide; PD-L1 exons 4 and 5; Set C
auggggcuaggacauaaacaaaaagaagucagggcuu

SEQ ID NO: 20849 - RNA, 35 nt, Artificial Sequence
  Synthetic Oligonucleotide; PD-L1 exons 4 and 5; Set C
uggggcuaggacauaaacaaaaagaagucagggcu

SEQ ID NO: 20850 - RNA, 31 nt, Artificial Sequence
  Synthetic Oligonucleotide; PD-L1 exons 4 and 5; Set A
gggcuaggacauaaacaaaaagaagucaggg

SEQ ID NO: 20851 - RNA, 33 nt, Artificial Sequence
  Synthetic Oligonucleotide; PD-L1 exons 4 and 5; Set A
ggggcuaggacauaaacaaaaagaagucagggc

SEQ ID NO: 20852 - RNA, 19 nt, Artificial Sequence
  Synthetic Oligonucleotide; PD-L1 exons 4 and 5; Set C
ggacauaaacaaaaagaag

SEQ ID NO: 20853 - RNA, 21 nt, Artificial Sequence
  Synthetic Oligonucleotide; PD-L1 exons 4 and 5; Set C
aggacauaaacaaaaagaagu

SEQ ID NO: 20854 - RNA, 40 nt, Artificial Sequence
  Synthetic Oligonucleotide; PD-L1 exons 4 and 5; Set C
guauggggcuaggacauaaacaaaaagaagucagggcuuu

SEQ ID NO: 20855 - RNA, 38 nt, Artificial Sequence
  Synthetic Oligonucleotide; PD-L1 exons 4 and 5; Set C
uauggggcuaggacauaaacaaaaagaagucagggcuu

SEQ ID NO: 20856 - RNA, 36 nt, Artificial Sequence
  Synthetic Oligonucleotide; PD-L1 exons 4 and 5; Set C
auggggcuaggacauaaacaaaaagaagucagggcu

SEQ ID NO: 20857 - RNA, 18 nt, Artificial Sequence
  Synthetic Oligonucleotide; PD-L1 exons 4 and 5; Set C
ggacauaaacaaaaagaa

SEQ ID NO: 20858 - RNA, 32 nt, Artificial Sequence
  Synthetic Oligonucleotide; PD-L1 exons 4 and 5; Set A
ggggcuaggacauaaacaaaaagaagucaggg

SEQ ID NO: 20859 - RNA, 34 nt, Artificial Sequence
  Synthetic Oligonucleotide; PD-L1 exons 4 and 5; Set A
uggggcuaggacauaaacaaaaagaagucagggc

SEQ ID NO: 20860 - RNA, 20 nt, Artificial Sequence
  Synthetic Oligonucleotide; PD-L1 exons 4 and 5; Set C
aggacauaaacaaaaagaag

SEQ ID NO: 20861 - RNA, 22 nt, Artificial Sequence
  Synthetic Oligonucleotide; PD-L1 exons 4 and 5; Set C
uaggacauaaacaaaaagaagu

SEQ ID NO: 20862 - RNA, 17 nt, Artificial Sequence
  Synthetic Oligonucleotide; PD-L1 exons 4 and 5; Set C
ggacauaaacaaaaaga

SEQ ID NO: 20863 - RNA, 39 nt, Artificial Sequence
  Synthetic Oligonucleotide; PD-L1 exons 4 and 5; Set C
guauggggcuaggacauaaacaaaaagaagucagggcuu

SEQ ID NO: 20864 - RNA, 37 nt, Artificial Sequence
  Synthetic Oligonucleotide; PD-L1 exons 4 and 5; Set C
uauggggcuaggacauaaacaaaaagaagucagggcu

SEQ ID NO: 20865 - RNA, 19 nt, Artificial Sequence
  Synthetic Oligonucleotide; PD-L1 exons 4 and 5; Set C
aggacauaaacaaaaagaa

SEQ ID NO: 20866 - RNA, 33 nt, Artificial Sequence
  Synthetic Oligonucleotide; PD-L1 exons 4 and 5; Set A
uggggcuaggacauaaacaaaaagaagucaggg

SEQ ID NO: 20867 - RNA, 35 nt, Artificial Sequence
  Synthetic Oligonucleotide; PD-L1 exons 4 and 5; Set A
auggggcuaggacauaaacaaaaagaagucagggc

SEQ ID NO: 20868 - RNA, 21 nt, Artificial Sequence
  Synthetic Oligonucleotide; PD-L1 exons 4 and 5; Set C
uaggacauaaacaaaaagaag

SEQ ID NO: 20869 - RNA, 23 nt, Artificial Sequence
  Synthetic Oligonucleotide; PD-L1 exons 4 and 5; Set C
cuaggacauaaacaaaaagaagu

SEQ ID NO: 20870 - RNA, 18 nt, Artificial Sequence
  Synthetic Oligonucleotide; PD-L1 exons 4 and 5; Set C
aggacauaaacaaaaaga

SEQ ID NO: 20871 - RNA, 40 nt, Artificial Sequence
  Synthetic Oligonucleotide; PD-L1 exons 4 and 5; Set C
uguauggggcuaggacauaaacaaaaagaagucagggcuu

SEQ ID NO: 20872 - RNA, 38 nt, Artificial Sequence
  Synthetic Oligonucleotide; PD-L1 exons 4 and 5; Set C
guauggggcuaggacauaaacaaaaagaagucagggcu

SEQ ID NO: 20873 - RNA, 20 nt, Artificial Sequence
  Synthetic Oligonucleotide; PD-L1 exons 4 and 5; Set C
uaggacauaaacaaaaagaa

SEQ ID NO: 20874 - RNA, 34 nt, Artificial Sequence
  Synthetic Oligonucleotide; PD-L1 exons 4 and 5; Set A
auggggcuaggacauaaacaaaaagaagucaggg

SEQ ID NO: 20875 - RNA, 36 nt, Artificial Sequence
  Synthetic Oligonucleotide; PD-L1 exons 4 and 5; Set A
uauggggcuaggacauaaacaaaaagaagucagggc

SEQ ID NO: 20876 - RNA, 22 nt, Artificial Sequence
  Synthetic Oligonucleotide; PD-L1 exons 4 and 5; Set C
cuaggacauaaacaaaaagaag

SEQ ID NO: 20877 - RNA, 24 nt, Artificial Sequence
  Synthetic Oligonucleotide; PD-L1 exons 4 and 5; Set C
gcuaggacauaaacaaaaagaagu

SEQ ID NO: 20878 - RNA, 19 nt, Artificial Sequence
  Synthetic Oligonucleotide; PD-L1 exons 4 and 5; Set C
uaggacauaaacaaaaaga

SEQ ID NO: 20879 - RNA, 39 nt, Artificial Sequence
  Synthetic Oligonucleotide; PD-L1 exons 4 and 5; Set C
uguauggggcuaggacauaaacaaaaagaagucagggcu

SEQ ID NO: 20880 - RNA, 21 nt, Artificial Sequence
  Synthetic Oligonucleotide; PD-L1 exons 4 and 5; Set C
cuaggacauaaacaaaaagaa

SEQ ID NO: 20881 - RNA, 35 nt, Artificial Sequence
  Synthetic Oligonucleotide; PD-L1 exons 4 and 5; Set A
uauggggcuaggacauaaacaaaaagaagucaggg

SEQ ID NO: 20882 - RNA, 37 nt, Artificial Sequence
  Synthetic Oligonucleotide; PD-L1 exons 4 and 5; Set C
guauggggcuaggacauaaacaaaaagaagucagggc

SEQ ID NO: 20883 - RNA, 23 nt, Artificial Sequence
  Synthetic Oligonucleotide; PD-L1 exons 4 and 5; Set C
gcuaggacauaaacaaaaagaag

SEQ ID NO: 20884 - RNA, 25 nt, Artificial Sequence
  Synthetic Oligonucleotide; PD-L1 exons 4 and 5; Set C
ggcuaggacauaaacaaaaagaagu

SEQ ID NO: 20885 - RNA, 40 nt, Artificial Sequence
  Synthetic Oligonucleotide; PD-L1 exons 4 and 5; Set C
uuguauggggcuaggacauaaacaaaaagaagucagggcu

SEQ ID NO: 20886 - RNA, 22 nt, Artificial Sequence
  Synthetic Oligonucleotide; PD-L1 exons 4 and 5; Set C
gcuaggacauaaacaaaaagaa

SEQ ID NO: 20887 - RNA, 36 nt, Artificial Sequence
  Synthetic Oligonucleotide; PD-L1 exons 4 and 5; Set A
guauggggcuaggacauaaacaaaaagaagucaggg

SEQ ID NO: 20888 - RNA, 38 nt, Artificial Sequence
  Synthetic Oligonucleotide; PD-L1 exons 4 and 5; Set C
uguauggggcuaggacauaaacaaaaagaagucagggc

SEQ ID NO: 20889 - RNA, 24 nt, Artificial Sequence
  Synthetic Oligonucleotide; PD-L1 exons 4 and 5; Set C
ggcuaggacauaaacaaaaagaag

SEQ ID NO: 20890 - RNA, 26 nt, Artificial Sequence
  Synthetic Oligonucleotide; PD-L1 exons 4 and 5; Set C
gggcuaggacauaaacaaaaagaagu

SEQ ID NO: 20891 - RNA, 21 nt, Artificial Sequence
  Synthetic Oligonucleotide; PD-L1 exons 4 and 5; Set C
gcuaggacauaaacaaaaaga

SEQ ID NO: 20892 - RNA, 23 nt, Artificial Sequence
  Synthetic Oligonucleotide; PD-L1 exons 4 and 5; Set C
ggcuaggacauaaacaaaaagaa

SEQ ID NO: 20893 - RNA, 37 nt, Artificial Sequence
  Synthetic Oligonucleotide; PD-L1 exons 4 and 5; Set A
uguauggggcuaggacauaaacaaaaagaagucaggg

SEQ ID NO: 20894 - RNA, 39 nt, Artificial Sequence
  Synthetic Oligonucleotide; PD-L1 exons 4 and 5; Set C
uuguauggggcuaggacauaaacaaaaagaagucagggc

SEQ ID NO: 20895 - RNA, 25 nt, Artificial Sequence
  Synthetic Oligonucleotide; PD-L1 exons 4 and 5; Set C
gggcuaggacauaaacaaaaagaag

SEQ ID NO: 20896 - RNA, 27 nt, Artificial Sequence
  Synthetic Oligonucleotide; PD-L1 exons 4 and 5; Set C
ggggcuaggacauaaacaaaaagaagu

SEQ ID NO: 20897 - RNA, 19 nt, Artificial Sequence
  Synthetic Oligonucleotide; PD-L1 exons 4 and 5; Set C
cuaggacauaaacaaaaag

SEQ ID NO: 20898 - RNA, 22 nt, Artificial Sequence
  Synthetic Oligonucleotide; PD-L1 exons 4 and 5; Set C
ggcuaggacauaaacaaaaaga

SEQ ID NO: 20899 - RNA, 24 nt, Artificial Sequence
  Synthetic Oligonucleotide; PD-L1 exons 4 and 5; Set C
gggcuaggacauaaacaaaaagaa

SEQ ID NO: 20900 - RNA, 38 nt, Artificial Sequence
  Synthetic Oligonucleotide; PD-L1 exons 4 and 5; Set A
uuguauggggcuaggacauaaacaaaaagaagucaggg

SEQ ID NO: 20901 - RNA, 40 nt, Artificial Sequence
  Synthetic Oligonucleotide; PD-L1 exons 4 and 5; Set C
guuguauggggcuaggacauaaacaaaaagaagucagggc

SEQ ID NO: 20902 - RNA, 26 nt, Artificial Sequence
  Synthetic Oligonucleotide; PD-L1 exons 4 and 5; Set C
ggggcuaggacauaaacaaaaagaag

SEQ ID NO: 20903 - RNA, 28 nt, Artificial Sequence
  Synthetic Oligonucleotide; PD-L1 exons 4 and 5; Set C
uggggcuaggacauaaacaaaaagaagu

SEQ ID NO: 20904 - RNA, 25 nt, Artificial Sequence
  Synthetic Oligonucleotide; PD-L1 exons 4 and 5; Set C
ggggcuaggacauaaacaaaaagaa

SEQ ID NO: 20905 - RNA, 39 nt, Artificial Sequence
  Synthetic Oligonucleotide; PD-L1 exons 4 and 5; Set A
guuguauggggcuaggacauaaacaaaaagaagucaggg

SEQ ID NO: 20906 - RNA, 27 nt, Artificial Sequence
  Synthetic Oligonucleotide; PD-L1 exons 4 and 5; Set C
uggggcuaggacauaaacaaaaagaag

SEQ ID NO: 20907 - RNA, 29 nt, Artificial Sequence
  Synthetic Oligonucleotide; PD-L1 exons 4 and 5; Set C
auggggcuaggacauaaacaaaaagaagu

SEQ ID NO: 20908 - RNA, 24 nt, Artificial Sequence
  Synthetic Oligonucleotide; PD-L1 exons 4 and 5; Set C
ggggcuaggacauaaacaaaaaga

SEQ ID NO: 20909 - RNA, 26 nt, Artificial Sequence
  Synthetic Oligonucleotide; PD-L1 exons 4 and 5; Set C
uggggcuaggacauaaacaaaaagaa

SEQ ID NO: 20910 - RNA, 40 nt, Artificial Sequence
  Synthetic Oligonucleotide; PD-L1 exons 4 and 5; Set C
uguuguauggggcuaggacauaaacaaaaagaagucaggg

SEQ ID NO: 20911 - RNA, 28 nt, Artificial Sequence
  Synthetic Oligonucleotide; PD-L1 exons 4 and 5; Set C
auggggcuaggacauaaacaaaaagaag

SEQ ID NO: 20912 - RNA, 30 nt, Artificial Sequence
  Synthetic Oligonucleotide; PD-L1 exons 4 and 5; Set C
uauggggcuaggacauaaacaaaaagaagu

SEQ ID NO: 20913 - RNA, 22 nt, Artificial Sequence
  Synthetic Oligonucleotide; PD-L1 exons 4 and 5; Set C
gggcuaggacauaaacaaaaag

SEQ ID NO: 20914 - RNA, 25 nt, Artificial Sequence
  Synthetic Oligonucleotide; PD-L1 exons 4 and 5; Set C
uggggcuaggacauaaacaaaaaga

SEQ ID NO: 20915 - RNA, 27 nt, Artificial Sequence
  Synthetic Oligonucleotide; PD-L1 exons 4 and 5; Set C
auggggcuaggacauaaacaaaaagaa

SEQ ID NO: 20916 - RNA, 29 nt, Artificial Sequence
  Synthetic Oligonucleotide; PD-L1 exons 4 and 5; Set C
uauggggcuaggacauaaacaaaaagaag

SEQ ID NO: 20917 - RNA, 31 nt, Artificial Sequence
  Synthetic Oligonucleotide; PD-L1 exons 4 and 5; Set A
guauggggcuaggacauaaacaaaaagaagu

SEQ ID NO: 20918 - RNA, 26 nt, Artificial Sequence
  Synthetic Oligonucleotide; PD-L1 exons 4 and 5; Set C
auggggcuaggacauaaacaaaaaga

SEQ ID NO: 20919 - RNA, 28 nt, Artificial Sequence
  Synthetic Oligonucleotide; PD-L1 exons 4 and 5; Set C
uauggggcuaggacauaaacaaaaagaa

SEQ ID NO: 20920 - RNA, 30 nt, Artificial Sequence
  Synthetic Oligonucleotide; PD-L1 exons 4 and 5; Set C
guauggggcuaggacauaaacaaaaagaag

SEQ ID NO: 20921 - RNA, 32 nt, Artificial Sequence
  Synthetic Oligonucleotide; PD-L1 exons 4 and 5; Set A
uguauggggcuaggacauaaacaaaaagaagu

SEQ ID NO: 20922 - RNA, 27 nt, Artificial Sequence
  Synthetic Oligonucleotide; PD-L1 exons 4 and 5; Set C
uauggggcuaggacauaaacaaaaaga

SEQ ID NO: 20923 - RNA, 29 nt, Artificial Sequence
  Synthetic Oligonucleotide; PD-L1 exons 4 and 5; Set C
guauggggcuaggacauaaacaaaaagaa

SEQ ID NO: 20924 - RNA, 31 nt, Artificial Sequence
  Synthetic Oligonucleotide; PD-L1 exons 4 and 5; Set A
uguauggggcuaggacauaaacaaaaagaag

SEQ ID NO: 20925 - RNA, 33 nt, Artificial Sequence
  Synthetic Oligonucleotide; PD-L1 exons 4 and 5; Set A
uuguauggggcuaggacauaaacaaaaagaagu

SEQ ID NO: 20926 - RNA, 28 nt, Artificial Sequence
  Synthetic Oligonucleotide; PD-L1 exons 4 and 5; Set A
guauggggcuaggacauaaacaaaaaga

SEQ ID NO: 20927 - RNA, 30 nt, Artificial Sequence
  Synthetic Oligonucleotide; PD-L1 exons 4 and 5; Set A
uguauggggcuaggacauaaacaaaaagaa

SEQ ID NO: 20928 - RNA, 32 nt, Artificial Sequence
  Synthetic Oligonucleotide; PD-L1 exons 4 and 5; Set A
uuguauggggcuaggacauaaacaaaaagaag

SEQ ID NO: 20929 - RNA, 34 nt, Artificial Sequence
  Synthetic Oligonucleotide; PD-L1 exons 4 and 5; Set A
guuguauggggcuaggacauaaacaaaaagaagu

SEQ ID NO: 20930 - RNA, 31 nt, Artificial Sequence
  Synthetic Oligonucleotide; PD-L1 exons 4 and 5; Set A
uuguauggggcuaggacauaaacaaaaagaa

SEQ ID NO: 20931 - RNA, 33 nt, Artificial Sequence
  Synthetic Oligonucleotide; PD-L1 exons 4 and 5; Set A
guuguauggggcuaggacauaaacaaaaagaag

SEQ ID NO: 20932 - RNA, 35 nt, Artificial Sequence
  Synthetic Oligonucleotide; PD-L1 exons 4 and 5; Set A
uguuguauggggcuaggacauaaacaaaaagaagu

SEQ ID NO: 20933 - RNA, 32 nt, Artificial Sequence
  Synthetic Oligonucleotide; PD-L1 exons 4 and 5; Set A
guuguauggggcuaggacauaaacaaaaagaa

SEQ ID NO: 20934 - RNA, 34 nt, Artificial Sequence
  Synthetic Oligonucleotide; PD-L1 exons 4 and 5; Set A
uguuguauggggcuaggacauaaacaaaaagaag

SEQ ID NO: 20935 - RNA, 36 nt, Artificial Sequence
  Synthetic Oligonucleotide; PD-L1 exons 4 and 5; Set A
uuguuguauggggcuaggacauaaacaaaaagaagu

SEQ ID NO: 20936 - RNA, 28 nt, Artificial Sequence
  Synthetic Oligonucleotide; PD-L1 exons 4 and 5; Set C
uguauggggcuaggacauaaacaaaaag

SEQ ID NO: 20937 - RNA, 33 nt, Artificial Sequence
  Synthetic Oligonucleotide; PD-L1 exons 4 and 5; Set A
uguuguauggggcuaggacauaaacaaaaagaa

SEQ ID NO: 20938 - RNA, 35 nt, Artificial Sequence
  Synthetic Oligonucleotide; PD-L1 exons 4 and 5; Set A
uuguuguauggggcuaggacauaaacaaaaagaag

SEQ ID NO: 20939 - RNA, 37 nt, Artificial Sequence
  Synthetic Oligonucleotide; PD-L1 exons 4 and 5; Set A
uuuguuguauggggcuaggacauaaacaaaaagaagu

SEQ ID NO: 20940 - RNA, 29 nt, Artificial Sequence
  Synthetic Oligonucleotide; PD-L1 exons 4 and 5; Set C
uuguauggggcuaggacauaaacaaaaag

SEQ ID NO: 20941 - RNA, 34 nt, Artificial Sequence
  Synthetic Oligonucleotide; PD-L1 exons 4 and 5; Set A
uuguuguauggggcuaggacauaaacaaaaagaa

SEQ ID NO: 20942 - RNA, 36 nt, Artificial Sequence
  Synthetic Oligonucleotide; PD-L1 exons 4 and 5; Set A
uuuguuguauggggcuaggacauaaacaaaaagaag

SEQ ID NO: 20943 - RNA, 38 nt, Artificial Sequence
  Synthetic Oligonucleotide; PD-L1 exons 4 and 5; Set A
uuuuguuguauggggcuaggacauaaacaaaaagaagu

SEQ ID NO: 20944 - RNA, 30 nt, Artificial Sequence
  Synthetic Oligonucleotide; PD-L1 exons 4 and 5; Set A
guuguauggggcuaggacauaaacaaaaag

SEQ ID NO: 20945 - RNA, 35 nt, Artificial Sequence
  Synthetic Oligonucleotide; PD-L1 exons 4 and 5; Set A
uuuguuguauggggcuaggacauaaacaaaaagaa

SEQ ID NO: 20946 - RNA, 37 nt, Artificial Sequence
  Synthetic Oligonucleotide; PD-L1 exons 4 and 5; Set A
uuuuguuguauggggcuaggacauaaacaaaaagaag

SEQ ID NO: 20947 - RNA, 39 nt, Artificial Sequence
  Synthetic Oligonucleotide; PD-L1 exons 4 and 5; Set A
auuuuguuguauggggcuaggacauaaacaaaaagaagu

SEQ ID NO: 20948 - RNA, 31 nt, Artificial Sequence
  Synthetic Oligonucleotide; PD-L1 exons 4 and 5; Set A
uguuguauggggcuaggacauaaacaaaaag

SEQ ID NO: 20949 - RNA, 36 nt, Artificial Sequence
  Synthetic Oligonucleotide; PD-L1 exons 4 and 5; Set A
uuuuguuguauggggcuaggacauaaacaaaaagaa

SEQ ID NO: 20950 - RNA, 38 nt, Artificial Sequence
  Synthetic Oligonucleotide; PD-L1 exons 4 and 5; Set A
auuuuguuguauggggcuaggacauaaacaaaaagaag

SEQ ID NO: 20951 - RNA, 32 nt, Artificial Sequence
  Synthetic Oligonucleotide; PD-L1 exons 4 and 5; Set A
uuguuguauggggcuaggacauaaacaaaaag

SEQ ID NO: 20952 - RNA, 37 nt, Artificial Sequence
  Synthetic Oligonucleotide; PD-L1 exons 4 and 5; Set A
auuuuguuguauggggcuaggacauaaacaaaaagaa

SEQ ID NO: 20953 - RNA, 33 nt, Artificial Sequence
  Synthetic Oligonucleotide; PD-L1 exons 4 and 5; Set A
uuuguuguauggggcuaggacauaaacaaaaag

SEQ ID NO: 20954 - RNA, 34 nt, Artificial Sequence
  Synthetic Oligonucleotide; PD-L1 exons 4 and 5; Set A
uuuuguuguauggggcuaggacauaaacaaaaag

SEQ ID NO: 20955 - RNA, 35 nt, Artificial Sequence
  Synthetic Oligonucleotide; PD-L1 exons 4 and 5; Set A
auuuuguuguauggggcuaggacauaaacaaaaag

SEQ ID NO: 20956 - RNA, 33 nt, Artificial Sequence
  Synthetic Oligonucleotide; PD-L1 exons 4 and 5; Set C
uucuuugguugauuuuguuguauggggcuagga

SEQ ID NO: 20957 - RNA, 32 nt, Artificial Sequence
  Synthetic Oligonucleotide; PD-L1 exons 4 and 5; Set A
uucuuugguugauuuuguuguauggggcuagg

SEQ ID NO: 20958 - RNA, 34 nt, Artificial Sequence
  Synthetic Oligonucleotide; PD-L1 exons 4 and 5; Set C
auucuuugguugauuuuguuguauggggcuagga

SEQ ID NO: 20959 - RNA, 33 nt, Artificial Sequence
  Synthetic Oligonucleotide; PD-L1 exons 4 and 5; Set A
auucuuugguugauuuuguuguauggggcuagg

SEQ ID NO: 20960 - RNA, 31 nt, Artificial Sequence
  Synthetic Oligonucleotide; PD-L1 exons 4 and 5; Set A
uucuuugguugauuuuguuguauggggcuag

SEQ ID NO: 20961 - RNA, 32 nt, Artificial Sequence
  Synthetic Oligonucleotide; PD-L1 exons 4 and 5; Set A
auucuuugguugauuuuguuguauggggcuag

SEQ ID NO: 20962 - RNA, 30 nt, Artificial Sequence
  Synthetic Oligonucleotide; PD-L1 exons 4 and 5; Set A
uucuuugguugauuuuguuguauggggcua

SEQ ID NO: 20963 - RNA, 31 nt, Artificial Sequence
  Synthetic Oligonucleotide; PD-L1 exons 4 and 5; Set A
auucuuugguugauuuuguuguauggggcua

SEQ ID NO: 20964 - RNA, 29 nt, Artificial Sequence
  Synthetic Oligonucleotide; PD-L1 exons 4 and 5; Set A
uucuuugguugauuuuguuguauggggcu

SEQ ID NO: 20965 - RNA, 30 nt, Artificial Sequence
  Synthetic Oligonucleotide; PD-L1 exons 4 and 5; Set A
auucuuugguugauuuuguuguauggggcu

SEQ ID NO: 20966 - RNA, 28 nt, Artificial Sequence
  Synthetic Oligonucleotide; PD-L1 exons 4 and 5; Set A
uucuuugguugauuuuguuguauggggc

SEQ ID NO: 20967 - RNA, 29 nt, Artificial Sequence
  Synthetic Oligonucleotide; PD-L1 exons 4 and 5; Set A
auucuuugguugauuuuguuguauggggc

SEQ ID NO: 20968 - RNA, 27 nt, Artificial Sequence
  Synthetic Oligonucleotide; PD-L1 exons 4 and 5; Set A
uucuuugguugauuuuguuguaugggg

SEQ ID NO: 20969 - RNA, 28 nt, Artificial Sequence
  Synthetic Oligonucleotide; PD-L1 exons 4 and 5; Set A
auucuuugguugauuuuguuguaugggg

SEQ ID NO: 20970 - RNA, 21 nt, Artificial Sequence
  Synthetic Oligonucleotide; PD-L1 exons 4 and 5; Set A
guucagaggugacuggaucca

SEQ ID NO: 20971 - RNA, 20 nt, Artificial Sequence
  Synthetic Oligonucleotide; PD-L1 exons 4 and 5; Set A
guucagaggugacuggaucc

SEQ ID NO: 20972 - RNA, 22 nt, Artificial Sequence
  Synthetic Oligonucleotide; PD-L1 exons 4 and 5; Set A
uguucagaggugacuggaucca

SEQ ID NO: 20973 - RNA, 19 nt, Artificial Sequence
  Synthetic Oligonucleotide; PD-L1 exons 4 and 5; Set C
guucagaggugacuggauc

SEQ ID NO: 20974 - RNA, 21 nt, Artificial Sequence
  Synthetic Oligonucleotide; PD-L1 exons 4 and 5; Set A
uguucagaggugacuggaucc

SEQ ID NO: 20975 - RNA, 23 nt, Artificial Sequence
  Synthetic Oligonucleotide; PD-L1 exons 4 and 5; Set A
auguucagaggugacuggaucca

SEQ ID NO: 20976 - RNA, 18 nt, Artificial Sequence
  Synthetic Oligonucleotide; PD-L1 exons 4 and 5; Set C
guucagaggugacuggau

SEQ ID NO: 20977 - RNA, 20 nt, Artificial Sequence
  Synthetic Oligonucleotide; PD-L1 exons 4 and 5; Set C
uguucagaggugacuggauc

SEQ ID NO: 20978 - RNA, 22 nt, Artificial Sequence
  Synthetic Oligonucleotide; PD-L1 exons 4 and 5; Set A
auguucagaggugacuggaucc

SEQ ID NO: 20979 - RNA, 19 nt, Artificial Sequence
  Synthetic Oligonucleotide; PD-L1 exons 4 and 5; Set C
uguucagaggugacuggau

SEQ ID NO: 20980 - RNA, 17 nt, Artificial Sequence
  Synthetic Oligonucleotide; PD-L1 exons 4 and 5; Set C
guucagaggugacugga

SEQ ID NO: 20981 - RNA, 21 nt, Artificial Sequence
  Synthetic Oligonucleotide; PD-L1 exons 4 and 5; Set C
auguucagaggugacuggauc

SEQ ID NO: 20982 - RNA, 20 nt, Artificial Sequence
  Synthetic Oligonucleotide; PD-L1 exons 4 and 5; Set C
auguucagaggugacuggau

SEQ ID NO: 20983 - RNA, 18 nt, Artificial Sequence
  Synthetic Oligonucleotide; PD-L1 exons 4 and 5; Set C
uguucagaggugacugga

SEQ ID NO: 20984 - RNA, 19 nt, Artificial Sequence
  Synthetic Oligonucleotide; PD-L1 exons 4 and 5; Set C
auguucagaggugacugga

SEQ ID NO: 20985 - RNA, 27 nt, Artificial Sequence
  Synthetic Oligonucleotide; PD-L1 exons 4 and 5; Set A
guucauguucagaggugacuggaucca

SEQ ID NO: 20986 - RNA, 26 nt, Artificial Sequence
  Synthetic Oligonucleotide; PD-L1 exons 4 and 5; Set A
guucauguucagaggugacuggaucc

SEQ ID NO: 20987 - RNA, 28 nt, Artificial Sequence
  Synthetic Oligonucleotide; PD-L1 exons 4 and 5; Set A
aguucauguucagaggugacuggaucca

SEQ ID NO: 20988 - RNA, 25 nt, Artificial Sequence
  Synthetic Oligonucleotide; PD-L1 exons 4 and 5; Set A
guucauguucagaggugacuggauc

SEQ ID NO: 20989 - RNA, 27 nt, Artificial Sequence
  Synthetic Oligonucleotide; PD-L1 exons 4 and 5; Set A
aguucauguucagaggugacuggaucc

SEQ ID NO: 20990 - RNA, 29 nt, Artificial Sequence
  Synthetic Oligonucleotide; PD-L1 exons 4 and 5; Set C
caguucauguucagaggugacuggaucca

SEQ ID NO: 20991 - RNA, 24 nt, Artificial Sequence
  Synthetic Oligonucleotide; PD-L1 exons 4 and 5; Set A
guucauguucagaggugacuggau

SEQ ID NO: 20992 - RNA, 26 nt, Artificial Sequence
  Synthetic Oligonucleotide; PD-L1 exons 4 and 5; Set A
aguucauguucagaggugacuggauc

SEQ ID NO: 20993 - RNA, 28 nt, Artificial Sequence
  Synthetic Oligonucleotide; PD-L1 exons 4 and 5; Set A
caguucauguucagaggugacuggaucc

SEQ ID NO: 20994 - RNA, 30 nt, Artificial Sequence
  Synthetic Oligonucleotide; PD-L1 exons 4 and 5; Set C
ucaguucauguucagaggugacuggaucca

SEQ ID NO: 20995 - RNA, 23 nt, Artificial Sequence
  Synthetic Oligonucleotide; PD-L1 exons 4 and 5; Set A
guucauguucagaggugacugga

SEQ ID NO: 20996 - RNA, 27 nt, Artificial Sequence
  Synthetic Oligonucleotide; PD-L1 exons 4 and 5; Set A
caguucauguucagaggugacuggauc

SEQ ID NO: 20997 - RNA, 29 nt, Artificial Sequence
  Synthetic Oligonucleotide; PD-L1 exons 4 and 5; Set C
ucaguucauguucagaggugacuggaucc

SEQ ID NO: 20998 - RNA, 24 nt, Artificial Sequence
  Synthetic Oligonucleotide; PD-L1 exons 4 and 5; Set A
aguucauguucagaggugacugga

SEQ ID NO: 20999 - RNA, 28 nt, Artificial Sequence
  Synthetic Oligonucleotide; PD-L1 exons 4 and 5; Set A
ucaguucauguucagaggugacuggauc

SEQ ID NO: 21000 - RNA, 25 nt, Artificial Sequence
  Synthetic Oligonucleotide; PD-L1 exons 4 and 5; Set A
caguucauguucagaggugacugga

SEQ ID NO: 21001 - RNA, 26 nt, Artificial Sequence
  Synthetic Oligonucleotide; PD-L1 exons 4 and 5; Set A
ucaguucauguucagaggugacugga

SEQ ID NO: 21002 - RNA, 25 nt, Artificial Sequence
  Synthetic Oligonucleotide; PD-L1 exons 4 and 5; Set A
ucaguucauguucagaggugacugg

SEQ ID NO: 21003 - RNA, 18 nt, Artificial Sequence
  Synthetic Oligonucleotide; PD-L1 exons 4 and 5; Set C
guucauguucagagguga

SEQ ID NO: 21004 - RNA, 17 nt, Artificial Sequence
  Synthetic Oligonucleotide; PD-L1 exons 4 and 5; Set C
guucauguucagaggug

SEQ ID NO: 21005 - RNA, 19 nt, Artificial Sequence
  Synthetic Oligonucleotide; PD-L1 exons 4 and 5; Set C
aguucauguucagagguga

SEQ ID NO: 21006 - RNA, 16 nt, Artificial Sequence
  Synthetic Oligonucleotide; PD-L1 exons 4 and 5; Set C
guucauguucagaggu

SEQ ID NO: 21007 - RNA, 18 nt, Artificial Sequence
  Synthetic Oligonucleotide; PD-L1 exons 4 and 5; Set C
aguucauguucagaggug

SEQ ID NO: 21008 - RNA, 20 nt, Artificial Sequence
  Synthetic Oligonucleotide; PD-L1 exons 4 and 5; Set C
caguucauguucagagguga

SEQ ID NO: 21009 - RNA, 17 nt, Artificial Sequence
  Synthetic Oligonucleotide; PD-L1 exons 4 and 5; Set C
aguucauguucagaggu

SEQ ID NO: 21010 - RNA, 19 nt, Artificial Sequence
  Synthetic Oligonucleotide; PD-L1 exons 4 and 5; Set C
caguucauguucagaggug

SEQ ID NO: 21011 - RNA, 21 nt, Artificial Sequence
  Synthetic Oligonucleotide; PD-L1 exons 4 and 5; Set C
ucaguucauguucagagguga

SEQ ID NO: 21012 - RNA, 18 nt, Artificial Sequence
  Synthetic Oligonucleotide; PD-L1 exons 4 and 5; Set C
caguucauguucagaggu

SEQ ID NO: 21013 - RNA, 20 nt, Artificial Sequence
  Synthetic Oligonucleotide; PD-L1 exons 4 and 5; Set C
ucaguucauguucagaggug

SEQ ID NO: 21014 - RNA, 19 nt, Artificial Sequence
  Synthetic Oligonucleotide; PD-L1 exons 4 and 5; Set C
ucaguucauguucagaggu

SEQ ID NO: 21015 - RNA, 15 nt, Artificial Sequence
  Synthetic Oligonucleotide; PD-L1 exons 4 and 5; Set C
ucggccuugggguag

SEQ ID NO: 21016 - RNA, 16 nt, Artificial Sequence
  Synthetic Oligonucleotide; PD-L1 exons 4 and 5; Set C
uucggccuugggguag

SEQ ID NO: 21017 - RNA, 15 nt, Artificial Sequence
  Synthetic Oligonucleotide; PD-L1 exons 4 and 5; Set C
uucggccuuggggua

SEQ ID NO: 21018 - RNA, 17 nt, Artificial Sequence
  Synthetic Oligonucleotide; PD-L1 exons 4 and 5; Set C
cuucggccuugggguag

SEQ ID NO: 21019 - RNA, 16 nt, Artificial Sequence
  Synthetic Oligonucleotide; PD-L1 exons 4 and 5; Set C
cuucggccuuggggua

SEQ ID NO: 21020 - RNA, 18 nt, Artificial Sequence
  Synthetic Oligonucleotide; PD-L1 exons 4 and 5; Set A
acuucggccuugggguag

SEQ ID NO: 21021 - RNA, 17 nt, Artificial Sequence
  Synthetic Oligonucleotide; PD-L1 exons 4 and 5; Set A
acuucggccuuggggua

SEQ ID NO: 21022 - RNA, 19 nt, Artificial Sequence
  Synthetic Oligonucleotide; PD-L1 exons 4 and 5; Set A
gacuucggccuugggguag

SEQ ID NO: 21023 - RNA, 15 nt, Artificial Sequence
  Synthetic Oligonucleotide; PD-L1 exons 4 and 5; Set C
cuucggccuuggggu

SEQ ID NO: 21024 - RNA, 18 nt, Artificial Sequence
  Synthetic Oligonucleotide; PD-L1 exons 4 and 5; Set A
gacuucggccuuggggua

SEQ ID NO: 21025 - RNA, 20 nt, Artificial Sequence
  Synthetic Oligonucleotide; PD-L1 exons 4 and 5; Set A
ugacuucggccuugggguag

SEQ ID NO: 21026 - RNA, 19 nt, Artificial Sequence
  Synthetic Oligonucleotide; PD-L1 exons 4 and 5; Set A
ugacuucggccuuggggua

SEQ ID NO: 21027 - RNA, 21 nt, Artificial Sequence
  Synthetic Oligonucleotide; PD-L1 exons 4 and 5; Set A
augacuucggccuugggguag

SEQ ID NO: 21028 - RNA, 20 nt, Artificial Sequence
  Synthetic Oligonucleotide; PD-L1 exons 4 and 5; Set A
augacuucggccuuggggua

SEQ ID NO: 21029 - RNA, 22 nt, Artificial Sequence
  Synthetic Oligonucleotide; PD-L1 exons 4 and 5; Set A
gaugacuucggccuugggguag

SEQ ID NO: 21030 - RNA, 21 nt, Artificial Sequence
  Synthetic Oligonucleotide; PD-L1 exons 4 and 5; Set A
gaugacuucggccuuggggua

SEQ ID NO: 21031 - RNA, 19 nt, Artificial Sequence
  Synthetic Oligonucleotide; PD-L1 exons 4 and 5; Set A
augacuucggccuuggggu

SEQ ID NO: 21032 - RNA, 20 nt, Artificial Sequence
  Synthetic Oligonucleotide; PD-L1 exons 4 and 5; Set A
gaugacuucggccuuggggu

SEQ ID NO: 21033 - RNA, 18 nt, Artificial Sequence
  Synthetic Oligonucleotide; PD-L1 exons 4 and 5; Set A
augacuucggccuugggg

SEQ ID NO: 21034 - RNA, 19 nt, Artificial Sequence
  Synthetic Oligonucleotide; PD-L1 exons 4 and 5; Set A
gaugacuucggccuugggg

SEQ ID NO: 21035 - RNA, 28 nt, Artificial Sequence
  Synthetic Oligonucleotide; PD-L1 exons 4 and 5; Set C
uguccagaugacuucggccuugggguag

SEQ ID NO: 21036 - RNA, 27 nt, Artificial Sequence
  Synthetic Oligonucleotide; PD-L1 exons 4 and 5; Set C
uguccagaugacuucggccuuggggua

SEQ ID NO: 21037 - RNA, 29 nt, Artificial Sequence
  Synthetic Oligonucleotide; PD-L1 exons 4 and 5; Set C
uuguccagaugacuucggccuugggguag

SEQ ID NO: 21038 - RNA, 28 nt, Artificial Sequence
  Synthetic Oligonucleotide; PD-L1 exons 4 and 5; Set C
uuguccagaugacuucggccuuggggua

SEQ ID NO: 21039 - RNA, 30 nt, Artificial Sequence
  Synthetic Oligonucleotide; PD-L1 exons 4 and 5; Set C
cuuguccagaugacuucggccuugggguag

SEQ ID NO: 21040 - RNA, 26 nt, Artificial Sequence
  Synthetic Oligonucleotide; PD-L1 exons 4 and 5; Set C
uguccagaugacuucggccuuggggu

SEQ ID NO: 21041 - RNA, 29 nt, Artificial Sequence
  Synthetic Oligonucleotide; PD-L1 exons 4 and 5; Set C
cuuguccagaugacuucggccuuggggua

SEQ ID NO: 21042 - RNA, 27 nt, Artificial Sequence
  Synthetic Oligonucleotide; PD-L1 exons 4 and 5; Set C
uuguccagaugacuucggccuuggggu

SEQ ID NO: 21043 - RNA, 25 nt, Artificial Sequence
  Synthetic Oligonucleotide; PD-L1 exons 4 and 5; Set C
uguccagaugacuucggccuugggg

SEQ ID NO: 21044 - RNA, 28 nt, Artificial Sequence
  Synthetic Oligonucleotide; PD-L1 exons 4 and 5; Set C
cuuguccagaugacuucggccuuggggu

SEQ ID NO: 21045 - RNA, 26 nt, Artificial Sequence
  Synthetic Oligonucleotide; PD-L1 exons 4 and 5; Set C
uuguccagaugacuucggccuugggg

SEQ ID NO: 21046 - RNA, 27 nt, Artificial Sequence
  Synthetic Oligonucleotide; PD-L1 exons 4 and 5; Set C
cuuguccagaugacuucggccuugggg

SEQ ID NO: 21047 - RNA, 39 nt, Artificial Sequence
  Synthetic Oligonucleotide; PD-L1 exons 4 and 5; Set C
uggucacugcuuguccagaugacuucggccuugggguag

SEQ ID NO: 21048 - RNA, 38 nt, Artificial Sequence
  Synthetic Oligonucleotide; PD-L1 exons 4 and 5; Set C
uggucacugcuuguccagaugacuucggccuuggggua

SEQ ID NO: 21049 - RNA, 16 nt, Artificial Sequence
  Synthetic Oligonucleotide; PD-L1 exons 4 and 5; Set C
uguccagaugacuucg

SEQ ID NO: 21050 - RNA, 40 nt, Artificial Sequence
  Synthetic Oligonucleotide; PD-L1 exons 4 and 5; Set C
auggucacugcuuguccagaugacuucggccuugggguag

SEQ ID NO: 21051 - RNA, 15 nt, Artificial Sequence
  Synthetic Oligonucleotide; PD-L1 exons 4 and 5; Set C
uguccagaugacuuc

SEQ ID NO: 21052 - RNA, 39 nt, Artificial Sequence
  Synthetic Oligonucleotide; PD-L1 exons 4 and 5; Set C
auggucacugcuuguccagaugacuucggccuuggggua

SEQ ID NO: 21053 - RNA, 17 nt, Artificial Sequence
  Synthetic Oligonucleotide; PD-L1 exons 4 and 5; Set C
uuguccagaugacuucg

SEQ ID NO: 21054 - RNA, 16 nt, Artificial Sequence
  Synthetic Oligonucleotide; PD-L1 exons 4 and 5; Set C
uuguccagaugacuuc

SEQ ID NO: 21055 - RNA, 40 nt, Artificial Sequence
  Synthetic Oligonucleotide; PD-L1 exons 4 and 5; Set C
gauggucacugcuuguccagaugacuucggccuuggggua

SEQ ID NO: 21056 - RNA, 18 nt, Artificial Sequence
  Synthetic Oligonucleotide; PD-L1 exons 4 and 5; Set C
cuuguccagaugacuucg

SEQ ID NO: 21057 - RNA, 38 nt, Artificial Sequence
  Synthetic Oligonucleotide; PD-L1 exons 4 and 5; Set C
auggucacugcuuguccagaugacuucggccuuggggu

SEQ ID NO: 21058 - RNA, 17 nt, Artificial Sequence
  Synthetic Oligonucleotide; PD-L1 exons 4 and 5; Set C
cuuguccagaugacuuc

SEQ ID NO: 21059 - RNA, 39 nt, Artificial Sequence
  Synthetic Oligonucleotide; PD-L1 exons 4 and 5; Set C
gauggucacugcuuguccagaugacuucggccuuggggu

SEQ ID NO: 21060 - RNA, 15 nt, Artificial Sequence
  Synthetic Oligonucleotide; PD-L1 exons 4 and 5; Set C
uuguccagaugacuu

SEQ ID NO: 21061 - RNA, 40 nt, Artificial Sequence
  Synthetic Oligonucleotide; PD-L1 exons 4 and 5; Set C
ugauggucacugcuuguccagaugacuucggccuuggggu

SEQ ID NO: 21062 - RNA, 38 nt, Artificial Sequence
  Synthetic Oligonucleotide; PD-L1 exons 4 and 5; Set C
gauggucacugcuuguccagaugacuucggccuugggg

SEQ ID NO: 21063 - RNA, 16 nt, Artificial Sequence
  Synthetic Oligonucleotide; PD-L1 exons 4 and 5; Set C
cuuguccagaugacuu

SEQ ID NO: 21064 - RNA, 39 nt, Artificial Sequence
  Synthetic Oligonucleotide; PD-L1 exons 4 and 5; Set C
ugauggucacugcuuguccagaugacuucggccuugggg

SEQ ID NO: 21065 - RNA, 40 nt, Artificial Sequence
  Synthetic Oligonucleotide; PD-L1 exons 4 and 5; Set C
uugauggucacugcuuguccagaugacuucggccuugggg

SEQ ID NO: 21066 - RNA, 28 nt, Artificial Sequence
  Synthetic Oligonucleotide; PD-L1 exons 4 and 5; Set C
auggucacugcuuguccagaugacuucg

SEQ ID NO: 21067 - RNA, 27 nt, Artificial Sequence
  Synthetic Oligonucleotide; PD-L1 exons 4 and 5; Set A
auggucacugcuuguccagaugacuuc

SEQ ID NO: 21068 - RNA, 29 nt, Artificial Sequence
  Synthetic Oligonucleotide; PD-L1 exons 4 and 5; Set C
gauggucacugcuuguccagaugacuucg

SEQ ID NO: 21069 - RNA, 28 nt, Artificial Sequence
  Synthetic Oligonucleotide; PD-L1 exons 4 and 5; Set C
gauggucacugcuuguccagaugacuuc

SEQ ID NO: 21070 - RNA, 30 nt, Artificial Sequence
  Synthetic Oligonucleotide; PD-L1 exons 4 and 5; Set C
ugauggucacugcuuguccagaugacuucg

SEQ ID NO: 21071 - RNA, 29 nt, Artificial Sequence
  Synthetic Oligonucleotide; PD-L1 exons 4 and 5; Set C
ugauggucacugcuuguccagaugacuuc

SEQ ID NO: 21072 - RNA, 31 nt, Artificial Sequence
  Synthetic Oligonucleotide; PD-L1 exons 4 and 5; Set C
uugauggucacugcuuguccagaugacuucg

SEQ ID NO: 21073 - RNA, 30 nt, Artificial Sequence
  Synthetic Oligonucleotide; PD-L1 exons 4 and 5; Set C
uugauggucacugcuuguccagaugacuuc

SEQ ID NO: 21074 - RNA, 32 nt, Artificial Sequence
  Synthetic Oligonucleotide; PD-L1 exons 4 and 5; Set C
cuugauggucacugcuuguccagaugacuucg

SEQ ID NO: 21075 - RNA, 31 nt, Artificial Sequence
  Synthetic Oligonucleotide; PD-L1 exons 4 and 5; Set C
cuugauggucacugcuuguccagaugacuuc

SEQ ID NO: 21076 - RNA, 17 nt, Artificial Sequence
  Synthetic Oligonucleotide; PD-L1 exons 4 and 5; Set C
uugauggucacugcuug

SEQ ID NO: 21077 - RNA, 18 nt, Artificial Sequence
  Synthetic Oligonucleotide; PD-L1 exons 4 and 5; Set C
cuugauggucacugcuug

SEQ ID NO: 21078 - RNA, 17 nt, Artificial Sequence
  Synthetic Oligonucleotide; PD-L1 exons 4 and 5; Set C
uugguggugguggucuu

SEQ ID NO: 21079 - RNA, 18 nt, Artificial Sequence
  Synthetic Oligonucleotide; PD-L1 exons 4 and 5; Set C
auugguggugguggucuu

SEQ ID NO: 21080 - RNA, 17 nt, Artificial Sequence
  Synthetic Oligonucleotide; PD-L1 exons 4 and 5; Set C
auugguggugguggucu

SEQ ID NO: 21081 - RNA, 24 nt, Artificial Sequence
  Synthetic Oligonucleotide; PD-L1 exons 4 and 5; Set A
cuuggaauugguggugguggucuu

SEQ ID NO: 21082 - RNA, 25 nt, Artificial Sequence
  Synthetic Oligonucleotide; PD-L1 exons 4 and 5; Set A
ucuuggaauugguggugguggucuu

SEQ ID NO: 21083 - RNA, 23 nt, Artificial Sequence
  Synthetic Oligonucleotide; PD-L1 exons 4 and 5; Set A
cuuggaauugguggugguggucu

SEQ ID NO: 21084 - RNA, 26 nt, Artificial Sequence
  Synthetic Oligonucleotide; PD-L1 exons 4 and 5; Set A
cucuuggaauugguggugguggucuu

SEQ ID NO: 21085 - RNA, 24 nt, Artificial Sequence
  Synthetic Oligonucleotide; PD-L1 exons 4 and 5; Set A
ucuuggaauugguggugguggucu

SEQ ID NO: 21086 - RNA, 22 nt, Artificial Sequence
  Synthetic Oligonucleotide; PD-L1 exons 4 and 5; Set A
cuuggaauuggugguggugguc

SEQ ID NO: 21087 - RNA, 27 nt, Artificial Sequence
  Synthetic Oligonucleotide; PD-L1 exons 4 and 5; Set A
ucucuuggaauugguggugguggucuu

SEQ ID NO: 21088 - RNA, 25 nt, Artificial Sequence
  Synthetic Oligonucleotide; PD-L1 exons 4 and 5; Set A
cucuuggaauugguggugguggucu

SEQ ID NO: 21089 - RNA, 23 nt, Artificial Sequence
  Synthetic Oligonucleotide; PD-L1 exons 4 and 5; Set A
ucuuggaauuggugguggugguc

SEQ ID NO: 21090 - RNA, 21 nt, Artificial Sequence
  Synthetic Oligonucleotide; PD-L1 exons 4 and 5; Set A
cuuggaauugguggugguggu

SEQ ID NO: 21091 - RNA, 28 nt, Artificial Sequence
  Synthetic Oligonucleotide; PD-L1 exons 4 and 5; Set A
cucucuuggaauugguggugguggucuu

SEQ ID NO: 21092 - RNA, 26 nt, Artificial Sequence
  Synthetic Oligonucleotide; PD-L1 exons 4 and 5; Set A
ucucuuggaauugguggugguggucu

SEQ ID NO: 21093 - RNA, 22 nt, Artificial Sequence
  Synthetic Oligonucleotide; PD-L1 exons 4 and 5; Set A
ucuuggaauugguggugguggu

SEQ ID NO: 21094 - RNA, 24 nt, Artificial Sequence
  Synthetic Oligonucleotide; PD-L1 exons 4 and 5; Set A
cucuuggaauuggugguggugguc

SEQ ID NO: 21095 - RNA, 29 nt, Artificial Sequence
  Synthetic Oligonucleotide; PD-L1 exons 4 and 5; Set C
ucucucuuggaauugguggugguggucuu

SEQ ID NO: 21096 - RNA, 27 nt, Artificial Sequence
  Synthetic Oligonucleotide; PD-L1 exons 4 and 5; Set A
cucucuuggaauugguggugguggucu

SEQ ID NO: 21097 - RNA, 23 nt, Artificial Sequence
  Synthetic Oligonucleotide; PD-L1 exons 4 and 5; Set A
cucuuggaauugguggugguggu

SEQ ID NO: 21098 - RNA, 25 nt, Artificial Sequence
  Synthetic Oligonucleotide; PD-L1 exons 4 and 5; Set A
ucucuuggaauuggugguggugguc

SEQ ID NO: 21099 - RNA, 28 nt, Artificial Sequence
  Synthetic Oligonucleotide; PD-L1 exons 4 and 5; Set C
ucucucuuggaauugguggugguggucu

SEQ ID NO: 21100 - RNA, 24 nt, Artificial Sequence
  Synthetic Oligonucleotide; PD-L1 exons 4 and 5; Set A
ucucuuggaauugguggugguggu

SEQ ID NO: 21101 - RNA, 26 nt, Artificial Sequence
  Synthetic Oligonucleotide; PD-L1 exons 4 and 5; Set A
cucucuuggaauuggugguggugguc

SEQ ID NO: 21102 - RNA, 25 nt, Artificial Sequence
  Synthetic Oligonucleotide; PD-L1 exons 4 and 5; Set A
cucucuuggaauugguggugguggu

SEQ ID NO: 21103 - RNA, 27 nt, Artificial Sequence
  Synthetic Oligonucleotide; PD-L1 exons 4 and 5; Set A
ucucucuuggaauuggugguggugguc

SEQ ID NO: 21104 - RNA, 26 nt, Artificial Sequence
  Synthetic Oligonucleotide; PD-L1 exons 4 and 5; Set A
ucucucuuggaauugguggugguggu

SEQ ID NO: 21105 - RNA, 36 nt, Artificial Sequence
  Synthetic Oligonucleotide; PD-L1 exons 4 and 5; Set C
cuucuccucucucuuggaauugguggugguggucuu

SEQ ID NO: 21106 - RNA, 37 nt, Artificial Sequence
  Synthetic Oligonucleotide; PD-L1 exons 4 and 5; Set C
gcuucuccucucucuuggaauugguggugguggucuu

SEQ ID NO: 21107 - RNA, 35 nt, Artificial Sequence
  Synthetic Oligonucleotide; PD-L1 exons 4 and 5; Set C
cuucuccucucucuuggaauugguggugguggucu

SEQ ID NO: 21108 - RNA, 38 nt, Artificial Sequence
  Synthetic Oligonucleotide; PD-L1 exons 4 and 5; Set C
agcuucuccucucucuuggaauugguggugguggucuu

SEQ ID NO: 21109 - RNA, 36 nt, Artificial Sequence
  Synthetic Oligonucleotide; PD-L1 exons 4 and 5; Set C
gcuucuccucucucuuggaauugguggugguggucu

SEQ ID NO: 21110 - RNA, 34 nt, Artificial Sequence
  Synthetic Oligonucleotide; PD-L1 exons 4 and 5; Set C
cuucuccucucucuuggaauuggugguggugguc

SEQ ID NO: 21111 - RNA, 35 nt, Artificial Sequence
  Synthetic Oligonucleotide; PD-L1 exons 4 and 5; Set C
gcuucuccucucucuuggaauuggugguggugguc

SEQ ID NO: 21112 - RNA, 33 nt, Artificial Sequence
  Synthetic Oligonucleotide; PD-L1 exons 4 and 5; Set C
cuucuccucucucuuggaauugguggugguggu

SEQ ID NO: 21113 - RNA, 34 nt, Artificial Sequence
  Synthetic Oligonucleotide; PD-L1 exons 4 and 5; Set C
gcuucuccucucucuuggaauugguggugguggu

SEQ ID NO: 21114 - RNA, 23 nt, Artificial Sequence
  Synthetic Oligonucleotide; PD-L1 exons 4 and 5; Set A
ucuccucucucuuggaauuggug

SEQ ID NO: 21115 - RNA, 22 nt, Artificial Sequence
  Synthetic Oligonucleotide; PD-L1 exons 4 and 5; Set C
ucuccucucucuuggaauuggu

SEQ ID NO: 21116 - RNA, 24 nt, Artificial Sequence
  Synthetic Oligonucleotide; PD-L1 exons 4 and 5; Set A
uucuccucucucuuggaauuggug

SEQ ID NO: 21117 - RNA, 21 nt, Artificial Sequence
  Synthetic Oligonucleotide; PD-L1 exons 4 and 5; Set C
ucuccucucucuuggaauugg

SEQ ID NO: 21118 - RNA, 23 nt, Artificial Sequence
  Synthetic Oligonucleotide; PD-L1 exons 4 and 5; Set A
uucuccucucucuuggaauuggu

SEQ ID NO: 21119 - RNA, 25 nt, Artificial Sequence
  Synthetic Oligonucleotide; PD-L1 exons 4 and 5; Set A
cuucuccucucucuuggaauuggug

SEQ ID NO: 21120 - RNA, 20 nt, Artificial Sequence
  Synthetic Oligonucleotide; PD-L1 exons 4 and 5; Set C
ucuccucucucuuggaauug

SEQ ID NO: 21121 - RNA, 22 nt, Artificial Sequence
  Synthetic Oligonucleotide; PD-L1 exons 4 and 5; Set C
uucuccucucucuuggaauugg

SEQ ID NO: 21122 - RNA, 24 nt, Artificial Sequence
  Synthetic Oligonucleotide; PD-L1 exons 4 and 5; Set A
cuucuccucucucuuggaauuggu

SEQ ID NO: 21123 - RNA, 26 nt, Artificial Sequence
  Synthetic Oligonucleotide; PD-L1 exons 4 and 5; Set A
gcuucuccucucucuuggaauuggug

SEQ ID NO: 21124 - RNA, 21 nt, Artificial Sequence
  Synthetic Oligonucleotide; PD-L1 exons 4 and 5; Set C
uucuccucucucuuggaauug

SEQ ID NO: 21125 - RNA, 23 nt, Artificial Sequence
  Synthetic Oligonucleotide; PD-L1 exons 4 and 5; Set C
cuucuccucucucuuggaauugg

SEQ ID NO: 21126 - RNA, 19 nt, Artificial Sequence
  Synthetic Oligonucleotide; PD-L1 exons 4 and 5; Set C
ucuccucucucuuggaauu

SEQ ID NO: 21127 - RNA, 25 nt, Artificial Sequence
  Synthetic Oligonucleotide; PD-L1 exons 4 and 5; Set A
gcuucuccucucucuuggaauuggu

SEQ ID NO: 21128 - RNA, 27 nt, Artificial Sequence
  Synthetic Oligonucleotide; PD-L1 exons 4 and 5; Set A
agcuucuccucucucuuggaauuggug

SEQ ID NO: 21129 - RNA, 22 nt, Artificial Sequence
  Synthetic Oligonucleotide; PD-L1 exons 4 and 5; Set C
cuucuccucucucuuggaauug

SEQ ID NO: 21130 - RNA, 24 nt, Artificial Sequence
  Synthetic Oligonucleotide; PD-L1 exons 4 and 5; Set A
gcuucuccucucucuuggaauugg

SEQ ID NO: 21131 - RNA, 20 nt, Artificial Sequence
  Synthetic Oligonucleotide; PD-L1 exons 4 and 5; Set C
uucuccucucucuuggaauu

SEQ ID NO: 21132 - RNA, 26 nt, Artificial Sequence
  Synthetic Oligonucleotide; PD-L1 exons 4 and 5; Set A
agcuucuccucucucuuggaauuggu

SEQ ID NO: 21133 - RNA, 23 nt, Artificial Sequence
  Synthetic Oligonucleotide; PD-L1 exons 4 and 5; Set A
gcuucuccucucucuuggaauug

SEQ ID NO: 21134 - RNA, 25 nt, Artificial Sequence
  Synthetic Oligonucleotide; PD-L1 exons 4 and 5; Set A
agcuucuccucucucuuggaauugg

SEQ ID NO: 21135 - RNA, 21 nt, Artificial Sequence
  Synthetic Oligonucleotide; PD-L1 exons 4 and 5; Set C
cuucuccucucucuuggaauu

SEQ ID NO: 21136 - RNA, 24 nt, Artificial Sequence
  Synthetic Oligonucleotide; PD-L1 exons 4 and 5; Set A
agcuucuccucucucuuggaauug

SEQ ID NO: 21137 - RNA, 22 nt, Artificial Sequence
  Synthetic Oligonucleotide; PD-L1 exons 4 and 5; Set A
gcuucuccucucucuuggaauu

SEQ ID NO: 21138 - RNA, 23 nt, Artificial Sequence
  Synthetic Oligonucleotide; PD-L1 exons 4 and 5; Set A
agcuucuccucucucuuggaauu

SEQ ID NO: 21139 - RNA, 15 nt, Artificial Sequence
  Synthetic Oligonucleotide; PD-L1 exons 4 and 5; Set C
cuucuccucucucuu

SEQ ID NO: 21140 - RNA, 17 nt, Artificial Sequence
  Synthetic Oligonucleotide; PD-L1 exons 4 and 5; Set C
gcuucuccucucucuug

SEQ ID NO: 21141 - RNA, 16 nt, Artificial Sequence
  Synthetic Oligonucleotide; PD-L1 exons 4 and 5; Set C
gcuucuccucucucuu

SEQ ID NO: 21142 - RNA, 15 nt, Artificial Sequence
  Synthetic Oligonucleotide; PD-L1 exons 4 and 5; Set C
gcuucuccucucucu

SEQ ID NO: 21143 - RNA, 17 nt, Artificial Sequence
  Synthetic Oligonucleotide; PD-L1 exons 4 and 5; Set C
agcuucuccucucucuu

SEQ ID NO: 21144 - RNA, 16 nt, Artificial Sequence
  Synthetic Oligonucleotide; PD-L1 exons 4 and 5; Set C
agcuucuccucucucu

SEQ ID NO: 21145 - RNA, 15 nt, Artificial Sequence
  Synthetic Oligonucleotide; PD-L1 exons 4 and 5; Set C
agcuucuccucucuc

SEQ ID NO: 21146 - RNA, 40 nt, Artificial Sequence
  Synthetic Oligonucleotide; PD-L1 exons 4 and 5; Set C
cuggucacauugaaaagcuucuccucucucuuggaauugg

SEQ ID NO: 21147 - RNA, 18 nt, Artificial Sequence
  Synthetic Oligonucleotide; PD-L1 exons 4 and 5; Set C
gauucucagugugcuggu

SEQ ID NO: 21148 - RNA, 19 nt, Artificial Sequence
  Synthetic Oligonucleotide; PD-L1 exons 4 and 5; Set C
ugauucucagugugcuggu

SEQ ID NO: 21149 - RNA, 18 nt, Artificial Sequence
  Synthetic Oligonucleotide; PD-L1 exons 4 and 5; Set C
ugauucucagugugcugg

SEQ ID NO: 21150 - RNA, 20 nt, Artificial Sequence
  Synthetic Oligonucleotide; PD-L1 exons 4 and 5; Set C
uugauucucagugugcuggu

SEQ ID NO: 21151 - RNA, 21 nt, Artificial Sequence
  Synthetic Oligonucleotide; PD-L1 exons 4 and 5; Set A
guugauucucagugugcuggu

SEQ ID NO: 21152 - RNA, 19 nt, Artificial Sequence
  Synthetic Oligonucleotide; PD-L1 exons 4 and 5; Set C
uugauucucagugugcugg

SEQ ID NO: 21153 - RNA, 17 nt, Artificial Sequence
  Synthetic Oligonucleotide; PD-L1 exons 4 and 5; Set C
ugauucucagugugcug

SEQ ID NO: 21154 - RNA, 22 nt, Artificial Sequence
  Synthetic Oligonucleotide; PD-L1 exons 4 and 5; Set A
uguugauucucagugugcuggu

SEQ ID NO: 21155 - RNA, 20 nt, Artificial Sequence
  Synthetic Oligonucleotide; PD-L1 exons 4 and 5; Set C
guugauucucagugugcugg

SEQ ID NO: 21156 - RNA, 18 nt, Artificial Sequence
  Synthetic Oligonucleotide; PD-L1 exons 4 and 5; Set C
uugauucucagugugcug

SEQ ID NO: 21157 - RNA, 23 nt, Artificial Sequence
  Synthetic Oligonucleotide; PD-L1 exons 4 and 5; Set A
guguugauucucagugugcuggu

SEQ ID NO: 21158 - RNA, 21 nt, Artificial Sequence
  Synthetic Oligonucleotide; PD-L1 exons 4 and 5; Set C
uguugauucucagugugcugg

SEQ ID NO: 21159 - RNA, 19 nt, Artificial Sequence
  Synthetic Oligonucleotide; PD-L1 exons 4 and 5; Set C
guugauucucagugugcug

SEQ ID NO: 21160 - RNA, 24 nt, Artificial Sequence
  Synthetic Oligonucleotide; PD-L1 exons 4 and 5; Set A
uguguugauucucagugugcuggu

SEQ ID NO: 21161 - RNA, 22 nt, Artificial Sequence
  Synthetic Oligonucleotide; PD-L1 exons 4 and 5; Set A
guguugauucucagugugcugg

SEQ ID NO: 21162 - RNA, 20 nt, Artificial Sequence
  Synthetic Oligonucleotide; PD-L1 exons 4 and 5; Set C
uguugauucucagugugcug

SEQ ID NO: 21163 - RNA, 25 nt, Artificial Sequence
  Synthetic Oligonucleotide; PD-L1 exons 4 and 5; Set A
uuguguugauucucagugugcuggu

SEQ ID NO: 21164 - RNA, 23 nt, Artificial Sequence
  Synthetic Oligonucleotide; PD-L1 exons 4 and 5; Set A
uguguugauucucagugugcugg

SEQ ID NO: 21165 - RNA, 21 nt, Artificial Sequence
  Synthetic Oligonucleotide; PD-L1 exons 4 and 5; Set C
guguugauucucagugugcug

SEQ ID NO: 21166 - RNA, 26 nt, Artificial Sequence
  Synthetic Oligonucleotide; PD-L1 exons 4 and 5; Set A
guuguguugauucucagugugcuggu

SEQ ID NO: 21167 - RNA, 24 nt, Artificial Sequence
  Synthetic Oligonucleotide; PD-L1 exons 4 and 5; Set A
uuguguugauucucagugugcugg

SEQ ID NO: 21168 - RNA, 22 nt, Artificial Sequence
  Synthetic Oligonucleotide; PD-L1 exons 4 and 5; Set C
uguguugauucucagugugcug

SEQ ID NO: 21169 - RNA, 27 nt, Artificial Sequence
  Synthetic Oligonucleotide; PD-L1 exons 4 and 5; Set A
uguuguguugauucucagugugcuggu

SEQ ID NO: 21170 - RNA, 25 nt, Artificial Sequence
  Synthetic Oligonucleotide; PD-L1 exons 4 and 5; Set A
guuguguugauucucagugugcugg

SEQ ID NO: 21171 - RNA, 23 nt, Artificial Sequence
  Synthetic Oligonucleotide; PD-L1 exons 4 and 5; Set C
uuguguugauucucagugugcug

SEQ ID NO: 21172 - RNA, 28 nt, Artificial Sequence
  Synthetic Oligonucleotide; PD-L1 exons 4 and 5; Set A
uuguuguguugauucucagugugcuggu

SEQ ID NO: 21173 - RNA, 26 nt, Artificial Sequence
  Synthetic Oligonucleotide; PD-L1 exons 4 and 5; Set A
uguuguguugauucucagugugcugg

SEQ ID NO: 21174 - RNA, 24 nt, Artificial Sequence
  Synthetic Oligonucleotide; PD-L1 exons 4 and 5; Set A
guuguguugauucucagugugcug

SEQ ID NO: 21175 - RNA, 27 nt, Artificial Sequence
  Synthetic Oligonucleotide; PD-L1 exons 4 and 5; Set A
uuguuguguugauucucagugugcugg

SEQ ID NO: 21176 - RNA, 29 nt, Artificial Sequence
  Synthetic Oligonucleotide; PD-L1 exons 4 and 5; Set A
guuguuguguugauucucagugugcuggu

SEQ ID NO: 21177 - RNA, 25 nt, Artificial Sequence
  Synthetic Oligonucleotide; PD-L1 exons 4 and 5; Set A
uguuguguugauucucagugugcug

SEQ ID NO: 21178 - RNA, 30 nt, Artificial Sequence
  Synthetic Oligonucleotide; PD-L1 exons 4 and 5; Set A
aguuguuguguugauucucagugugcuggu

SEQ ID NO: 21179 - RNA, 28 nt, Artificial Sequence
  Synthetic Oligonucleotide; PD-L1 exons 4 and 5; Set A
guuguuguguugauucucagugugcugg

SEQ ID NO: 21180 - RNA, 26 nt, Artificial Sequence
  Synthetic Oligonucleotide; PD-L1 exons 4 and 5; Set A
uuguuguguugauucucagugugcug

SEQ ID NO: 21181 - RNA, 16 nt, Artificial Sequence
  Synthetic Oligonucleotide; PD-L1 exons 4 and 5; Set C
guguugauucucagug

SEQ ID NO: 21182 - RNA, 31 nt, Artificial Sequence
  Synthetic Oligonucleotide; PD-L1 exons 4 and 5; Set A
uaguuguuguguugauucucagugugcuggu

SEQ ID NO: 21183 - RNA, 29 nt, Artificial Sequence
  Synthetic Oligonucleotide; PD-L1 exons 4 and 5; Set A
aguuguuguguugauucucagugugcugg

SEQ ID NO: 21184 - RNA, 27 nt, Artificial Sequence
  Synthetic Oligonucleotide; PD-L1 exons 4 and 5; Set A
guuguuguguugauucucagugugcug

SEQ ID NO: 21185 - RNA, 17 nt, Artificial Sequence
  Synthetic Oligonucleotide; PD-L1 exons 4 and 5; Set C
uguguugauucucagug

SEQ ID NO: 21186 - RNA, 30 nt, Artificial Sequence
  Synthetic Oligonucleotide; PD-L1 exons 4 and 5; Set A
uaguuguuguguugauucucagugugcugg

SEQ ID NO: 21187 - RNA, 28 nt, Artificial Sequence
  Synthetic Oligonucleotide; PD-L1 exons 4 and 5; Set A
aguuguuguguugauucucagugugcug

SEQ ID NO: 21188 - RNA, 18 nt, Artificial Sequence
  Synthetic Oligonucleotide; PD-L1 exons 4 and 5; Set C
uuguguugauucucagug

SEQ ID NO: 21189 - RNA, 29 nt, Artificial Sequence
  Synthetic Oligonucleotide; PD-L1 exons 4 and 5; Set A
uaguuguuguguugauucucagugugcug

SEQ ID NO: 21190 - RNA, 19 nt, Artificial Sequence
  Synthetic Oligonucleotide; PD-L1 exons 4 and 5; Set C
guuguguugauucucagug

SEQ ID NO: 21191 - RNA, 20 nt, Artificial Sequence
  Synthetic Oligonucleotide; PD-L1 exons 4 and 5; Set C
uguuguguugauucucagug

SEQ ID NO: 21192 - RNA, 21 nt, Artificial Sequence
  Synthetic Oligonucleotide; PD-L1 exons 4 and 5; Set C
uuguuguguugauucucagug

SEQ ID NO: 21193 - RNA, 19 nt, Artificial Sequence
  Synthetic Oligonucleotide; PD-L1 exons 4 and 5; Set C
uguuguguugauucucagu

SEQ ID NO: 21194 - RNA, 22 nt, Artificial Sequence
  Synthetic Oligonucleotide; PD-L1 exons 4 and 5; Set C
guuguuguguugauucucagug

SEQ ID NO: 21195 - RNA, 20 nt, Artificial Sequence
  Synthetic Oligonucleotide; PD-L1 exons 4 and 5; Set C
uuguuguguugauucucagu

SEQ ID NO: 21196 - RNA, 23 nt, Artificial Sequence
  Synthetic Oligonucleotide; PD-L1 exons 4 and 5; Set C
aguuguuguguugauucucagug

SEQ ID NO: 21197 - RNA, 21 nt, Artificial Sequence
  Synthetic Oligonucleotide; PD-L1 exons 4 and 5; Set C
guuguuguguugauucucagu

SEQ ID NO: 21198 - RNA, 24 nt, Artificial Sequence
  Synthetic Oligonucleotide; PD-L1 exons 4 and 5; Set C
uaguuguuguguugauucucagug

SEQ ID NO: 21199 - RNA, 22 nt, Artificial Sequence
  Synthetic Oligonucleotide; PD-L1 exons 4 and 5; Set C
aguuguuguguugauucucagu

SEQ ID NO: 21200 - RNA, 39 nt, Artificial Sequence
  Synthetic Oligonucleotide; PD-L1 exons 4 and 5; Set C
aaucucauuaguuguuguguugauucucagugugcuggu

SEQ ID NO: 21201 - RNA, 25 nt, Artificial Sequence
  Synthetic Oligonucleotide; PD-L1 exons 4 and 5; Set C
uuaguuguuguguugauucucagug

SEQ ID NO: 21202 - RNA, 23 nt, Artificial Sequence
  Synthetic Oligonucleotide; PD-L1 exons 4 and 5; Set C
uaguuguuguguugauucucagu

SEQ ID NO: 21203 - RNA, 38 nt, Artificial Sequence
  Synthetic Oligonucleotide; PD-L1 exons 4 and 5; Set C
aaucucauuaguuguuguguugauucucagugugcugg

SEQ ID NO: 21204 - RNA, 40 nt, Artificial Sequence
  Synthetic Oligonucleotide; PD-L1 exons 4 and 5; Set C
aaaucucauuaguuguuguguugauucucagugugcuggu

SEQ ID NO: 21205 - RNA, 26 nt, Artificial Sequence
  Synthetic Oligonucleotide; PD-L1 exons 4 and 5; Set C
auuaguuguuguguugauucucagug

SEQ ID NO: 21206 - RNA, 24 nt, Artificial Sequence
  Synthetic Oligonucleotide; PD-L1 exons 4 and 5; Set C
uuaguuguuguguugauucucagu

SEQ ID NO: 21207 - RNA, 39 nt, Artificial Sequence
  Synthetic Oligonucleotide; PD-L1 exons 4 and 5; Set A
aaaucucauuaguuguuguguugauucucagugugcugg

SEQ ID NO: 21208 - RNA, 37 nt, Artificial Sequence
  Synthetic Oligonucleotide; PD-L1 exons 4 and 5; Set A
aaucucauuaguuguuguguugauucucagugugcug

SEQ ID NO: 21209 - RNA, 27 nt, Artificial Sequence
  Synthetic Oligonucleotide; PD-L1 exons 4 and 5; Set C
cauuaguuguuguguugauucucagug

SEQ ID NO: 21210 - RNA, 25 nt, Artificial Sequence
  Synthetic Oligonucleotide; PD-L1 exons 4 and 5; Set C
auuaguuguuguguugauucucagu

SEQ ID NO: 21211 - RNA, 40 nt, Artificial Sequence
  Synthetic Oligonucleotide; PD-L1 exons 4 and 5; Set A
aaaaucucauuaguuguuguguugauucucagugugcugg

SEQ ID NO: 21212 - RNA, 38 nt, Artificial Sequence
  Synthetic Oligonucleotide; PD-L1 exons 4 and 5; Set A
aaaucucauuaguuguuguguugauucucagugugcug

SEQ ID NO: 21213 - RNA, 28 nt, Artificial Sequence
  Synthetic Oligonucleotide; PD-L1 exons 4 and 5; Set A
ucauuaguuguuguguugauucucagug

SEQ ID NO: 21214 - RNA, 26 nt, Artificial Sequence
  Synthetic Oligonucleotide; PD-L1 exons 4 and 5; Set C
cauuaguuguuguguugauucucagu

SEQ ID NO: 21215 - RNA, 39 nt, Artificial Sequence
  Synthetic Oligonucleotide; PD-L1 exons 4 and 5; Set A
aaaaucucauuaguuguuguguugauucucagugugcug

SEQ ID NO: 21216 - RNA, 27 nt, Artificial Sequence
  Synthetic Oligonucleotide; PD-L1 exons 4 and 5; Set C
ucauuaguuguuguguugauucucagu

SEQ ID NO: 21217 - RNA, 40 nt, Artificial Sequence
  Synthetic Oligonucleotide; PD-L1 exons 4 and 5; Set A
gaaaaucucauuaguuguuguguugauucucagugugcug

SEQ ID NO: 21218 - RNA, 32 nt, Artificial Sequence
  Synthetic Oligonucleotide; PD-L1 exons 4 and 5; Set A
aaucucauuaguuguuguguugauucucagug

SEQ ID NO: 21219 - RNA, 37 nt, Artificial Sequence
  Synthetic Oligonucleotide; PD-L1 exons 4 and 5; Set A
uagaaaaucucauuaguuguuguguugauucucagug

SEQ ID NO: 21220 - RNA, 20 nt, Artificial Sequence
  Synthetic Oligonucleotide; PD-L1 exons 4 and 5; Set C
cucauuaguuguuguguuga

SEQ ID NO: 21221 - RNA, 38 nt, Artificial Sequence
  Synthetic Oligonucleotide; PD-L1 exons 4 and 5; Set A
guagaaaaucucauuaguuguuguguugauucucagug

SEQ ID NO: 21222 - RNA, 21 nt, Artificial Sequence
  Synthetic Oligonucleotide; PD-L1 exons 4 and 5; Set C
ucucauuaguuguuguguuga

SEQ ID NO: 21223 - RNA, 19 nt, Artificial Sequence
  Synthetic Oligonucleotide; PD-L1 exons 4 and 5; Set C
cucauuaguuguuguguug

SEQ ID NO: 21224 - RNA, 39 nt, Artificial Sequence
  Synthetic Oligonucleotide; PD-L1 exons 4 and 5; Set A
aguagaaaaucucauuaguuguuguguugauucucagug

SEQ ID NO: 21225 - RNA, 37 nt, Artificial Sequence
  Synthetic Oligonucleotide; PD-L1 exons 4 and 5; Set A
guagaaaaucucauuaguuguuguguugauucucagu

SEQ ID NO: 21226 - RNA, 22 nt, Artificial Sequence
  Synthetic Oligonucleotide; PD-L1 exons 4 and 5; Set C
aucucauuaguuguuguguuga

SEQ ID NO: 21227 - RNA, 18 nt, Artificial Sequence
  Synthetic Oligonucleotide; PD-L1 exons 4 and 5; Set C
cucauuaguuguuguguu

SEQ ID NO: 21228 - RNA, 20 nt, Artificial Sequence
  Synthetic Oligonucleotide; PD-L1 exons 4 and 5; Set C
ucucauuaguuguuguguug

SEQ ID NO: 21229 - RNA, 24 nt, Artificial Sequence
  Synthetic Oligonucleotide; PD-L1 exons 4 and 5; Set C
aaucucauuaguuguuguguugau

SEQ ID NO: 21230 - RNA, 38 nt, Artificial Sequence
  Synthetic Oligonucleotide; PD-L1 exons 4 and 5; Set A
aguagaaaaucucauuaguuguuguguugauucucagu

SEQ ID NO: 21231 - RNA, 17 nt, Artificial Sequence
  Synthetic Oligonucleotide; PD-L1 exons 4 and 5; Set C
cucauuaguuguugugu

SEQ ID NO: 21232 - RNA, 19 nt, Artificial Sequence
  Synthetic Oligonucleotide; PD-L1 exons 4 and 5; Set C
ucucauuaguuguuguguu

SEQ ID NO: 21233 - RNA, 21 nt, Artificial Sequence
  Synthetic Oligonucleotide; PD-L1 exons 4 and 5; Set C
aucucauuaguuguuguguug

SEQ ID NO: 21234 - RNA, 25 nt, Artificial Sequence
  Synthetic Oligonucleotide; PD-L1 exons 4 and 5; Set C
aaaucucauuaguuguuguguugau

SEQ ID NO: 21235 - RNA, 24 nt, Artificial Sequence
  Synthetic Oligonucleotide; PD-L1 exons 4 and 5; Set C
aaaucucauuaguuguuguguuga

SEQ ID NO: 21236 - RNA, 16 nt, Artificial Sequence
  Synthetic Oligonucleotide; PD-L1 exons 4 and 5; Set C
cucauuaguuguugug

SEQ ID NO: 21237 - RNA, 18 nt, Artificial Sequence
  Synthetic Oligonucleotide; PD-L1 exons 4 and 5; Set C
ucucauuaguuguugugu

SEQ ID NO: 21238 - RNA, 20 nt, Artificial Sequence
  Synthetic Oligonucleotide; PD-L1 exons 4 and 5; Set C
aucucauuaguuguuguguu

SEQ ID NO: 21239 - RNA, 26 nt, Artificial Sequence
  Synthetic Oligonucleotide; PD-L1 exons 4 and 5; Set C
aaaaucucauuaguuguuguguugau

SEQ ID NO: 21240 - RNA, 25 nt, Artificial Sequence
  Synthetic Oligonucleotide; PD-L1 exons 4 and 5; Set C
aaaaucucauuaguuguuguguuga

SEQ ID NO: 21241 - RNA, 15 nt, Artificial Sequence
  Synthetic Oligonucleotide; PD-L1 exons 4 and 5; Set C
cucauuaguuguugu

SEQ ID NO: 21242 - RNA, 17 nt, Artificial Sequence
  Synthetic Oligonucleotide; PD-L1 exons 4 and 5; Set C
ucucauuaguuguugug

SEQ ID NO: 21243 - RNA, 19 nt, Artificial Sequence
  Synthetic Oligonucleotide; PD-L1 exons 4 and 5; Set C
aucucauuaguuguugugu

SEQ ID NO: 21244 - RNA, 23 nt, Artificial Sequence
  Synthetic Oligonucleotide; PD-L1 exons 4 and 5; Set C
aaaucucauuaguuguuguguug

SEQ ID NO: 21245 - RNA, 27 nt, Artificial Sequence
  Synthetic Oligonucleotide; PD-L1 exons 4 and 5; Set C
gaaaaucucauuaguuguuguguugau

SEQ ID NO: 21246 - RNA, 26 nt, Artificial Sequence
  Synthetic Oligonucleotide; PD-L1 exons 4 and 5; Set C
gaaaaucucauuaguuguuguguuga

SEQ ID NO: 21247 - RNA, 22 nt, Artificial Sequence
  Synthetic Oligonucleotide; PD-L1 exons 4 and 5; Set C
aaaucucauuaguuguuguguu

SEQ ID NO: 21248 - RNA, 16 nt, Artificial Sequence
  Synthetic Oligonucleotide; PD-L1 exons 4 and 5; Set C
ucucauuaguuguugu

SEQ ID NO: 21249 - RNA, 18 nt, Artificial Sequence
  Synthetic Oligonucleotide; PD-L1 exons 4 and 5; Set C
aucucauuaguuguugug

SEQ ID NO: 21250 - RNA, 24 nt, Artificial Sequence
  Synthetic Oligonucleotide; PD-L1 exons 4 and 5; Set C
aaaaucucauuaguuguuguguug

SEQ ID NO: 21251 - RNA, 28 nt, Artificial Sequence
  Synthetic Oligonucleotide; PD-L1 exons 4 and 5; Set C
agaaaaucucauuaguuguuguguugau

SEQ ID NO: 21252 - RNA, 27 nt, Artificial Sequence
  Synthetic Oligonucleotide; PD-L1 exons 4 and 5; Set C
agaaaaucucauuaguuguuguguuga

SEQ ID NO: 21253 - RNA, 23 nt, Artificial Sequence
  Synthetic Oligonucleotide; PD-L1 exons 4 and 5; Set C
aaaaucucauuaguuguuguguu

SEQ ID NO: 21254 - RNA, 21 nt, Artificial Sequence
  Synthetic Oligonucleotide; PD-L1 exons 4 and 5; Set C
aaaucucauuaguuguugugu

SEQ ID NO: 21255 - RNA, 15 nt, Artificial Sequence
  Synthetic Oligonucleotide; PD-L1 exons 4 and 5; Set C
ucucauuaguuguug

SEQ ID NO: 21256 - RNA, 17 nt, Artificial Sequence
  Synthetic Oligonucleotide; PD-L1 exons 4 and 5; Set C
aucucauuaguuguugu

SEQ ID NO: 21257 - RNA, 25 nt, Artificial Sequence
  Synthetic Oligonucleotide; PD-L1 exons 4 and 5; Set C
gaaaaucucauuaguuguuguguug

SEQ ID NO: 21258 - RNA, 29 nt, Artificial Sequence
  Synthetic Oligonucleotide; PD-L1 exons 4 and 5; Set C
uagaaaaucucauuaguuguuguguugau

SEQ ID NO: 21259 - RNA, 24 nt, Artificial Sequence
  Synthetic Oligonucleotide; PD-L1 exons 4 and 5; Set C
gaaaaucucauuaguuguuguguu

SEQ ID NO: 21260 - RNA, 22 nt, Artificial Sequence
  Synthetic Oligonucleotide; PD-L1 exons 4 and 5; Set C
aaaaucucauuaguuguugugu

SEQ ID NO: 21261 - RNA, 20 nt, Artificial Sequence
  Synthetic Oligonucleotide; PD-L1 exons 4 and 5; Set C
aaaucucauuaguuguugug

SEQ ID NO: 21262 - RNA, 16 nt, Artificial Sequence
  Synthetic Oligonucleotide; PD-L1 exons 4 and 5; Set C
aucucauuaguuguug

SEQ ID NO: 21263 - RNA, 26 nt, Artificial Sequence
  Synthetic Oligonucleotide; PD-L1 exons 4 and 5; Set C
agaaaaucucauuaguuguuguguug

SEQ ID NO: 21264 - RNA, 25 nt, Artificial Sequence
  Synthetic Oligonucleotide; PD-L1 exons 4 and 5; Set C
agaaaaucucauuaguuguuguguu

SEQ ID NO: 21265 - RNA, 23 nt, Artificial Sequence
  Synthetic Oligonucleotide; PD-L1 exons 4 and 5; Set C
gaaaaucucauuaguuguugugu

SEQ ID NO: 21266 - RNA, 21 nt, Artificial Sequence
  Synthetic Oligonucleotide; PD-L1 exons 4 and 5; Set C
aaaaucucauuaguuguugug

SEQ ID NO: 21267 - RNA, 19 nt, Artificial Sequence
  Synthetic Oligonucleotide; PD-L1 exons 4 and 5; Set C
aaaucucauuaguuguugu

SEQ ID NO: 21268 - RNA, 15 nt, Artificial Sequence
  Synthetic Oligonucleotide; PD-L1 exons 4 and 5; Set C
aucucauuaguuguu

SEQ ID NO: 21269 - RNA, 27 nt, Artificial Sequence
  Synthetic Oligonucleotide; PD-L1 exons 4 and 5; Set C
uagaaaaucucauuaguuguuguguug

SEQ ID NO: 21270 - RNA, 31 nt, Artificial Sequence
  Synthetic Oligonucleotide; PD-L1 exons 4 and 5; Set C
aguagaaaaucucauuaguuguuguguugau

SEQ ID NO: 21271 - RNA, 16 nt, Artificial Sequence
  Synthetic Oligonucleotide; PD-L1 exons 4 and 5; Set C
aaucucauuaguuguu

SEQ ID NO: 21272 - RNA, 26 nt, Artificial Sequence
  Synthetic Oligonucleotide; PD-L1 exons 4 and 5; Set C
uagaaaaucucauuaguuguuguguu

SEQ ID NO: 21273 - RNA, 24 nt, Artificial Sequence
  Synthetic Oligonucleotide; PD-L1 exons 4 and 5; Set C
agaaaaucucauuaguuguugugu

SEQ ID NO: 21274 - RNA, 22 nt, Artificial Sequence
  Synthetic Oligonucleotide; PD-L1 exons 4 and 5; Set C
gaaaaucucauuaguuguugug

SEQ ID NO: 21275 - RNA, 20 nt, Artificial Sequence
  Synthetic Oligonucleotide; PD-L1 exons 4 and 5; Set C
aaaaucucauuaguuguugu

SEQ ID NO: 21276 - RNA, 18 nt, Artificial Sequence
  Synthetic Oligonucleotide; PD-L1 exons 4 and 5; Set C
aaaucucauuaguuguug

SEQ ID NO: 21277 - RNA, 25 nt, Artificial Sequence
  Synthetic Oligonucleotide; PD-L1 exons 4 and 5; Set C
uagaaaaucucauuaguuguugugu

SEQ ID NO: 21278 - RNA, 23 nt, Artificial Sequence
  Synthetic Oligonucleotide; PD-L1 exons 4 and 5; Set C
agaaaaucucauuaguuguugug

SEQ ID NO: 21279 - RNA, 21 nt, Artificial Sequence
  Synthetic Oligonucleotide; PD-L1 exons 4 and 5; Set C
gaaaaucucauuaguuguugu

SEQ ID NO: 21280 - RNA, 19 nt, Artificial Sequence
  Synthetic Oligonucleotide; PD-L1 exons 4 and 5; Set C
aaaaucucauuaguuguug

SEQ ID NO: 21281 - RNA, 17 nt, Artificial Sequence
  Synthetic Oligonucleotide; PD-L1 exons 4 and 5; Set C
aaaucucauuaguuguu

SEQ ID NO: 21282 - RNA, 16 nt, Artificial Sequence
  Synthetic Oligonucleotide; PD-L1 exons 4 and 5; Set C
aaaucucauuaguugu

SEQ ID NO: 21283 - RNA, 24 nt, Artificial Sequence
  Synthetic Oligonucleotide; PD-L1 exons 4 and 5; Set C
uagaaaaucucauuaguuguugug

SEQ ID NO: 21284 - RNA, 22 nt, Artificial Sequence
  Synthetic Oligonucleotide; PD-L1 exons 4 and 5; Set C
agaaaaucucauuaguuguugu

SEQ ID NO: 21285 - RNA, 20 nt, Artificial Sequence
  Synthetic Oligonucleotide; PD-L1 exons 4 and 5; Set C
gaaaaucucauuaguuguug

SEQ ID NO: 21286 - RNA, 18 nt, Artificial Sequence
  Synthetic Oligonucleotide; PD-L1 exons 4 and 5; Set C
aaaaucucauuaguuguu

SEQ ID NO: 21287 - RNA, 17 nt, Artificial Sequence
  Synthetic Oligonucleotide; PD-L1 exons 4 and 5; Set C
aaaaucucauuaguugu

SEQ ID NO: 21288 - RNA, 15 nt, Artificial Sequence
  Synthetic Oligonucleotide; PD-L1 exons 4 and 5; Set C
aaaucucauuaguug

SEQ ID NO: 21289 - RNA, 23 nt, Artificial Sequence
  Synthetic Oligonucleotide; PD-L1 exons 4 and 5; Set C
uagaaaaucucauuaguuguugu

SEQ ID NO: 21290 - RNA, 21 nt, Artificial Sequence
  Synthetic Oligonucleotide; PD-L1 exons 4 and 5; Set C
agaaaaucucauuaguuguug

SEQ ID NO: 21291 - RNA, 19 nt, Artificial Sequence
  Synthetic Oligonucleotide; PD-L1 exons 4 and 5; Set C
gaaaaucucauuaguuguu

SEQ ID NO: 21292 - RNA, 18 nt, Artificial Sequence
  Synthetic Oligonucleotide; PD-L1 exons 4 and 5; Set C
gaaaaucucauuaguugu

SEQ ID NO: 21293 - RNA, 16 nt, Artificial Sequence
  Synthetic Oligonucleotide; PD-L1 exons 4 and 5; Set C
aaaaucucauuaguug

SEQ ID NO: 21294 - RNA, 22 nt, Artificial Sequence
  Synthetic Oligonucleotide; PD-L1 exons 4 and 5; Set C
uagaaaaucucauuaguuguug

SEQ ID NO: 21295 - RNA, 20 nt, Artificial Sequence
  Synthetic Oligonucleotide; PD-L1 exons 4 and 5; Set C
agaaaaucucauuaguuguu

SEQ ID NO: 21296 - RNA, 19 nt, Artificial Sequence
  Synthetic Oligonucleotide; PD-L1 exons 4 and 5; Set C
agaaaaucucauuaguugu

SEQ ID NO: 21297 - RNA, 17 nt, Artificial Sequence
  Synthetic Oligonucleotide; PD-L1 exons 4 and 5; Set C
gaaaaucucauuaguug

SEQ ID NO: 21298 - RNA, 21 nt, Artificial Sequence
  Synthetic Oligonucleotide; PD-L1 exons 4 and 5; Set C
uagaaaaucucauuaguuguu

SEQ ID NO: 21299 - RNA, 15 nt, Artificial Sequence
  Synthetic Oligonucleotide; PD-L1 exons 4 and 5; Set C
aaaaucucauuaguu

SEQ ID NO: 21300 - RNA, 37 nt, Artificial Sequence
  Synthetic Oligonucleotide; PD-L1 exons 4 and 5; Set A
aagugcaguagaaaaucucauuaguuguuguguugau

SEQ ID NO: 21301 - RNA, 36 nt, Artificial Sequence
  Synthetic Oligonucleotide; PD-L1 exons 4 and 5; Set A
aagugcaguagaaaaucucauuaguuguuguguuga

SEQ ID NO: 21302 - RNA, 20 nt, Artificial Sequence
  Synthetic Oligonucleotide; PD-L1 exons 4 and 5; Set C
uagaaaaucucauuaguugu

SEQ ID NO: 21303 - RNA, 18 nt, Artificial Sequence
  Synthetic Oligonucleotide; PD-L1 exons 4 and 5; Set C
agaaaaucucauuaguug

SEQ ID NO: 21304 - RNA, 16 nt, Artificial Sequence
  Synthetic Oligonucleotide; PD-L1 exons 4 and 5; Set C
gaaaaucucauuaguu

SEQ ID NO: 21305 - RNA, 19 nt, Artificial Sequence
  Synthetic Oligonucleotide; PD-L1 exons 4 and 5; Set C
uagaaaaucucauuaguug

SEQ ID NO: 21306 - RNA, 35 nt, Artificial Sequence
  Synthetic Oligonucleotide; PD-L1 exons 4 and 5; Set A
aagugcaguagaaaaucucauuaguuguuguguug

SEQ ID NO: 21307 - RNA, 17 nt, Artificial Sequence
  Synthetic Oligonucleotide; PD-L1 exons 4 and 5; Set C
agaaaaucucauuaguu

SEQ ID NO: 21308 - RNA, 15 nt, Artificial Sequence
  Synthetic Oligonucleotide; PD-L1 exons 4 and 5; Set C
gaaaaucucauuagu

SEQ ID NO: 21309 - RNA, 34 nt, Artificial Sequence
  Synthetic Oligonucleotide; PD-L1 exons 4 and 5; Set A
aagugcaguagaaaaucucauuaguuguuguguu

SEQ ID NO: 21310 - RNA, 18 nt, Artificial Sequence
  Synthetic Oligonucleotide; PD-L1 exons 4 and 5; Set C
uagaaaaucucauuaguu

SEQ ID NO: 21311 - RNA, 16 nt, Artificial Sequence
  Synthetic Oligonucleotide; PD-L1 exons 4 and 5; Set C
agaaaaucucauuagu

SEQ ID NO: 21312 - RNA, 33 nt, Artificial Sequence
  Synthetic Oligonucleotide; PD-L1 exons 4 and 5; Set A
aagugcaguagaaaaucucauuaguuguugugu

SEQ ID NO: 21313 - RNA, 17 nt, Artificial Sequence
  Synthetic Oligonucleotide; PD-L1 exons 4 and 5; Set C
uagaaaaucucauuagu

SEQ ID NO: 21314 - RNA, 15 nt, Artificial Sequence
  Synthetic Oligonucleotide; PD-L1 exons 4 and 5; Set C
agaaaaucucauuag

SEQ ID NO: 21315 - RNA, 32 nt, Artificial Sequence
  Synthetic Oligonucleotide; PD-L1 exons 4 and 5; Set C
aagugcaguagaaaaucucauuaguuguugug

SEQ ID NO: 21316 - RNA, 16 nt, Artificial Sequence
  Synthetic Oligonucleotide; PD-L1 exons 4 and 5; Set C
uagaaaaucucauuag

SEQ ID NO: 21317 - RNA, 15 nt, Artificial Sequence
  Synthetic Oligonucleotide; PD-L1 exons 4 and 5; Set C
uagaaaaucucauua

SEQ ID NO: 21318 - RNA, 31 nt, Artificial Sequence
  Synthetic Oligonucleotide; PD-L1 exons 4 and 5; Set C
aagugcaguagaaaaucucauuaguuguugu

SEQ ID NO: 21319 - RNA, 30 nt, Artificial Sequence
  Synthetic Oligonucleotide; PD-L1 exons 4 and 5; Set C
aagugcaguagaaaaucucauuaguuguug

SEQ ID NO: 21320 - RNA, 29 nt, Artificial Sequence
  Synthetic Oligonucleotide; PD-L1 exons 4 and 5; Set C
aagugcaguagaaaaucucauuaguuguu

SEQ ID NO: 21321 - RNA, 28 nt, Artificial Sequence
  Synthetic Oligonucleotide; PD-L1 exons 4 and 5; Set C
aagugcaguagaaaaucucauuaguugu

SEQ ID NO: 21322 - RNA, 27 nt, Artificial Sequence
  Synthetic Oligonucleotide; PD-L1 exons 4 and 5; Set C
aagugcaguagaaaaucucauuaguug

SEQ ID NO: 21323 - RNA, 26 nt, Artificial Sequence
  Synthetic Oligonucleotide; PD-L1 exons 4 and 5; Set C
aagugcaguagaaaaucucauuaguu

SEQ ID NO: 21324 - RNA, 25 nt, Artificial Sequence
  Synthetic Oligonucleotide; PD-L1 exons 4 and 5; Set C
aagugcaguagaaaaucucauuagu

SEQ ID NO: 21325 - RNA, 24 nt, Artificial Sequence
  Synthetic Oligonucleotide; PD-L1 exons 4 and 5; Set C
aagugcaguagaaaaucucauuag

SEQ ID NO: 21326 - RNA, 23 nt, Artificial Sequence
  Synthetic Oligonucleotide; PD-L1 exons 4 and 5; Set C
aagugcaguagaaaaucucauua

SEQ ID NO: 21327 - RNA, 22 nt, Artificial Sequence
  Synthetic Oligonucleotide; PD-L1 exons 4 and 5; Set C
aagugcaguagaaaaucucauu

SEQ ID NO: 21328 - RNA, 21 nt, Artificial Sequence
  Synthetic Oligonucleotide; PD-L1 exons 4 and 5; Set C
aagugcaguagaaaaucucau

SEQ ID NO: 21329 - RNA, 20 nt, Artificial Sequence
  Synthetic Oligonucleotide; PD-L1 exons 4 and 5; Set C
aagugcaguagaaaaucuca

SEQ ID NO: 21330 - RNA, 15 nt, Artificial Sequence
  Synthetic Oligonucleotide; PD-L1 exons 4 and 5; Set C
agugcaguagaaaau

SEQ ID NO: 21331 - RNA, 16 nt, Artificial Sequence
  Synthetic Oligonucleotide; PD-L1 exons 4 and 5; Set C
aagugcaguagaaaau

SEQ ID NO: 21332 - RNA, 40 nt, Artificial Sequence
  Synthetic Oligonucleotide; PD-L1 exons 4 and 5; Set B
aucuaaucuccuaaaagugcaguagaaaaucucauuaguu

SEQ ID NO: 21333 - RNA, 39 nt, Artificial Sequence
  Synthetic Oligonucleotide; PD-L1 exons 4 and 5; Set B
aucuaaucuccuaaaagugcaguagaaaaucucauuagu

SEQ ID NO: 21334 - RNA, 38 nt, Artificial Sequence
  Synthetic Oligonucleotide; PD-L1 exons 4 and 5; Set B
aucuaaucuccuaaaagugcaguagaaaaucucauuag

SEQ ID NO: 21335 - RNA, 37 nt, Artificial Sequence
  Synthetic Oligonucleotide; PD-L1 exons 4 and 5; Set B
aucuaaucuccuaaaagugcaguagaaaaucucauua

SEQ ID NO: 21336 - RNA, 36 nt, Artificial Sequence
  Synthetic Oligonucleotide; PD-L1 exons 4 and 5; Set C
aucuaaucuccuaaaagugcaguagaaaaucucauu

SEQ ID NO: 21337 - RNA, 35 nt, Artificial Sequence
  Synthetic Oligonucleotide; PD-L1 exons 4 and 5; Set C
aucuaaucuccuaaaagugcaguagaaaaucucau

SEQ ID NO: 21338 - RNA, 34 nt, Artificial Sequence
  Synthetic Oligonucleotide; PD-L1 exons 4 and 5; Set C
aucuaaucuccuaaaagugcaguagaaaaucuca

SEQ ID NO: 21339 - RNA, 24 nt, Artificial Sequence
  Synthetic Oligonucleotide; PD-L1 exons 4 and 5; Set C
uuaauggacacauucagaauauua

SEQ ID NO: 21340 - RNA, 25 nt, Artificial Sequence
  Synthetic Oligonucleotide; PD-L1 exons 4 and 5; Set C
uuuaauggacacauucagaauauua

SEQ ID NO: 21341 - RNA, 26 nt, Artificial Sequence
  Synthetic Oligonucleotide; PD-L1 exons 4 and 5; Set C
uuuuaauggacacauucagaauauua

SEQ ID NO: 21342 - RNA, 27 nt, Artificial Sequence
  Synthetic Oligonucleotide; PD-L1 exons 4 and 5; Set C
auuuuaauggacacauucagaauauua

SEQ ID NO: 21343 - RNA, 35 nt, Artificial Sequence
  Synthetic Oligonucleotide; PD-L1 exons 4 and 5; Set C
uuagacauauuuuaauggacacauucagaauauua

SEQ ID NO: 21344 - RNA, 15 nt, Artificial Sequence
  Synthetic Oligonucleotide; PD-L1 exons 4 and 5; Set C
uuuaauggacacauu

SEQ ID NO: 21345 - RNA, 16 nt, Artificial Sequence
  Synthetic Oligonucleotide; PD-L1 exons 4 and 5; Set C
uuuuaauggacacauu

SEQ ID NO: 21346 - RNA, 17 nt, Artificial Sequence
  Synthetic Oligonucleotide; PD-L1 exons 4 and 5; Set C
auuuuaauggacacauu

SEQ ID NO: 21347 - RNA, 15 nt, Artificial Sequence
  Synthetic Oligonucleotide; PD-L1 exons 4 and 5; Set C
uuuuaauggacacau

SEQ ID NO: 21348 - RNA, 16 nt, Artificial Sequence
  Synthetic Oligonucleotide; PD-L1 exons 4 and 5; Set C
auuuuaauggacacau

SEQ ID NO: 21349 - RNA, 15 nt, Artificial Sequence
  Synthetic Oligonucleotide; PD-L1 exons 4 and 5; Set C
auuuuaauggacaca

SEQ ID NO: 21350 - RNA, 25 nt, Artificial Sequence
  Synthetic Oligonucleotide; PD-L1 exons 4 and 5; Set C
uuagacauauuuuaauggacacauu

SEQ ID NO: 21351 - RNA, 33 nt, Artificial Sequence
  Synthetic Oligonucleotide; PD-L1 exons 4 and 5; Set B
ggacaguguuagacauauuuuaauggacacauu

SEQ ID NO: 21352 - RNA, 16 nt, Artificial Sequence
  Synthetic Oligonucleotide; PD-L1 exons 4 and 5; Set C
uuagacauauuuuaau

SEQ ID NO: 21353 - RNA, 34 nt, Artificial Sequence
  Synthetic Oligonucleotide; PD-L1 exons 4 and 5; Set B
gggacaguguuagacauauuuuaauggacacauu

SEQ ID NO: 21354 - RNA, 17 nt, Artificial Sequence
  Synthetic Oligonucleotide; PD-L1 exons 4 and 5; Set C
guuagacauauuuuaau

SEQ ID NO: 21355 - RNA, 35 nt, Artificial Sequence
  Synthetic Oligonucleotide; PD-L1 exons 4 and 5; Set C
ggggacaguguuagacauauuuuaauggacacauu

SEQ ID NO: 21356 - RNA, 16 nt, Artificial Sequence
  Synthetic Oligonucleotide; PD-L1 exons 4 and 5; Set C
guuagacauauuuuaa

SEQ ID NO: 21357 - RNA, 18 nt, Artificial Sequence
  Synthetic Oligonucleotide; PD-L1 exons 4 and 5; Set C
uguuagacauauuuuaau

SEQ ID NO: 21358 - RNA, 36 nt, Artificial Sequence
  Synthetic Oligonucleotide; PD-L1 exons 4 and 5; Set C
aggggacaguguuagacauauuuuaauggacacauu

SEQ ID NO: 21359 - RNA, 15 nt, Artificial Sequence
  Synthetic Oligonucleotide; PD-L1 exons 4 and 5; Set C
guuagacauauuuua

SEQ ID NO: 21360 - RNA, 17 nt, Artificial Sequence
  Synthetic Oligonucleotide; PD-L1 exons 4 and 5; Set C
uguuagacauauuuuaa

SEQ ID NO: 21361 - RNA, 16 nt, Artificial Sequence
  Synthetic Oligonucleotide; PD-L1 exons 4 and 5; Set C
uguuagacauauuuua

SEQ ID NO: 21362 - RNA, 18 nt, Artificial Sequence
  Synthetic Oligonucleotide; PD-L1 exons 4 and 5; Set C
guguuagacauauuuuaa

SEQ ID NO: 21363 - RNA, 20 nt, Artificial Sequence
  Synthetic Oligonucleotide; PD-L1 exons 4 and 5; Set C
aguguuagacauauuuuaau

SEQ ID NO: 21364 - RNA, 30 nt, Artificial Sequence
  Synthetic Oligonucleotide; PD-L1 exons 4 and 5; Set B
gggacaguguuagacauauuuuaauggaca

SEQ ID NO: 21365 - RNA, 19 nt, Artificial Sequence
  Synthetic Oligonucleotide; PD-L1 exons 4 and 5; Set C
aguguuagacauauuuuaa

SEQ ID NO: 21366 - RNA, 15 nt, Artificial Sequence
  Synthetic Oligonucleotide; PD-L1 exons 4 and 5; Set C
uguuagacauauuuu

SEQ ID NO: 21367 - RNA, 17 nt, Artificial Sequence
  Synthetic Oligonucleotide; PD-L1 exons 4 and 5; Set C
guguuagacauauuuua

SEQ ID NO: 21368 - RNA, 18 nt, Artificial Sequence
  Synthetic Oligonucleotide; PD-L1 exons 4 and 5; Set C
aguguuagacauauuuua

SEQ ID NO: 21369 - RNA, 16 nt, Artificial Sequence
  Synthetic Oligonucleotide; PD-L1 exons 4 and 5; Set C
guguuagacauauuuu

SEQ ID NO: 21370 - RNA, 20 nt, Artificial Sequence
  Synthetic Oligonucleotide; PD-L1 exons 4 and 5; Set C
caguguuagacauauuuuaa

SEQ ID NO: 21371 - RNA, 32 nt, Artificial Sequence
  Synthetic Oligonucleotide; PD-L1 exons 4 and 5; Set B
aggggacaguguuagacauauuuuaauggaca

SEQ ID NO: 21372 - RNA, 17 nt, Artificial Sequence
  Synthetic Oligonucleotide; PD-L1 exons 4 and 5; Set C
aguguuagacauauuuu

SEQ ID NO: 21373 - RNA, 15 nt, Artificial Sequence
  Synthetic Oligonucleotide; PD-L1 exons 4 and 5; Set C
guguuagacauauuu

SEQ ID NO: 21374 - RNA, 21 nt, Artificial Sequence
  Synthetic Oligonucleotide; PD-L1 exons 4 and 5; Set C
acaguguuagacauauuuuaa

SEQ ID NO: 21375 - RNA, 16 nt, Artificial Sequence
  Synthetic Oligonucleotide; PD-L1 exons 4 and 5; Set C
aguguuagacauauuu

SEQ ID NO: 21376 - RNA, 22 nt, Artificial Sequence
  Synthetic Oligonucleotide; PD-L1 exons 4 and 5; Set C
gacaguguuagacauauuuuaa

SEQ ID NO: 21377 - RNA, 24 nt, Artificial Sequence
  Synthetic Oligonucleotide; PD-L1 exons 4 and 5; Set C
ggacaguguuagacauauuuuaau

SEQ ID NO: 21378 - RNA, 21 nt, Artificial Sequence
  Synthetic Oligonucleotide; PD-L1 exons 4 and 5; Set C
gacaguguuagacauauuuua

SEQ ID NO: 21379 - RNA, 15 nt, Artificial Sequence
  Synthetic Oligonucleotide; PD-L1 exons 4 and 5; Set C
aguguuagacauauu

SEQ ID NO: 21380 - RNA, 25 nt, Artificial Sequence
  Synthetic Oligonucleotide; PD-L1 exons 4 and 5; Set C
gggacaguguuagacauauuuuaau

SEQ ID NO: 21381 - RNA, 20 nt, Artificial Sequence
  Synthetic Oligonucleotide; PD-L1 exons 4 and 5; Set C
gacaguguuagacauauuuu

SEQ ID NO: 21382 - RNA, 26 nt, Artificial Sequence
  Synthetic Oligonucleotide; PD-L1 exons 4 and 5; Set C
ggggacaguguuagacauauuuuaau

SEQ ID NO: 21383 - RNA, 27 nt, Artificial Sequence
  Synthetic Oligonucleotide; PD-L1 exons 4 and 5; Set C
aggggacaguguuagacauauuuuaau

SEQ ID NO: 21384 - RNA, 27 nt, Artificial Sequence
  Synthetic Oligonucleotide; PD-L1 exons 4 and 5; Set C
uaggggacaguguuagacauauuuuaa

SEQ ID NO: 21385 - RNA, 26 nt, Artificial Sequence
  Synthetic Oligonucleotide; PD-L1 exons 4 and 5; Set B
uaggggacaguguuagacauauuuua

SEQ ID NO: 21386 - RNA, 25 nt, Artificial Sequence
  Synthetic Oligonucleotide; PD-L1 exons 4 and 5; Set B
uaggggacaguguuagacauauuuu

SEQ ID NO: 21387 - RNA, 19 nt, Artificial Sequence
  Synthetic Oligonucleotide; PD-L1 exons 4 and 5; Set C
gggacaguguuagacauau

SEQ ID NO: 21388 - RNA, 24 nt, Artificial Sequence
  Synthetic Oligonucleotide; PD-L1 exons 4 and 5; Set C
uaggggacaguguuagacauauuu

SEQ ID NO: 21389 - RNA, 20 nt, Artificial Sequence
  Synthetic Oligonucleotide; PD-L1 exons 4 and 5; Set C
ggggacaguguuagacauau

SEQ ID NO: 21390 - RNA, 23 nt, Artificial Sequence
  Synthetic Oligonucleotide; PD-L1 exons 4 and 5; Set C
uaggggacaguguuagacauauu

SEQ ID NO: 21391 - RNA, 21 nt, Artificial Sequence
  Synthetic Oligonucleotide; PD-L1 exons 4 and 5; Set C
aggggacaguguuagacauau

SEQ ID NO: 21392 - RNA, 15 nt, Artificial Sequence
  Synthetic Oligonucleotide; PD-L1 exons 4 and 5; Set C
uaggggacaguguua

SEQ ID NO: 21393 - RNA, 21 nt, Artificial Sequence
  Synthetic Oligonucleotide; PD-L1 exons 4 and 5; Set C
aagaagucagggcuuuugcug

SEQ ID NO: 21394 - RNA, 22 nt, Artificial Sequence
  Synthetic Oligonucleotide; PD-L1 exons 4 and 5; Set C
aaagaagucagggcuuuugcug

SEQ ID NO: 21395 - RNA, 20 nt, Artificial Sequence
  Synthetic Oligonucleotide; PD-L1 exons 4 and 5; Set C
aagaagucagggcuuuugcu

SEQ ID NO: 21396 - RNA, 23 nt, Artificial Sequence
  Synthetic Oligonucleotide; PD-L1 exons 4 and 5; Set C
aaaagaagucagggcuuuugcug

SEQ ID NO: 21397 - RNA, 19 nt, Artificial Sequence
  Synthetic Oligonucleotide; PD-L1 exons 4 and 5; Set C
aagaagucagggcuuuugc

SEQ ID NO: 21398 - RNA, 21 nt, Artificial Sequence
  Synthetic Oligonucleotide; PD-L1 exons 4 and 5; Set C
aaagaagucagggcuuuugcu

SEQ ID NO: 21399 - RNA, 18 nt, Artificial Sequence
  Synthetic Oligonucleotide; PD-L1 exons 4 and 5; Set C
aagaagucagggcuuuug

SEQ ID NO: 21400 - RNA, 20 nt, Artificial Sequence
  Synthetic Oligonucleotide; PD-L1 exons 4 and 5; Set C
aaagaagucagggcuuuugc

SEQ ID NO: 21401 - RNA, 22 nt, Artificial Sequence
  Synthetic Oligonucleotide; PD-L1 exons 4 and 5; Set C
aaaagaagucagggcuuuugcu

SEQ ID NO: 21402 - RNA, 19 nt, Artificial Sequence
  Synthetic Oligonucleotide; PD-L1 exons 4 and 5; Set C
aaagaagucagggcuuuug

SEQ ID NO: 21403 - RNA, 21 nt, Artificial Sequence
  Synthetic Oligonucleotide; PD-L1 exons 4 and 5; Set C
aaaagaagucagggcuuuugc

SEQ ID NO: 21404 - RNA, 20 nt, Artificial Sequence
  Synthetic Oligonucleotide; PD-L1 exons 4 and 5; Set C
aaaagaagucagggcuuuug

SEQ ID NO: 21405 - RNA, 19 nt, Artificial Sequence
  Synthetic Oligonucleotide; PD-L1 exons 4 and 5; Set C
aaaagaagucagggcuuuu

SEQ ID NO: 21406 - RNA, 17 nt, Artificial Sequence
  Synthetic Oligonucleotide; PD-L1 exons 4 and 5; Set C
aaagaagucagggcuuu

SEQ ID NO: 21407 - RNA, 20 nt, Artificial Sequence
  Synthetic Oligonucleotide; PD-L1 exons 4 and 5; Set C
aaaaagaagucagggcuuuu

SEQ ID NO: 21408 - RNA, 18 nt, Artificial Sequence
  Synthetic Oligonucleotide; PD-L1 exons 4 and 5; Set C
aaaagaagucagggcuuu

SEQ ID NO: 21409 - RNA, 16 nt, Artificial Sequence
  Synthetic Oligonucleotide; PD-L1 exons 4 and 5; Set C
aaagaagucagggcuu

SEQ ID NO: 21410 - RNA, 28 nt, Artificial Sequence
  Synthetic Oligonucleotide; PD-L1 exons 4 and 5; Set C
aaacaaaaagaagucagggcuuuugcug

SEQ ID NO: 21411 - RNA, 19 nt, Artificial Sequence
  Synthetic Oligonucleotide; PD-L1 exons 4 and 5; Set C
aaaaagaagucagggcuuu

SEQ ID NO: 21412 - RNA, 17 nt, Artificial Sequence
  Synthetic Oligonucleotide; PD-L1 exons 4 and 5; Set C
aaaagaagucagggcuu

SEQ ID NO: 21413 - RNA, 15 nt, Artificial Sequence
  Synthetic Oligonucleotide; PD-L1 exons 4 and 5; Set C
aaagaagucagggcu

SEQ ID NO: 21414 - RNA, 29 nt, Artificial Sequence
  Synthetic Oligonucleotide; PD-L1 exons 4 and 5; Set C
uaaacaaaaagaagucagggcuuuugcug

SEQ ID NO: 21415 - RNA, 18 nt, Artificial Sequence
  Synthetic Oligonucleotide; PD-L1 exons 4 and 5; Set C
aaaaagaagucagggcuu

SEQ ID NO: 21416 - RNA, 16 nt, Artificial Sequence
  Synthetic Oligonucleotide; PD-L1 exons 4 and 5; Set C
aaaagaagucagggcu

SEQ ID NO: 21417 - RNA, 28 nt, Artificial Sequence
  Synthetic Oligonucleotide; PD-L1 exons 4 and 5; Set C
uaaacaaaaagaagucagggcuuuugcu

SEQ ID NO: 21418 - RNA, 15 nt, Artificial Sequence
  Synthetic Oligonucleotide; PD-L1 exons 4 and 5; Set C
aaaagaagucagggc

SEQ ID NO: 21419 - RNA, 27 nt, Artificial Sequence
  Synthetic Oligonucleotide; PD-L1 exons 4 and 5; Set C
uaaacaaaaagaagucagggcuuuugc

SEQ ID NO: 21420 - RNA, 24 nt, Artificial Sequence
  Synthetic Oligonucleotide; PD-L1 exons 4 and 5; Set C
aaacaaaaagaagucagggcuuuu

SEQ ID NO: 21421 - RNA, 26 nt, Artificial Sequence
  Synthetic Oligonucleotide; PD-L1 exons 4 and 5; Set C
uaaacaaaaagaagucagggcuuuug

SEQ ID NO: 21422 - RNA, 25 nt, Artificial Sequence
  Synthetic Oligonucleotide; PD-L1 exons 4 and 5; Set C
uaaacaaaaagaagucagggcuuuu

SEQ ID NO: 21423 - RNA, 23 nt, Artificial Sequence
  Synthetic Oligonucleotide; PD-L1 exons 4 and 5; Set C
aaacaaaaagaagucagggcuuu

SEQ ID NO: 21424 - RNA, 24 nt, Artificial Sequence
  Synthetic Oligonucleotide; PD-L1 exons 4 and 5; Set C
uaaacaaaaagaagucagggcuuu

SEQ ID NO: 21425 - RNA, 22 nt, Artificial Sequence
  Synthetic Oligonucleotide; PD-L1 exons 4 and 5; Set C
aaacaaaaagaagucagggcuu

SEQ ID NO: 21426 - RNA, 23 nt, Artificial Sequence
  Synthetic Oligonucleotide; PD-L1 exons 4 and 5; Set C
uaaacaaaaagaagucagggcuu

SEQ ID NO: 21427 - RNA, 21 nt, Artificial Sequence
  Synthetic Oligonucleotide; PD-L1 exons 4 and 5; Set C
aaacaaaaagaagucagggcu

SEQ ID NO: 21428 - RNA, 22 nt, Artificial Sequence
  Synthetic Oligonucleotide; PD-L1 exons 4 and 5; Set C
uaaacaaaaagaagucagggcu

SEQ ID NO: 21429 - RNA, 21 nt, Artificial Sequence
  Synthetic Oligonucleotide; PD-L1 exons 4 and 5; Set C
uaaacaaaaagaagucagggc

SEQ ID NO: 21430 - RNA, 20 nt, Artificial Sequence
  Synthetic Oligonucleotide; PD-L1 exons 4 and 5; Set C
uaaacaaaaagaagucaggg

SEQ ID NO: 21431 - RNA, 15 nt, Artificial Sequence
  Synthetic Oligonucleotide; PD-L1 exons 4 and 5; Set C
uaaacaaaaagaagu

SEQ ID NO: 21432 - RNA, 16 nt, Artificial Sequence
  Synthetic Oligonucleotide; PD-L1 exons 4 and 5; Set C
ggacauaaacaaaaag

SEQ ID NO: 21433 - RNA, 17 nt, Artificial Sequence
  Synthetic Oligonucleotide; PD-L1 exons 4 and 5; Set C
aggacauaaacaaaaag

SEQ ID NO: 21434 - RNA, 15 nt, Artificial Sequence
  Synthetic Oligonucleotide; PD-L1 exons 4 and 5; Set C
ggacauaaacaaaaa

SEQ ID NO: 21435 - RNA, 18 nt, Artificial Sequence
  Synthetic Oligonucleotide; PD-L1 exons 4 and 5; Set C
uaggacauaaacaaaaag

SEQ ID NO: 21436 - RNA, 16 nt, Artificial Sequence
  Synthetic Oligonucleotide; PD-L1 exons 4 and 5; Set C
aggacauaaacaaaaa

SEQ ID NO: 21437 - RNA, 17 nt, Artificial Sequence
  Synthetic Oligonucleotide; PD-L1 exons 4 and 5; Set C
uaggacauaaacaaaaa

SEQ ID NO: 21438 - RNA, 15 nt, Artificial Sequence
  Synthetic Oligonucleotide; PD-L1 exons 4 and 5; Set C
aggacauaaacaaaa

SEQ ID NO: 21439 - RNA, 20 nt, Artificial Sequence
  Synthetic Oligonucleotide; PD-L1 exons 4 and 5; Set C
gcuaggacauaaacaaaaag

SEQ ID NO: 21440 - RNA, 18 nt, Artificial Sequence
  Synthetic Oligonucleotide; PD-L1 exons 4 and 5; Set C
cuaggacauaaacaaaaa

SEQ ID NO: 21441 - RNA, 16 nt, Artificial Sequence
  Synthetic Oligonucleotide; PD-L1 exons 4 and 5; Set C
uaggacauaaacaaaa

SEQ ID NO: 21442 - RNA, 21 nt, Artificial Sequence
  Synthetic Oligonucleotide; PD-L1 exons 4 and 5; Set C
ggcuaggacauaaacaaaaag

SEQ ID NO: 21443 - RNA, 19 nt, Artificial Sequence
  Synthetic Oligonucleotide; PD-L1 exons 4 and 5; Set C
gcuaggacauaaacaaaaa

SEQ ID NO: 21444 - RNA, 17 nt, Artificial Sequence
  Synthetic Oligonucleotide; PD-L1 exons 4 and 5; Set C
cuaggacauaaacaaaa

SEQ ID NO: 21445 - RNA, 20 nt, Artificial Sequence
  Synthetic Oligonucleotide; PD-L1 exons 4 and 5; Set C
ggcuaggacauaaacaaaaa

SEQ ID NO: 21446 - RNA, 18 nt, Artificial Sequence
  Synthetic Oligonucleotide; PD-L1 exons 4 and 5; Set C
gcuaggacauaaacaaaa

SEQ ID NO: 21447 - RNA, 23 nt, Artificial Sequence
  Synthetic Oligonucleotide; PD-L1 exons 4 and 5; Set C
ggggcuaggacauaaacaaaaag

SEQ ID NO: 21448 - RNA, 21 nt, Artificial Sequence
  Synthetic Oligonucleotide; PD-L1 exons 4 and 5; Set C
gggcuaggacauaaacaaaaa

SEQ ID NO: 21449 - RNA, 19 nt, Artificial Sequence
  Synthetic Oligonucleotide; PD-L1 exons 4 and 5; Set C
ggcuaggacauaaacaaaa

SEQ ID NO: 21450 - RNA, 24 nt, Artificial Sequence
  Synthetic Oligonucleotide; PD-L1 exons 4 and 5; Set C
uggggcuaggacauaaacaaaaag

SEQ ID NO: 21451 - RNA, 22 nt, Artificial Sequence
  Synthetic Oligonucleotide; PD-L1 exons 4 and 5; Set C
ggggcuaggacauaaacaaaaa

SEQ ID NO: 21452 - RNA, 20 nt, Artificial Sequence
  Synthetic Oligonucleotide; PD-L1 exons 4 and 5; Set C
gggcuaggacauaaacaaaa

SEQ ID NO: 21453 - RNA, 25 nt, Artificial Sequence
  Synthetic Oligonucleotide; PD-L1 exons 4 and 5; Set C
auggggcuaggacauaaacaaaaag

SEQ ID NO: 21454 - RNA, 23 nt, Artificial Sequence
  Synthetic Oligonucleotide; PD-L1 exons 4 and 5; Set C
uggggcuaggacauaaacaaaaa

SEQ ID NO: 21455 - RNA, 21 nt, Artificial Sequence
  Synthetic Oligonucleotide; PD-L1 exons 4 and 5; Set C
ggggcuaggacauaaacaaaa

SEQ ID NO: 21456 - RNA, 26 nt, Artificial Sequence
  Synthetic Oligonucleotide; PD-L1 exons 4 and 5; Set C
uauggggcuaggacauaaacaaaaag

SEQ ID NO: 21457 - RNA, 24 nt, Artificial Sequence
  Synthetic Oligonucleotide; PD-L1 exons 4 and 5; Set C
auggggcuaggacauaaacaaaaa

SEQ ID NO: 21458 - RNA, 22 nt, Artificial Sequence
  Synthetic Oligonucleotide; PD-L1 exons 4 and 5; Set C
uggggcuaggacauaaacaaaa

SEQ ID NO: 21459 - RNA, 27 nt, Artificial Sequence
  Synthetic Oligonucleotide; PD-L1 exons 4 and 5; Set C
guauggggcuaggacauaaacaaaaag

SEQ ID NO: 21460 - RNA, 25 nt, Artificial Sequence
  Synthetic Oligonucleotide; PD-L1 exons 4 and 5; Set C
uauggggcuaggacauaaacaaaaa

SEQ ID NO: 21461 - RNA, 23 nt, Artificial Sequence
  Synthetic Oligonucleotide; PD-L1 exons 4 and 5; Set C
auggggcuaggacauaaacaaaa

SEQ ID NO: 21462 - RNA, 26 nt, Artificial Sequence
  Synthetic Oligonucleotide; PD-L1 exons 4 and 5; Set C
guauggggcuaggacauaaacaaaaa

SEQ ID NO: 21463 - RNA, 24 nt, Artificial Sequence
  Synthetic Oligonucleotide; PD-L1 exons 4 and 5; Set C
uauggggcuaggacauaaacaaaa

SEQ ID NO: 21464 - RNA, 27 nt, Artificial Sequence
  Synthetic Oligonucleotide; PD-L1 exons 4 and 5; Set C
uguauggggcuaggacauaaacaaaaa

SEQ ID NO: 21465 - RNA, 25 nt, Artificial Sequence
  Synthetic Oligonucleotide; PD-L1 exons 4 and 5; Set C
guauggggcuaggacauaaacaaaa

SEQ ID NO: 21466 - RNA, 15 nt, Artificial Sequence
  Synthetic Oligonucleotide; PD-L1 exons 4 and 5; Set C
gggcuaggacauaaa

SEQ ID NO: 21467 - RNA, 28 nt, Artificial Sequence
  Synthetic Oligonucleotide; PD-L1 exons 4 and 5; Set C
uuguauggggcuaggacauaaacaaaaa

SEQ ID NO: 21468 - RNA, 26 nt, Artificial Sequence
  Synthetic Oligonucleotide; PD-L1 exons 4 and 5; Set C
uguauggggcuaggacauaaacaaaa

SEQ ID NO: 21469 - RNA, 16 nt, Artificial Sequence
  Synthetic Oligonucleotide; PD-L1 exons 4 and 5; Set C
ggggcuaggacauaaa

SEQ ID NO: 21470 - RNA, 29 nt, Artificial Sequence
  Synthetic Oligonucleotide; PD-L1 exons 4 and 5; Set A
guuguauggggcuaggacauaaacaaaaa

SEQ ID NO: 21471 - RNA, 27 nt, Artificial Sequence
  Synthetic Oligonucleotide; PD-L1 exons 4 and 5; Set C
uuguauggggcuaggacauaaacaaaa

SEQ ID NO: 21472 - RNA, 15 nt, Artificial Sequence
  Synthetic Oligonucleotide; PD-L1 exons 4 and 5; Set C
ggggcuaggacauaa

SEQ ID NO: 21473 - RNA, 17 nt, Artificial Sequence
  Synthetic Oligonucleotide; PD-L1 exons 4 and 5; Set C
uggggcuaggacauaaa

SEQ ID NO: 21474 - RNA, 25 nt, Artificial Sequence
  Synthetic Oligonucleotide; PD-L1 exons 4 and 5; Set C
uguauggggcuaggacauaaacaaa

SEQ ID NO: 21475 - RNA, 30 nt, Artificial Sequence
  Synthetic Oligonucleotide; PD-L1 exons 4 and 5; Set A
uguuguauggggcuaggacauaaacaaaaa

SEQ ID NO: 21476 - RNA, 28 nt, Artificial Sequence
  Synthetic Oligonucleotide; PD-L1 exons 4 and 5; Set A
guuguauggggcuaggacauaaacaaaa

SEQ ID NO: 21477 - RNA, 16 nt, Artificial Sequence
  Synthetic Oligonucleotide; PD-L1 exons 4 and 5; Set C
uggggcuaggacauaa

SEQ ID NO: 21478 - RNA, 18 nt, Artificial Sequence
  Synthetic Oligonucleotide; PD-L1 exons 4 and 5; Set C
auggggcuaggacauaaa

SEQ ID NO: 21479 - RNA, 26 nt, Artificial Sequence
  Synthetic Oligonucleotide; PD-L1 exons 4 and 5; Set A
uuguauggggcuaggacauaaacaaa

SEQ ID NO: 21480 - RNA, 31 nt, Artificial Sequence
  Synthetic Oligonucleotide; PD-L1 exons 4 and 5; Set A
uuguuguauggggcuaggacauaaacaaaaa

SEQ ID NO: 21481 - RNA, 29 nt, Artificial Sequence
  Synthetic Oligonucleotide; PD-L1 exons 4 and 5; Set A
uguuguauggggcuaggacauaaacaaaa

SEQ ID NO: 21482 - RNA, 17 nt, Artificial Sequence
  Synthetic Oligonucleotide; PD-L1 exons 4 and 5; Set C
auggggcuaggacauaa

SEQ ID NO: 21483 - RNA, 19 nt, Artificial Sequence
  Synthetic Oligonucleotide; PD-L1 exons 4 and 5; Set C
uauggggcuaggacauaaa

SEQ ID NO: 21484 - RNA, 27 nt, Artificial Sequence
  Synthetic Oligonucleotide; PD-L1 exons 4 and 5; Set A
guuguauggggcuaggacauaaacaaa

SEQ ID NO: 21485 - RNA, 15 nt, Artificial Sequence
  Synthetic Oligonucleotide; PD-L1 exons 4 and 5; Set C
uggggcuaggacaua

SEQ ID NO: 21486 - RNA, 32 nt, Artificial Sequence
  Synthetic Oligonucleotide; PD-L1 exons 4 and 5; Set A
uuuguuguauggggcuaggacauaaacaaaaa

SEQ ID NO: 21487 - RNA, 30 nt, Artificial Sequence
  Synthetic Oligonucleotide; PD-L1 exons 4 and 5; Set A
uuguuguauggggcuaggacauaaacaaaa

SEQ ID NO: 21488 - RNA, 18 nt, Artificial Sequence
  Synthetic Oligonucleotide; PD-L1 exons 4 and 5; Set C
uauggggcuaggacauaa

SEQ ID NO: 21489 - RNA, 20 nt, Artificial Sequence
  Synthetic Oligonucleotide; PD-L1 exons 4 and 5; Set C
guauggggcuaggacauaaa

SEQ ID NO: 21490 - RNA, 28 nt, Artificial Sequence
  Synthetic Oligonucleotide; PD-L1 exons 4 and 5; Set A
uguuguauggggcuaggacauaaacaaa

SEQ ID NO: 21491 - RNA, 16 nt, Artificial Sequence
  Synthetic Oligonucleotide; PD-L1 exons 4 and 5; Set C
auggggcuaggacaua

SEQ ID NO: 21492 - RNA, 33 nt, Artificial Sequence
  Synthetic Oligonucleotide; PD-L1 exons 4 and 5; Set A
uuuuguuguauggggcuaggacauaaacaaaaa

SEQ ID NO: 21493 - RNA, 31 nt, Artificial Sequence
  Synthetic Oligonucleotide; PD-L1 exons 4 and 5; Set A
uuuguuguauggggcuaggacauaaacaaaa

SEQ ID NO: 21494 - RNA, 19 nt, Artificial Sequence
  Synthetic Oligonucleotide; PD-L1 exons 4 and 5; Set C
guauggggcuaggacauaa

SEQ ID NO: 21495 - RNA, 21 nt, Artificial Sequence
  Synthetic Oligonucleotide; PD-L1 exons 4 and 5; Set C
uguauggggcuaggacauaaa

SEQ ID NO: 21496 - RNA, 29 nt, Artificial Sequence
  Synthetic Oligonucleotide; PD-L1 exons 4 and 5; Set A
uuguuguauggggcuaggacauaaacaaa

SEQ ID NO: 21497 - RNA, 17 nt, Artificial Sequence
  Synthetic Oligonucleotide; PD-L1 exons 4 and 5; Set C
uauggggcuaggacaua

SEQ ID NO: 21498 - RNA, 34 nt, Artificial Sequence
  Synthetic Oligonucleotide; PD-L1 exons 4 and 5; Set A
auuuuguuguauggggcuaggacauaaacaaaaa

SEQ ID NO: 21499 - RNA, 20 nt, Artificial Sequence
  Synthetic Oligonucleotide; PD-L1 exons 4 and 5; Set C
uguauggggcuaggacauaa

SEQ ID NO: 21500 - RNA, 32 nt, Artificial Sequence
  Synthetic Oligonucleotide; PD-L1 exons 4 and 5; Set A
uuuuguuguauggggcuaggacauaaacaaaa

SEQ ID NO: 21501 - RNA, 22 nt, Artificial Sequence
  Synthetic Oligonucleotide; PD-L1 exons 4 and 5; Set C
uuguauggggcuaggacauaaa

SEQ ID NO: 21502 - RNA, 30 nt, Artificial Sequence
  Synthetic Oligonucleotide; PD-L1 exons 4 and 5; Set A
uuuguuguauggggcuaggacauaaacaaa

SEQ ID NO: 21503 - RNA, 18 nt, Artificial Sequence
  Synthetic Oligonucleotide; PD-L1 exons 4 and 5; Set C
guauggggcuaggacaua

SEQ ID NO: 21504 - RNA, 21 nt, Artificial Sequence
  Synthetic Oligonucleotide; PD-L1 exons 4 and 5; Set C
uuguauggggcuaggacauaa

SEQ ID NO: 21505 - RNA, 33 nt, Artificial Sequence
  Synthetic Oligonucleotide; PD-L1 exons 4 and 5; Set A
auuuuguuguauggggcuaggacauaaacaaaa

SEQ ID NO: 21506 - RNA, 23 nt, Artificial Sequence
  Synthetic Oligonucleotide; PD-L1 exons 4 and 5; Set A
guuguauggggcuaggacauaaa

SEQ ID NO: 21507 - RNA, 31 nt, Artificial Sequence
  Synthetic Oligonucleotide; PD-L1 exons 4 and 5; Set A
uuuuguuguauggggcuaggacauaaacaaa

SEQ ID NO: 21508 - RNA, 19 nt, Artificial Sequence
  Synthetic Oligonucleotide; PD-L1 exons 4 and 5; Set C
uguauggggcuaggacaua

SEQ ID NO: 21509 - RNA, 22 nt, Artificial Sequence
  Synthetic Oligonucleotide; PD-L1 exons 4 and 5; Set A
guuguauggggcuaggacauaa

SEQ ID NO: 21510 - RNA, 24 nt, Artificial Sequence
  Synthetic Oligonucleotide; PD-L1 exons 4 and 5; Set A
uguuguauggggcuaggacauaaa

SEQ ID NO: 21511 - RNA, 32 nt, Artificial Sequence
  Synthetic Oligonucleotide; PD-L1 exons 4 and 5; Set A
auuuuguuguauggggcuaggacauaaacaaa

SEQ ID NO: 21512 - RNA, 20 nt, Artificial Sequence
  Synthetic Oligonucleotide; PD-L1 exons 4 and 5; Set C
uuguauggggcuaggacaua

SEQ ID NO: 21513 - RNA, 23 nt, Artificial Sequence
  Synthetic Oligonucleotide; PD-L1 exons 4 and 5; Set A
uguuguauggggcuaggacauaa

SEQ ID NO: 21514 - RNA, 25 nt, Artificial Sequence
  Synthetic Oligonucleotide; PD-L1 exons 4 and 5; Set A
uuguuguauggggcuaggacauaaa

SEQ ID NO: 21515 - RNA, 21 nt, Artificial Sequence
  Synthetic Oligonucleotide; PD-L1 exons 4 and 5; Set A
guuguauggggcuaggacaua

SEQ ID NO: 21516 - RNA, 15 nt, Artificial Sequence
  Synthetic Oligonucleotide; PD-L1 exons 4 and 5; Set C
guauggggcuaggac

SEQ ID NO: 21517 - RNA, 24 nt, Artificial Sequence
  Synthetic Oligonucleotide; PD-L1 exons 4 and 5; Set A
uuguuguauggggcuaggacauaa

SEQ ID NO: 21518 - RNA, 26 nt, Artificial Sequence
  Synthetic Oligonucleotide; PD-L1 exons 4 and 5; Set A
uuuguuguauggggcuaggacauaaa

SEQ ID NO: 21519 - RNA, 22 nt, Artificial Sequence
  Synthetic Oligonucleotide; PD-L1 exons 4 and 5; Set A
uguuguauggggcuaggacaua

SEQ ID NO: 21520 - RNA, 16 nt, Artificial Sequence
  Synthetic Oligonucleotide; PD-L1 exons 4 and 5; Set C
uguauggggcuaggac

SEQ ID NO: 21521 - RNA, 25 nt, Artificial Sequence
  Synthetic Oligonucleotide; PD-L1 exons 4 and 5; Set A
uuuguuguauggggcuaggacauaa

SEQ ID NO: 21522 - RNA, 27 nt, Artificial Sequence
  Synthetic Oligonucleotide; PD-L1 exons 4 and 5; Set A
uuuuguuguauggggcuaggacauaaa

SEQ ID NO: 21523 - RNA, 23 nt, Artificial Sequence
  Synthetic Oligonucleotide; PD-L1 exons 4 and 5; Set A
uuguuguauggggcuaggacaua

SEQ ID NO: 21524 - RNA, 17 nt, Artificial Sequence
  Synthetic Oligonucleotide; PD-L1 exons 4 and 5; Set C
uuguauggggcuaggac

SEQ ID NO: 21525 - RNA, 26 nt, Artificial Sequence
  Synthetic Oligonucleotide; PD-L1 exons 4 and 5; Set A
uuuuguuguauggggcuaggacauaa

SEQ ID NO: 21526 - RNA, 28 nt, Artificial Sequence
  Synthetic Oligonucleotide; PD-L1 exons 4 and 5; Set A
auuuuguuguauggggcuaggacauaaa

SEQ ID NO: 21527 - RNA, 24 nt, Artificial Sequence
  Synthetic Oligonucleotide; PD-L1 exons 4 and 5; Set A
uuuguuguauggggcuaggacaua

SEQ ID NO: 21528 - RNA, 18 nt, Artificial Sequence
  Synthetic Oligonucleotide; PD-L1 exons 4 and 5; Set C
guuguauggggcuaggac

SEQ ID NO: 21529 - RNA, 27 nt, Artificial Sequence
  Synthetic Oligonucleotide; PD-L1 exons 4 and 5; Set A
auuuuguuguauggggcuaggacauaa

SEQ ID NO: 21530 - RNA, 25 nt, Artificial Sequence
  Synthetic Oligonucleotide; PD-L1 exons 4 and 5; Set A
uuuuguuguauggggcuaggacaua

SEQ ID NO: 21531 - RNA, 19 nt, Artificial Sequence
  Synthetic Oligonucleotide; PD-L1 exons 4 and 5; Set C
uguuguauggggcuaggac

SEQ ID NO: 21532 - RNA, 26 nt, Artificial Sequence
  Synthetic Oligonucleotide; PD-L1 exons 4 and 5; Set A
auuuuguuguauggggcuaggacaua

SEQ ID NO: 21533 - RNA, 20 nt, Artificial Sequence
  Synthetic Oligonucleotide; PD-L1 exons 4 and 5; Set A
uuguuguauggggcuaggac

SEQ ID NO: 21534 - RNA, 21 nt, Artificial Sequence
  Synthetic Oligonucleotide; PD-L1 exons 4 and 5; Set A
uuuguuguauggggcuaggac

SEQ ID NO: 21535 - RNA, 22 nt, Artificial Sequence
  Synthetic Oligonucleotide; PD-L1 exons 4 and 5; Set A
uuuuguuguauggggcuaggac

SEQ ID NO: 21536 - RNA, 23 nt, Artificial Sequence
  Synthetic Oligonucleotide; PD-L1 exons 4 and 5; Set A
auuuuguuguauggggcuaggac

SEQ ID NO: 21537 - RNA, 22 nt, Artificial Sequence
  Synthetic Oligonucleotide; PD-L1 exons 4 and 5; Set C
gauuuuguuguauggggcuagg

SEQ ID NO: 21538 - RNA, 21 nt, Artificial Sequence
  Synthetic Oligonucleotide; PD-L1 exons 4 and 5; Set C
gauuuuguuguauggggcuag

SEQ ID NO: 21539 - RNA, 39 nt, Artificial Sequence
  Synthetic Oligonucleotide; PD-L1 exons 4 and 5; Set C
auucuuugguugauuuuguuguauggggcuaggacauaa

SEQ ID NO: 21540 - RNA, 26 nt, Artificial Sequence
  Synthetic Oligonucleotide; PD-L1 exons 4 and 5; Set C
uucuuugguugauuuuguuguauggg

SEQ ID NO: 21541 - RNA, 27 nt, Artificial Sequence
  Synthetic Oligonucleotide; PD-L1 exons 4 and 5; Set C
auucuuugguugauuuuguuguauggg

SEQ ID NO: 21542 - RNA, 25 nt, Artificial Sequence
  Synthetic Oligonucleotide; PD-L1 exons 4 and 5; Set C
uucuuugguugauuuuguuguaugg

SEQ ID NO: 21543 - RNA, 26 nt, Artificial Sequence
  Synthetic Oligonucleotide; PD-L1 exons 4 and 5; Set C
auucuuugguugauuuuguuguaugg

SEQ ID NO: 21544 - RNA, 24 nt, Artificial Sequence
  Synthetic Oligonucleotide; PD-L1 exons 4 and 5; Set C
uucuuugguugauuuuguuguaug

SEQ ID NO: 21545 - RNA, 23 nt, Artificial Sequence
  Synthetic Oligonucleotide; PD-L1 exons 4 and 5; Set C
uucuuugguugauuuuguuguau

SEQ ID NO: 21546 - RNA, 25 nt, Artificial Sequence
  Synthetic Oligonucleotide; PD-L1 exons 4 and 5; Set C
auucuuugguugauuuuguuguaug

SEQ ID NO: 21547 - RNA, 22 nt, Artificial Sequence
  Synthetic Oligonucleotide; PD-L1 exons 4 and 5; Set C
uucuuugguugauuuuguugua

SEQ ID NO: 21548 - RNA, 24 nt, Artificial Sequence
  Synthetic Oligonucleotide; PD-L1 exons 4 and 5; Set C
auucuuugguugauuuuguuguau

SEQ ID NO: 21549 - RNA, 21 nt, Artificial Sequence
  Synthetic Oligonucleotide; PD-L1 exons 4 and 5; Set C
uucuuugguugauuuuguugu

SEQ ID NO: 21550 - RNA, 23 nt, Artificial Sequence
  Synthetic Oligonucleotide; PD-L1 exons 4 and 5; Set C
auucuuugguugauuuuguugua

SEQ ID NO: 21551 - RNA, 20 nt, Artificial Sequence
  Synthetic Oligonucleotide; PD-L1 exons 4 and 5; Set C
uucuuugguugauuuuguug

SEQ ID NO: 21552 - RNA, 22 nt, Artificial Sequence
  Synthetic Oligonucleotide; PD-L1 exons 4 and 5; Set C
auucuuugguugauuuuguugu

SEQ ID NO: 21553 - RNA, 21 nt, Artificial Sequence
  Synthetic Oligonucleotide; PD-L1 exons 4 and 5; Set C
auucuuugguugauuuuguug

SEQ ID NO: 21554 - RNA, 19 nt, Artificial Sequence
  Synthetic Oligonucleotide; PD-L1 exons 4 and 5; Set C
uucuuugguugauuuuguu

SEQ ID NO: 21555 - RNA, 18 nt, Artificial Sequence
  Synthetic Oligonucleotide; PD-L1 exons 4 and 5; Set C
uucuuugguugauuuugu

SEQ ID NO: 21556 - RNA, 20 nt, Artificial Sequence
  Synthetic Oligonucleotide; PD-L1 exons 4 and 5; Set C
auucuuugguugauuuuguu

SEQ ID NO: 21557 - RNA, 19 nt, Artificial Sequence
  Synthetic Oligonucleotide; PD-L1 exons 4 and 5; Set C
auucuuugguugauuuugu

SEQ ID NO: 21558 - RNA, 18 nt, Artificial Sequence
  Synthetic Oligonucleotide; PD-L1 exons 4 and 5; Set C
auucuuugguugauuuug

SEQ ID NO: 21559 - RNA, 26 nt, Artificial Sequence
  Synthetic Oligonucleotide; PD-L1 exons 4 and 5; Set A
ggugacuggauccacaaccaaaauuc

SEQ ID NO: 21560 - RNA, 39 nt, Artificial Sequence
  Synthetic Oligonucleotide; PD-L1 exons 4 and 5; Set C
guucauguucagaggugacuggauccacaaccaaaauuc

SEQ ID NO: 21561 - RNA, 15 nt, Artificial Sequence
  Synthetic Oligonucleotide; PD-L1 exons 4 and 5; Set C
aggugacuggaucca

SEQ ID NO: 21562 - RNA, 38 nt, Artificial Sequence
  Synthetic Oligonucleotide; PD-L1 exons 4 and 5; Set C
guucauguucagaggugacuggauccacaaccaaaauu

SEQ ID NO: 21563 - RNA, 40 nt, Artificial Sequence
  Synthetic Oligonucleotide; PD-L1 exons 4 and 5; Set C
aguucauguucagaggugacuggauccacaaccaaaauuc

SEQ ID NO: 21564 - RNA, 39 nt, Artificial Sequence
  Synthetic Oligonucleotide; PD-L1 exons 4 and 5; Set C
aguucauguucagaggugacuggauccacaaccaaaauu

SEQ ID NO: 21565 - RNA, 40 nt, Artificial Sequence
  Synthetic Oligonucleotide; PD-L1 exons 4 and 5; Set C
caguucauguucagaggugacuggauccacaaccaaaauu

SEQ ID NO: 21566 - RNA, 19 nt, Artificial Sequence
  Synthetic Oligonucleotide; PD-L1 exons 4 and 5; Set A
ucagaggugacuggaucca

SEQ ID NO: 21567 - RNA, 18 nt, Artificial Sequence
  Synthetic Oligonucleotide; PD-L1 exons 4 and 5; Set C
ucagaggugacuggaucc

SEQ ID NO: 21568 - RNA, 20 nt, Artificial Sequence
  Synthetic Oligonucleotide; PD-L1 exons 4 and 5; Set A
uucagaggugacuggaucca

SEQ ID NO: 21569 - RNA, 17 nt, Artificial Sequence
  Synthetic Oligonucleotide; PD-L1 exons 4 and 5; Set C
ucagaggugacuggauc

SEQ ID NO: 21570 - RNA, 19 nt, Artificial Sequence
  Synthetic Oligonucleotide; PD-L1 exons 4 and 5; Set C
uucagaggugacuggaucc

SEQ ID NO: 21571 - RNA, 16 nt, Artificial Sequence
  Synthetic Oligonucleotide; PD-L1 exons 4 and 5; Set C
ucagaggugacuggau

SEQ ID NO: 21572 - RNA, 18 nt, Artificial Sequence
  Synthetic Oligonucleotide; PD-L1 exons 4 and 5; Set C
uucagaggugacuggauc

SEQ ID NO: 21573 - RNA, 17 nt, Artificial Sequence
  Synthetic Oligonucleotide; PD-L1 exons 4 and 5; Set C
uucagaggugacuggau

SEQ ID NO: 21574 - RNA, 15 nt, Artificial Sequence
  Synthetic Oligonucleotide; PD-L1 exons 4 and 5; Set C
ucagaggugacugga

SEQ ID NO: 21575 - RNA, 16 nt, Artificial Sequence
  Synthetic Oligonucleotide; PD-L1 exons 4 and 5; Set C
uucagaggugacugga

SEQ ID NO: 21576 - RNA, 16 nt, Artificial Sequence
  Synthetic Oligonucleotide; PD-L1 exons 4 and 5; Set C
guucagaggugacugg

SEQ ID NO: 21577 - RNA, 17 nt, Artificial Sequence
  Synthetic Oligonucleotide; PD-L1 exons 4 and 5; Set C
uguucagaggugacugg

SEQ ID NO: 21578 - RNA, 18 nt, Artificial Sequence
  Synthetic Oligonucleotide; PD-L1 exons 4 and 5; Set C
auguucagaggugacugg

SEQ ID NO: 21579 - RNA, 31 nt, Artificial Sequence
  Synthetic Oligonucleotide; PD-L1 exons 4 and 5; Set C
gucaguucauguucagaggugacuggaucca

SEQ ID NO: 21580 - RNA, 30 nt, Artificial Sequence
  Synthetic Oligonucleotide; PD-L1 exons 4 and 5; Set C
gucaguucauguucagaggugacuggaucc

SEQ ID NO: 21581 - RNA, 32 nt, Artificial Sequence
  Synthetic Oligonucleotide; PD-L1 exons 4 and 5; Set C
ugucaguucauguucagaggugacuggaucca

SEQ ID NO: 21582 - RNA, 22 nt, Artificial Sequence
  Synthetic Oligonucleotide; PD-L1 exons 4 and 5; Set A
guucauguucagaggugacugg

SEQ ID NO: 21583 - RNA, 29 nt, Artificial Sequence
  Synthetic Oligonucleotide; PD-L1 exons 4 and 5; Set A
gucaguucauguucagaggugacuggauc

SEQ ID NO: 21584 - RNA, 31 nt, Artificial Sequence
  Synthetic Oligonucleotide; PD-L1 exons 4 and 5; Set C
ugucaguucauguucagaggugacuggaucc

SEQ ID NO: 21585 - RNA, 33 nt, Artificial Sequence
  Synthetic Oligonucleotide; PD-L1 exons 4 and 5; Set C
augucaguucauguucagaggugacuggaucca

SEQ ID NO: 21586 - RNA, 23 nt, Artificial Sequence
  Synthetic Oligonucleotide; PD-L1 exons 4 and 5; Set A
aguucauguucagaggugacugg

SEQ ID NO: 21587 - RNA, 28 nt, Artificial Sequence
  Synthetic Oligonucleotide; PD-L1 exons 4 and 5; Set A
gucaguucauguucagaggugacuggau

SEQ ID NO: 21588 - RNA, 30 nt, Artificial Sequence
  Synthetic Oligonucleotide; PD-L1 exons 4 and 5; Set A
ugucaguucauguucagaggugacuggauc

SEQ ID NO: 21589 - RNA, 32 nt, Artificial Sequence
  Synthetic Oligonucleotide; PD-L1 exons 4 and 5; Set C
augucaguucauguucagaggugacuggaucc

SEQ ID NO: 21590 - RNA, 24 nt, Artificial Sequence
  Synthetic Oligonucleotide; PD-L1 exons 4 and 5; Set A
caguucauguucagaggugacugg

SEQ ID NO: 21591 - RNA, 29 nt, Artificial Sequence
  Synthetic Oligonucleotide; PD-L1 exons 4 and 5; Set A
ugucaguucauguucagaggugacuggau

SEQ ID NO: 21592 - RNA, 27 nt, Artificial Sequence
  Synthetic Oligonucleotide; PD-L1 exons 4 and 5; Set A
gucaguucauguucagaggugacugga

SEQ ID NO: 21593 - RNA, 31 nt, Artificial Sequence
  Synthetic Oligonucleotide; PD-L1 exons 4 and 5; Set A
augucaguucauguucagaggugacuggauc

SEQ ID NO: 21594 - RNA, 30 nt, Artificial Sequence
  Synthetic Oligonucleotide; PD-L1 exons 4 and 5; Set A
augucaguucauguucagaggugacuggau

SEQ ID NO: 21595 - RNA, 28 nt, Artificial Sequence
  Synthetic Oligonucleotide; PD-L1 exons 4 and 5; Set A
ugucaguucauguucagaggugacugga

SEQ ID NO: 21596 - RNA, 16 nt, Artificial Sequence
  Synthetic Oligonucleotide; PD-L1 exons 4 and 5; Set C
aguucauguucagagg

SEQ ID NO: 21597 - RNA, 17 nt, Artificial Sequence
  Synthetic Oligonucleotide; PD-L1 exons 4 and 5; Set C
caguucauguucagagg

SEQ ID NO: 21598 - RNA, 20 nt, Artificial Sequence
  Synthetic Oligonucleotide; PD-L1 exons 4 and 5; Set C
gucaguucauguucagaggu

SEQ ID NO: 21599 - RNA, 18 nt, Artificial Sequence
  Synthetic Oligonucleotide; PD-L1 exons 4 and 5; Set C
ucaguucauguucagagg

SEQ ID NO: 21600 - RNA, 21 nt, Artificial Sequence
  Synthetic Oligonucleotide; PD-L1 exons 4 and 5; Set C
ugucaguucauguucagaggu

SEQ ID NO: 21601 - RNA, 40 nt, Artificial Sequence
  Synthetic Oligonucleotide; PD-L1 exons 4 and 5; Set C
cagccugacaugucaguucauguucagaggugacuggauc

SEQ ID NO: 21602 - RNA, 39 nt, Artificial Sequence
  Synthetic Oligonucleotide; PD-L1 exons 4 and 5; Set C
cagccugacaugucaguucauguucagaggugacuggau

SEQ ID NO: 21603 - RNA, 40 nt, Artificial Sequence
  Synthetic Oligonucleotide; PD-L1 exons 4 and 5; Set C
ucagccugacaugucaguucauguucagaggugacuggau

SEQ ID NO: 21604 - RNA, 38 nt, Artificial Sequence
  Synthetic Oligonucleotide; PD-L1 exons 4 and 5; Set C
cagccugacaugucaguucauguucagaggugacugga

SEQ ID NO: 21605 - RNA, 40 nt, Artificial Sequence
  Synthetic Oligonucleotide; PD-L1 exons 4 and 5; Set C
uagcccucagccugacaugucaguucauguucagagguga

SEQ ID NO: 21606 - RNA, 39 nt, Artificial Sequence
  Synthetic Oligonucleotide; PD-L1 exons 4 and 5; Set C
uagcccucagccugacaugucaguucauguucagaggug

SEQ ID NO: 21607 - RNA, 38 nt, Artificial Sequence
  Synthetic Oligonucleotide; PD-L1 exons 4 and 5; Set C
uagcccucagccugacaugucaguucauguucagaggu

SEQ ID NO: 21608 - RNA, 40 nt, Artificial Sequence
  Synthetic Oligonucleotide; PD-L1 exons 4 and 5; Set C
guagcccucagccugacaugucaguucauguucagaggug

SEQ ID NO: 21609 - RNA, 39 nt, Artificial Sequence
  Synthetic Oligonucleotide; PD-L1 exons 4 and 5; Set C
guagcccucagccugacaugucaguucauguucagaggu

SEQ ID NO: 21610 - RNA, 40 nt, Artificial Sequence
  Synthetic Oligonucleotide; PD-L1 exons 4 and 5; Set C
gguagcccucagccugacaugucaguucauguucagaggu

SEQ ID NO: 21611 - RNA, 26 nt, Artificial Sequence
  Synthetic Oligonucleotide; PD-L1 exons 4 and 5; Set C
guagcccucagccugacaugucaguu

SEQ ID NO: 21612 - RNA, 25 nt, Artificial Sequence
  Synthetic Oligonucleotide; PD-L1 exons 4 and 5; Set C
guagcccucagccugacaugucagu

SEQ ID NO: 21613 - RNA, 27 nt, Artificial Sequence
  Synthetic Oligonucleotide; PD-L1 exons 4 and 5; Set C
gguagcccucagccugacaugucaguu

SEQ ID NO: 21614 - RNA, 26 nt, Artificial Sequence
  Synthetic Oligonucleotide; PD-L1 exons 4 and 5; Set C
gguagcccucagccugacaugucagu

SEQ ID NO: 21615 - RNA, 28 nt, Artificial Sequence
  Synthetic Oligonucleotide; PD-L1 exons 4 and 5; Set C
ggguagcccucagccugacaugucaguu

SEQ ID NO: 21616 - RNA, 37 nt, Artificial Sequence
  Synthetic Oligonucleotide; PD-L1 exons 4 and 5; Set C
ucggccuugggguagcccucagccugacaugucaguu

SEQ ID NO: 21617 - RNA, 36 nt, Artificial Sequence
  Synthetic Oligonucleotide; PD-L1 exons 4 and 5; Set C
ucggccuugggguagcccucagccugacaugucagu

SEQ ID NO: 21618 - RNA, 38 nt, Artificial Sequence
  Synthetic Oligonucleotide; PD-L1 exons 4 and 5; Set C
uucggccuugggguagcccucagccugacaugucaguu

SEQ ID NO: 21619 - RNA, 35 nt, Artificial Sequence
  Synthetic Oligonucleotide; PD-L1 exons 4 and 5; Set C
ucggccuugggguagcccucagccugacaugucag

SEQ ID NO: 21620 - RNA, 37 nt, Artificial Sequence
  Synthetic Oligonucleotide; PD-L1 exons 4 and 5; Set C
uucggccuugggguagcccucagccugacaugucagu

SEQ ID NO: 21621 - RNA, 39 nt, Artificial Sequence
  Synthetic Oligonucleotide; PD-L1 exons 4 and 5; Set C
cuucggccuugggguagcccucagccugacaugucaguu

SEQ ID NO: 21622 - RNA, 34 nt, Artificial Sequence
  Synthetic Oligonucleotide; PD-L1 exons 4 and 5; Set C
ucggccuugggguagcccucagccugacauguca

SEQ ID NO: 21623 - RNA, 36 nt, Artificial Sequence
  Synthetic Oligonucleotide; PD-L1 exons 4 and 5; Set C
uucggccuugggguagcccucagccugacaugucag

SEQ ID NO: 21624 - RNA, 38 nt, Artificial Sequence
  Synthetic Oligonucleotide; PD-L1 exons 4 and 5; Set C
cuucggccuugggguagcccucagccugacaugucagu

SEQ ID NO: 21625 - RNA, 35 nt, Artificial Sequence
  Synthetic Oligonucleotide; PD-L1 exons 4 and 5; Set C
uucggccuugggguagcccucagccugacauguca

SEQ ID NO: 21626 - RNA, 37 nt, Artificial Sequence
  Synthetic Oligonucleotide; PD-L1 exons 4 and 5; Set C
cuucggccuugggguagcccucagccugacaugucag

SEQ ID NO: 21627 - RNA, 36 nt, Artificial Sequence
  Synthetic Oligonucleotide; PD-L1 exons 4 and 5; Set C
cuucggccuugggguagcccucagccugacauguca

SEQ ID NO: 21628 - RNA, 40 nt, Artificial Sequence
  Synthetic Oligonucleotide; PD-L1 exons 4 and 5; Set C
augacuucggccuugggguagcccucagccugacauguca

SEQ ID NO: 21629 - RNA, 23 nt, Artificial Sequence
  Synthetic Oligonucleotide; PD-L1 exons 4 and 5; Set C
uucggccuugggguagcccucag

SEQ ID NO: 21630 - RNA, 29 nt, Artificial Sequence
  Synthetic Oligonucleotide; PD-L1 exons 4 and 5; Set C
gaugacuucggccuugggguagcccucag

SEQ ID NO: 21631 - RNA, 28 nt, Artificial Sequence
  Synthetic Oligonucleotide; PD-L1 exons 4 and 5; Set C
gaugacuucggccuugggguagcccuca

SEQ ID NO: 21632 - RNA, 16 nt, Artificial Sequence
  Synthetic Oligonucleotide; PD-L1 exons 4 and 5; Set A
acuucggccuuggggu

SEQ ID NO: 21633 - RNA, 17 nt, Artificial Sequence
  Synthetic Oligonucleotide; PD-L1 exons 4 and 5; Set A
gacuucggccuuggggu

SEQ ID NO: 21634 - RNA, 15 nt, Artificial Sequence
  Synthetic Oligonucleotide; PD-L1 exons 4 and 5; Set C
acuucggccuugggg

SEQ ID NO: 21635 - RNA, 35 nt, Artificial Sequence
  Synthetic Oligonucleotide; PD-L1 exons 4 and 5; Set C
uguccagaugacuucggccuugggguagcccucag

SEQ ID NO: 21636 - RNA, 18 nt, Artificial Sequence
  Synthetic Oligonucleotide; PD-L1 exons 4 and 5; Set A
ugacuucggccuuggggu

SEQ ID NO: 21637 - RNA, 16 nt, Artificial Sequence
  Synthetic Oligonucleotide; PD-L1 exons 4 and 5; Set A
gacuucggccuugggg

SEQ ID NO: 21638 - RNA, 36 nt, Artificial Sequence
  Synthetic Oligonucleotide; PD-L1 exons 4 and 5; Set C
uuguccagaugacuucggccuugggguagcccucag

SEQ ID NO: 21639 - RNA, 17 nt, Artificial Sequence
  Synthetic Oligonucleotide; PD-L1 exons 4 and 5; Set A
ugacuucggccuugggg

SEQ ID NO: 21640 - RNA, 37 nt, Artificial Sequence
  Synthetic Oligonucleotide; PD-L1 exons 4 and 5; Set C
cuuguccagaugacuucggccuugggguagcccucag

SEQ ID NO: 21641 - RNA, 35 nt, Artificial Sequence
  Synthetic Oligonucleotide; PD-L1 exons 4 and 5; Set C
uuguccagaugacuucggccuugggguagcccuca

SEQ ID NO: 21642 - RNA, 36 nt, Artificial Sequence
  Synthetic Oligonucleotide; PD-L1 exons 4 and 5; Set C
cuuguccagaugacuucggccuugggguagcccuca

SEQ ID NO: 21643 - RNA, 18 nt, Artificial Sequence
  Synthetic Oligonucleotide; PD-L1 exons 4 and 5; Set C
uguccagaugacuucggc

SEQ ID NO: 21644 - RNA, 17 nt, Artificial Sequence
  Synthetic Oligonucleotide; PD-L1 exons 4 and 5; Set C
uguccagaugacuucgg

SEQ ID NO: 21645 - RNA, 19 nt, Artificial Sequence
  Synthetic Oligonucleotide; PD-L1 exons 4 and 5; Set C
uuguccagaugacuucggc

SEQ ID NO: 21646 - RNA, 18 nt, Artificial Sequence
  Synthetic Oligonucleotide; PD-L1 exons 4 and 5; Set C
uuguccagaugacuucgg

SEQ ID NO: 21647 - RNA, 20 nt, Artificial Sequence
  Synthetic Oligonucleotide; PD-L1 exons 4 and 5; Set A
cuuguccagaugacuucggc

SEQ ID NO: 21648 - RNA, 37 nt, Artificial Sequence
  Synthetic Oligonucleotide; PD-L1 exons 4 and 5; Set C
uggucacugcuuguccagaugacuucggccuuggggu

SEQ ID NO: 21649 - RNA, 19 nt, Artificial Sequence
  Synthetic Oligonucleotide; PD-L1 exons 4 and 5; Set C
cuuguccagaugacuucgg

SEQ ID NO: 21650 - RNA, 36 nt, Artificial Sequence
  Synthetic Oligonucleotide; PD-L1 exons 4 and 5; Set C
uggucacugcuuguccagaugacuucggccuugggg

SEQ ID NO: 21651 - RNA, 37 nt, Artificial Sequence
  Synthetic Oligonucleotide; PD-L1 exons 4 and 5; Set C
auggucacugcuuguccagaugacuucggccuugggg

SEQ ID NO: 21652 - RNA, 15 nt, Artificial Sequence
  Synthetic Oligonucleotide; PD-L1 exons 4 and 5; Set C
cuuguccagaugacu

SEQ ID NO: 21653 - RNA, 30 nt, Artificial Sequence
  Synthetic Oligonucleotide; PD-L1 exons 4 and 5; Set C
auggucacugcuuguccagaugacuucggc

SEQ ID NO: 21654 - RNA, 27 nt, Artificial Sequence
  Synthetic Oligonucleotide; PD-L1 exons 4 and 5; Set C
uggucacugcuuguccagaugacuucg

SEQ ID NO: 21655 - RNA, 29 nt, Artificial Sequence
  Synthetic Oligonucleotide; PD-L1 exons 4 and 5; Set C
auggucacugcuuguccagaugacuucgg

SEQ ID NO: 21656 - RNA, 31 nt, Artificial Sequence
  Synthetic Oligonucleotide; PD-L1 exons 4 and 5; Set C
gauggucacugcuuguccagaugacuucggc

SEQ ID NO: 21657 - RNA, 26 nt, Artificial Sequence
  Synthetic Oligonucleotide; PD-L1 exons 4 and 5; Set A
uggucacugcuuguccagaugacuuc

SEQ ID NO: 21658 - RNA, 30 nt, Artificial Sequence
  Synthetic Oligonucleotide; PD-L1 exons 4 and 5; Set C
gauggucacugcuuguccagaugacuucgg

SEQ ID NO: 21659 - RNA, 32 nt, Artificial Sequence
  Synthetic Oligonucleotide; PD-L1 exons 4 and 5; Set C
ugauggucacugcuuguccagaugacuucggc

SEQ ID NO: 21660 - RNA, 25 nt, Artificial Sequence
  Synthetic Oligonucleotide; PD-L1 exons 4 and 5; Set A
uggucacugcuuguccagaugacuu

SEQ ID NO: 21661 - RNA, 31 nt, Artificial Sequence
  Synthetic Oligonucleotide; PD-L1 exons 4 and 5; Set C
ugauggucacugcuuguccagaugacuucgg

SEQ ID NO: 21662 - RNA, 33 nt, Artificial Sequence
  Synthetic Oligonucleotide; PD-L1 exons 4 and 5; Set C
uugauggucacugcuuguccagaugacuucggc

SEQ ID NO: 21663 - RNA, 26 nt, Artificial Sequence
  Synthetic Oligonucleotide; PD-L1 exons 4 and 5; Set A
auggucacugcuuguccagaugacuu

SEQ ID NO: 21664 - RNA, 32 nt, Artificial Sequence
  Synthetic Oligonucleotide; PD-L1 exons 4 and 5; Set C
uugauggucacugcuuguccagaugacuucgg

SEQ ID NO: 21665 - RNA, 34 nt, Artificial Sequence
  Synthetic Oligonucleotide; PD-L1 exons 4 and 5; Set C
cuugauggucacugcuuguccagaugacuucggc

SEQ ID NO: 21666 - RNA, 27 nt, Artificial Sequence
  Synthetic Oligonucleotide; PD-L1 exons 4 and 5; Set C
gauggucacugcuuguccagaugacuu

SEQ ID NO: 21667 - RNA, 25 nt, Artificial Sequence
  Synthetic Oligonucleotide; PD-L1 exons 4 and 5; Set A
auggucacugcuuguccagaugacu

SEQ ID NO: 21668 - RNA, 33 nt, Artificial Sequence
  Synthetic Oligonucleotide; PD-L1 exons 4 and 5; Set C
cuugauggucacugcuuguccagaugacuucgg

SEQ ID NO: 21669 - RNA, 28 nt, Artificial Sequence
  Synthetic Oligonucleotide; PD-L1 exons 4 and 5; Set C
ugauggucacugcuuguccagaugacuu

SEQ ID NO: 21670 - RNA, 26 nt, Artificial Sequence
  Synthetic Oligonucleotide; PD-L1 exons 4 and 5; Set C
gauggucacugcuuguccagaugacu

SEQ ID NO: 21671 - RNA, 33 nt, Artificial Sequence
  Synthetic Oligonucleotide; PD-L1 exons 4 and 5; Set C
acuugauggucacugcuuguccagaugacuucg

SEQ ID NO: 21672 - RNA, 21 nt, Artificial Sequence
  Synthetic Oligonucleotide; PD-L1 exons 4 and 5; Set A
uggucacugcuuguccagaug

SEQ ID NO: 21673 - RNA, 29 nt, Artificial Sequence
  Synthetic Oligonucleotide; PD-L1 exons 4 and 5; Set C
uugauggucacugcuuguccagaugacuu

SEQ ID NO: 21674 - RNA, 27 nt, Artificial Sequence
  Synthetic Oligonucleotide; PD-L1 exons 4 and 5; Set C
ugauggucacugcuuguccagaugacu

SEQ ID NO: 21675 - RNA, 25 nt, Artificial Sequence
  Synthetic Oligonucleotide; PD-L1 exons 4 and 5; Set A
gauggucacugcuuguccagaugac

SEQ ID NO: 21676 - RNA, 32 nt, Artificial Sequence
  Synthetic Oligonucleotide; PD-L1 exons 4 and 5; Set C
acuugauggucacugcuuguccagaugacuuc

SEQ ID NO: 21677 - RNA, 20 nt, Artificial Sequence
  Synthetic Oligonucleotide; PD-L1 exons 4 and 5; Set A
uggucacugcuuguccagau

SEQ ID NO: 21678 - RNA, 22 nt, Artificial Sequence
  Synthetic Oligonucleotide; PD-L1 exons 4 and 5; Set A
auggucacugcuuguccagaug

SEQ ID NO: 21679 - RNA, 30 nt, Artificial Sequence
  Synthetic Oligonucleotide; PD-L1 exons 4 and 5; Set C
cuugauggucacugcuuguccagaugacuu

SEQ ID NO: 21680 - RNA, 28 nt, Artificial Sequence
  Synthetic Oligonucleotide; PD-L1 exons 4 and 5; Set C
uugauggucacugcuuguccagaugacu

SEQ ID NO: 21681 - RNA, 26 nt, Artificial Sequence
  Synthetic Oligonucleotide; PD-L1 exons 4 and 5; Set A
ugauggucacugcuuguccagaugac

SEQ ID NO: 21682 - RNA, 21 nt, Artificial Sequence
  Synthetic Oligonucleotide; PD-L1 exons 4 and 5; Set A
auggucacugcuuguccagau

SEQ ID NO: 21683 - RNA, 23 nt, Artificial Sequence
  Synthetic Oligonucleotide; PD-L1 exons 4 and 5; Set A
gauggucacugcuuguccagaug

SEQ ID NO: 21684 - RNA, 31 nt, Artificial Sequence
  Synthetic Oligonucleotide; PD-L1 exons 4 and 5; Set C
acuugauggucacugcuuguccagaugacuu

SEQ ID NO: 21685 - RNA, 29 nt, Artificial Sequence
  Synthetic Oligonucleotide; PD-L1 exons 4 and 5; Set C
cuugauggucacugcuuguccagaugacu

SEQ ID NO: 21686 - RNA, 25 nt, Artificial Sequence
  Synthetic Oligonucleotide; PD-L1 exons 4 and 5; Set A
ugauggucacugcuuguccagauga

SEQ ID NO: 21687 - RNA, 27 nt, Artificial Sequence
  Synthetic Oligonucleotide; PD-L1 exons 4 and 5; Set A
uugauggucacugcuuguccagaugac

SEQ ID NO: 21688 - RNA, 22 nt, Artificial Sequence
  Synthetic Oligonucleotide; PD-L1 exons 4 and 5; Set A
gauggucacugcuuguccagau

SEQ ID NO: 21689 - RNA, 24 nt, Artificial Sequence
  Synthetic Oligonucleotide; PD-L1 exons 4 and 5; Set A
ugauggucacugcuuguccagaug

SEQ ID NO: 21690 - RNA, 26 nt, Artificial Sequence
  Synthetic Oligonucleotide; PD-L1 exons 4 and 5; Set A
uugauggucacugcuuguccagauga

SEQ ID NO: 21691 - RNA, 28 nt, Artificial Sequence
  Synthetic Oligonucleotide; PD-L1 exons 4 and 5; Set C
cuugauggucacugcuuguccagaugac

SEQ ID NO: 21692 - RNA, 23 nt, Artificial Sequence
  Synthetic Oligonucleotide; PD-L1 exons 4 and 5; Set A
ugauggucacugcuuguccagau

SEQ ID NO: 21693 - RNA, 25 nt, Artificial Sequence
  Synthetic Oligonucleotide; PD-L1 exons 4 and 5; Set A
uugauggucacugcuuguccagaug

SEQ ID NO: 21694 - RNA, 27 nt, Artificial Sequence
  Synthetic Oligonucleotide; PD-L1 exons 4 and 5; Set A
cuugauggucacugcuuguccagauga

SEQ ID NO: 21695 - RNA, 24 nt, Artificial Sequence
  Synthetic Oligonucleotide; PD-L1 exons 4 and 5; Set A
uugauggucacugcuuguccagau

SEQ ID NO: 21696 - RNA, 26 nt, Artificial Sequence
  Synthetic Oligonucleotide; PD-L1 exons 4 and 5; Set A
cuugauggucacugcuuguccagaug

SEQ ID NO: 21697 - RNA, 25 nt, Artificial Sequence
  Synthetic Oligonucleotide; PD-L1 exons 4 and 5; Set A
cuugauggucacugcuuguccagau

SEQ ID NO: 21698 - RNA, 15 nt, Artificial Sequence
  Synthetic Oligonucleotide; PD-L1 exons 4 and 5; Set C
auggucacugcuugu

SEQ ID NO: 21699 - RNA, 16 nt, Artificial Sequence
  Synthetic Oligonucleotide; PD-L1 exons 4 and 5; Set C
gauggucacugcuugu

SEQ ID NO: 21700 - RNA, 15 nt, Artificial Sequence
  Synthetic Oligonucleotide; PD-L1 exons 4 and 5; Set C
gauggucacugcuug

SEQ ID NO: 21701 - RNA, 17 nt, Artificial Sequence
  Synthetic Oligonucleotide; PD-L1 exons 4 and 5; Set C
ugauggucacugcuugu

SEQ ID NO: 21702 - RNA, 16 nt, Artificial Sequence
  Synthetic Oligonucleotide; PD-L1 exons 4 and 5; Set C
ugauggucacugcuug

SEQ ID NO: 21703 - RNA, 18 nt, Artificial Sequence
  Synthetic Oligonucleotide; PD-L1 exons 4 and 5; Set C
uugauggucacugcuugu

SEQ ID NO: 21704 - RNA, 15 nt, Artificial Sequence
  Synthetic Oligonucleotide; PD-L1 exons 4 and 5; Set C
ugauggucacugcuu

SEQ ID NO: 21705 - RNA, 19 nt, Artificial Sequence
  Synthetic Oligonucleotide; PD-L1 exons 4 and 5; Set C
cuugauggucacugcuugu

SEQ ID NO: 21706 - RNA, 16 nt, Artificial Sequence
  Synthetic Oligonucleotide; PD-L1 exons 4 and 5; Set C
uugauggucacugcuu

SEQ ID NO: 21707 - RNA, 20 nt, Artificial Sequence
  Synthetic Oligonucleotide; PD-L1 exons 4 and 5; Set C
acuugauggucacugcuugu

SEQ ID NO: 21708 - RNA, 17 nt, Artificial Sequence
  Synthetic Oligonucleotide; PD-L1 exons 4 and 5; Set C
cuugauggucacugcuu

SEQ ID NO: 21709 - RNA, 19 nt, Artificial Sequence
  Synthetic Oligonucleotide; PD-L1 exons 4 and 5; Set C
acuugauggucacugcuug

SEQ ID NO: 21710 - RNA, 18 nt, Artificial Sequence
  Synthetic Oligonucleotide; PD-L1 exons 4 and 5; Set C
acuugauggucacugcuu

SEQ ID NO: 21711 - RNA, 40 nt, Artificial Sequence
  Synthetic Oligonucleotide; PD-L1 exons 4 and 5; Set C
cuuaccacucaggacuugauggucacugcuuguccagaug

SEQ ID NO: 21712 - RNA, 39 nt, Artificial Sequence
  Synthetic Oligonucleotide; PD-L1 exons 4 and 5; Set C
cuuaccacucaggacuugauggucacugcuuguccagau

SEQ ID NO: 21713 - RNA, 40 nt, Artificial Sequence
  Synthetic Oligonucleotide; PD-L1 exons 4 and 5; Set C
ucuuaccacucaggacuugauggucacugcuuguccagau

SEQ ID NO: 21714 - RNA, 33 nt, Artificial Sequence
  Synthetic Oligonucleotide; PD-L1 exons 4 and 5; Set C
cuuaccacucaggacuugauggucacugcuugu

SEQ ID NO: 21715 - RNA, 32 nt, Artificial Sequence
  Synthetic Oligonucleotide; PD-L1 exons 4 and 5; Set C
cuuaccacucaggacuugauggucacugcuug

SEQ ID NO: 21716 - RNA, 34 nt, Artificial Sequence
  Synthetic Oligonucleotide; PD-L1 exons 4 and 5; Set C
ucuuaccacucaggacuugauggucacugcuugu

SEQ ID NO: 21717 - RNA, 31 nt, Artificial Sequence
  Synthetic Oligonucleotide; PD-L1 exons 4 and 5; Set C
cuuaccacucaggacuugauggucacugcuu

SEQ ID NO: 21718 - RNA, 33 nt, Artificial Sequence
  Synthetic Oligonucleotide; PD-L1 exons 4 and 5; Set C
ucuuaccacucaggacuugauggucacugcuug

SEQ ID NO: 21719 - RNA, 35 nt, Artificial Sequence
  Synthetic Oligonucleotide; PD-L1 exons 4 and 5; Set C
gucuuaccacucaggacuugauggucacugcuugu

SEQ ID NO: 21720 - RNA, 32 nt, Artificial Sequence
  Synthetic Oligonucleotide; PD-L1 exons 4 and 5; Set C
ucuuaccacucaggacuugauggucacugcuu

SEQ ID NO: 21721 - RNA, 34 nt, Artificial Sequence
  Synthetic Oligonucleotide; PD-L1 exons 4 and 5; Set C
gucuuaccacucaggacuugauggucacugcuug

SEQ ID NO: 21722 - RNA, 36 nt, Artificial Sequence
  Synthetic Oligonucleotide; PD-L1 exons 4 and 5; Set C
ggucuuaccacucaggacuugauggucacugcuugu

SEQ ID NO: 21723 - RNA, 33 nt, Artificial Sequence
  Synthetic Oligonucleotide; PD-L1 exons 4 and 5; Set C
gucuuaccacucaggacuugauggucacugcuu

SEQ ID NO: 21724 - RNA, 35 nt, Artificial Sequence
  Synthetic Oligonucleotide; PD-L1 exons 4 and 5; Set C
ggucuuaccacucaggacuugauggucacugcuug

SEQ ID NO: 21725 - RNA, 34 nt, Artificial Sequence
  Synthetic Oligonucleotide; PD-L1 exons 4 and 5; Set C
ggucuuaccacucaggacuugauggucacugcuu

SEQ ID NO: 21726 - RNA, 22 nt, Artificial Sequence
  Synthetic Oligonucleotide; PD-L1 exons 4 and 5; Set A
cuuaccacucaggacuugaugg

SEQ ID NO: 21727 - RNA, 21 nt, Artificial Sequence
  Synthetic Oligonucleotide; PD-L1 exons 4 and 5; Set C
cuuaccacucaggacuugaug

SEQ ID NO: 21728 - RNA, 23 nt, Artificial Sequence
  Synthetic Oligonucleotide; PD-L1 exons 4 and 5; Set A
ucuuaccacucaggacuugaugg

SEQ ID NO: 21729 - RNA, 20 nt, Artificial Sequence
  Synthetic Oligonucleotide; PD-L1 exons 4 and 5; Set C
cuuaccacucaggacuugau

SEQ ID NO: 21730 - RNA, 22 nt, Artificial Sequence
  Synthetic Oligonucleotide; PD-L1 exons 4 and 5; Set C
ucuuaccacucaggacuugaug

SEQ ID NO: 21731 - RNA, 24 nt, Artificial Sequence
  Synthetic Oligonucleotide; PD-L1 exons 4 and 5; Set A
gucuuaccacucaggacuugaugg

SEQ ID NO: 21732 - RNA, 21 nt, Artificial Sequence
  Synthetic Oligonucleotide; PD-L1 exons 4 and 5; Set C
ucuuaccacucaggacuugau

SEQ ID NO: 21733 - RNA, 23 nt, Artificial Sequence
  Synthetic Oligonucleotide; PD-L1 exons 4 and 5; Set A
gucuuaccacucaggacuugaug

SEQ ID NO: 21734 - RNA, 19 nt, Artificial Sequence
  Synthetic Oligonucleotide; PD-L1 exons 4 and 5; Set C
cuuaccacucaggacuuga

SEQ ID NO: 21735 - RNA, 25 nt, Artificial Sequence
  Synthetic Oligonucleotide; PD-L1 exons 4 and 5; Set A
ggucuuaccacucaggacuugaugg

SEQ ID NO: 21736 - RNA, 24 nt, Artificial Sequence
  Synthetic Oligonucleotide; PD-L1 exons 4 and 5; Set A
ggucuuaccacucaggacuugaug

SEQ ID NO: 21737 - RNA, 22 nt, Artificial Sequence
  Synthetic Oligonucleotide; PD-L1 exons 4 and 5; Set A
gucuuaccacucaggacuugau

SEQ ID NO: 21738 - RNA, 18 nt, Artificial Sequence
  Synthetic Oligonucleotide; PD-L1 exons 4 and 5; Set C
cuuaccacucaggacuug

SEQ ID NO: 21739 - RNA, 20 nt, Artificial Sequence
  Synthetic Oligonucleotide; PD-L1 exons 4 and 5; Set C
ucuuaccacucaggacuuga

SEQ ID NO: 21740 - RNA, 23 nt, Artificial Sequence
  Synthetic Oligonucleotide; PD-L1 exons 4 and 5; Set A
ggucuuaccacucaggacuugau

SEQ ID NO: 21741 - RNA, 19 nt, Artificial Sequence
  Synthetic Oligonucleotide; PD-L1 exons 4 and 5; Set C
ucuuaccacucaggacuug

SEQ ID NO: 21742 - RNA, 21 nt, Artificial Sequence
  Synthetic Oligonucleotide; PD-L1 exons 4 and 5; Set A
gucuuaccacucaggacuuga

SEQ ID NO: 21743 - RNA, 20 nt, Artificial Sequence
  Synthetic Oligonucleotide; PD-L1 exons 4 and 5; Set C
gucuuaccacucaggacuug

SEQ ID NO: 21744 - RNA, 22 nt, Artificial Sequence
  Synthetic Oligonucleotide; PD-L1 exons 4 and 5; Set A
ggucuuaccacucaggacuuga

SEQ ID NO: 21745 - RNA, 21 nt, Artificial Sequence
  Synthetic Oligonucleotide; PD-L1 exons 4 and 5; Set A
ggucuuaccacucaggacuug

SEQ ID NO: 21746 - RNA, 19 nt, Artificial Sequence
  Synthetic Oligonucleotide; PD-L1 exons 4 and 5; Set C
gucuuaccacucaggacuu

SEQ ID NO: 21747 - RNA, 20 nt, Artificial Sequence
  Synthetic Oligonucleotide; PD-L1 exons 4 and 5; Set A
ggucuuaccacucaggacuu

SEQ ID NO: 21748 - RNA, 33 nt, Artificial Sequence
  Synthetic Oligonucleotide; PD-L1 exons 4 and 5; Set C
guggugguggucuuaccacucaggacuugaugg

SEQ ID NO: 21749 - RNA, 32 nt, Artificial Sequence
  Synthetic Oligonucleotide; PD-L1 exons 4 and 5; Set C
guggugguggucuuaccacucaggacuugaug

SEQ ID NO: 21750 - RNA, 34 nt, Artificial Sequence
  Synthetic Oligonucleotide; PD-L1 exons 4 and 5; Set C
gguggugguggucuuaccacucaggacuugaugg

SEQ ID NO: 21751 - RNA, 33 nt, Artificial Sequence
  Synthetic Oligonucleotide; PD-L1 exons 4 and 5; Set C
gguggugguggucuuaccacucaggacuugaug

SEQ ID NO: 21752 - RNA, 31 nt, Artificial Sequence
  Synthetic Oligonucleotide; PD-L1 exons 4 and 5; Set C
guggugguggucuuaccacucaggacuugau

SEQ ID NO: 21753 - RNA, 35 nt, Artificial Sequence
  Synthetic Oligonucleotide; PD-L1 exons 4 and 5; Set C
ugguggugguggucuuaccacucaggacuugaugg

SEQ ID NO: 21754 - RNA, 34 nt, Artificial Sequence
  Synthetic Oligonucleotide; PD-L1 exons 4 and 5; Set C
ugguggugguggucuuaccacucaggacuugaug

SEQ ID NO: 21755 - RNA, 32 nt, Artificial Sequence
  Synthetic Oligonucleotide; PD-L1 exons 4 and 5; Set C
gguggugguggucuuaccacucaggacuugau

SEQ ID NO: 21756 - RNA, 30 nt, Artificial Sequence
  Synthetic Oligonucleotide; PD-L1 exons 4 and 5; Set C
guggugguggucuuaccacucaggacuuga

SEQ ID NO: 21757 - RNA, 36 nt, Artificial Sequence
  Synthetic Oligonucleotide; PD-L1 exons 4 and 5; Set C
uugguggugguggucuuaccacucaggacuugaugg

SEQ ID NO: 21758 - RNA, 35 nt, Artificial Sequence
  Synthetic Oligonucleotide; PD-L1 exons 4 and 5; Set C
uugguggugguggucuuaccacucaggacuugaug

SEQ ID NO: 21759 - RNA, 33 nt, Artificial Sequence
  Synthetic Oligonucleotide; PD-L1 exons 4 and 5; Set C
ugguggugguggucuuaccacucaggacuugau

SEQ ID NO: 21760 - RNA, 31 nt, Artificial Sequence
  Synthetic Oligonucleotide; PD-L1 exons 4 and 5; Set C
gguggugguggucuuaccacucaggacuuga

SEQ ID NO: 21761 - RNA, 37 nt, Artificial Sequence
  Synthetic Oligonucleotide; PD-L1 exons 4 and 5; Set C
auugguggugguggucuuaccacucaggacuugaugg

SEQ ID NO: 21762 - RNA, 34 nt, Artificial Sequence
  Synthetic Oligonucleotide; PD-L1 exons 4 and 5; Set C
uugguggugguggucuuaccacucaggacuugau

SEQ ID NO: 21763 - RNA, 36 nt, Artificial Sequence
  Synthetic Oligonucleotide; PD-L1 exons 4 and 5; Set C
auugguggugguggucuuaccacucaggacuugaug

SEQ ID NO: 21764 - RNA, 30 nt, Artificial Sequence
  Synthetic Oligonucleotide; PD-L1 exons 4 and 5; Set C
gguggugguggucuuaccacucaggacuug

SEQ ID NO: 21765 - RNA, 32 nt, Artificial Sequence
  Synthetic Oligonucleotide; PD-L1 exons 4 and 5; Set C
ugguggugguggucuuaccacucaggacuuga

SEQ ID NO: 21766 - RNA, 35 nt, Artificial Sequence
  Synthetic Oligonucleotide; PD-L1 exons 4 and 5; Set C
auugguggugguggucuuaccacucaggacuugau

SEQ ID NO: 21767 - RNA, 31 nt, Artificial Sequence
  Synthetic Oligonucleotide; PD-L1 exons 4 and 5; Set C
ugguggugguggucuuaccacucaggacuug

SEQ ID NO: 21768 - RNA, 33 nt, Artificial Sequence
  Synthetic Oligonucleotide; PD-L1 exons 4 and 5; Set C
uugguggugguggucuuaccacucaggacuuga

SEQ ID NO: 21769 - RNA, 32 nt, Artificial Sequence
  Synthetic Oligonucleotide; PD-L1 exons 4 and 5; Set C
uugguggugguggucuuaccacucaggacuug

SEQ ID NO: 21770 - RNA, 34 nt, Artificial Sequence
  Synthetic Oligonucleotide; PD-L1 exons 4 and 5; Set C
auugguggugguggucuuaccacucaggacuuga

SEQ ID NO: 21771 - RNA, 30 nt, Artificial Sequence
  Synthetic Oligonucleotide; PD-L1 exons 4 and 5; Set C
ugguggugguggucuuaccacucaggacuu

SEQ ID NO: 21772 - RNA, 33 nt, Artificial Sequence
  Synthetic Oligonucleotide; PD-L1 exons 4 and 5; Set C
auugguggugguggucuuaccacucaggacuug

SEQ ID NO: 21773 - RNA, 31 nt, Artificial Sequence
  Synthetic Oligonucleotide; PD-L1 exons 4 and 5; Set C
uugguggugguggucuuaccacucaggacuu

SEQ ID NO: 21774 - RNA, 32 nt, Artificial Sequence
  Synthetic Oligonucleotide; PD-L1 exons 4 and 5; Set C
auugguggugguggucuuaccacucaggacuu

SEQ ID NO: 21775 - RNA, 40 nt, Artificial Sequence
  Synthetic Oligonucleotide; PD-L1 exons 4 and 5; Set C
uuggaauugguggugguggucuuaccacucaggacuugau

SEQ ID NO: 21776 - RNA, 40 nt, Artificial Sequence
  Synthetic Oligonucleotide; PD-L1 exons 4 and 5; Set C
cuuggaauugguggugguggucuuaccacucaggacuuga

SEQ ID NO: 21777 - RNA, 39 nt, Artificial Sequence
  Synthetic Oligonucleotide; PD-L1 exons 4 and 5; Set C
cuuggaauugguggugguggucuuaccacucaggacuug

SEQ ID NO: 21778 - RNA, 40 nt, Artificial Sequence
  Synthetic Oligonucleotide; PD-L1 exons 4 and 5; Set C
ucuuggaauugguggugguggucuuaccacucaggacuug

SEQ ID NO: 21779 - RNA, 38 nt, Artificial Sequence
  Synthetic Oligonucleotide; PD-L1 exons 4 and 5; Set C
cuuggaauugguggugguggucuuaccacucaggacuu

SEQ ID NO: 21780 - RNA, 39 nt, Artificial Sequence
  Synthetic Oligonucleotide; PD-L1 exons 4 and 5; Set C
ucuuggaauugguggugguggucuuaccacucaggacuu

SEQ ID NO: 21781 - RNA, 40 nt, Artificial Sequence
  Synthetic Oligonucleotide; PD-L1 exons 4 and 5; Set C
cucuuggaauugguggugguggucuuaccacucaggacuu

SEQ ID NO: 21782 - RNA, 15 nt, Artificial Sequence
  Synthetic Oligonucleotide; PD-L1 exons 4 and 5; Set C
gguggugguggucuu

SEQ ID NO: 21783 - RNA, 16 nt, Artificial Sequence
  Synthetic Oligonucleotide; PD-L1 exons 4 and 5; Set C
ugguggugguggucuu

SEQ ID NO: 21784 - RNA, 15 nt, Artificial Sequence
  Synthetic Oligonucleotide; PD-L1 exons 4 and 5; Set C
ugguggugguggucu

SEQ ID NO: 21785 - RNA, 16 nt, Artificial Sequence
  Synthetic Oligonucleotide; PD-L1 exons 4 and 5; Set C
uugguggugguggucu

SEQ ID NO: 21786 - RNA, 15 nt, Artificial Sequence
  Synthetic Oligonucleotide; PD-L1 exons 4 and 5; Set C
uuggugguggugguc

SEQ ID NO: 21787 - RNA, 16 nt, Artificial Sequence
  Synthetic Oligonucleotide; PD-L1 exons 4 and 5; Set C
auuggugguggugguc

SEQ ID NO: 21788 - RNA, 15 nt, Artificial Sequence
  Synthetic Oligonucleotide; PD-L1 exons 4 and 5; Set C
auugguggugguggu

SEQ ID NO: 21789 - RNA, 23 nt, Artificial Sequence
  Synthetic Oligonucleotide; PD-L1 exons 4 and 5; Set A
uuggaauugguggugguggucuu

SEQ ID NO: 21790 - RNA, 22 nt, Artificial Sequence
  Synthetic Oligonucleotide; PD-L1 exons 4 and 5; Set A
uuggaauugguggugguggucu

SEQ ID NO: 21791 - RNA, 21 nt, Artificial Sequence
  Synthetic Oligonucleotide; PD-L1 exons 4 and 5; Set A
uuggaauuggugguggugguc

SEQ ID NO: 21792 - RNA, 20 nt, Artificial Sequence
  Synthetic Oligonucleotide; PD-L1 exons 4 and 5; Set A
uuggaauugguggugguggu

SEQ ID NO: 21793 - RNA, 34 nt, Artificial Sequence
  Synthetic Oligonucleotide; PD-L1 exons 4 and 5; Set C
ucuccucucucuuggaauugguggugguggucuu

SEQ ID NO: 21794 - RNA, 35 nt, Artificial Sequence
  Synthetic Oligonucleotide; PD-L1 exons 4 and 5; Set C
uucuccucucucuuggaauugguggugguggucuu

SEQ ID NO: 21795 - RNA, 33 nt, Artificial Sequence
  Synthetic Oligonucleotide; PD-L1 exons 4 and 5; Set C
ucuccucucucuuggaauugguggugguggucu

SEQ ID NO: 21796 - RNA, 34 nt, Artificial Sequence
  Synthetic Oligonucleotide; PD-L1 exons 4 and 5; Set C
uucuccucucucuuggaauugguggugguggucu

SEQ ID NO: 21797 - RNA, 32 nt, Artificial Sequence
  Synthetic Oligonucleotide; PD-L1 exons 4 and 5; Set C
ucuccucucucuuggaauuggugguggugguc

SEQ ID NO: 21798 - RNA, 31 nt, Artificial Sequence
  Synthetic Oligonucleotide; PD-L1 exons 4 and 5; Set C
ucuccucucucuuggaauugguggugguggu

SEQ ID NO: 21799 - RNA, 33 nt, Artificial Sequence
  Synthetic Oligonucleotide; PD-L1 exons 4 and 5; Set C
uucuccucucucuuggaauuggugguggugguc

SEQ ID NO: 21800 - RNA, 32 nt, Artificial Sequence
  Synthetic Oligonucleotide; PD-L1 exons 4 and 5; Set C
uucuccucucucuuggaauugguggugguggu

SEQ ID NO: 21801 - RNA, 37 nt, Artificial Sequence
  Synthetic Oligonucleotide; PD-L1 exons 4 and 5; Set C
agcuucuccucucucuuggaauugguggugguggucu

SEQ ID NO: 21802 - RNA, 36 nt, Artificial Sequence
  Synthetic Oligonucleotide; PD-L1 exons 4 and 5; Set C
agcuucuccucucucuuggaauuggugguggugguc

SEQ ID NO: 21803 - RNA, 35 nt, Artificial Sequence
  Synthetic Oligonucleotide; PD-L1 exons 4 and 5; Set C
agcuucuccucucucuuggaauugguggugguggu

SEQ ID NO: 21804 - RNA, 28 nt, Artificial Sequence
  Synthetic Oligonucleotide; PD-L1 exons 4 and 5; Set A
aagcuucuccucucucuuggaauuggug

SEQ ID NO: 21805 - RNA, 27 nt, Artificial Sequence
  Synthetic Oligonucleotide; PD-L1 exons 4 and 5; Set A
aagcuucuccucucucuuggaauuggu

SEQ ID NO: 21806 - RNA, 26 nt, Artificial Sequence
  Synthetic Oligonucleotide; PD-L1 exons 4 and 5; Set A
aagcuucuccucucucuuggaauugg

SEQ ID NO: 21807 - RNA, 25 nt, Artificial Sequence
  Synthetic Oligonucleotide; PD-L1 exons 4 and 5; Set A
aagcuucuccucucucuuggaauug

SEQ ID NO: 21808 - RNA, 24 nt, Artificial Sequence
  Synthetic Oligonucleotide; PD-L1 exons 4 and 5; Set C
aagcuucuccucucucuuggaauu

SEQ ID NO: 21809 - RNA, 15 nt, Artificial Sequence
  Synthetic Oligonucleotide; PD-L1 exons 4 and 5; Set C
uucuccucucucuug

SEQ ID NO: 21810 - RNA, 16 nt, Artificial Sequence
  Synthetic Oligonucleotide; PD-L1 exons 4 and 5; Set C
cuucuccucucucuug

SEQ ID NO: 21811 - RNA, 18 nt, Artificial Sequence
  Synthetic Oligonucleotide; PD-L1 exons 4 and 5; Set C
agcuucuccucucucuug

SEQ ID NO: 21812 - RNA, 18 nt, Artificial Sequence
  Synthetic Oligonucleotide; PD-L1 exons 4 and 5; Set C
aagcuucuccucucucuu

SEQ ID NO: 21813 - RNA, 17 nt, Artificial Sequence
  Synthetic Oligonucleotide; PD-L1 exons 4 and 5; Set C
aagcuucuccucucucu

SEQ ID NO: 21814 - RNA, 16 nt, Artificial Sequence
  Synthetic Oligonucleotide; PD-L1 exons 4 and 5; Set C
aagcuucuccucucuc

SEQ ID NO: 21815 - RNA, 40 nt, Artificial Sequence
  Synthetic Oligonucleotide; PD-L1 exons 4 and 5; Set C
ggucacauugaaaagcuucuccucucucuuggaauuggug

SEQ ID NO: 21816 - RNA, 15 nt, Artificial Sequence
  Synthetic Oligonucleotide; PD-L1 exons 4 and 5; Set C
aagcuucuccucucu

SEQ ID NO: 21817 - RNA, 39 nt, Artificial Sequence
  Synthetic Oligonucleotide; PD-L1 exons 4 and 5; Set C
ggucacauugaaaagcuucuccucucucuuggaauuggu

SEQ ID NO: 21818 - RNA, 38 nt, Artificial Sequence
  Synthetic Oligonucleotide; PD-L1 exons 4 and 5; Set C
ggucacauugaaaagcuucuccucucucuuggaauugg

SEQ ID NO: 21819 - RNA, 40 nt, Artificial Sequence
  Synthetic Oligonucleotide; PD-L1 exons 4 and 5; Set C
uggucacauugaaaagcuucuccucucucuuggaauuggu

SEQ ID NO: 21820 - RNA, 37 nt, Artificial Sequence
  Synthetic Oligonucleotide; PD-L1 exons 4 and 5; Set C
ggucacauugaaaagcuucuccucucucuuggaauug

SEQ ID NO: 21821 - RNA, 39 nt, Artificial Sequence
  Synthetic Oligonucleotide; PD-L1 exons 4 and 5; Set C
uggucacauugaaaagcuucuccucucucuuggaauugg

SEQ ID NO: 21822 - RNA, 38 nt, Artificial Sequence
  Synthetic Oligonucleotide; PD-L1 exons 4 and 5; Set C
uggucacauugaaaagcuucuccucucucuuggaauug

SEQ ID NO: 21823 - RNA, 36 nt, Artificial Sequence
  Synthetic Oligonucleotide; PD-L1 exons 4 and 5; Set C
ggucacauugaaaagcuucuccucucucuuggaauu

SEQ ID NO: 21824 - RNA, 39 nt, Artificial Sequence
  Synthetic Oligonucleotide; PD-L1 exons 4 and 5; Set C
cuggucacauugaaaagcuucuccucucucuuggaauug

SEQ ID NO: 21825 - RNA, 37 nt, Artificial Sequence
  Synthetic Oligonucleotide; PD-L1 exons 4 and 5; Set C
uggucacauugaaaagcuucuccucucucuuggaauu

SEQ ID NO: 21826 - RNA, 38 nt, Artificial Sequence
  Synthetic Oligonucleotide; PD-L1 exons 4 and 5; Set C
cuggucacauugaaaagcuucuccucucucuuggaauu

SEQ ID NO: 21827 - RNA, 30 nt, Artificial Sequence
  Synthetic Oligonucleotide; PD-L1 exons 4 and 5; Set A
ggucacauugaaaagcuucuccucucucuu

SEQ ID NO: 21828 - RNA, 32 nt, Artificial Sequence
  Synthetic Oligonucleotide; PD-L1 exons 4 and 5; Set A
uggucacauugaaaagcuucuccucucucuug

SEQ ID NO: 21829 - RNA, 29 nt, Artificial Sequence
  Synthetic Oligonucleotide; PD-L1 exons 4 and 5; Set A
ggucacauugaaaagcuucuccucucucu

SEQ ID NO: 21830 - RNA, 31 nt, Artificial Sequence
  Synthetic Oligonucleotide; PD-L1 exons 4 and 5; Set A
uggucacauugaaaagcuucuccucucucuu

SEQ ID NO: 21831 - RNA, 33 nt, Artificial Sequence
  Synthetic Oligonucleotide; PD-L1 exons 4 and 5; Set A
cuggucacauugaaaagcuucuccucucucuug

SEQ ID NO: 21832 - RNA, 30 nt, Artificial Sequence
  Synthetic Oligonucleotide; PD-L1 exons 4 and 5; Set A
uggucacauugaaaagcuucuccucucucu

SEQ ID NO: 21833 - RNA, 32 nt, Artificial Sequence
  Synthetic Oligonucleotide; PD-L1 exons 4 and 5; Set A
cuggucacauugaaaagcuucuccucucucuu

SEQ ID NO: 21834 - RNA, 28 nt, Artificial Sequence
  Synthetic Oligonucleotide; PD-L1 exons 4 and 5; Set A
ggucacauugaaaagcuucuccucucuc

SEQ ID NO: 21835 - RNA, 31 nt, Artificial Sequence
  Synthetic Oligonucleotide; PD-L1 exons 4 and 5; Set A
cuggucacauugaaaagcuucuccucucucu

SEQ ID NO: 21836 - RNA, 29 nt, Artificial Sequence
  Synthetic Oligonucleotide; PD-L1 exons 4 and 5; Set A
uggucacauugaaaagcuucuccucucuc

SEQ ID NO: 21837 - RNA, 27 nt, Artificial Sequence
  Synthetic Oligonucleotide; PD-L1 exons 4 and 5; Set A
ggucacauugaaaagcuucuccucucu

SEQ ID NO: 21838 - RNA, 30 nt, Artificial Sequence
  Synthetic Oligonucleotide; PD-L1 exons 4 and 5; Set A
cuggucacauugaaaagcuucuccucucuc

SEQ ID NO: 21839 - RNA, 28 nt, Artificial Sequence
  Synthetic Oligonucleotide; PD-L1 exons 4 and 5; Set A
uggucacauugaaaagcuucuccucucu

SEQ ID NO: 21840 - RNA, 26 nt, Artificial Sequence
  Synthetic Oligonucleotide; PD-L1 exons 4 and 5; Set A
ggucacauugaaaagcuucuccucuc

SEQ ID NO: 21841 - RNA, 29 nt, Artificial Sequence
  Synthetic Oligonucleotide; PD-L1 exons 4 and 5; Set A
cuggucacauugaaaagcuucuccucucu

SEQ ID NO: 21842 - RNA, 27 nt, Artificial Sequence
  Synthetic Oligonucleotide; PD-L1 exons 4 and 5; Set A
uggucacauugaaaagcuucuccucuc

SEQ ID NO: 21843 - RNA, 28 nt, Artificial Sequence
  Synthetic Oligonucleotide; PD-L1 exons 4 and 5; Set A
cuggucacauugaaaagcuucuccucuc

SEQ ID NO: 21844 - RNA, 26 nt, Artificial Sequence
  Synthetic Oligonucleotide; PD-L1 exons 4 and 5; Set A
uggucacauugaaaagcuucuccucu

SEQ ID NO: 21845 - RNA, 38 nt, Artificial Sequence
  Synthetic Oligonucleotide; PD-L1 exons 4 and 5; Set C
gugugcuggucacauugaaaagcuucuccucucucuug

SEQ ID NO: 21846 - RNA, 37 nt, Artificial Sequence
  Synthetic Oligonucleotide; PD-L1 exons 4 and 5; Set C
gugugcuggucacauugaaaagcuucuccucucucuu

SEQ ID NO: 21847 - RNA, 27 nt, Artificial Sequence
  Synthetic Oligonucleotide; PD-L1 exons 4 and 5; Set A
cuggucacauugaaaagcuucuccucu

SEQ ID NO: 21848 - RNA, 36 nt, Artificial Sequence
  Synthetic Oligonucleotide; PD-L1 exons 4 and 5; Set C
gugugcuggucacauugaaaagcuucuccucucucu

SEQ ID NO: 21849 - RNA, 38 nt, Artificial Sequence
  Synthetic Oligonucleotide; PD-L1 exons 4 and 5; Set C
agugugcuggucacauugaaaagcuucuccucucucuu

SEQ ID NO: 21850 - RNA, 37 nt, Artificial Sequence
  Synthetic Oligonucleotide; PD-L1 exons 4 and 5; Set C
agugugcuggucacauugaaaagcuucuccucucucu

SEQ ID NO: 21851 - RNA, 35 nt, Artificial Sequence
  Synthetic Oligonucleotide; PD-L1 exons 4 and 5; Set C
gugugcuggucacauugaaaagcuucuccucucuc

SEQ ID NO: 21852 - RNA, 36 nt, Artificial Sequence
  Synthetic Oligonucleotide; PD-L1 exons 4 and 5; Set C
agugugcuggucacauugaaaagcuucuccucucuc

SEQ ID NO: 21853 - RNA, 34 nt, Artificial Sequence
  Synthetic Oligonucleotide; PD-L1 exons 4 and 5; Set C
gugugcuggucacauugaaaagcuucuccucucu

SEQ ID NO: 21854 - RNA, 35 nt, Artificial Sequence
  Synthetic Oligonucleotide; PD-L1 exons 4 and 5; Set C
agugugcuggucacauugaaaagcuucuccucucu

SEQ ID NO: 21855 - RNA, 33 nt, Artificial Sequence
  Synthetic Oligonucleotide; PD-L1 exons 4 and 5; Set C
gugugcuggucacauugaaaagcuucuccucuc

SEQ ID NO: 21856 - RNA, 34 nt, Artificial Sequence
  Synthetic Oligonucleotide; PD-L1 exons 4 and 5; Set C
agugugcuggucacauugaaaagcuucuccucuc

SEQ ID NO: 21857 - RNA, 32 nt, Artificial Sequence
  Synthetic Oligonucleotide; PD-L1 exons 4 and 5; Set C
gugugcuggucacauugaaaagcuucuccucu

SEQ ID NO: 21858 - RNA, 34 nt, Artificial Sequence
  Synthetic Oligonucleotide; PD-L1 exons 4 and 5; Set A
ugauucucagugugcuggucacauugaaaagcuu

SEQ ID NO: 21859 - RNA, 33 nt, Artificial Sequence
  Synthetic Oligonucleotide; PD-L1 exons 4 and 5; Set A
ugauucucagugugcuggucacauugaaaagcu

SEQ ID NO: 21860 - RNA, 35 nt, Artificial Sequence
  Synthetic Oligonucleotide; PD-L1 exons 4 and 5; Set A
uugauucucagugugcuggucacauugaaaagcuu

SEQ ID NO: 21861 - RNA, 34 nt, Artificial Sequence
  Synthetic Oligonucleotide; PD-L1 exons 4 and 5; Set A
uugauucucagugugcuggucacauugaaaagcu

SEQ ID NO: 21862 - RNA, 36 nt, Artificial Sequence
  Synthetic Oligonucleotide; PD-L1 exons 4 and 5; Set C
guugauucucagugugcuggucacauugaaaagcuu

SEQ ID NO: 21863 - RNA, 35 nt, Artificial Sequence
  Synthetic Oligonucleotide; PD-L1 exons 4 and 5; Set C
guugauucucagugugcuggucacauugaaaagcu

SEQ ID NO: 21864 - RNA, 37 nt, Artificial Sequence
  Synthetic Oligonucleotide; PD-L1 exons 4 and 5; Set C
uguugauucucagugugcuggucacauugaaaagcuu

SEQ ID NO: 21865 - RNA, 36 nt, Artificial Sequence
  Synthetic Oligonucleotide; PD-L1 exons 4 and 5; Set C
uguugauucucagugugcuggucacauugaaaagcu

SEQ ID NO: 21866 - RNA, 38 nt, Artificial Sequence
  Synthetic Oligonucleotide; PD-L1 exons 4 and 5; Set C
guguugauucucagugugcuggucacauugaaaagcuu

SEQ ID NO: 21867 - RNA, 37 nt, Artificial Sequence
  Synthetic Oligonucleotide; PD-L1 exons 4 and 5; Set C
guguugauucucagugugcuggucacauugaaaagcu

SEQ ID NO: 21868 - RNA, 39 nt, Artificial Sequence
  Synthetic Oligonucleotide; PD-L1 exons 4 and 5; Set C
uguguugauucucagugugcuggucacauugaaaagcuu

SEQ ID NO: 21869 - RNA, 38 nt, Artificial Sequence
  Synthetic Oligonucleotide; PD-L1 exons 4 and 5; Set C
uguguugauucucagugugcuggucacauugaaaagcu

SEQ ID NO: 21870 - RNA, 40 nt, Artificial Sequence
  Synthetic Oligonucleotide; PD-L1 exons 4 and 5; Set C
uuguguugauucucagugugcuggucacauugaaaagcuu

SEQ ID NO: 21871 - RNA, 39 nt, Artificial Sequence
  Synthetic Oligonucleotide; PD-L1 exons 4 and 5; Set C
uuguguugauucucagugugcuggucacauugaaaagcu

SEQ ID NO: 21872 - RNA, 37 nt, Artificial Sequence
  Synthetic Oligonucleotide; PD-L1 exons 4 and 5; Set C
uguguugauucucagugugcuggucacauugaaaagc

SEQ ID NO: 21873 - RNA, 40 nt, Artificial Sequence
  Synthetic Oligonucleotide; PD-L1 exons 4 and 5; Set C
guuguguugauucucagugugcuggucacauugaaaagcu

SEQ ID NO: 21874 - RNA, 38 nt, Artificial Sequence
  Synthetic Oligonucleotide; PD-L1 exons 4 and 5; Set C
uuguguugauucucagugugcuggucacauugaaaagc

SEQ ID NO: 21875 - RNA, 39 nt, Artificial Sequence
  Synthetic Oligonucleotide; PD-L1 exons 4 and 5; Set C
guuguguugauucucagugugcuggucacauugaaaagc

SEQ ID NO: 21876 - RNA, 40 nt, Artificial Sequence
  Synthetic Oligonucleotide; PD-L1 exons 4 and 5; Set C
uguuguguugauucucagugugcuggucacauugaaaagc

SEQ ID NO: 21877 - RNA, 17 nt, Artificial Sequence
  Synthetic Oligonucleotide; PD-L1 exons 4 and 5; Set C
gauucucagugugcugg

SEQ ID NO: 21878 - RNA, 16 nt, Artificial Sequence
  Synthetic Oligonucleotide; PD-L1 exons 4 and 5; Set C
gauucucagugugcug

SEQ ID NO: 21879 - RNA, 16 nt, Artificial Sequence
  Synthetic Oligonucleotide; PD-L1 exons 4 and 5; Set C
ugauucucagugugcu

SEQ ID NO: 21880 - RNA, 17 nt, Artificial Sequence
  Synthetic Oligonucleotide; PD-L1 exons 4 and 5; Set C
uugauucucagugugcu

SEQ ID NO: 21881 - RNA, 18 nt, Artificial Sequence
  Synthetic Oligonucleotide; PD-L1 exons 4 and 5; Set C
guugauucucagugugcu

SEQ ID NO: 21882 - RNA, 19 nt, Artificial Sequence
  Synthetic Oligonucleotide; PD-L1 exons 4 and 5; Set C
uguugauucucagugugcu

SEQ ID NO: 21883 - RNA, 20 nt, Artificial Sequence
  Synthetic Oligonucleotide; PD-L1 exons 4 and 5; Set C
guguugauucucagugugcu

SEQ ID NO: 21884 - RNA, 18 nt, Artificial Sequence
  Synthetic Oligonucleotide; PD-L1 exons 4 and 5; Set C
uguugauucucagugugc

SEQ ID NO: 21885 - RNA, 21 nt, Artificial Sequence
  Synthetic Oligonucleotide; PD-L1 exons 4 and 5; Set C
uguguugauucucagugugcu

SEQ ID NO: 21886 - RNA, 19 nt, Artificial Sequence
  Synthetic Oligonucleotide; PD-L1 exons 4 and 5; Set C
guguugauucucagugugc

SEQ ID NO: 21887 - RNA, 22 nt, Artificial Sequence
  Synthetic Oligonucleotide; PD-L1 exons 4 and 5; Set C
uuguguugauucucagugugcu

SEQ ID NO: 21888 - RNA, 16 nt, Artificial Sequence
  Synthetic Oligonucleotide; PD-L1 exons 4 and 5; Set C
uguugauucucagugu

SEQ ID NO: 21889 - RNA, 20 nt, Artificial Sequence
  Synthetic Oligonucleotide; PD-L1 exons 4 and 5; Set C
uguguugauucucagugugc

SEQ ID NO: 21890 - RNA, 18 nt, Artificial Sequence
  Synthetic Oligonucleotide; PD-L1 exons 4 and 5; Set C
guguugauucucagugug

SEQ ID NO: 21891 - RNA, 15 nt, Artificial Sequence
  Synthetic Oligonucleotide; PD-L1 exons 4 and 5; Set C
uguugauucucagug

SEQ ID NO: 21892 - RNA, 23 nt, Artificial Sequence
  Synthetic Oligonucleotide; PD-L1 exons 4 and 5; Set A
guuguguugauucucagugugcu

SEQ ID NO: 21893 - RNA, 17 nt, Artificial Sequence
  Synthetic Oligonucleotide; PD-L1 exons 4 and 5; Set C
guguugauucucagugu

SEQ ID NO: 21894 - RNA, 21 nt, Artificial Sequence
  Synthetic Oligonucleotide; PD-L1 exons 4 and 5; Set C
uuguguugauucucagugugc

SEQ ID NO: 21895 - RNA, 19 nt, Artificial Sequence
  Synthetic Oligonucleotide; PD-L1 exons 4 and 5; Set C
uguguugauucucagugug

SEQ ID NO: 21896 - RNA, 24 nt, Artificial Sequence
  Synthetic Oligonucleotide; PD-L1 exons 4 and 5; Set A
uguuguguugauucucagugugcu

SEQ ID NO: 21897 - RNA, 18 nt, Artificial Sequence
  Synthetic Oligonucleotide; PD-L1 exons 4 and 5; Set C
uguguugauucucagugu

SEQ ID NO: 21898 - RNA, 22 nt, Artificial Sequence
  Synthetic Oligonucleotide; PD-L1 exons 4 and 5; Set C
guuguguugauucucagugugc

SEQ ID NO: 21899 - RNA, 20 nt, Artificial Sequence
  Synthetic Oligonucleotide; PD-L1 exons 4 and 5; Set C
uuguguugauucucagugug

SEQ ID NO: 21900 - RNA, 15 nt, Artificial Sequence
  Synthetic Oligonucleotide; PD-L1 exons 4 and 5; Set C
guguugauucucagu

SEQ ID NO: 21901 - RNA, 25 nt, Artificial Sequence
  Synthetic Oligonucleotide; PD-L1 exons 4 and 5; Set A
uuguuguguugauucucagugugcu

SEQ ID NO: 21902 - RNA, 19 nt, Artificial Sequence
  Synthetic Oligonucleotide; PD-L1 exons 4 and 5; Set C
uuguguugauucucagugu

SEQ ID NO: 21903 - RNA, 23 nt, Artificial Sequence
  Synthetic Oligonucleotide; PD-L1 exons 4 and 5; Set A
uguuguguugauucucagugugc

SEQ ID NO: 21904 - RNA, 21 nt, Artificial Sequence
  Synthetic Oligonucleotide; PD-L1 exons 4 and 5; Set C
guuguguugauucucagugug

SEQ ID NO: 21905 - RNA, 16 nt, Artificial Sequence
  Synthetic Oligonucleotide; PD-L1 exons 4 and 5; Set C
uguguugauucucagu

SEQ ID NO: 21906 - RNA, 20 nt, Artificial Sequence
  Synthetic Oligonucleotide; PD-L1 exons 4 and 5; Set C
guuguguugauucucagugu

SEQ ID NO: 21907 - RNA, 26 nt, Artificial Sequence
  Synthetic Oligonucleotide; PD-L1 exons 4 and 5; Set A
guuguuguguugauucucagugugcu

SEQ ID NO: 21908 - RNA, 24 nt, Artificial Sequence
  Synthetic Oligonucleotide; PD-L1 exons 4 and 5; Set A
uuguuguguugauucucagugugc

SEQ ID NO: 21909 - RNA, 22 nt, Artificial Sequence
  Synthetic Oligonucleotide; PD-L1 exons 4 and 5; Set C
uguuguguugauucucagugug

SEQ ID NO: 21910 - RNA, 17 nt, Artificial Sequence
  Synthetic Oligonucleotide; PD-L1 exons 4 and 5; Set C
uuguguugauucucagu

SEQ ID NO: 21911 - RNA, 21 nt, Artificial Sequence
  Synthetic Oligonucleotide; PD-L1 exons 4 and 5; Set C
uguuguguugauucucagugu

SEQ ID NO: 21912 - RNA, 27 nt, Artificial Sequence
  Synthetic Oligonucleotide; PD-L1 exons 4 and 5; Set A
aguuguuguguugauucucagugugcu

SEQ ID NO: 21913 - RNA, 25 nt, Artificial Sequence
  Synthetic Oligonucleotide; PD-L1 exons 4 and 5; Set A
guuguuguguugauucucagugugc

SEQ ID NO: 21914 - RNA, 23 nt, Artificial Sequence
  Synthetic Oligonucleotide; PD-L1 exons 4 and 5; Set C
uuguuguguugauucucagugug

SEQ ID NO: 21915 - RNA, 18 nt, Artificial Sequence
  Synthetic Oligonucleotide; PD-L1 exons 4 and 5; Set C
guuguguugauucucagu

SEQ ID NO: 21916 - RNA, 22 nt, Artificial Sequence
  Synthetic Oligonucleotide; PD-L1 exons 4 and 5; Set C
uuguuguguugauucucagugu

SEQ ID NO: 21917 - RNA, 28 nt, Artificial Sequence
  Synthetic Oligonucleotide; PD-L1 exons 4 and 5; Set A
uaguuguuguguugauucucagugugcu

SEQ ID NO: 21918 - RNA, 26 nt, Artificial Sequence
  Synthetic Oligonucleotide; PD-L1 exons 4 and 5; Set A
aguuguuguguugauucucagugugc

SEQ ID NO: 21919 - RNA, 24 nt, Artificial Sequence
  Synthetic Oligonucleotide; PD-L1 exons 4 and 5; Set C
guuguuguguugauucucagugug

SEQ ID NO: 21920 - RNA, 29 nt, Artificial Sequence
  Synthetic Oligonucleotide; PD-L1 exons 4 and 5; Set A
uuaguuguuguguugauucucagugugcu

SEQ ID NO: 21921 - RNA, 23 nt, Artificial Sequence
  Synthetic Oligonucleotide; PD-L1 exons 4 and 5; Set C
guuguuguguugauucucagugu

SEQ ID NO: 21922 - RNA, 27 nt, Artificial Sequence
  Synthetic Oligonucleotide; PD-L1 exons 4 and 5; Set A
uaguuguuguguugauucucagugugc

SEQ ID NO: 21923 - RNA, 25 nt, Artificial Sequence
  Synthetic Oligonucleotide; PD-L1 exons 4 and 5; Set C
aguuguuguguugauucucagugug

SEQ ID NO: 21924 - RNA, 36 nt, Artificial Sequence
  Synthetic Oligonucleotide; PD-L1 exons 4 and 5; Set C
cucauuaguuguuguguugauucucagugugcuggu

SEQ ID NO: 21925 - RNA, 30 nt, Artificial Sequence
  Synthetic Oligonucleotide; PD-L1 exons 4 and 5; Set A
auuaguuguuguguugauucucagugugcu

SEQ ID NO: 21926 - RNA, 24 nt, Artificial Sequence
  Synthetic Oligonucleotide; PD-L1 exons 4 and 5; Set C
aguuguuguguugauucucagugu

SEQ ID NO: 21927 - RNA, 28 nt, Artificial Sequence
  Synthetic Oligonucleotide; PD-L1 exons 4 and 5; Set A
uuaguuguuguguugauucucagugugc

SEQ ID NO: 21928 - RNA, 26 nt, Artificial Sequence
  Synthetic Oligonucleotide; PD-L1 exons 4 and 5; Set C
uaguuguuguguugauucucagugug

SEQ ID NO: 21929 - RNA, 35 nt, Artificial Sequence
  Synthetic Oligonucleotide; PD-L1 exons 4 and 5; Set C
cucauuaguuguuguguugauucucagugugcugg

SEQ ID NO: 21930 - RNA, 37 nt, Artificial Sequence
  Synthetic Oligonucleotide; PD-L1 exons 4 and 5; Set C
ucucauuaguuguuguguugauucucagugugcuggu

SEQ ID NO: 21931 - RNA, 31 nt, Artificial Sequence
  Synthetic Oligonucleotide; PD-L1 exons 4 and 5; Set A
cauuaguuguuguguugauucucagugugcu

SEQ ID NO: 21932 - RNA, 25 nt, Artificial Sequence
  Synthetic Oligonucleotide; PD-L1 exons 4 and 5; Set C
uaguuguuguguugauucucagugu

SEQ ID NO: 21933 - RNA, 29 nt, Artificial Sequence
  Synthetic Oligonucleotide; PD-L1 exons 4 and 5; Set A
auuaguuguuguguugauucucagugugc

SEQ ID NO: 21934 - RNA, 27 nt, Artificial Sequence
  Synthetic Oligonucleotide; PD-L1 exons 4 and 5; Set A
uuaguuguuguguugauucucagugug

SEQ ID NO: 21935 - RNA, 36 nt, Artificial Sequence
  Synthetic Oligonucleotide; PD-L1 exons 4 and 5; Set C
ucucauuaguuguuguguugauucucagugugcugg

SEQ ID NO: 21936 - RNA, 38 nt, Artificial Sequence
  Synthetic Oligonucleotide; PD-L1 exons 4 and 5; Set C
aucucauuaguuguuguguugauucucagugugcuggu

SEQ ID NO: 21937 - RNA, 34 nt, Artificial Sequence
  Synthetic Oligonucleotide; PD-L1 exons 4 and 5; Set A
cucauuaguuguuguguugauucucagugugcug

SEQ ID NO: 21938 - RNA, 26 nt, Artificial Sequence
  Synthetic Oligonucleotide; PD-L1 exons 4 and 5; Set C
uuaguuguuguguugauucucagugu

SEQ ID NO: 21939 - RNA, 32 nt, Artificial Sequence
  Synthetic Oligonucleotide; PD-L1 exons 4 and 5; Set A
ucauuaguuguuguguugauucucagugugcu

SEQ ID NO: 21940 - RNA, 30 nt, Artificial Sequence
  Synthetic Oligonucleotide; PD-L1 exons 4 and 5; Set A
cauuaguuguuguguugauucucagugugc

SEQ ID NO: 21941 - RNA, 28 nt, Artificial Sequence
  Synthetic Oligonucleotide; PD-L1 exons 4 and 5; Set A
auuaguuguuguguugauucucagugug

SEQ ID NO: 21942 - RNA, 37 nt, Artificial Sequence
  Synthetic Oligonucleotide; PD-L1 exons 4 and 5; Set C
aucucauuaguuguuguguugauucucagugugcugg

SEQ ID NO: 21943 - RNA, 35 nt, Artificial Sequence
  Synthetic Oligonucleotide; PD-L1 exons 4 and 5; Set A
ucucauuaguuguuguguugauucucagugugcug

SEQ ID NO: 21944 - RNA, 27 nt, Artificial Sequence
  Synthetic Oligonucleotide; PD-L1 exons 4 and 5; Set C
auuaguuguuguguugauucucagugu

SEQ ID NO: 21945 - RNA, 31 nt, Artificial Sequence
  Synthetic Oligonucleotide; PD-L1 exons 4 and 5; Set A
ucauuaguuguuguguugauucucagugugc

SEQ ID NO: 21946 - RNA, 29 nt, Artificial Sequence
  Synthetic Oligonucleotide; PD-L1 exons 4 and 5; Set A
cauuaguuguuguguugauucucagugug

SEQ ID NO: 21947 - RNA, 36 nt, Artificial Sequence
  Synthetic Oligonucleotide; PD-L1 exons 4 and 5; Set A
aucucauuaguuguuguguugauucucagugugcug

SEQ ID NO: 21948 - RNA, 28 nt, Artificial Sequence
  Synthetic Oligonucleotide; PD-L1 exons 4 and 5; Set A
cauuaguuguuguguugauucucagugu

SEQ ID NO: 21949 - RNA, 30 nt, Artificial Sequence
  Synthetic Oligonucleotide; PD-L1 exons 4 and 5; Set A
ucauuaguuguuguguugauucucagugug

SEQ ID NO: 21950 - RNA, 29 nt, Artificial Sequence
  Synthetic Oligonucleotide; PD-L1 exons 4 and 5; Set A
ucauuaguuguuguguugauucucagugu

SEQ ID NO: 21951 - RNA, 36 nt, Artificial Sequence
  Synthetic Oligonucleotide; PD-L1 exons 4 and 5; Set A
aaucucauuaguuguuguguugauucucagugugcu

SEQ ID NO: 21952 - RNA, 29 nt, Artificial Sequence
  Synthetic Oligonucleotide; PD-L1 exons 4 and 5; Set A
cucauuaguuguuguguugauucucagug

SEQ ID NO: 21953 - RNA, 35 nt, Artificial Sequence
  Synthetic Oligonucleotide; PD-L1 exons 4 and 5; Set A
aaucucauuaguuguuguguugauucucagugugc

SEQ ID NO: 21954 - RNA, 30 nt, Artificial Sequence
  Synthetic Oligonucleotide; PD-L1 exons 4 and 5; Set A
ucucauuaguuguuguguugauucucagug

SEQ ID NO: 21955 - RNA, 28 nt, Artificial Sequence
  Synthetic Oligonucleotide; PD-L1 exons 4 and 5; Set A
cucauuaguuguuguguugauucucagu

SEQ ID NO: 21956 - RNA, 34 nt, Artificial Sequence
  Synthetic Oligonucleotide; PD-L1 exons 4 and 5; Set A
aaucucauuaguuguuguguugauucucagugug

SEQ ID NO: 21957 - RNA, 31 nt, Artificial Sequence
  Synthetic Oligonucleotide; PD-L1 exons 4 and 5; Set A
aucucauuaguuguuguguugauucucagug

SEQ ID NO: 21958 - RNA, 33 nt, Artificial Sequence
  Synthetic Oligonucleotide; PD-L1 exons 4 and 5; Set A
aaucucauuaguuguuguguugauucucagugu

SEQ ID NO: 21959 - RNA, 18 nt, Artificial Sequence
  Synthetic Oligonucleotide; PD-L1 exons 4 and 5; Set C
uuaguuguuguguugauu

SEQ ID NO: 21960 - RNA, 33 nt, Artificial Sequence
  Synthetic Oligonucleotide; PD-L1 exons 4 and 5; Set A
aaaucucauuaguuguuguguugauucucagug

SEQ ID NO: 21961 - RNA, 31 nt, Artificial Sequence
  Synthetic Oligonucleotide; PD-L1 exons 4 and 5; Set A
aaucucauuaguuguuguguugauucucagu

SEQ ID NO: 21962 - RNA, 19 nt, Artificial Sequence
  Synthetic Oligonucleotide; PD-L1 exons 4 and 5; Set C
auuaguuguuguguugauu

SEQ ID NO: 21963 - RNA, 34 nt, Artificial Sequence
  Synthetic Oligonucleotide; PD-L1 exons 4 and 5; Set A
aaaaucucauuaguuguuguguugauucucagug

SEQ ID NO: 21964 - RNA, 32 nt, Artificial Sequence
  Synthetic Oligonucleotide; PD-L1 exons 4 and 5; Set A
aaaucucauuaguuguuguguugauucucagu

SEQ ID NO: 21965 - RNA, 40 nt, Artificial Sequence
  Synthetic Oligonucleotide; PD-L1 exons 4 and 5; Set A
uagaaaaucucauuaguuguuguguugauucucagugugc

SEQ ID NO: 21966 - RNA, 20 nt, Artificial Sequence
  Synthetic Oligonucleotide; PD-L1 exons 4 and 5; Set C
cauuaguuguuguguugauu

SEQ ID NO: 21967 - RNA, 35 nt, Artificial Sequence
  Synthetic Oligonucleotide; PD-L1 exons 4 and 5; Set A
gaaaaucucauuaguuguuguguugauucucagug

SEQ ID NO: 21968 - RNA, 33 nt, Artificial Sequence
  Synthetic Oligonucleotide; PD-L1 exons 4 and 5; Set A
aaaaucucauuaguuguuguguugauucucagu

SEQ ID NO: 21969 - RNA, 39 nt, Artificial Sequence
  Synthetic Oligonucleotide; PD-L1 exons 4 and 5; Set A
uagaaaaucucauuaguuguuguguugauucucagugug

SEQ ID NO: 21970 - RNA, 21 nt, Artificial Sequence
  Synthetic Oligonucleotide; PD-L1 exons 4 and 5; Set C
ucauuaguuguuguguugauu

SEQ ID NO: 21971 - RNA, 36 nt, Artificial Sequence
  Synthetic Oligonucleotide; PD-L1 exons 4 and 5; Set A
agaaaaucucauuaguuguuguguugauucucagug

SEQ ID NO: 21972 - RNA, 34 nt, Artificial Sequence
  Synthetic Oligonucleotide; PD-L1 exons 4 and 5; Set A
gaaaaucucauuaguuguuguguugauucucagu

SEQ ID NO: 21973 - RNA, 38 nt, Artificial Sequence
  Synthetic Oligonucleotide; PD-L1 exons 4 and 5; Set A
uagaaaaucucauuaguuguuguguugauucucagugu

SEQ ID NO: 21974 - RNA, 40 nt, Artificial Sequence
  Synthetic Oligonucleotide; PD-L1 exons 4 and 5; Set A
guagaaaaucucauuaguuguuguguugauucucagugug

SEQ ID NO: 21975 - RNA, 21 nt, Artificial Sequence
  Synthetic Oligonucleotide; PD-L1 exons 4 and 5; Set C
cucauuaguuguuguguugau

SEQ ID NO: 21976 - RNA, 35 nt, Artificial Sequence
  Synthetic Oligonucleotide; PD-L1 exons 4 and 5; Set A
agaaaaucucauuaguuguuguguugauucucagu

SEQ ID NO: 21977 - RNA, 39 nt, Artificial Sequence
  Synthetic Oligonucleotide; PD-L1 exons 4 and 5; Set A
guagaaaaucucauuaguuguuguguugauucucagugu

SEQ ID NO: 21978 - RNA, 22 nt, Artificial Sequence
  Synthetic Oligonucleotide; PD-L1 exons 4 and 5; Set C
ucucauuaguuguuguguugau

SEQ ID NO: 21979 - RNA, 36 nt, Artificial Sequence
  Synthetic Oligonucleotide; PD-L1 exons 4 and 5; Set A
uagaaaaucucauuaguuguuguguugauucucagu

SEQ ID NO: 21980 - RNA, 40 nt, Artificial Sequence
  Synthetic Oligonucleotide; PD-L1 exons 4 and 5; Set A
aguagaaaaucucauuaguuguuguguugauucucagugu

SEQ ID NO: 21981 - RNA, 23 nt, Artificial Sequence
  Synthetic Oligonucleotide; PD-L1 exons 4 and 5; Set C
aucucauuaguuguuguguugau

SEQ ID NO: 21982 - RNA, 31 nt, Artificial Sequence
  Synthetic Oligonucleotide; PD-L1 exons 4 and 5; Set C
guagaaaaucucauuaguuguuguguugauu

SEQ ID NO: 21983 - RNA, 31 nt, Artificial Sequence
  Synthetic Oligonucleotide; PD-L1 exons 4 and 5; Set C
caguagaaaaucucauuaguuguuguguuga

SEQ ID NO: 21984 - RNA, 32 nt, Artificial Sequence
  Synthetic Oligonucleotide; PD-L1 exons 4 and 5; Set A
gcaguagaaaaucucauuaguuguuguguuga

SEQ ID NO: 21985 - RNA, 30 nt, Artificial Sequence
  Synthetic Oligonucleotide; PD-L1 exons 4 and 5; Set C
caguagaaaaucucauuaguuguuguguug

SEQ ID NO: 21986 - RNA, 33 nt, Artificial Sequence
  Synthetic Oligonucleotide; PD-L1 exons 4 and 5; Set A
ugcaguagaaaaucucauuaguuguuguguuga

SEQ ID NO: 21987 - RNA, 29 nt, Artificial Sequence
  Synthetic Oligonucleotide; PD-L1 exons 4 and 5; Set C
caguagaaaaucucauuaguuguuguguu

SEQ ID NO: 21988 - RNA, 31 nt, Artificial Sequence
  Synthetic Oligonucleotide; PD-L1 exons 4 and 5; Set A
gcaguagaaaaucucauuaguuguuguguug

SEQ ID NO: 21989 - RNA, 35 nt, Artificial Sequence
  Synthetic Oligonucleotide; PD-L1 exons 4 and 5; Set A
gugcaguagaaaaucucauuaguuguuguguugau

SEQ ID NO: 21990 - RNA, 34 nt, Artificial Sequence
  Synthetic Oligonucleotide; PD-L1 exons 4 and 5; Set A
gugcaguagaaaaucucauuaguuguuguguuga

SEQ ID NO: 21991 - RNA, 28 nt, Artificial Sequence
  Synthetic Oligonucleotide; PD-L1 exons 4 and 5; Set C
caguagaaaaucucauuaguuguugugu

SEQ ID NO: 21992 - RNA, 30 nt, Artificial Sequence
  Synthetic Oligonucleotide; PD-L1 exons 4 and 5; Set A
gcaguagaaaaucucauuaguuguuguguu

SEQ ID NO: 21993 - RNA, 32 nt, Artificial Sequence
  Synthetic Oligonucleotide; PD-L1 exons 4 and 5; Set A
ugcaguagaaaaucucauuaguuguuguguug

SEQ ID NO: 21994 - RNA, 31 nt, Artificial Sequence
  Synthetic Oligonucleotide; PD-L1 exons 4 and 5; Set A
ugcaguagaaaaucucauuaguuguuguguu

SEQ ID NO: 21995 - RNA, 27 nt, Artificial Sequence
  Synthetic Oligonucleotide; PD-L1 exons 4 and 5; Set C
caguagaaaaucucauuaguuguugug

SEQ ID NO: 21996 - RNA, 29 nt, Artificial Sequence
  Synthetic Oligonucleotide; PD-L1 exons 4 and 5; Set C
gcaguagaaaaucucauuaguuguugugu

SEQ ID NO: 21997 - RNA, 33 nt, Artificial Sequence
  Synthetic Oligonucleotide; PD-L1 exons 4 and 5; Set A
gugcaguagaaaaucucauuaguuguuguguug

SEQ ID NO: 21998 - RNA, 32 nt, Artificial Sequence
  Synthetic Oligonucleotide; PD-L1 exons 4 and 5; Set A
gugcaguagaaaaucucauuaguuguuguguu

SEQ ID NO: 21999 - RNA, 30 nt, Artificial Sequence
  Synthetic Oligonucleotide; PD-L1 exons 4 and 5; Set A
ugcaguagaaaaucucauuaguuguugugu

SEQ ID NO: 22000 - RNA, 26 nt, Artificial Sequence
  Synthetic Oligonucleotide; PD-L1 exons 4 and 5; Set C
caguagaaaaucucauuaguuguugu

SEQ ID NO: 22001 - RNA, 28 nt, Artificial Sequence
  Synthetic Oligonucleotide; PD-L1 exons 4 and 5; Set C
gcaguagaaaaucucauuaguuguugug

SEQ ID NO: 22002 - RNA, 37 nt, Artificial Sequence
  Synthetic Oligonucleotide; PD-L1 exons 4 and 5; Set A
aaagugcaguagaaaaucucauuaguuguuguguuga

SEQ ID NO: 22003 - RNA, 31 nt, Artificial Sequence
  Synthetic Oligonucleotide; PD-L1 exons 4 and 5; Set A
gugcaguagaaaaucucauuaguuguugugu

SEQ ID NO: 22004 - RNA, 29 nt, Artificial Sequence
  Synthetic Oligonucleotide; PD-L1 exons 4 and 5; Set C
ugcaguagaaaaucucauuaguuguugug

SEQ ID NO: 22005 - RNA, 25 nt, Artificial Sequence
  Synthetic Oligonucleotide; PD-L1 exons 4 and 5; Set C
caguagaaaaucucauuaguuguug

SEQ ID NO: 22006 - RNA, 27 nt, Artificial Sequence
  Synthetic Oligonucleotide; PD-L1 exons 4 and 5; Set C
gcaguagaaaaucucauuaguuguugu

SEQ ID NO: 22007 - RNA, 30 nt, Artificial Sequence
  Synthetic Oligonucleotide; PD-L1 exons 4 and 5; Set A
gugcaguagaaaaucucauuaguuguugug

SEQ ID NO: 22008 - RNA, 28 nt, Artificial Sequence
  Synthetic Oligonucleotide; PD-L1 exons 4 and 5; Set C
ugcaguagaaaaucucauuaguuguugu

SEQ ID NO: 22009 - RNA, 24 nt, Artificial Sequence
  Synthetic Oligonucleotide; PD-L1 exons 4 and 5; Set C
caguagaaaaucucauuaguuguu

SEQ ID NO: 22010 - RNA, 26 nt, Artificial Sequence
  Synthetic Oligonucleotide; PD-L1 exons 4 and 5; Set C
gcaguagaaaaucucauuaguuguug

SEQ ID NO: 22011 - RNA, 36 nt, Artificial Sequence
  Synthetic Oligonucleotide; PD-L1 exons 4 and 5; Set A
aaagugcaguagaaaaucucauuaguuguuguguug

SEQ ID NO: 22012 - RNA, 23 nt, Artificial Sequence
  Synthetic Oligonucleotide; PD-L1 exons 4 and 5; Set C
caguagaaaaucucauuaguugu

SEQ ID NO: 22013 - RNA, 29 nt, Artificial Sequence
  Synthetic Oligonucleotide; PD-L1 exons 4 and 5; Set C
gugcaguagaaaaucucauuaguuguugu

SEQ ID NO: 22014 - RNA, 35 nt, Artificial Sequence
  Synthetic Oligonucleotide; PD-L1 exons 4 and 5; Set A
aaagugcaguagaaaaucucauuaguuguuguguu

SEQ ID NO: 22015 - RNA, 27 nt, Artificial Sequence
  Synthetic Oligonucleotide; PD-L1 exons 4 and 5; Set C
ugcaguagaaaaucucauuaguuguug

SEQ ID NO: 22016 - RNA, 25 nt, Artificial Sequence
  Synthetic Oligonucleotide; PD-L1 exons 4 and 5; Set C
gcaguagaaaaucucauuaguuguu

SEQ ID NO: 22017 - RNA, 22 nt, Artificial Sequence
  Synthetic Oligonucleotide; PD-L1 exons 4 and 5; Set C
caguagaaaaucucauuaguug

SEQ ID NO: 22018 - RNA, 24 nt, Artificial Sequence
  Synthetic Oligonucleotide; PD-L1 exons 4 and 5; Set C
gcaguagaaaaucucauuaguugu

SEQ ID NO: 22019 - RNA, 28 nt, Artificial Sequence
  Synthetic Oligonucleotide; PD-L1 exons 4 and 5; Set C
gugcaguagaaaaucucauuaguuguug

SEQ ID NO: 22020 - RNA, 34 nt, Artificial Sequence
  Synthetic Oligonucleotide; PD-L1 exons 4 and 5; Set A
aaagugcaguagaaaaucucauuaguuguugugu

SEQ ID NO: 22021 - RNA, 26 nt, Artificial Sequence
  Synthetic Oligonucleotide; PD-L1 exons 4 and 5; Set C
ugcaguagaaaaucucauuaguuguu

SEQ ID NO: 22022 - RNA, 25 nt, Artificial Sequence
  Synthetic Oligonucleotide; PD-L1 exons 4 and 5; Set C
ugcaguagaaaaucucauuaguugu

SEQ ID NO: 22023 - RNA, 23 nt, Artificial Sequence
  Synthetic Oligonucleotide; PD-L1 exons 4 and 5; Set C
gcaguagaaaaucucauuaguug

SEQ ID NO: 22024 - RNA, 27 nt, Artificial Sequence
  Synthetic Oligonucleotide; PD-L1 exons 4 and 5; Set C
gugcaguagaaaaucucauuaguuguu

SEQ ID NO: 22025 - RNA, 33 nt, Artificial Sequence
  Synthetic Oligonucleotide; PD-L1 exons 4 and 5; Set C
aaagugcaguagaaaaucucauuaguuguugug

SEQ ID NO: 22026 - RNA, 26 nt, Artificial Sequence
  Synthetic Oligonucleotide; PD-L1 exons 4 and 5; Set C
gugcaguagaaaaucucauuaguugu

SEQ ID NO: 22027 - RNA, 24 nt, Artificial Sequence
  Synthetic Oligonucleotide; PD-L1 exons 4 and 5; Set C
ugcaguagaaaaucucauuaguug

SEQ ID NO: 22028 - RNA, 32 nt, Artificial Sequence
  Synthetic Oligonucleotide; PD-L1 exons 4 and 5; Set C
aaagugcaguagaaaaucucauuaguuguugu

SEQ ID NO: 22029 - RNA, 25 nt, Artificial Sequence
  Synthetic Oligonucleotide; PD-L1 exons 4 and 5; Set C
gugcaguagaaaaucucauuaguug

SEQ ID NO: 22030 - RNA, 31 nt, Artificial Sequence
  Synthetic Oligonucleotide; PD-L1 exons 4 and 5; Set C
aaagugcaguagaaaaucucauuaguuguug

SEQ ID NO: 22031 - RNA, 18 nt, Artificial Sequence
  Synthetic Oligonucleotide; PD-L1 exons 4 and 5; Set C
caguagaaaaucucauua

SEQ ID NO: 22032 - RNA, 30 nt, Artificial Sequence
  Synthetic Oligonucleotide; PD-L1 exons 4 and 5; Set C
aaagugcaguagaaaaucucauuaguuguu

SEQ ID NO: 22033 - RNA, 24 nt, Artificial Sequence
  Synthetic Oligonucleotide; PD-L1 exons 4 and 5; Set C
gugcaguagaaaaucucauuaguu

SEQ ID NO: 22034 - RNA, 19 nt, Artificial Sequence
  Synthetic Oligonucleotide; PD-L1 exons 4 and 5; Set C
gcaguagaaaaucucauua

SEQ ID NO: 22035 - RNA, 17 nt, Artificial Sequence
  Synthetic Oligonucleotide; PD-L1 exons 4 and 5; Set C
caguagaaaaucucauu

SEQ ID NO: 22036 - RNA, 29 nt, Artificial Sequence
  Synthetic Oligonucleotide; PD-L1 exons 4 and 5; Set C
aaagugcaguagaaaaucucauuaguugu

SEQ ID NO: 22037 - RNA, 23 nt, Artificial Sequence
  Synthetic Oligonucleotide; PD-L1 exons 4 and 5; Set C
gugcaguagaaaaucucauuagu

SEQ ID NO: 22038 - RNA, 20 nt, Artificial Sequence
  Synthetic Oligonucleotide; PD-L1 exons 4 and 5; Set C
ugcaguagaaaaucucauua

SEQ ID NO: 22039 - RNA, 18 nt, Artificial Sequence
  Synthetic Oligonucleotide; PD-L1 exons 4 and 5; Set C
gcaguagaaaaucucauu

SEQ ID NO: 22040 - RNA, 16 nt, Artificial Sequence
  Synthetic Oligonucleotide; PD-L1 exons 4 and 5; Set C
caguagaaaaucucau

SEQ ID NO: 22041 - RNA, 28 nt, Artificial Sequence
  Synthetic Oligonucleotide; PD-L1 exons 4 and 5; Set C
aaagugcaguagaaaaucucauuaguug

SEQ ID NO: 22042 - RNA, 22 nt, Artificial Sequence
  Synthetic Oligonucleotide; PD-L1 exons 4 and 5; Set C
gugcaguagaaaaucucauuag

SEQ ID NO: 22043 - RNA, 21 nt, Artificial Sequence
  Synthetic Oligonucleotide; PD-L1 exons 4 and 5; Set C
gugcaguagaaaaucucauua

SEQ ID NO: 22044 - RNA, 19 nt, Artificial Sequence
  Synthetic Oligonucleotide; PD-L1 exons 4 and 5; Set C
ugcaguagaaaaucucauu

SEQ ID NO: 22045 - RNA, 17 nt, Artificial Sequence
  Synthetic Oligonucleotide; PD-L1 exons 4 and 5; Set C
gcaguagaaaaucucau

SEQ ID NO: 22046 - RNA, 15 nt, Artificial Sequence
  Synthetic Oligonucleotide; PD-L1 exons 4 and 5; Set C
caguagaaaaucuca

SEQ ID NO: 22047 - RNA, 20 nt, Artificial Sequence
  Synthetic Oligonucleotide; PD-L1 exons 4 and 5; Set C
gugcaguagaaaaucucauu

SEQ ID NO: 22048 - RNA, 18 nt, Artificial Sequence
  Synthetic Oligonucleotide; PD-L1 exons 4 and 5; Set C
ugcaguagaaaaucucau

SEQ ID NO: 22049 - RNA, 40 nt, Artificial Sequence
  Synthetic Oligonucleotide; PD-L1 exons 4 and 5; Set A
ucuccuaaaagugcaguagaaaaucucauuaguuguugug

SEQ ID NO: 22050 - RNA, 19 nt, Artificial Sequence
  Synthetic Oligonucleotide; PD-L1 exons 4 and 5; Set C
gugcaguagaaaaucucau

SEQ ID NO: 22051 - RNA, 17 nt, Artificial Sequence
  Synthetic Oligonucleotide; PD-L1 exons 4 and 5; Set C
ugcaguagaaaaucuca

SEQ ID NO: 22052 - RNA, 39 nt, Artificial Sequence
  Synthetic Oligonucleotide; PD-L1 exons 4 and 5; Set A
ucuccuaaaagugcaguagaaaaucucauuaguuguugu

SEQ ID NO: 22053 - RNA, 24 nt, Artificial Sequence
  Synthetic Oligonucleotide; PD-L1 exons 4 and 5; Set C
aaagugcaguagaaaaucucauua

SEQ ID NO: 22054 - RNA, 18 nt, Artificial Sequence
  Synthetic Oligonucleotide; PD-L1 exons 4 and 5; Set C
gugcaguagaaaaucuca

SEQ ID NO: 22055 - RNA, 40 nt, Artificial Sequence
  Synthetic Oligonucleotide; PD-L1 exons 4 and 5; Set A
aucuccuaaaagugcaguagaaaaucucauuaguuguugu

SEQ ID NO: 22056 - RNA, 38 nt, Artificial Sequence
  Synthetic Oligonucleotide; PD-L1 exons 4 and 5; Set A
ucuccuaaaagugcaguagaaaaucucauuaguuguug

SEQ ID NO: 22057 - RNA, 23 nt, Artificial Sequence
  Synthetic Oligonucleotide; PD-L1 exons 4 and 5; Set C
aaagugcaguagaaaaucucauu

SEQ ID NO: 22058 - RNA, 39 nt, Artificial Sequence
  Synthetic Oligonucleotide; PD-L1 exons 4 and 5; Set A
aucuccuaaaagugcaguagaaaaucucauuaguuguug

SEQ ID NO: 22059 - RNA, 37 nt, Artificial Sequence
  Synthetic Oligonucleotide; PD-L1 exons 4 and 5; Set B
ucuccuaaaagugcaguagaaaaucucauuaguuguu

SEQ ID NO: 22060 - RNA, 22 nt, Artificial Sequence
  Synthetic Oligonucleotide; PD-L1 exons 4 and 5; Set C
aaagugcaguagaaaaucucau

SEQ ID NO: 22061 - RNA, 36 nt, Artificial Sequence
  Synthetic Oligonucleotide; PD-L1 exons 4 and 5; Set B
ucuccuaaaagugcaguagaaaaucucauuaguugu

SEQ ID NO: 22062 - RNA, 40 nt, Artificial Sequence
  Synthetic Oligonucleotide; PD-L1 exons 4 and 5; Set A
aaucuccuaaaagugcaguagaaaaucucauuaguuguug

SEQ ID NO: 22063 - RNA, 38 nt, Artificial Sequence
  Synthetic Oligonucleotide; PD-L1 exons 4 and 5; Set B
aucuccuaaaagugcaguagaaaaucucauuaguuguu

SEQ ID NO: 22064 - RNA, 18 nt, Artificial Sequence
  Synthetic Oligonucleotide; PD-L1 exons 4 and 5; Set C
agugcaguagaaaaucuc

SEQ ID NO: 22065 - RNA, 21 nt, Artificial Sequence
  Synthetic Oligonucleotide; PD-L1 exons 4 and 5; Set C
aaagugcaguagaaaaucuca

SEQ ID NO: 22066 - RNA, 37 nt, Artificial Sequence
  Synthetic Oligonucleotide; PD-L1 exons 4 and 5; Set B
aucuccuaaaagugcaguagaaaaucucauuaguugu

SEQ ID NO: 22067 - RNA, 35 nt, Artificial Sequence
  Synthetic Oligonucleotide; PD-L1 exons 4 and 5; Set B
ucuccuaaaagugcaguagaaaaucucauuaguug

SEQ ID NO: 22068 - RNA, 39 nt, Artificial Sequence
  Synthetic Oligonucleotide; PD-L1 exons 4 and 5; Set B
aaucuccuaaaagugcaguagaaaaucucauuaguuguu

SEQ ID NO: 22069 - RNA, 19 nt, Artificial Sequence
  Synthetic Oligonucleotide; PD-L1 exons 4 and 5; Set C
aagugcaguagaaaaucuc

SEQ ID NO: 22070 - RNA, 17 nt, Artificial Sequence
  Synthetic Oligonucleotide; PD-L1 exons 4 and 5; Set C
agugcaguagaaaaucu

SEQ ID NO: 22071 - RNA, 38 nt, Artificial Sequence
  Synthetic Oligonucleotide; PD-L1 exons 4 and 5; Set B
aaucuccuaaaagugcaguagaaaaucucauuaguugu

SEQ ID NO: 22072 - RNA, 36 nt, Artificial Sequence
  Synthetic Oligonucleotide; PD-L1 exons 4 and 5; Set B
aucuccuaaaagugcaguagaaaaucucauuaguug

SEQ ID NO: 22073 - RNA, 18 nt, Artificial Sequence
  Synthetic Oligonucleotide; PD-L1 exons 4 and 5; Set C
aagugcaguagaaaaucu

SEQ ID NO: 22074 - RNA, 16 nt, Artificial Sequence
  Synthetic Oligonucleotide; PD-L1 exons 4 and 5; Set C
agugcaguagaaaauc

SEQ ID NO: 22075 - RNA, 37 nt, Artificial Sequence
  Synthetic Oligonucleotide; PD-L1 exons 4 and 5; Set B
aaucuccuaaaagugcaguagaaaaucucauuaguug

SEQ ID NO: 22076 - RNA, 35 nt, Artificial Sequence
  Synthetic Oligonucleotide; PD-L1 exons 4 and 5; Set B
aucuccuaaaagugcaguagaaaaucucauuaguu

SEQ ID NO: 22077 - RNA, 17 nt, Artificial Sequence
  Synthetic Oligonucleotide; PD-L1 exons 4 and 5; Set C
aagugcaguagaaaauc

SEQ ID NO: 22078 - RNA, 36 nt, Artificial Sequence
  Synthetic Oligonucleotide; PD-L1 exons 4 and 5; Set C
aaucuccuaaaagugcaguagaaaaucucauuaguu

SEQ ID NO: 22079 - RNA, 34 nt, Artificial Sequence
  Synthetic Oligonucleotide; PD-L1 exons 4 and 5; Set B
aucuccuaaaagugcaguagaaaaucucauuagu

SEQ ID NO: 22080 - RNA, 31 nt, Artificial Sequence
  Synthetic Oligonucleotide; PD-L1 exons 4 and 5; Set C
ucuccuaaaagugcaguagaaaaucucauua

SEQ ID NO: 22081 - RNA, 35 nt, Artificial Sequence
  Synthetic Oligonucleotide; PD-L1 exons 4 and 5; Set C
aaucuccuaaaagugcaguagaaaaucucauuagu

SEQ ID NO: 22082 - RNA, 33 nt, Artificial Sequence
  Synthetic Oligonucleotide; PD-L1 exons 4 and 5; Set C
aucuccuaaaagugcaguagaaaaucucauuag

SEQ ID NO: 22083 - RNA, 15 nt, Artificial Sequence
  Synthetic Oligonucleotide; PD-L1 exons 4 and 5; Set C
aagugcaguagaaaa

SEQ ID NO: 22084 - RNA, 32 nt, Artificial Sequence
  Synthetic Oligonucleotide; PD-L1 exons 4 and 5; Set C
aucuccuaaaagugcaguagaaaaucucauua

SEQ ID NO: 22085 - RNA, 34 nt, Artificial Sequence
  Synthetic Oligonucleotide; PD-L1 exons 4 and 5; Set C
aaucuccuaaaagugcaguagaaaaucucauuag

SEQ ID NO: 22086 - RNA, 33 nt, Artificial Sequence
  Synthetic Oligonucleotide; PD-L1 exons 4 and 5; Set C
aaucuccuaaaagugcaguagaaaaucucauua

SEQ ID NO: 22087 - RNA, 31 nt, Artificial Sequence
  Synthetic Oligonucleotide; PD-L1 exons 4 and 5; Set C
aucuccuaaaagugcaguagaaaaucucauu

SEQ ID NO: 22088 - RNA, 32 nt, Artificial Sequence
  Synthetic Oligonucleotide; PD-L1 exons 4 and 5; Set C
aaucuccuaaaagugcaguagaaaaucucauu

SEQ ID NO: 22089 - RNA, 30 nt, Artificial Sequence
  Synthetic Oligonucleotide; PD-L1 exons 4 and 5; Set C
aucuccuaaaagugcaguagaaaaucucau

SEQ ID NO: 22090 - RNA, 31 nt, Artificial Sequence
  Synthetic Oligonucleotide; PD-L1 exons 4 and 5; Set C
aaucuccuaaaagugcaguagaaaaucucau

SEQ ID NO: 22091 - RNA, 29 nt, Artificial Sequence
  Synthetic Oligonucleotide; PD-L1 exons 4 and 5; Set C
aucuccuaaaagugcaguagaaaaucuca

SEQ ID NO: 22092 - RNA, 30 nt, Artificial Sequence
  Synthetic Oligonucleotide; PD-L1 exons 4 and 5; Set C
aaucuccuaaaagugcaguagaaaaucuca

SEQ ID NO: 22093 - RNA, 30 nt, Artificial Sequence
  Synthetic Oligonucleotide; PD-L1 exons 4 and 5; Set C
aucuaaucuccuaaaagugcaguagaaaau

SEQ ID NO: 22094 - RNA, 25 nt, Artificial Sequence
  Synthetic Oligonucleotide; PD-L1 exons 4 and 5; Set C
aucuaaucuccuaaaagugcaguag

SEQ ID NO: 22095 - RNA, 24 nt, Artificial Sequence
  Synthetic Oligonucleotide; PD-L1 exons 4 and 5; Set C
aucuaaucuccuaaaagugcagua

SEQ ID NO: 22096 - RNA, 23 nt, Artificial Sequence
  Synthetic Oligonucleotide; PD-L1 exons 4 and 5; Set C
aucuaaucuccuaaaagugcagu

SEQ ID NO: 22097 - RNA, 18 nt, Artificial Sequence
  Synthetic Oligonucleotide; PD-L1 exons 4 and 5; Set C
aucuaaucuccuaaaagu

SEQ ID NO: 22098 - RNA, 40 nt, Artificial Sequence
  Synthetic Oligonucleotide; PD-L1 exons 4 and 5; Set C
guaugguuuuccucaggaucuaaucuccuaaaagugcagu

SEQ ID NO: 22099 - RNA, 36 nt, Artificial Sequence
  Synthetic Oligonucleotide; PD-L1 exons 4 and 5; Set B
uguaugguuuuccucaggaucuaaucuccuaaaagu

SEQ ID NO: 22100 - RNA, 37 nt, Artificial Sequence
  Synthetic Oligonucleotide; PD-L1 exons 4 and 5; Set B
cuguaugguuuuccucaggaucuaaucuccuaaaagu

SEQ ID NO: 22101 - RNA, 38 nt, Artificial Sequence
  Synthetic Oligonucleotide; PD-L1 exons 4 and 5; Set B
gcuguaugguuuuccucaggaucuaaucuccuaaaagu

SEQ ID NO: 22102 - RNA, 39 nt, Artificial Sequence
  Synthetic Oligonucleotide; PD-L1 exons 4 and 5; Set B
agcuguaugguuuuccucaggaucuaaucuccuaaaagu

SEQ ID NO: 22103 - RNA, 40 nt, Artificial Sequence
  Synthetic Oligonucleotide; PD-L1 exons 4 and 5; Set C
cagcuguaugguuuuccucaggaucuaaucuccuaaaagu

SEQ ID NO: 22104 - RNA, 24 nt, Artificial Sequence
  Synthetic Oligonucleotide; PD-L1 exons 4 and 5; Set B
agcuguaugguuuuccucaggauc

SEQ ID NO: 22105 - RNA, 25 nt, Artificial Sequence
  Synthetic Oligonucleotide; PD-L1 exons 4 and 5; Set B
cagcuguaugguuuuccucaggauc

SEQ ID NO: 22106 - RNA, 26 nt, Artificial Sequence
  Synthetic Oligonucleotide; PD-L1 exons 4 and 5; Set B
ucagcuguaugguuuuccucaggauc

SEQ ID NO: 22107 - RNA, 27 nt, Artificial Sequence
  Synthetic Oligonucleotide; PD-L1 exons 4 and 5; Set B
uucagcuguaugguuuuccucaggauc

SEQ ID NO: 22108 - RNA, 28 nt, Artificial Sequence
  Synthetic Oligonucleotide; PD-L1 exons 4 and 5; Set B
auucagcuguaugguuuuccucaggauc

SEQ ID NO: 22109 - RNA, 15 nt, Artificial Sequence
  Synthetic Oligonucleotide; PD-L1 exons 4 and 5; Set C
ucagcuguaugguuu

SEQ ID NO: 22110 - RNA, 17 nt, Artificial Sequence
  Synthetic Oligonucleotide; PD-L1 exons 4 and 5; Set C
uucagcuguaugguuuu

SEQ ID NO: 22111 - RNA, 16 nt, Artificial Sequence
  Synthetic Oligonucleotide; PD-L1 exons 4 and 5; Set C
uucagcuguaugguuu

SEQ ID NO: 22112 - RNA, 18 nt, Artificial Sequence
  Synthetic Oligonucleotide; PD-L1 exons 4 and 5; Set C
auucagcuguaugguuuu

SEQ ID NO: 22113 - RNA, 17 nt, Artificial Sequence
  Synthetic Oligonucleotide; PD-L1 exons 4 and 5; Set C
auucagcuguaugguuu

SEQ ID NO: 22114 - RNA, 40 nt, Artificial Sequence
  Synthetic Oligonucleotide; PD-L1 exons 4 and 5; Set C
uaauggacacauucagaauauuaccugggaugaccaauuc

SEQ ID NO: 22115 - RNA, 39 nt, Artificial Sequence
  Synthetic Oligonucleotide; PD-L1 exons 4 and 5; Set C
uaauggacacauucagaauauuaccugggaugaccaauu

SEQ ID NO: 22116 - RNA, 40 nt, Artificial Sequence
  Synthetic Oligonucleotide; PD-L1 exons 4 and 5; Set C
uuaauggacacauucagaauauuaccugggaugaccaauu

SEQ ID NO: 22117 - RNA, 22 nt, Artificial Sequence
  Synthetic Oligonucleotide; PD-L1 exons 4 and 5; Set C
aauggacacauucagaauauua

SEQ ID NO: 22118 - RNA, 23 nt, Artificial Sequence
  Synthetic Oligonucleotide; PD-L1 exons 4 and 5; Set C
uaauggacacauucagaauauua

SEQ ID NO: 22119 - RNA, 28 nt, Artificial Sequence
  Synthetic Oligonucleotide; PD-L1 exons 4 and 5; Set C
uauuuuaauggacacauucagaauauua

SEQ ID NO: 22120 - RNA, 16 nt, Artificial Sequence
  Synthetic Oligonucleotide; PD-L1 exons 4 and 5; Set C
uaauggacacauucag

SEQ ID NO: 22121 - RNA, 17 nt, Artificial Sequence
  Synthetic Oligonucleotide; PD-L1 exons 4 and 5; Set C
uuaauggacacauucag

SEQ ID NO: 22122 - RNA, 18 nt, Artificial Sequence
  Synthetic Oligonucleotide; PD-L1 exons 4 and 5; Set C
uuuaauggacacauucag

SEQ ID NO: 22123 - RNA, 16 nt, Artificial Sequence
  Synthetic Oligonucleotide; PD-L1 exons 4 and 5; Set C
uuaauggacacauuca

SEQ ID NO: 22124 - RNA, 19 nt, Artificial Sequence
  Synthetic Oligonucleotide; PD-L1 exons 4 and 5; Set C
uuuuaauggacacauucag

SEQ ID NO: 22125 - RNA, 15 nt, Artificial Sequence
  Synthetic Oligonucleotide; PD-L1 exons 4 and 5; Set C
uuaauggacacauuc

SEQ ID NO: 22126 - RNA, 17 nt, Artificial Sequence
  Synthetic Oligonucleotide; PD-L1 exons 4 and 5; Set C
uuuaauggacacauuca

SEQ ID NO: 22127 - RNA, 20 nt, Artificial Sequence
  Synthetic Oligonucleotide; PD-L1 exons 4 and 5; Set C
auuuuaauggacacauucag

SEQ ID NO: 22128 - RNA, 16 nt, Artificial Sequence
  Synthetic Oligonucleotide; PD-L1 exons 4 and 5; Set C
uuuaauggacacauuc

SEQ ID NO: 22129 - RNA, 18 nt, Artificial Sequence
  Synthetic Oligonucleotide; PD-L1 exons 4 and 5; Set C
uuuuaauggacacauuca

SEQ ID NO: 22130 - RNA, 17 nt, Artificial Sequence
  Synthetic Oligonucleotide; PD-L1 exons 4 and 5; Set C
uuuuaauggacacauuc

SEQ ID NO: 22131 - RNA, 19 nt, Artificial Sequence
  Synthetic Oligonucleotide; PD-L1 exons 4 and 5; Set C
auuuuaauggacacauuca

SEQ ID NO: 22132 - RNA, 36 nt, Artificial Sequence
  Synthetic Oligonucleotide; PD-L1 exons 4 and 5; Set B
guuagacauauuuuaauggacacauucagaauauua

SEQ ID NO: 22133 - RNA, 18 nt, Artificial Sequence
  Synthetic Oligonucleotide; PD-L1 exons 4 and 5; Set C
auuuuaauggacacauuc

SEQ ID NO: 22134 - RNA, 37 nt, Artificial Sequence
  Synthetic Oligonucleotide; PD-L1 exons 4 and 5; Set B
uguuagacauauuuuaauggacacauucagaauauua

SEQ ID NO: 22135 - RNA, 38 nt, Artificial Sequence
  Synthetic Oligonucleotide; PD-L1 exons 4 and 5; Set B
guguuagacauauuuuaauggacacauucagaauauua

SEQ ID NO: 22136 - RNA, 18 nt, Artificial Sequence
  Synthetic Oligonucleotide; PD-L1 exons 4 and 5; Set C
uauuuuaauggacacauu

SEQ ID NO: 22137 - RNA, 39 nt, Artificial Sequence
  Synthetic Oligonucleotide; PD-L1 exons 4 and 5; Set B
aguguuagacauauuuuaauggacacauucagaauauua

SEQ ID NO: 22138 - RNA, 28 nt, Artificial Sequence
  Synthetic Oligonucleotide; PD-L1 exons 4 and 5; Set C
uuagacauauuuuaauggacacauucag

SEQ ID NO: 22139 - RNA, 29 nt, Artificial Sequence
  Synthetic Oligonucleotide; PD-L1 exons 4 and 5; Set C
guuagacauauuuuaauggacacauucag

SEQ ID NO: 22140 - RNA, 30 nt, Artificial Sequence
  Synthetic Oligonucleotide; PD-L1 exons 4 and 5; Set C
uguuagacauauuuuaauggacacauucag

SEQ ID NO: 22141 - RNA, 31 nt, Artificial Sequence
  Synthetic Oligonucleotide; PD-L1 exons 4 and 5; Set B
guguuagacauauuuuaauggacacauucag

SEQ ID NO: 22142 - RNA, 26 nt, Artificial Sequence
  Synthetic Oligonucleotide; PD-L1 exons 4 and 5; Set C
guuagacauauuuuaauggacacauu

SEQ ID NO: 22143 - RNA, 24 nt, Artificial Sequence
  Synthetic Oligonucleotide; PD-L1 exons 4 and 5; Set C
uuagacauauuuuaauggacacau

SEQ ID NO: 22144 - RNA, 32 nt, Artificial Sequence
  Synthetic Oligonucleotide; PD-L1 exons 4 and 5; Set B
aguguuagacauauuuuaauggacacauucag

SEQ ID NO: 22145 - RNA, 27 nt, Artificial Sequence
  Synthetic Oligonucleotide; PD-L1 exons 4 and 5; Set C
uguuagacauauuuuaauggacacauu

SEQ ID NO: 22146 - RNA, 25 nt, Artificial Sequence
  Synthetic Oligonucleotide; PD-L1 exons 4 and 5; Set C
guuagacauauuuuaauggacacau

SEQ ID NO: 22147 - RNA, 23 nt, Artificial Sequence
  Synthetic Oligonucleotide; PD-L1 exons 4 and 5; Set C
uuagacauauuuuaauggacaca

SEQ ID NO: 22148 - RNA, 28 nt, Artificial Sequence
  Synthetic Oligonucleotide; PD-L1 exons 4 and 5; Set C
guguuagacauauuuuaauggacacauu

SEQ ID NO: 22149 - RNA, 26 nt, Artificial Sequence
  Synthetic Oligonucleotide; PD-L1 exons 4 and 5; Set C
uguuagacauauuuuaauggacacau

SEQ ID NO: 22150 - RNA, 24 nt, Artificial Sequence
  Synthetic Oligonucleotide; PD-L1 exons 4 and 5; Set C
guuagacauauuuuaauggacaca

SEQ ID NO: 22151 - RNA, 22 nt, Artificial Sequence
  Synthetic Oligonucleotide; PD-L1 exons 4 and 5; Set C
uuagacauauuuuaauggacac

SEQ ID NO: 22152 - RNA, 29 nt, Artificial Sequence
  Synthetic Oligonucleotide; PD-L1 exons 4 and 5; Set C
aguguuagacauauuuuaauggacacauu

SEQ ID NO: 22153 - RNA, 21 nt, Artificial Sequence
  Synthetic Oligonucleotide; PD-L1 exons 4 and 5; Set C
uuagacauauuuuaauggaca

SEQ ID NO: 22154 - RNA, 27 nt, Artificial Sequence
  Synthetic Oligonucleotide; PD-L1 exons 4 and 5; Set C
guguuagacauauuuuaauggacacau

SEQ ID NO: 22155 - RNA, 25 nt, Artificial Sequence
  Synthetic Oligonucleotide; PD-L1 exons 4 and 5; Set C
uguuagacauauuuuaauggacaca

SEQ ID NO: 22156 - RNA, 23 nt, Artificial Sequence
  Synthetic Oligonucleotide; PD-L1 exons 4 and 5; Set C
guuagacauauuuuaauggacac

SEQ ID NO: 22157 - RNA, 22 nt, Artificial Sequence
  Synthetic Oligonucleotide; PD-L1 exons 4 and 5; Set C
guuagacauauuuuaauggaca

SEQ ID NO: 22158 - RNA, 20 nt, Artificial Sequence
  Synthetic Oligonucleotide; PD-L1 exons 4 and 5; Set C
uuagacauauuuuaauggac

SEQ ID NO: 22159 - RNA, 28 nt, Artificial Sequence
  Synthetic Oligonucleotide; PD-L1 exons 4 and 5; Set C
aguguuagacauauuuuaauggacacau

SEQ ID NO: 22160 - RNA, 26 nt, Artificial Sequence
  Synthetic Oligonucleotide; PD-L1 exons 4 and 5; Set C
guguuagacauauuuuaauggacaca

SEQ ID NO: 22161 - RNA, 36 nt, Artificial Sequence
  Synthetic Oligonucleotide; PD-L1 exons 4 and 5; Set B
ggacaguguuagacauauuuuaauggacacauucag

SEQ ID NO: 22162 - RNA, 24 nt, Artificial Sequence
  Synthetic Oligonucleotide; PD-L1 exons 4 and 5; Set C
uguuagacauauuuuaauggacac

SEQ ID NO: 22163 - RNA, 23 nt, Artificial Sequence
  Synthetic Oligonucleotide; PD-L1 exons 4 and 5; Set C
uguuagacauauuuuaauggaca

SEQ ID NO: 22164 - RNA, 21 nt, Artificial Sequence
  Synthetic Oligonucleotide; PD-L1 exons 4 and 5; Set C
guuagacauauuuuaauggac

SEQ ID NO: 22165 - RNA, 27 nt, Artificial Sequence
  Synthetic Oligonucleotide; PD-L1 exons 4 and 5; Set C
aguguuagacauauuuuaauggacaca

SEQ ID NO: 22166 - RNA, 37 nt, Artificial Sequence
  Synthetic Oligonucleotide; PD-L1 exons 4 and 5; Set C
gggacaguguuagacauauuuuaauggacacauucag

SEQ ID NO: 22167 - RNA, 25 nt, Artificial Sequence
  Synthetic Oligonucleotide; PD-L1 exons 4 and 5; Set C
guguuagacauauuuuaauggacac

SEQ ID NO: 22168 - RNA, 24 nt, Artificial Sequence
  Synthetic Oligonucleotide; PD-L1 exons 4 and 5; Set C
guguuagacauauuuuaauggaca

SEQ ID NO: 22169 - RNA, 22 nt, Artificial Sequence
  Synthetic Oligonucleotide; PD-L1 exons 4 and 5; Set C
uguuagacauauuuuaauggac

SEQ ID NO: 22170 - RNA, 38 nt, Artificial Sequence
  Synthetic Oligonucleotide; PD-L1 exons 4 and 5; Set C
ggggacaguguuagacauauuuuaauggacacauucag

SEQ ID NO: 22171 - RNA, 26 nt, Artificial Sequence
  Synthetic Oligonucleotide; PD-L1 exons 4 and 5; Set C
aguguuagacauauuuuaauggacac

SEQ ID NO: 22172 - RNA, 25 nt, Artificial Sequence
  Synthetic Oligonucleotide; PD-L1 exons 4 and 5; Set C
aguguuagacauauuuuaauggaca

SEQ ID NO: 22173 - RNA, 23 nt, Artificial Sequence
  Synthetic Oligonucleotide; PD-L1 exons 4 and 5; Set C
guguuagacauauuuuaauggac

SEQ ID NO: 22174 - RNA, 39 nt, Artificial Sequence
  Synthetic Oligonucleotide; PD-L1 exons 4 and 5; Set C
aggggacaguguuagacauauuuuaauggacacauucag

SEQ ID NO: 22175 - RNA, 35 nt, Artificial Sequence
  Synthetic Oligonucleotide; PD-L1 exons 4 and 5; Set B
gggacaguguuagacauauuuuaauggacacauuc

SEQ ID NO: 22176 - RNA, 24 nt, Artificial Sequence
  Synthetic Oligonucleotide; PD-L1 exons 4 and 5; Set C
aguguuagacauauuuuaauggac

SEQ ID NO: 22177 - RNA, 32 nt, Artificial Sequence
  Synthetic Oligonucleotide; PD-L1 exons 4 and 5; Set B
ggacaguguuagacauauuuuaauggacacau

SEQ ID NO: 22178 - RNA, 40 nt, Artificial Sequence
  Synthetic Oligonucleotide; PD-L1 exons 4 and 5; Set C
uaggggacaguguuagacauauuuuaauggacacauucag

SEQ ID NO: 22179 - RNA, 36 nt, Artificial Sequence
  Synthetic Oligonucleotide; PD-L1 exons 4 and 5; Set C
ggggacaguguuagacauauuuuaauggacacauuc

SEQ ID NO: 22180 - RNA, 33 nt, Artificial Sequence
  Synthetic Oligonucleotide; PD-L1 exons 4 and 5; Set B
gggacaguguuagacauauuuuaauggacacau

SEQ ID NO: 22181 - RNA, 31 nt, Artificial Sequence
  Synthetic Oligonucleotide; PD-L1 exons 4 and 5; Set B
ggacaguguuagacauauuuuaauggacaca

SEQ ID NO: 22182 - RNA, 37 nt, Artificial Sequence
  Synthetic Oligonucleotide; PD-L1 exons 4 and 5; Set C
aggggacaguguuagacauauuuuaauggacacauuc

SEQ ID NO: 22183 - RNA, 34 nt, Artificial Sequence
  Synthetic Oligonucleotide; PD-L1 exons 4 and 5; Set C
ggggacaguguuagacauauuuuaauggacacau

SEQ ID NO: 22184 - RNA, 32 nt, Artificial Sequence
  Synthetic Oligonucleotide; PD-L1 exons 4 and 5; Set B
gggacaguguuagacauauuuuaauggacaca

SEQ ID NO: 22185 - RNA, 30 nt, Artificial Sequence
  Synthetic Oligonucleotide; PD-L1 exons 4 and 5; Set B
ggacaguguuagacauauuuuaauggacac

SEQ ID NO: 22186 - RNA, 19 nt, Artificial Sequence
  Synthetic Oligonucleotide; PD-L1 exons 4 and 5; Set C
guguuagacauauuuuaau

SEQ ID NO: 22187 - RNA, 37 nt, Artificial Sequence
  Synthetic Oligonucleotide; PD-L1 exons 4 and 5; Set C
uaggggacaguguuagacauauuuuaauggacacauu

SEQ ID NO: 22188 - RNA, 29 nt, Artificial Sequence
  Synthetic Oligonucleotide; PD-L1 exons 4 and 5; Set B
ggacaguguuagacauauuuuaauggaca

SEQ ID NO: 22189 - RNA, 35 nt, Artificial Sequence
  Synthetic Oligonucleotide; PD-L1 exons 4 and 5; Set C
aggggacaguguuagacauauuuuaauggacacau

SEQ ID NO: 22190 - RNA, 33 nt, Artificial Sequence
  Synthetic Oligonucleotide; PD-L1 exons 4 and 5; Set C
ggggacaguguuagacauauuuuaauggacaca

SEQ ID NO: 22191 - RNA, 31 nt, Artificial Sequence
  Synthetic Oligonucleotide; PD-L1 exons 4 and 5; Set B
gggacaguguuagacauauuuuaauggacac

SEQ ID NO: 22192 - RNA, 28 nt, Artificial Sequence
  Synthetic Oligonucleotide; PD-L1 exons 4 and 5; Set B
ggacaguguuagacauauuuuaauggac

SEQ ID NO: 22193 - RNA, 36 nt, Artificial Sequence
  Synthetic Oligonucleotide; PD-L1 exons 4 and 5; Set C
uaggggacaguguuagacauauuuuaauggacacau

SEQ ID NO: 22194 - RNA, 34 nt, Artificial Sequence
  Synthetic Oligonucleotide; PD-L1 exons 4 and 5; Set C
aggggacaguguuagacauauuuuaauggacaca

SEQ ID NO: 22195 - RNA, 32 nt, Artificial Sequence
  Synthetic Oligonucleotide; PD-L1 exons 4 and 5; Set B
ggggacaguguuagacauauuuuaauggacac

SEQ ID NO: 22196 - RNA, 21 nt, Artificial Sequence
  Synthetic Oligonucleotide; PD-L1 exons 4 and 5; Set C
caguguuagacauauuuuaau

SEQ ID NO: 22197 - RNA, 31 nt, Artificial Sequence
  Synthetic Oligonucleotide; PD-L1 exons 4 and 5; Set B
ggggacaguguuagacauauuuuaauggaca

SEQ ID NO: 22198 - RNA, 29 nt, Artificial Sequence
  Synthetic Oligonucleotide; PD-L1 exons 4 and 5; Set B
gggacaguguuagacauauuuuaauggac

SEQ ID NO: 22199 - RNA, 35 nt, Artificial Sequence
  Synthetic Oligonucleotide; PD-L1 exons 4 and 5; Set C
uaggggacaguguuagacauauuuuaauggacaca

SEQ ID NO: 22200 - RNA, 33 nt, Artificial Sequence
  Synthetic Oligonucleotide; PD-L1 exons 4 and 5; Set B
aggggacaguguuagacauauuuuaauggacac

SEQ ID NO: 22201 - RNA, 22 nt, Artificial Sequence
  Synthetic Oligonucleotide; PD-L1 exons 4 and 5; Set C
acaguguuagacauauuuuaau

SEQ ID NO: 22202 - RNA, 30 nt, Artificial Sequence
  Synthetic Oligonucleotide; PD-L1 exons 4 and 5; Set B
ggggacaguguuagacauauuuuaauggac

SEQ ID NO: 22203 - RNA, 34 nt, Artificial Sequence
  Synthetic Oligonucleotide; PD-L1 exons 4 and 5; Set B
uaggggacaguguuagacauauuuuaauggacac

SEQ ID NO: 22204 - RNA, 19 nt, Artificial Sequence
  Synthetic Oligonucleotide; PD-L1 exons 4 and 5; Set C
caguguuagacauauuuua

SEQ ID NO: 22205 - RNA, 23 nt, Artificial Sequence
  Synthetic Oligonucleotide; PD-L1 exons 4 and 5; Set C
gacaguguuagacauauuuuaau

SEQ ID NO: 22206 - RNA, 33 nt, Artificial Sequence
  Synthetic Oligonucleotide; PD-L1 exons 4 and 5; Set B
uaggggacaguguuagacauauuuuaauggaca

SEQ ID NO: 22207 - RNA, 31 nt, Artificial Sequence
  Synthetic Oligonucleotide; PD-L1 exons 4 and 5; Set B
aggggacaguguuagacauauuuuaauggac

SEQ ID NO: 22208 - RNA, 20 nt, Artificial Sequence
  Synthetic Oligonucleotide; PD-L1 exons 4 and 5; Set C
acaguguuagacauauuuua

SEQ ID NO: 22209 - RNA, 18 nt, Artificial Sequence
  Synthetic Oligonucleotide; PD-L1 exons 4 and 5; Set C
caguguuagacauauuuu

SEQ ID NO: 22210 - RNA, 32 nt, Artificial Sequence
  Synthetic Oligonucleotide; PD-L1 exons 4 and 5; Set B
uaggggacaguguuagacauauuuuaauggac

SEQ ID NO: 22211 - RNA, 19 nt, Artificial Sequence
  Synthetic Oligonucleotide; PD-L1 exons 4 and 5; Set C
acaguguuagacauauuuu

SEQ ID NO: 22212 - RNA, 17 nt, Artificial Sequence
  Synthetic Oligonucleotide; PD-L1 exons 4 and 5; Set C
caguguuagacauauuu

SEQ ID NO: 22213 - RNA, 18 nt, Artificial Sequence
  Synthetic Oligonucleotide; PD-L1 exons 4 and 5; Set C
acaguguuagacauauuu

SEQ ID NO: 22214 - RNA, 16 nt, Artificial Sequence
  Synthetic Oligonucleotide; PD-L1 exons 4 and 5; Set C
caguguuagacauauu

SEQ ID NO: 22215 - RNA, 19 nt, Artificial Sequence
  Synthetic Oligonucleotide; PD-L1 exons 4 and 5; Set C
gacaguguuagacauauuu

SEQ ID NO: 22216 - RNA, 17 nt, Artificial Sequence
  Synthetic Oligonucleotide; PD-L1 exons 4 and 5; Set C
acaguguuagacauauu

SEQ ID NO: 22217 - RNA, 18 nt, Artificial Sequence
  Synthetic Oligonucleotide; PD-L1 exons 4 and 5; Set C
gacaguguuagacauauu

SEQ ID NO: 22218 - RNA, 28 nt, Artificial Sequence
  Synthetic Oligonucleotide; PD-L1 exons 4 and 5; Set C
uaggggacaguguuagacauauuuuaau

SEQ ID NO: 22219 - RNA, 18 nt, Artificial Sequence
  Synthetic Oligonucleotide; PD-L1 exons 4 and 5; Set C
ggacaguguuagacauau

SEQ ID NO: 22220 - RNA, 22 nt, Artificial Sequence
  Synthetic Oligonucleotide; PD-L1 exons 4 and 5; Set C
uaggggacaguguuagacauau

SEQ ID NO: 22221 - RNA, 15 nt, Artificial Sequence
  Synthetic Oligonucleotide; PD-L1 exons 4 and 5; Set C
ggggacaguguuaga

SEQ ID NO: 22222 - RNA, 16 nt, Artificial Sequence
  Synthetic Oligonucleotide; PD-L1 exons 4 and 5; Set C
aggggacaguguuaga

SEQ ID NO: 22223 - RNA, 15 nt, Artificial Sequence
  Synthetic Oligonucleotide; PD-L1 exons 4 and 5; Set C
aggggacaguguuag

SEQ ID NO: 22224 - RNA, 16 nt, Artificial Sequence
  Synthetic Oligonucleotide; PD-L1 exons 4 and 5; Set C
uaggggacaguguuag

SEQ ID NO: 22225 - RNA, 15 nt, Artificial Sequence
  Synthetic Oligonucleotide; PD-L1 exons 4 and 5; Set C
ucagggcuuuugcug

SEQ ID NO: 22226 - RNA, 16 nt, Artificial Sequence
  Synthetic Oligonucleotide; PD-L1 exons 4 and 5; Set C
gucagggcuuuugcug

SEQ ID NO: 22227 - RNA, 15 nt, Artificial Sequence
  Synthetic Oligonucleotide; PD-L1 exons 4 and 5; Set C
gucagggcuuuugcu

SEQ ID NO: 22228 - RNA, 24 nt, Artificial Sequence
  Synthetic Oligonucleotide; PD-L1 exons 4 and 5; Set C
aaaaagaagucagggcuuuugcug

SEQ ID NO: 22229 - RNA, 23 nt, Artificial Sequence
  Synthetic Oligonucleotide; PD-L1 exons 4 and 5; Set C
aaaaagaagucagggcuuuugcu

SEQ ID NO: 22230 - RNA, 22 nt, Artificial Sequence
  Synthetic Oligonucleotide; PD-L1 exons 4 and 5; Set C
aaaaagaagucagggcuuuugc

SEQ ID NO: 22231 - RNA, 21 nt, Artificial Sequence
  Synthetic Oligonucleotide; PD-L1 exons 4 and 5; Set C
aaaaagaagucagggcuuuug

SEQ ID NO: 22232 - RNA, 27 nt, Artificial Sequence
  Synthetic Oligonucleotide; PD-L1 exons 4 and 5; Set C
aaacaaaaagaagucagggcuuuugcu

SEQ ID NO: 22233 - RNA, 30 nt, Artificial Sequence
  Synthetic Oligonucleotide; PD-L1 exons 4 and 5; Set C
auaaacaaaaagaagucagggcuuuugcug

SEQ ID NO: 22234 - RNA, 26 nt, Artificial Sequence
  Synthetic Oligonucleotide; PD-L1 exons 4 and 5; Set C
aaacaaaaagaagucagggcuuuugc

SEQ ID NO: 22235 - RNA, 17 nt, Artificial Sequence
  Synthetic Oligonucleotide; PD-L1 exons 4 and 5; Set C
aaaaagaagucagggcu

SEQ ID NO: 22236 - RNA, 25 nt, Artificial Sequence
  Synthetic Oligonucleotide; PD-L1 exons 4 and 5; Set C
aaacaaaaagaagucagggcuuuug

SEQ ID NO: 22237 - RNA, 29 nt, Artificial Sequence
  Synthetic Oligonucleotide; PD-L1 exons 4 and 5; Set C
auaaacaaaaagaagucagggcuuuugcu

SEQ ID NO: 22238 - RNA, 16 nt, Artificial Sequence
  Synthetic Oligonucleotide; PD-L1 exons 4 and 5; Set C
aaaaagaagucagggc

SEQ ID NO: 22239 - RNA, 28 nt, Artificial Sequence
  Synthetic Oligonucleotide; PD-L1 exons 4 and 5; Set C
auaaacaaaaagaagucagggcuuuugc

SEQ ID NO: 22240 - RNA, 15 nt, Artificial Sequence
  Synthetic Oligonucleotide; PD-L1 exons 4 and 5; Set C
aaaaagaagucaggg

SEQ ID NO: 22241 - RNA, 27 nt, Artificial Sequence
  Synthetic Oligonucleotide; PD-L1 exons 4 and 5; Set C
auaaacaaaaagaagucagggcuuuug

SEQ ID NO: 22242 - RNA, 33 nt, Artificial Sequence
  Synthetic Oligonucleotide; PD-L1 exons 4 and 5; Set A
gacauaaacaaaaagaagucagggcuuuugcug

SEQ ID NO: 22243 - RNA, 26 nt, Artificial Sequence
  Synthetic Oligonucleotide; PD-L1 exons 4 and 5; Set C
auaaacaaaaagaagucagggcuuuu

SEQ ID NO: 22244 - RNA, 32 nt, Artificial Sequence
  Synthetic Oligonucleotide; PD-L1 exons 4 and 5; Set A
gacauaaacaaaaagaagucagggcuuuugcu

SEQ ID NO: 22245 - RNA, 27 nt, Artificial Sequence
  Synthetic Oligonucleotide; PD-L1 exons 4 and 5; Set C
cauaaacaaaaagaagucagggcuuuu

SEQ ID NO: 22246 - RNA, 25 nt, Artificial Sequence
  Synthetic Oligonucleotide; PD-L1 exons 4 and 5; Set C
auaaacaaaaagaagucagggcuuu

SEQ ID NO: 22247 - RNA, 31 nt, Artificial Sequence
  Synthetic Oligonucleotide; PD-L1 exons 4 and 5; Set A
gacauaaacaaaaagaagucagggcuuuugc

SEQ ID NO: 22248 - RNA, 28 nt, Artificial Sequence
  Synthetic Oligonucleotide; PD-L1 exons 4 and 5; Set C
acauaaacaaaaagaagucagggcuuuu

SEQ ID NO: 22249 - RNA, 26 nt, Artificial Sequence
  Synthetic Oligonucleotide; PD-L1 exons 4 and 5; Set C
cauaaacaaaaagaagucagggcuuu

SEQ ID NO: 22250 - RNA, 24 nt, Artificial Sequence
  Synthetic Oligonucleotide; PD-L1 exons 4 and 5; Set C
auaaacaaaaagaagucagggcuu

SEQ ID NO: 22251 - RNA, 20 nt, Artificial Sequence
  Synthetic Oligonucleotide; PD-L1 exons 4 and 5; Set C
aaacaaaaagaagucagggc

SEQ ID NO: 22252 - RNA, 30 nt, Artificial Sequence
  Synthetic Oligonucleotide; PD-L1 exons 4 and 5; Set C
gacauaaacaaaaagaagucagggcuuuug

SEQ ID NO: 22253 - RNA, 29 nt, Artificial Sequence
  Synthetic Oligonucleotide; PD-L1 exons 4 and 5; Set C
gacauaaacaaaaagaagucagggcuuuu

SEQ ID NO: 22254 - RNA, 27 nt, Artificial Sequence
  Synthetic Oligonucleotide; PD-L1 exons 4 and 5; Set C
acauaaacaaaaagaagucagggcuuu

SEQ ID NO: 22255 - RNA, 23 nt, Artificial Sequence
  Synthetic Oligonucleotide; PD-L1 exons 4 and 5; Set C
auaaacaaaaagaagucagggcu

SEQ ID NO: 22256 - RNA, 19 nt, Artificial Sequence
  Synthetic Oligonucleotide; PD-L1 exons 4 and 5; Set C
aaacaaaaagaagucaggg

SEQ ID NO: 22257 - RNA, 28 nt, Artificial Sequence
  Synthetic Oligonucleotide; PD-L1 exons 4 and 5; Set C
gacauaaacaaaaagaagucagggcuuu

SEQ ID NO: 22258 - RNA, 22 nt, Artificial Sequence
  Synthetic Oligonucleotide; PD-L1 exons 4 and 5; Set C
auaaacaaaaagaagucagggc

SEQ ID NO: 22259 - RNA, 27 nt, Artificial Sequence
  Synthetic Oligonucleotide; PD-L1 exons 4 and 5; Set C
gacauaaacaaaaagaagucagggcuu

SEQ ID NO: 22260 - RNA, 21 nt, Artificial Sequence
  Synthetic Oligonucleotide; PD-L1 exons 4 and 5; Set C
auaaacaaaaagaagucaggg

SEQ ID NO: 22261 - RNA, 26 nt, Artificial Sequence
  Synthetic Oligonucleotide; PD-L1 exons 4 and 5; Set C
gacauaaacaaaaagaagucagggcu

SEQ ID NO: 22262 - RNA, 25 nt, Artificial Sequence
  Synthetic Oligonucleotide; PD-L1 exons 4 and 5; Set C
gacauaaacaaaaagaagucagggc

SEQ ID NO: 22263 - RNA, 24 nt, Artificial Sequence
  Synthetic Oligonucleotide; PD-L1 exons 4 and 5; Set C
gacauaaacaaaaagaagucaggg

SEQ ID NO: 22264 - RNA, 16 nt, Artificial Sequence
  Synthetic Oligonucleotide; PD-L1 exons 4 and 5; Set C
auaaacaaaaagaagu

SEQ ID NO: 22265 - RNA, 24 nt, Artificial Sequence
  Synthetic Oligonucleotide; PD-L1 exons 4 and 5; Set C
ggacauaaacaaaaagaagucagg

SEQ ID NO: 22266 - RNA, 15 nt, Artificial Sequence
  Synthetic Oligonucleotide; PD-L1 exons 4 and 5; Set C
auaaacaaaaagaag

SEQ ID NO: 22267 - RNA, 25 nt, Artificial Sequence
  Synthetic Oligonucleotide; PD-L1 exons 4 and 5; Set C
aggacauaaacaaaaagaagucagg

SEQ ID NO: 22268 - RNA, 23 nt, Artificial Sequence
  Synthetic Oligonucleotide; PD-L1 exons 4 and 5; Set C
ggacauaaacaaaaagaagucag

SEQ ID NO: 22269 - RNA, 26 nt, Artificial Sequence
  Synthetic Oligonucleotide; PD-L1 exons 4 and 5; Set C
uaggacauaaacaaaaagaagucagg

SEQ ID NO: 22270 - RNA, 22 nt, Artificial Sequence
  Synthetic Oligonucleotide; PD-L1 exons 4 and 5; Set C
ggacauaaacaaaaagaaguca

SEQ ID NO: 22271 - RNA, 24 nt, Artificial Sequence
  Synthetic Oligonucleotide; PD-L1 exons 4 and 5; Set C
aggacauaaacaaaaagaagucag

SEQ ID NO: 22272 - RNA, 19 nt, Artificial Sequence
  Synthetic Oligonucleotide; PD-L1 exons 4 and 5; Set C
gacauaaacaaaaagaagu

SEQ ID NO: 22273 - RNA, 27 nt, Artificial Sequence
  Synthetic Oligonucleotide; PD-L1 exons 4 and 5; Set C
cuaggacauaaacaaaaagaagucagg

SEQ ID NO: 22274 - RNA, 23 nt, Artificial Sequence
  Synthetic Oligonucleotide; PD-L1 exons 4 and 5; Set C
aggacauaaacaaaaagaaguca

SEQ ID NO: 22275 - RNA, 25 nt, Artificial Sequence
  Synthetic Oligonucleotide; PD-L1 exons 4 and 5; Set C
uaggacauaaacaaaaagaagucag

SEQ ID NO: 22276 - RNA, 21 nt, Artificial Sequence
  Synthetic Oligonucleotide; PD-L1 exons 4 and 5; Set C
ggacauaaacaaaaagaaguc

SEQ ID NO: 22277 - RNA, 18 nt, Artificial Sequence
  Synthetic Oligonucleotide; PD-L1 exons 4 and 5; Set C
gacauaaacaaaaagaag

SEQ ID NO: 22278 - RNA, 28 nt, Artificial Sequence
  Synthetic Oligonucleotide; PD-L1 exons 4 and 5; Set C
gcuaggacauaaacaaaaagaagucagg

SEQ ID NO: 22279 - RNA, 24 nt, Artificial Sequence
  Synthetic Oligonucleotide; PD-L1 exons 4 and 5; Set C
uaggacauaaacaaaaagaaguca

SEQ ID NO: 22280 - RNA, 26 nt, Artificial Sequence
  Synthetic Oligonucleotide; PD-L1 exons 4 and 5; Set C
cuaggacauaaacaaaaagaagucag

SEQ ID NO: 22281 - RNA, 22 nt, Artificial Sequence
  Synthetic Oligonucleotide; PD-L1 exons 4 and 5; Set C
aggacauaaacaaaaagaaguc

SEQ ID NO: 22282 - RNA, 17 nt, Artificial Sequence
  Synthetic Oligonucleotide; PD-L1 exons 4 and 5; Set C
gacauaaacaaaaagaa

SEQ ID NO: 22283 - RNA, 29 nt, Artificial Sequence
  Synthetic Oligonucleotide; PD-L1 exons 4 and 5; Set C
ggcuaggacauaaacaaaaagaagucagg

SEQ ID NO: 22284 - RNA, 25 nt, Artificial Sequence
  Synthetic Oligonucleotide; PD-L1 exons 4 and 5; Set C
cuaggacauaaacaaaaagaaguca

SEQ ID NO: 22285 - RNA, 27 nt, Artificial Sequence
  Synthetic Oligonucleotide; PD-L1 exons 4 and 5; Set C
gcuaggacauaaacaaaaagaagucag

SEQ ID NO: 22286 - RNA, 23 nt, Artificial Sequence
  Synthetic Oligonucleotide; PD-L1 exons 4 and 5; Set C
uaggacauaaacaaaaagaaguc

SEQ ID NO: 22287 - RNA, 16 nt, Artificial Sequence
  Synthetic Oligonucleotide; PD-L1 exons 4 and 5; Set C
gacauaaacaaaaaga

SEQ ID NO: 22288 - RNA, 30 nt, Artificial Sequence
  Synthetic Oligonucleotide; PD-L1 exons 4 and 5; Set A
gggcuaggacauaaacaaaaagaagucagg

SEQ ID NO: 22289 - RNA, 26 nt, Artificial Sequence
  Synthetic Oligonucleotide; PD-L1 exons 4 and 5; Set C
gcuaggacauaaacaaaaagaaguca

SEQ ID NO: 22290 - RNA, 28 nt, Artificial Sequence
  Synthetic Oligonucleotide; PD-L1 exons 4 and 5; Set C
ggcuaggacauaaacaaaaagaagucag

SEQ ID NO: 22291 - RNA, 24 nt, Artificial Sequence
  Synthetic Oligonucleotide; PD-L1 exons 4 and 5; Set C
cuaggacauaaacaaaaagaaguc

SEQ ID NO: 22292 - RNA, 31 nt, Artificial Sequence
  Synthetic Oligonucleotide; PD-L1 exons 4 and 5; Set A
ggggcuaggacauaaacaaaaagaagucagg

SEQ ID NO: 22293 - RNA, 27 nt, Artificial Sequence
  Synthetic Oligonucleotide; PD-L1 exons 4 and 5; Set C
ggcuaggacauaaacaaaaagaaguca

SEQ ID NO: 22294 - RNA, 29 nt, Artificial Sequence
  Synthetic Oligonucleotide; PD-L1 exons 4 and 5; Set C
gggcuaggacauaaacaaaaagaagucag

SEQ ID NO: 22295 - RNA, 25 nt, Artificial Sequence
  Synthetic Oligonucleotide; PD-L1 exons 4 and 5; Set C
gcuaggacauaaacaaaaagaaguc

SEQ ID NO: 22296 - RNA, 32 nt, Artificial Sequence
  Synthetic Oligonucleotide; PD-L1 exons 4 and 5; Set A
uggggcuaggacauaaacaaaaagaagucagg

SEQ ID NO: 22297 - RNA, 28 nt, Artificial Sequence
  Synthetic Oligonucleotide; PD-L1 exons 4 and 5; Set C
gggcuaggacauaaacaaaaagaaguca

SEQ ID NO: 22298 - RNA, 30 nt, Artificial Sequence
  Synthetic Oligonucleotide; PD-L1 exons 4 and 5; Set A
ggggcuaggacauaaacaaaaagaagucag

SEQ ID NO: 22299 - RNA, 26 nt, Artificial Sequence
  Synthetic Oligonucleotide; PD-L1 exons 4 and 5; Set C
ggcuaggacauaaacaaaaagaaguc

SEQ ID NO: 22300 - RNA, 33 nt, Artificial Sequence
  Synthetic Oligonucleotide; PD-L1 exons 4 and 5; Set A
auggggcuaggacauaaacaaaaagaagucagg

SEQ ID NO: 22301 - RNA, 29 nt, Artificial Sequence
  Synthetic Oligonucleotide; PD-L1 exons 4 and 5; Set A
ggggcuaggacauaaacaaaaagaaguca

SEQ ID NO: 22302 - RNA, 31 nt, Artificial Sequence
  Synthetic Oligonucleotide; PD-L1 exons 4 and 5; Set A
uggggcuaggacauaaacaaaaagaagucag

SEQ ID NO: 22303 - RNA, 27 nt, Artificial Sequence
  Synthetic Oligonucleotide; PD-L1 exons 4 and 5; Set C
gggcuaggacauaaacaaaaagaaguc

SEQ ID NO: 22304 - RNA, 34 nt, Artificial Sequence
  Synthetic Oligonucleotide; PD-L1 exons 4 and 5; Set A
uauggggcuaggacauaaacaaaaagaagucagg

SEQ ID NO: 22305 - RNA, 30 nt, Artificial Sequence
  Synthetic Oligonucleotide; PD-L1 exons 4 and 5; Set A
uggggcuaggacauaaacaaaaagaaguca

SEQ ID NO: 22306 - RNA, 32 nt, Artificial Sequence
  Synthetic Oligonucleotide; PD-L1 exons 4 and 5; Set A
auggggcuaggacauaaacaaaaagaagucag

SEQ ID NO: 22307 - RNA, 35 nt, Artificial Sequence
  Synthetic Oligonucleotide; PD-L1 exons 4 and 5; Set A
guauggggcuaggacauaaacaaaaagaagucagg

SEQ ID NO: 22308 - RNA, 31 nt, Artificial Sequence
  Synthetic Oligonucleotide; PD-L1 exons 4 and 5; Set A
auggggcuaggacauaaacaaaaagaaguca

SEQ ID NO: 22309 - RNA, 33 nt, Artificial Sequence
  Synthetic Oligonucleotide; PD-L1 exons 4 and 5; Set A
uauggggcuaggacauaaacaaaaagaagucag

SEQ ID NO: 22310 - RNA, 29 nt, Artificial Sequence
  Synthetic Oligonucleotide; PD-L1 exons 4 and 5; Set C
uggggcuaggacauaaacaaaaagaaguc

SEQ ID NO: 22311 - RNA, 36 nt, Artificial Sequence
  Synthetic Oligonucleotide; PD-L1 exons 4 and 5; Set A
uguauggggcuaggacauaaacaaaaagaagucagg

SEQ ID NO: 22312 - RNA, 32 nt, Artificial Sequence
  Synthetic Oligonucleotide; PD-L1 exons 4 and 5; Set A
uauggggcuaggacauaaacaaaaagaaguca

SEQ ID NO: 22313 - RNA, 34 nt, Artificial Sequence
  Synthetic Oligonucleotide; PD-L1 exons 4 and 5; Set A
guauggggcuaggacauaaacaaaaagaagucag

SEQ ID NO: 22314 - RNA, 30 nt, Artificial Sequence
  Synthetic Oligonucleotide; PD-L1 exons 4 and 5; Set C
auggggcuaggacauaaacaaaaagaaguc

SEQ ID NO: 22315 - RNA, 15 nt, Artificial Sequence
  Synthetic Oligonucleotide; PD-L1 exons 4 and 5; Set C
uaggacauaaacaaa

SEQ ID NO: 22316 - RNA, 37 nt, Artificial Sequence
  Synthetic Oligonucleotide; PD-L1 exons 4 and 5; Set A
uuguauggggcuaggacauaaacaaaaagaagucagg

SEQ ID NO: 22317 - RNA, 33 nt, Artificial Sequence
  Synthetic Oligonucleotide; PD-L1 exons 4 and 5; Set A
guauggggcuaggacauaaacaaaaagaaguca

SEQ ID NO: 22318 - RNA, 35 nt, Artificial Sequence
  Synthetic Oligonucleotide; PD-L1 exons 4 and 5; Set A
uguauggggcuaggacauaaacaaaaagaagucag

SEQ ID NO: 22319 - RNA, 31 nt, Artificial Sequence
  Synthetic Oligonucleotide; PD-L1 exons 4 and 5; Set A
uauggggcuaggacauaaacaaaaagaaguc

SEQ ID NO: 22320 - RNA, 16 nt, Artificial Sequence
  Synthetic Oligonucleotide; PD-L1 exons 4 and 5; Set C
cuaggacauaaacaaa

SEQ ID NO: 22321 - RNA, 38 nt, Artificial Sequence
  Synthetic Oligonucleotide; PD-L1 exons 4 and 5; Set A
guuguauggggcuaggacauaaacaaaaagaagucagg

SEQ ID NO: 22322 - RNA, 34 nt, Artificial Sequence
  Synthetic Oligonucleotide; PD-L1 exons 4 and 5; Set A
uguauggggcuaggacauaaacaaaaagaaguca

SEQ ID NO: 22323 - RNA, 36 nt, Artificial Sequence
  Synthetic Oligonucleotide; PD-L1 exons 4 and 5; Set A
uuguauggggcuaggacauaaacaaaaagaagucag

SEQ ID NO: 22324 - RNA, 32 nt, Artificial Sequence
  Synthetic Oligonucleotide; PD-L1 exons 4 and 5; Set A
guauggggcuaggacauaaacaaaaagaaguc

SEQ ID NO: 22325 - RNA, 17 nt, Artificial Sequence
  Synthetic Oligonucleotide; PD-L1 exons 4 and 5; Set C
gcuaggacauaaacaaa

SEQ ID NO: 22326 - RNA, 39 nt, Artificial Sequence
  Synthetic Oligonucleotide; PD-L1 exons 4 and 5; Set A
uguuguauggggcuaggacauaaacaaaaagaagucagg

SEQ ID NO: 22327 - RNA, 35 nt, Artificial Sequence
  Synthetic Oligonucleotide; PD-L1 exons 4 and 5; Set A
uuguauggggcuaggacauaaacaaaaagaaguca

SEQ ID NO: 22328 - RNA, 37 nt, Artificial Sequence
  Synthetic Oligonucleotide; PD-L1 exons 4 and 5; Set A
guuguauggggcuaggacauaaacaaaaagaagucag

SEQ ID NO: 22329 - RNA, 33 nt, Artificial Sequence
  Synthetic Oligonucleotide; PD-L1 exons 4 and 5; Set A
uguauggggcuaggacauaaacaaaaagaaguc

SEQ ID NO: 22330 - RNA, 18 nt, Artificial Sequence
  Synthetic Oligonucleotide; PD-L1 exons 4 and 5; Set C
ggcuaggacauaaacaaa

SEQ ID NO: 22331 - RNA, 40 nt, Artificial Sequence
  Synthetic Oligonucleotide; PD-L1 exons 4 and 5; Set A
uuguuguauggggcuaggacauaaacaaaaagaagucagg

SEQ ID NO: 22332 - RNA, 36 nt, Artificial Sequence
  Synthetic Oligonucleotide; PD-L1 exons 4 and 5; Set A
guuguauggggcuaggacauaaacaaaaagaaguca

SEQ ID NO: 22333 - RNA, 38 nt, Artificial Sequence
  Synthetic Oligonucleotide; PD-L1 exons 4 and 5; Set A
uguuguauggggcuaggacauaaacaaaaagaagucag

SEQ ID NO: 22334 - RNA, 34 nt, Artificial Sequence
  Synthetic Oligonucleotide; PD-L1 exons 4 and 5; Set A
uuguauggggcuaggacauaaacaaaaagaaguc

SEQ ID NO: 22335 - RNA, 19 nt, Artificial Sequence
  Synthetic Oligonucleotide; PD-L1 exons 4 and 5; Set C
gggcuaggacauaaacaaa

SEQ ID NO: 22336 - RNA, 37 nt, Artificial Sequence
  Synthetic Oligonucleotide; PD-L1 exons 4 and 5; Set A
uguuguauggggcuaggacauaaacaaaaagaaguca

SEQ ID NO: 22337 - RNA, 39 nt, Artificial Sequence
  Synthetic Oligonucleotide; PD-L1 exons 4 and 5; Set A
uuguuguauggggcuaggacauaaacaaaaagaagucag

SEQ ID NO: 22338 - RNA, 35 nt, Artificial Sequence
  Synthetic Oligonucleotide; PD-L1 exons 4 and 5; Set A
guuguauggggcuaggacauaaacaaaaagaaguc

SEQ ID NO: 22339 - RNA, 20 nt, Artificial Sequence
  Synthetic Oligonucleotide; PD-L1 exons 4 and 5; Set C
ggggcuaggacauaaacaaa

SEQ ID NO: 22340 - RNA, 38 nt, Artificial Sequence
  Synthetic Oligonucleotide; PD-L1 exons 4 and 5; Set A
uuguuguauggggcuaggacauaaacaaaaagaaguca

SEQ ID NO: 22341 - RNA, 40 nt, Artificial Sequence
  Synthetic Oligonucleotide; PD-L1 exons 4 and 5; Set A
uuuguuguauggggcuaggacauaaacaaaaagaagucag

SEQ ID NO: 22342 - RNA, 36 nt, Artificial Sequence
  Synthetic Oligonucleotide; PD-L1 exons 4 and 5; Set A
uguuguauggggcuaggacauaaacaaaaagaaguc

SEQ ID NO: 22343 - RNA, 21 nt, Artificial Sequence
  Synthetic Oligonucleotide; PD-L1 exons 4 and 5; Set C
uggggcuaggacauaaacaaa

SEQ ID NO: 22344 - RNA, 39 nt, Artificial Sequence
  Synthetic Oligonucleotide; PD-L1 exons 4 and 5; Set A
uuuguuguauggggcuaggacauaaacaaaaagaaguca

SEQ ID NO: 22345 - RNA, 37 nt, Artificial Sequence
  Synthetic Oligonucleotide; PD-L1 exons 4 and 5; Set A
uuguuguauggggcuaggacauaaacaaaaagaaguc

SEQ ID NO: 22346 - RNA, 22 nt, Artificial Sequence
  Synthetic Oligonucleotide; PD-L1 exons 4 and 5; Set C
auggggcuaggacauaaacaaa

SEQ ID NO: 22347 - RNA, 40 nt, Artificial Sequence
  Synthetic Oligonucleotide; PD-L1 exons 4 and 5; Set A
uuuuguuguauggggcuaggacauaaacaaaaagaaguca

SEQ ID NO: 22348 - RNA, 38 nt, Artificial Sequence
  Synthetic Oligonucleotide; PD-L1 exons 4 and 5; Set A
uuuguuguauggggcuaggacauaaacaaaaagaaguc

SEQ ID NO: 22349 - RNA, 23 nt, Artificial Sequence
  Synthetic Oligonucleotide; PD-L1 exons 4 and 5; Set C
uauggggcuaggacauaaacaaa

SEQ ID NO: 22350 - RNA, 39 nt, Artificial Sequence
  Synthetic Oligonucleotide; PD-L1 exons 4 and 5; Set A
uuuuguuguauggggcuaggacauaaacaaaaagaaguc

SEQ ID NO: 22351 - RNA, 24 nt, Artificial Sequence
  Synthetic Oligonucleotide; PD-L1 exons 4 and 5; Set C
guauggggcuaggacauaaacaaa

SEQ ID NO: 22352 - RNA, 40 nt, Artificial Sequence
  Synthetic Oligonucleotide; PD-L1 exons 4 and 5; Set A
auuuuguuguauggggcuaggacauaaacaaaaagaaguc

SEQ ID NO: 22353 - RNA, 40 nt, Artificial Sequence
  Synthetic Oligonucleotide; PD-L1 exons 4 and 5; Set A
gauuuuguuguauggggcuaggacauaaacaaaaagaagu

SEQ ID NO: 22354 - RNA, 39 nt, Artificial Sequence
  Synthetic Oligonucleotide; PD-L1 exons 4 and 5; Set A
gauuuuguuguauggggcuaggacauaaacaaaaagaag

SEQ ID NO: 22355 - RNA, 38 nt, Artificial Sequence
  Synthetic Oligonucleotide; PD-L1 exons 4 and 5; Set A
gauuuuguuguauggggcuaggacauaaacaaaaagaa

SEQ ID NO: 22356 - RNA, 37 nt, Artificial Sequence
  Synthetic Oligonucleotide; PD-L1 exons 4 and 5; Set A
gauuuuguuguauggggcuaggacauaaacaaaaaga

SEQ ID NO: 22357 - RNA, 15 nt, Artificial Sequence
  Synthetic Oligonucleotide; PD-L1 exons 4 and 5; Set C
auggggcuaggacau

SEQ ID NO: 22358 - RNA, 16 nt, Artificial Sequence
  Synthetic Oligonucleotide; PD-L1 exons 4 and 5; Set C
uauggggcuaggacau

SEQ ID NO: 22359 - RNA, 17 nt, Artificial Sequence
  Synthetic Oligonucleotide; PD-L1 exons 4 and 5; Set C
guauggggcuaggacau

SEQ ID NO: 22360 - RNA, 15 nt, Artificial Sequence
  Synthetic Oligonucleotide; PD-L1 exons 4 and 5; Set C
uauggggcuaggaca

SEQ ID NO: 22361 - RNA, 18 nt, Artificial Sequence
  Synthetic Oligonucleotide; PD-L1 exons 4 and 5; Set C
uguauggggcuaggacau

SEQ ID NO: 22362 - RNA, 16 nt, Artificial Sequence
  Synthetic Oligonucleotide; PD-L1 exons 4 and 5; Set C
guauggggcuaggaca

SEQ ID NO: 22363 - RNA, 19 nt, Artificial Sequence
  Synthetic Oligonucleotide; PD-L1 exons 4 and 5; Set C
uuguauggggcuaggacau

SEQ ID NO: 22364 - RNA, 17 nt, Artificial Sequence
  Synthetic Oligonucleotide; PD-L1 exons 4 and 5; Set C
uguauggggcuaggaca

SEQ ID NO: 22365 - RNA, 18 nt, Artificial Sequence
  Synthetic Oligonucleotide; PD-L1 exons 4 and 5; Set C
uuguauggggcuaggaca

SEQ ID NO: 22366 - RNA, 20 nt, Artificial Sequence
  Synthetic Oligonucleotide; PD-L1 exons 4 and 5; Set A
guuguauggggcuaggacau

SEQ ID NO: 22367 - RNA, 21 nt, Artificial Sequence
  Synthetic Oligonucleotide; PD-L1 exons 4 and 5; Set A
uguuguauggggcuaggacau

SEQ ID NO: 22368 - RNA, 19 nt, Artificial Sequence
  Synthetic Oligonucleotide; PD-L1 exons 4 and 5; Set A
guuguauggggcuaggaca

SEQ ID NO: 22369 - RNA, 20 nt, Artificial Sequence
  Synthetic Oligonucleotide; PD-L1 exons 4 and 5; Set A
uguuguauggggcuaggaca

SEQ ID NO: 22370 - RNA, 22 nt, Artificial Sequence
  Synthetic Oligonucleotide; PD-L1 exons 4 and 5; Set A
uuguuguauggggcuaggacau

SEQ ID NO: 22371 - RNA, 23 nt, Artificial Sequence
  Synthetic Oligonucleotide; PD-L1 exons 4 and 5; Set A
uuuguuguauggggcuaggacau

SEQ ID NO: 22372 - RNA, 21 nt, Artificial Sequence
  Synthetic Oligonucleotide; PD-L1 exons 4 and 5; Set A
uuguuguauggggcuaggaca

SEQ ID NO: 22373 - RNA, 22 nt, Artificial Sequence
  Synthetic Oligonucleotide; PD-L1 exons 4 and 5; Set A
uuuguuguauggggcuaggaca

SEQ ID NO: 22374 - RNA, 24 nt, Artificial Sequence
  Synthetic Oligonucleotide; PD-L1 exons 4 and 5; Set A
uuuuguuguauggggcuaggacau

SEQ ID NO: 22375 - RNA, 23 nt, Artificial Sequence
  Synthetic Oligonucleotide; PD-L1 exons 4 and 5; Set A
uuuuguuguauggggcuaggaca

SEQ ID NO: 22376 - RNA, 25 nt, Artificial Sequence
  Synthetic Oligonucleotide; PD-L1 exons 4 and 5; Set A
auuuuguuguauggggcuaggacau

SEQ ID NO: 22377 - RNA, 24 nt, Artificial Sequence
  Synthetic Oligonucleotide; PD-L1 exons 4 and 5; Set A
auuuuguuguauggggcuaggaca

SEQ ID NO: 22378 - RNA, 23 nt, Artificial Sequence
  Synthetic Oligonucleotide; PD-L1 exons 4 and 5; Set A
gauuuuguuguauggggcuagga

SEQ ID NO: 22379 - RNA, 20 nt, Artificial Sequence
  Synthetic Oligonucleotide; PD-L1 exons 4 and 5; Set C
gauuuuguuguauggggcua

SEQ ID NO: 22380 - RNA, 19 nt, Artificial Sequence
  Synthetic Oligonucleotide; PD-L1 exons 4 and 5; Set C
gauuuuguuguauggggcu

SEQ ID NO: 22381 - RNA, 39 nt, Artificial Sequence
  Synthetic Oligonucleotide; PD-L1 exons 4 and 5; Set C
uucuuugguugauuuuguuguauggggcuaggacauaaa

SEQ ID NO: 22382 - RNA, 18 nt, Artificial Sequence
  Synthetic Oligonucleotide; PD-L1 exons 4 and 5; Set C
gauuuuguuguauggggc

SEQ ID NO: 22383 - RNA, 38 nt, Artificial Sequence
  Synthetic Oligonucleotide; PD-L1 exons 4 and 5; Set C
uucuuugguugauuuuguuguauggggcuaggacauaa

SEQ ID NO: 22384 - RNA, 40 nt, Artificial Sequence
  Synthetic Oligonucleotide; PD-L1 exons 4 and 5; Set C
auucuuugguugauuuuguuguauggggcuaggacauaaa

SEQ ID NO: 22385 - RNA, 17 nt, Artificial Sequence
  Synthetic Oligonucleotide; PD-L1 exons 4 and 5; Set C
gauuuuguuguaugggg

SEQ ID NO: 22386 - RNA, 37 nt, Artificial Sequence
  Synthetic Oligonucleotide; PD-L1 exons 4 and 5; Set C
uucuuugguugauuuuguuguauggggcuaggacaua

SEQ ID NO: 22387 - RNA, 16 nt, Artificial Sequence
  Synthetic Oligonucleotide; PD-L1 exons 4 and 5; Set C
gauuuuguuguauggg

SEQ ID NO: 22388 - RNA, 38 nt, Artificial Sequence
  Synthetic Oligonucleotide; PD-L1 exons 4 and 5; Set C
auucuuugguugauuuuguuguauggggcuaggacaua

SEQ ID NO: 22389 - RNA, 15 nt, Artificial Sequence
  Synthetic Oligonucleotide; PD-L1 exons 4 and 5; Set C
gauuuuguuguaugg

SEQ ID NO: 22390 - RNA, 34 nt, Artificial Sequence
  Synthetic Oligonucleotide; PD-L1 exons 4 and 5; Set C
uucuuugguugauuuuguuguauggggcuaggac

SEQ ID NO: 22391 - RNA, 35 nt, Artificial Sequence
  Synthetic Oligonucleotide; PD-L1 exons 4 and 5; Set C
auucuuugguugauuuuguuguauggggcuaggac

SEQ ID NO: 22392 - RNA, 17 nt, Artificial Sequence
  Synthetic Oligonucleotide; PD-L1 exons 4 and 5; Set C
uucuuugguugauuuug

SEQ ID NO: 22393 - RNA, 40 nt, Artificial Sequence
  Synthetic Oligonucleotide; PD-L1 exons 4 and 5; Set C
ccacaaccaaaauucuuugguugauuuuguuguauggggc

SEQ ID NO: 22394 - RNA, 16 nt, Artificial Sequence
  Synthetic Oligonucleotide; PD-L1 exons 4 and 5; Set C
uucuuugguugauuuu

SEQ ID NO: 22395 - RNA, 39 nt, Artificial Sequence
  Synthetic Oligonucleotide; PD-L1 exons 4 and 5; Set C
ccacaaccaaaauucuuugguugauuuuguuguaugggg

SEQ ID NO: 22396 - RNA, 17 nt, Artificial Sequence
  Synthetic Oligonucleotide; PD-L1 exons 4 and 5; Set C
auucuuugguugauuuu

SEQ ID NO: 22397 - RNA, 15 nt, Artificial Sequence
  Synthetic Oligonucleotide; PD-L1 exons 4 and 5; Set C
uucuuugguugauuu

SEQ ID NO: 22398 - RNA, 40 nt, Artificial Sequence
  Synthetic Oligonucleotide; PD-L1 exons 4 and 5; Set C
uccacaaccaaaauucuuugguugauuuuguuguaugggg

SEQ ID NO: 22399 - RNA, 16 nt, Artificial Sequence
  Synthetic Oligonucleotide; PD-L1 exons 4 and 5; Set C
auucuuugguugauuu

SEQ ID NO: 22400 - RNA, 38 nt, Artificial Sequence
  Synthetic Oligonucleotide; PD-L1 exons 4 and 5; Set A
ccacaaccaaaauucuuugguugauuuuguuguauggg

SEQ ID NO: 22401 - RNA, 15 nt, Artificial Sequence
  Synthetic Oligonucleotide; PD-L1 exons 4 and 5; Set C
auucuuugguugauu

SEQ ID NO: 22402 - RNA, 39 nt, Artificial Sequence
  Synthetic Oligonucleotide; PD-L1 exons 4 and 5; Set A
uccacaaccaaaauucuuugguugauuuuguuguauggg

SEQ ID NO: 22403 - RNA, 37 nt, Artificial Sequence
  Synthetic Oligonucleotide; PD-L1 exons 4 and 5; Set A
ccacaaccaaaauucuuugguugauuuuguuguaugg

SEQ ID NO: 22404 - RNA, 40 nt, Artificial Sequence
  Synthetic Oligonucleotide; PD-L1 exons 4 and 5; Set A
auccacaaccaaaauucuuugguugauuuuguuguauggg

SEQ ID NO: 22405 - RNA, 38 nt, Artificial Sequence
  Synthetic Oligonucleotide; PD-L1 exons 4 and 5; Set A
uccacaaccaaaauucuuugguugauuuuguuguaugg

SEQ ID NO: 22406 - RNA, 36 nt, Artificial Sequence
  Synthetic Oligonucleotide; PD-L1 exons 4 and 5; Set A
ccacaaccaaaauucuuugguugauuuuguuguaug

SEQ ID NO: 22407 - RNA, 35 nt, Artificial Sequence
  Synthetic Oligonucleotide; PD-L1 exons 4 and 5; Set A
ccacaaccaaaauucuuugguugauuuuguuguau

SEQ ID NO: 22408 - RNA, 39 nt, Artificial Sequence
  Synthetic Oligonucleotide; PD-L1 exons 4 and 5; Set A
auccacaaccaaaauucuuugguugauuuuguuguaugg

SEQ ID NO: 22409 - RNA, 37 nt, Artificial Sequence
  Synthetic Oligonucleotide; PD-L1 exons 4 and 5; Set A
uccacaaccaaaauucuuugguugauuuuguuguaug

SEQ ID NO: 22410 - RNA, 36 nt, Artificial Sequence
  Synthetic Oligonucleotide; PD-L1 exons 4 and 5; Set A
uccacaaccaaaauucuuugguugauuuuguuguau

SEQ ID NO: 22411 - RNA, 40 nt, Artificial Sequence
  Synthetic Oligonucleotide; PD-L1 exons 4 and 5; Set A
gauccacaaccaaaauucuuugguugauuuuguuguaugg

SEQ ID NO: 22412 - RNA, 38 nt, Artificial Sequence
  Synthetic Oligonucleotide; PD-L1 exons 4 and 5; Set A
auccacaaccaaaauucuuugguugauuuuguuguaug

SEQ ID NO: 22413 - RNA, 35 nt, Artificial Sequence
  Synthetic Oligonucleotide; PD-L1 exons 4 and 5; Set A
uccacaaccaaaauucuuugguugauuuuguugua

SEQ ID NO: 22414 - RNA, 37 nt, Artificial Sequence
  Synthetic Oligonucleotide; PD-L1 exons 4 and 5; Set A
auccacaaccaaaauucuuugguugauuuuguuguau

SEQ ID NO: 22415 - RNA, 39 nt, Artificial Sequence
  Synthetic Oligonucleotide; PD-L1 exons 4 and 5; Set A
gauccacaaccaaaauucuuugguugauuuuguuguaug

SEQ ID NO: 22416 - RNA, 34 nt, Artificial Sequence
  Synthetic Oligonucleotide; PD-L1 exons 4 and 5; Set A
uccacaaccaaaauucuuugguugauuuuguugu

SEQ ID NO: 22417 - RNA, 36 nt, Artificial Sequence
  Synthetic Oligonucleotide; PD-L1 exons 4 and 5; Set A
auccacaaccaaaauucuuugguugauuuuguugua

SEQ ID NO: 22418 - RNA, 38 nt, Artificial Sequence
  Synthetic Oligonucleotide; PD-L1 exons 4 and 5; Set A
gauccacaaccaaaauucuuugguugauuuuguuguau

SEQ ID NO: 22419 - RNA, 40 nt, Artificial Sequence
  Synthetic Oligonucleotide; PD-L1 exons 4 and 5; Set A
ggauccacaaccaaaauucuuugguugauuuuguuguaug

SEQ ID NO: 22420 - RNA, 33 nt, Artificial Sequence
  Synthetic Oligonucleotide; PD-L1 exons 4 and 5; Set A
uccacaaccaaaauucuuugguugauuuuguug

SEQ ID NO: 22421 - RNA, 35 nt, Artificial Sequence
  Synthetic Oligonucleotide; PD-L1 exons 4 and 5; Set A
auccacaaccaaaauucuuugguugauuuuguugu

SEQ ID NO: 22422 - RNA, 37 nt, Artificial Sequence
  Synthetic Oligonucleotide; PD-L1 exons 4 and 5; Set A
gauccacaaccaaaauucuuugguugauuuuguugua

SEQ ID NO: 22423 - RNA, 39 nt, Artificial Sequence
  Synthetic Oligonucleotide; PD-L1 exons 4 and 5; Set A
ggauccacaaccaaaauucuuugguugauuuuguuguau

SEQ ID NO: 22424 - RNA, 34 nt, Artificial Sequence
  Synthetic Oligonucleotide; PD-L1 exons 4 and 5; Set A
auccacaaccaaaauucuuugguugauuuuguug

SEQ ID NO: 22425 - RNA, 36 nt, Artificial Sequence
  Synthetic Oligonucleotide; PD-L1 exons 4 and 5; Set A
gauccacaaccaaaauucuuugguugauuuuguugu

SEQ ID NO: 22426 - RNA, 38 nt, Artificial Sequence
  Synthetic Oligonucleotide; PD-L1 exons 4 and 5; Set A
ggauccacaaccaaaauucuuugguugauuuuguugua

SEQ ID NO: 22427 - RNA, 35 nt, Artificial Sequence
  Synthetic Oligonucleotide; PD-L1 exons 4 and 5; Set A
gauccacaaccaaaauucuuugguugauuuuguug

SEQ ID NO: 22428 - RNA, 33 nt, Artificial Sequence
  Synthetic Oligonucleotide; PD-L1 exons 4 and 5; Set A
auccacaaccaaaauucuuugguugauuuuguu

SEQ ID NO: 22429 - RNA, 37 nt, Artificial Sequence
  Synthetic Oligonucleotide; PD-L1 exons 4 and 5; Set A
ggauccacaaccaaaauucuuugguugauuuuguugu

SEQ ID NO: 22430 - RNA, 34 nt, Artificial Sequence
  Synthetic Oligonucleotide; PD-L1 exons 4 and 5; Set A
gauccacaaccaaaauucuuugguugauuuuguu

SEQ ID NO: 22431 - RNA, 36 nt, Artificial Sequence
  Synthetic Oligonucleotide; PD-L1 exons 4 and 5; Set A
ggauccacaaccaaaauucuuugguugauuuuguug

SEQ ID NO: 22432 - RNA, 33 nt, Artificial Sequence
  Synthetic Oligonucleotide; PD-L1 exons 4 and 5; Set A
gauccacaaccaaaauucuuugguugauuuugu

SEQ ID NO: 22433 - RNA, 35 nt, Artificial Sequence
  Synthetic Oligonucleotide; PD-L1 exons 4 and 5; Set A
ggauccacaaccaaaauucuuugguugauuuuguu

SEQ ID NO: 22434 - RNA, 34 nt, Artificial Sequence
  Synthetic Oligonucleotide; PD-L1 exons 4 and 5; Set A
ggauccacaaccaaaauucuuugguugauuuugu

SEQ ID NO: 22435 - RNA, 32 nt, Artificial Sequence
  Synthetic Oligonucleotide; PD-L1 exons 4 and 5; Set A
gauccacaaccaaaauucuuugguugauuuug

SEQ ID NO: 22436 - RNA, 40 nt, Artificial Sequence
  Synthetic Oligonucleotide; PD-L1 exons 4 and 5; Set C
ugacuggauccacaaccaaaauucuuugguugauuuuguu

SEQ ID NO: 22437 - RNA, 39 nt, Artificial Sequence
  Synthetic Oligonucleotide; PD-L1 exons 4 and 5; Set C
ugacuggauccacaaccaaaauucuuugguugauuuugu

SEQ ID NO: 22438 - RNA, 40 nt, Artificial Sequence
  Synthetic Oligonucleotide; PD-L1 exons 4 and 5; Set C
gugacuggauccacaaccaaaauucuuugguugauuuugu

SEQ ID NO: 22439 - RNA, 38 nt, Artificial Sequence
  Synthetic Oligonucleotide; PD-L1 exons 4 and 5; Set A
ugacuggauccacaaccaaaauucuuugguugauuuug

SEQ ID NO: 22440 - RNA, 37 nt, Artificial Sequence
  Synthetic Oligonucleotide; PD-L1 exons 4 and 5; Set A
ugacuggauccacaaccaaaauucuuugguugauuuu

SEQ ID NO: 22441 - RNA, 39 nt, Artificial Sequence
  Synthetic Oligonucleotide; PD-L1 exons 4 and 5; Set C
gugacuggauccacaaccaaaauucuuugguugauuuug

SEQ ID NO: 22442 - RNA, 38 nt, Artificial Sequence
  Synthetic Oligonucleotide; PD-L1 exons 4 and 5; Set C
gugacuggauccacaaccaaaauucuuugguugauuuu

SEQ ID NO: 22443 - RNA, 36 nt, Artificial Sequence
  Synthetic Oligonucleotide; PD-L1 exons 4 and 5; Set A
ugacuggauccacaaccaaaauucuuugguugauuu

SEQ ID NO: 22444 - RNA, 40 nt, Artificial Sequence
  Synthetic Oligonucleotide; PD-L1 exons 4 and 5; Set C
ggugacuggauccacaaccaaaauucuuugguugauuuug

SEQ ID NO: 22445 - RNA, 39 nt, Artificial Sequence
  Synthetic Oligonucleotide; PD-L1 exons 4 and 5; Set C
ggugacuggauccacaaccaaaauucuuugguugauuuu

SEQ ID NO: 22446 - RNA, 37 nt, Artificial Sequence
  Synthetic Oligonucleotide; PD-L1 exons 4 and 5; Set C
gugacuggauccacaaccaaaauucuuugguugauuu

SEQ ID NO: 22447 - RNA, 38 nt, Artificial Sequence
  Synthetic Oligonucleotide; PD-L1 exons 4 and 5; Set C
ggugacuggauccacaaccaaaauucuuugguugauuu

SEQ ID NO: 22448 - RNA, 36 nt, Artificial Sequence
  Synthetic Oligonucleotide; PD-L1 exons 4 and 5; Set A
gugacuggauccacaaccaaaauucuuugguugauu

SEQ ID NO: 22449 - RNA, 37 nt, Artificial Sequence
  Synthetic Oligonucleotide; PD-L1 exons 4 and 5; Set C
ggugacuggauccacaaccaaaauucuuugguugauu

SEQ ID NO: 22450 - RNA, 18 nt, Artificial Sequence
  Synthetic Oligonucleotide; PD-L1 exons 4 and 5; Set C
gauccacaaccaaaauuc

SEQ ID NO: 22451 - RNA, 19 nt, Artificial Sequence
  Synthetic Oligonucleotide; PD-L1 exons 4 and 5; Set C
ggauccacaaccaaaauuc

SEQ ID NO: 22452 - RNA, 24 nt, Artificial Sequence
  Synthetic Oligonucleotide; PD-L1 exons 4 and 5; Set C
ugacuggauccacaaccaaaauuc

SEQ ID NO: 22453 - RNA, 23 nt, Artificial Sequence
  Synthetic Oligonucleotide; PD-L1 exons 4 and 5; Set C
ugacuggauccacaaccaaaauu

SEQ ID NO: 22454 - RNA, 25 nt, Artificial Sequence
  Synthetic Oligonucleotide; PD-L1 exons 4 and 5; Set C
gugacuggauccacaaccaaaauuc

SEQ ID NO: 22455 - RNA, 24 nt, Artificial Sequence
  Synthetic Oligonucleotide; PD-L1 exons 4 and 5; Set C
gugacuggauccacaaccaaaauu

SEQ ID NO: 22456 - RNA, 25 nt, Artificial Sequence
  Synthetic Oligonucleotide; PD-L1 exons 4 and 5; Set A
ggugacuggauccacaaccaaaauu

SEQ ID NO: 22457 - RNA, 33 nt, Artificial Sequence
  Synthetic Oligonucleotide; PD-L1 exons 4 and 5; Set A
guucagaggugacuggauccacaaccaaaauuc

SEQ ID NO: 22458 - RNA, 32 nt, Artificial Sequence
  Synthetic Oligonucleotide; PD-L1 exons 4 and 5; Set A
guucagaggugacuggauccacaaccaaaauu

SEQ ID NO: 22459 - RNA, 34 nt, Artificial Sequence
  Synthetic Oligonucleotide; PD-L1 exons 4 and 5; Set C
uguucagaggugacuggauccacaaccaaaauuc

SEQ ID NO: 22460 - RNA, 33 nt, Artificial Sequence
  Synthetic Oligonucleotide; PD-L1 exons 4 and 5; Set A
uguucagaggugacuggauccacaaccaaaauu

SEQ ID NO: 22461 - RNA, 35 nt, Artificial Sequence
  Synthetic Oligonucleotide; PD-L1 exons 4 and 5; Set A
auguucagaggugacuggauccacaaccaaaauuc

SEQ ID NO: 22462 - RNA, 34 nt, Artificial Sequence
  Synthetic Oligonucleotide; PD-L1 exons 4 and 5; Set A
auguucagaggugacuggauccacaaccaaaauu

SEQ ID NO: 22463 - RNA, 15 nt, Artificial Sequence
  Synthetic Oligonucleotide; PD-L1 exons 4 and 5; Set C
uucagaggugacugg

SEQ ID NO: 22464 - RNA, 21 nt, Artificial Sequence
  Synthetic Oligonucleotide; PD-L1 exons 4 and 5; Set C
guucauguucagaggugacug

SEQ ID NO: 22465 - RNA, 22 nt, Artificial Sequence
  Synthetic Oligonucleotide; PD-L1 exons 4 and 5; Set C
aguucauguucagaggugacug

SEQ ID NO: 22466 - RNA, 20 nt, Artificial Sequence
  Synthetic Oligonucleotide; PD-L1 exons 4 and 5; Set C
guucauguucagaggugacu

SEQ ID NO: 22467 - RNA, 19 nt, Artificial Sequence
  Synthetic Oligonucleotide; PD-L1 exons 4 and 5; Set C
guucauguucagaggugac

SEQ ID NO: 22468 - RNA, 23 nt, Artificial Sequence
  Synthetic Oligonucleotide; PD-L1 exons 4 and 5; Set A
caguucauguucagaggugacug

SEQ ID NO: 22469 - RNA, 21 nt, Artificial Sequence
  Synthetic Oligonucleotide; PD-L1 exons 4 and 5; Set C
aguucauguucagaggugacu

SEQ ID NO: 22470 - RNA, 26 nt, Artificial Sequence
  Synthetic Oligonucleotide; PD-L1 exons 4 and 5; Set A
gucaguucauguucagaggugacugg

SEQ ID NO: 22471 - RNA, 20 nt, Artificial Sequence
  Synthetic Oligonucleotide; PD-L1 exons 4 and 5; Set C
aguucauguucagaggugac

SEQ ID NO: 22472 - RNA, 24 nt, Artificial Sequence
  Synthetic Oligonucleotide; PD-L1 exons 4 and 5; Set A
ucaguucauguucagaggugacug

SEQ ID NO: 22473 - RNA, 22 nt, Artificial Sequence
  Synthetic Oligonucleotide; PD-L1 exons 4 and 5; Set C
caguucauguucagaggugacu

SEQ ID NO: 22474 - RNA, 29 nt, Artificial Sequence
  Synthetic Oligonucleotide; PD-L1 exons 4 and 5; Set A
augucaguucauguucagaggugacugga

SEQ ID NO: 22475 - RNA, 27 nt, Artificial Sequence
  Synthetic Oligonucleotide; PD-L1 exons 4 and 5; Set A
ugucaguucauguucagaggugacugg

SEQ ID NO: 22476 - RNA, 21 nt, Artificial Sequence
  Synthetic Oligonucleotide; PD-L1 exons 4 and 5; Set C
caguucauguucagaggugac

SEQ ID NO: 22477 - RNA, 23 nt, Artificial Sequence
  Synthetic Oligonucleotide; PD-L1 exons 4 and 5; Set A
ucaguucauguucagaggugacu

SEQ ID NO: 22478 - RNA, 28 nt, Artificial Sequence
  Synthetic Oligonucleotide; PD-L1 exons 4 and 5; Set A
augucaguucauguucagaggugacugg

SEQ ID NO: 22479 - RNA, 22 nt, Artificial Sequence
  Synthetic Oligonucleotide; PD-L1 exons 4 and 5; Set C
ucaguucauguucagaggugac

SEQ ID NO: 22480 - RNA, 15 nt, Artificial Sequence
  Synthetic Oligonucleotide; PD-L1 exons 4 and 5; Set C
guucauguucagagg

SEQ ID NO: 22481 - RNA, 22 nt, Artificial Sequence
  Synthetic Oligonucleotide; PD-L1 exons 4 and 5; Set A
gucaguucauguucagagguga

SEQ ID NO: 22482 - RNA, 21 nt, Artificial Sequence
  Synthetic Oligonucleotide; PD-L1 exons 4 and 5; Set C
gucaguucauguucagaggug

SEQ ID NO: 22483 - RNA, 23 nt, Artificial Sequence
  Synthetic Oligonucleotide; PD-L1 exons 4 and 5; Set A
ugucaguucauguucagagguga

SEQ ID NO: 22484 - RNA, 22 nt, Artificial Sequence
  Synthetic Oligonucleotide; PD-L1 exons 4 and 5; Set C
ugucaguucauguucagaggug

SEQ ID NO: 22485 - RNA, 24 nt, Artificial Sequence
  Synthetic Oligonucleotide; PD-L1 exons 4 and 5; Set A
augucaguucauguucagagguga

SEQ ID NO: 22486 - RNA, 23 nt, Artificial Sequence
  Synthetic Oligonucleotide; PD-L1 exons 4 and 5; Set C
augucaguucauguucagaggug

SEQ ID NO: 22487 - RNA, 22 nt, Artificial Sequence
  Synthetic Oligonucleotide; PD-L1 exons 4 and 5; Set C
augucaguucauguucagaggu

SEQ ID NO: 22488 - RNA, 39 nt, Artificial Sequence
  Synthetic Oligonucleotide; PD-L1 exons 4 and 5; Set C
ucagccugacaugucaguucauguucagaggugacugga

SEQ ID NO: 22489 - RNA, 37 nt, Artificial Sequence
  Synthetic Oligonucleotide; PD-L1 exons 4 and 5; Set C
cagccugacaugucaguucauguucagaggugacugg

SEQ ID NO: 22490 - RNA, 38 nt, Artificial Sequence
  Synthetic Oligonucleotide; PD-L1 exons 4 and 5; Set C
ucagccugacaugucaguucauguucagaggugacugg

SEQ ID NO: 22491 - RNA, 33 nt, Artificial Sequence
  Synthetic Oligonucleotide; PD-L1 exons 4 and 5; Set C
cagccugacaugucaguucauguucagagguga

SEQ ID NO: 22492 - RNA, 15 nt, Artificial Sequence
  Synthetic Oligonucleotide; PD-L1 exons 4 and 5; Set C
augucaguucauguu

SEQ ID NO: 22493 - RNA, 32 nt, Artificial Sequence
  Synthetic Oligonucleotide; PD-L1 exons 4 and 5; Set C
cagccugacaugucaguucauguucagaggug

SEQ ID NO: 22494 - RNA, 34 nt, Artificial Sequence
  Synthetic Oligonucleotide; PD-L1 exons 4 and 5; Set C
ucagccugacaugucaguucauguucagagguga

SEQ ID NO: 22495 - RNA, 31 nt, Artificial Sequence
  Synthetic Oligonucleotide; PD-L1 exons 4 and 5; Set C
cagccugacaugucaguucauguucagaggu

SEQ ID NO: 22496 - RNA, 33 nt, Artificial Sequence
  Synthetic Oligonucleotide; PD-L1 exons 4 and 5; Set C
ucagccugacaugucaguucauguucagaggug

SEQ ID NO: 22497 - RNA, 32 nt, Artificial Sequence
  Synthetic Oligonucleotide; PD-L1 exons 4 and 5; Set C
ucagccugacaugucaguucauguucagaggu

SEQ ID NO: 22498 - RNA, 24 nt, Artificial Sequence
  Synthetic Oligonucleotide; PD-L1 exons 4 and 5; Set A
cagccugacaugucaguucauguu

SEQ ID NO: 22499 - RNA, 25 nt, Artificial Sequence
  Synthetic Oligonucleotide; PD-L1 exons 4 and 5; Set A
ucagccugacaugucaguucauguu

SEQ ID NO: 22500 - RNA, 23 nt, Artificial Sequence
  Synthetic Oligonucleotide; PD-L1 exons 4 and 5; Set A
cagccugacaugucaguucaugu

SEQ ID NO: 22501 - RNA, 24 nt, Artificial Sequence
  Synthetic Oligonucleotide; PD-L1 exons 4 and 5; Set A
ucagccugacaugucaguucaugu

SEQ ID NO: 22502 - RNA, 18 nt, Artificial Sequence
  Synthetic Oligonucleotide; PD-L1 exons 4 and 5; Set C
cagccugacaugucaguu

SEQ ID NO: 22503 - RNA, 17 nt, Artificial Sequence
  Synthetic Oligonucleotide; PD-L1 exons 4 and 5; Set C
cagccugacaugucagu

SEQ ID NO: 22504 - RNA, 19 nt, Artificial Sequence
  Synthetic Oligonucleotide; PD-L1 exons 4 and 5; Set C
ucagccugacaugucaguu

SEQ ID NO: 22505 - RNA, 31 nt, Artificial Sequence
  Synthetic Oligonucleotide; PD-L1 exons 4 and 5; Set C
uagcccucagccugacaugucaguucauguu

SEQ ID NO: 22506 - RNA, 16 nt, Artificial Sequence
  Synthetic Oligonucleotide; PD-L1 exons 4 and 5; Set C
cagccugacaugucag

SEQ ID NO: 22507 - RNA, 18 nt, Artificial Sequence
  Synthetic Oligonucleotide; PD-L1 exons 4 and 5; Set C
ucagccugacaugucagu

SEQ ID NO: 22508 - RNA, 32 nt, Artificial Sequence
  Synthetic Oligonucleotide; PD-L1 exons 4 and 5; Set C
guagcccucagccugacaugucaguucauguu

SEQ ID NO: 22509 - RNA, 30 nt, Artificial Sequence
  Synthetic Oligonucleotide; PD-L1 exons 4 and 5; Set C
uagcccucagccugacaugucaguucaugu

SEQ ID NO: 22510 - RNA, 15 nt, Artificial Sequence
  Synthetic Oligonucleotide; PD-L1 exons 4 and 5; Set C
cagccugacauguca

SEQ ID NO: 22511 - RNA, 17 nt, Artificial Sequence
  Synthetic Oligonucleotide; PD-L1 exons 4 and 5; Set C
ucagccugacaugucag

SEQ ID NO: 22512 - RNA, 33 nt, Artificial Sequence
  Synthetic Oligonucleotide; PD-L1 exons 4 and 5; Set C
gguagcccucagccugacaugucaguucauguu

SEQ ID NO: 22513 - RNA, 31 nt, Artificial Sequence
  Synthetic Oligonucleotide; PD-L1 exons 4 and 5; Set C
guagcccucagccugacaugucaguucaugu

SEQ ID NO: 22514 - RNA, 29 nt, Artificial Sequence
  Synthetic Oligonucleotide; PD-L1 exons 4 and 5; Set C
uagcccucagccugacaugucaguucaug

SEQ ID NO: 22515 - RNA, 16 nt, Artificial Sequence
  Synthetic Oligonucleotide; PD-L1 exons 4 and 5; Set C
ucagccugacauguca

SEQ ID NO: 22516 - RNA, 34 nt, Artificial Sequence
  Synthetic Oligonucleotide; PD-L1 exons 4 and 5; Set C
ggguagcccucagccugacaugucaguucauguu

SEQ ID NO: 22517 - RNA, 32 nt, Artificial Sequence
  Synthetic Oligonucleotide; PD-L1 exons 4 and 5; Set C
gguagcccucagccugacaugucaguucaugu

SEQ ID NO: 22518 - RNA, 30 nt, Artificial Sequence
  Synthetic Oligonucleotide; PD-L1 exons 4 and 5; Set C
guagcccucagccugacaugucaguucaug

SEQ ID NO: 22519 - RNA, 33 nt, Artificial Sequence
  Synthetic Oligonucleotide; PD-L1 exons 4 and 5; Set C
ggguagcccucagccugacaugucaguucaugu

SEQ ID NO: 22520 - RNA, 31 nt, Artificial Sequence
  Synthetic Oligonucleotide; PD-L1 exons 4 and 5; Set C
gguagcccucagccugacaugucaguucaug

SEQ ID NO: 22521 - RNA, 32 nt, Artificial Sequence
  Synthetic Oligonucleotide; PD-L1 exons 4 and 5; Set C
ggguagcccucagccugacaugucaguucaug

SEQ ID NO: 22522 - RNA, 25 nt, Artificial Sequence
  Synthetic Oligonucleotide; PD-L1 exons 4 and 5; Set C
uagcccucagccugacaugucaguu

SEQ ID NO: 22523 - RNA, 24 nt, Artificial Sequence
  Synthetic Oligonucleotide; PD-L1 exons 4 and 5; Set C
uagcccucagccugacaugucagu

SEQ ID NO: 22524 - RNA, 23 nt, Artificial Sequence
  Synthetic Oligonucleotide; PD-L1 exons 4 and 5; Set A
uagcccucagccugacaugucag

SEQ ID NO: 22525 - RNA, 22 nt, Artificial Sequence
  Synthetic Oligonucleotide; PD-L1 exons 4 and 5; Set A
uagcccucagccugacauguca

SEQ ID NO: 22526 - RNA, 24 nt, Artificial Sequence
  Synthetic Oligonucleotide; PD-L1 exons 4 and 5; Set C
guagcccucagccugacaugucag

SEQ ID NO: 22527 - RNA, 23 nt, Artificial Sequence
  Synthetic Oligonucleotide; PD-L1 exons 4 and 5; Set C
guagcccucagccugacauguca

SEQ ID NO: 22528 - RNA, 25 nt, Artificial Sequence
  Synthetic Oligonucleotide; PD-L1 exons 4 and 5; Set C
gguagcccucagccugacaugucag

SEQ ID NO: 22529 - RNA, 27 nt, Artificial Sequence
  Synthetic Oligonucleotide; PD-L1 exons 4 and 5; Set C
ggguagcccucagccugacaugucagu

SEQ ID NO: 22530 - RNA, 24 nt, Artificial Sequence
  Synthetic Oligonucleotide; PD-L1 exons 4 and 5; Set C
gguagcccucagccugacauguca

SEQ ID NO: 22531 - RNA, 26 nt, Artificial Sequence
  Synthetic Oligonucleotide; PD-L1 exons 4 and 5; Set C
ggguagcccucagccugacaugucag

SEQ ID NO: 22532 - RNA, 25 nt, Artificial Sequence
  Synthetic Oligonucleotide; PD-L1 exons 4 and 5; Set C
ggguagcccucagccugacauguca

SEQ ID NO: 22533 - RNA, 35 nt, Artificial Sequence
  Synthetic Oligonucleotide; PD-L1 exons 4 and 5; Set C
ggccuugggguagcccucagccugacaugucaguu

SEQ ID NO: 22534 - RNA, 34 nt, Artificial Sequence
  Synthetic Oligonucleotide; PD-L1 exons 4 and 5; Set C
ggccuugggguagcccucagccugacaugucagu

SEQ ID NO: 22535 - RNA, 36 nt, Artificial Sequence
  Synthetic Oligonucleotide; PD-L1 exons 4 and 5; Set C
cggccuugggguagcccucagccugacaugucaguu

SEQ ID NO: 22536 - RNA, 33 nt, Artificial Sequence
  Synthetic Oligonucleotide; PD-L1 exons 4 and 5; Set C
ggccuugggguagcccucagccugacaugucag

SEQ ID NO: 22537 - RNA, 35 nt, Artificial Sequence
  Synthetic Oligonucleotide; PD-L1 exons 4 and 5; Set C
cggccuugggguagcccucagccugacaugucagu

SEQ ID NO: 22538 - RNA, 32 nt, Artificial Sequence
  Synthetic Oligonucleotide; PD-L1 exons 4 and 5; Set C
ggccuugggguagcccucagccugacauguca

SEQ ID NO: 22539 - RNA, 34 nt, Artificial Sequence
  Synthetic Oligonucleotide; PD-L1 exons 4 and 5; Set C
cggccuugggguagcccucagccugacaugucag

SEQ ID NO: 22540 - RNA, 33 nt, Artificial Sequence
  Synthetic Oligonucleotide; PD-L1 exons 4 and 5; Set C
cggccuugggguagcccucagccugacauguca

SEQ ID NO: 22541 - RNA, 40 nt, Artificial Sequence
  Synthetic Oligonucleotide; PD-L1 exons 4 and 5; Set C
acuucggccuugggguagcccucagccugacaugucaguu

SEQ ID NO: 22542 - RNA, 39 nt, Artificial Sequence
  Synthetic Oligonucleotide; PD-L1 exons 4 and 5; Set C
acuucggccuugggguagcccucagccugacaugucagu

SEQ ID NO: 22543 - RNA, 38 nt, Artificial Sequence
  Synthetic Oligonucleotide; PD-L1 exons 4 and 5; Set C
acuucggccuugggguagcccucagccugacaugucag

SEQ ID NO: 22544 - RNA, 40 nt, Artificial Sequence
  Synthetic Oligonucleotide; PD-L1 exons 4 and 5; Set C
gacuucggccuugggguagcccucagccugacaugucagu

SEQ ID NO: 22545 - RNA, 37 nt, Artificial Sequence
  Synthetic Oligonucleotide; PD-L1 exons 4 and 5; Set C
acuucggccuugggguagcccucagccugacauguca

SEQ ID NO: 22546 - RNA, 39 nt, Artificial Sequence
  Synthetic Oligonucleotide; PD-L1 exons 4 and 5; Set C
gacuucggccuugggguagcccucagccugacaugucag

SEQ ID NO: 22547 - RNA, 38 nt, Artificial Sequence
  Synthetic Oligonucleotide; PD-L1 exons 4 and 5; Set C
gacuucggccuugggguagcccucagccugacauguca

SEQ ID NO: 22548 - RNA, 40 nt, Artificial Sequence
  Synthetic Oligonucleotide; PD-L1 exons 4 and 5; Set C
ugacuucggccuugggguagcccucagccugacaugucag

SEQ ID NO: 22549 - RNA, 39 nt, Artificial Sequence
  Synthetic Oligonucleotide; PD-L1 exons 4 and 5; Set C
ugacuucggccuugggguagcccucagccugacauguca

SEQ ID NO: 22550 - RNA, 22 nt, Artificial Sequence
  Synthetic Oligonucleotide; PD-L1 exons 4 and 5; Set C
ucggccuugggguagcccucag

SEQ ID NO: 22551 - RNA, 21 nt, Artificial Sequence
  Synthetic Oligonucleotide; PD-L1 exons 4 and 5; Set C
ucggccuugggguagcccuca

SEQ ID NO: 22552 - RNA, 24 nt, Artificial Sequence
  Synthetic Oligonucleotide; PD-L1 exons 4 and 5; Set C
cuucggccuugggguagcccucag

SEQ ID NO: 22553 - RNA, 22 nt, Artificial Sequence
  Synthetic Oligonucleotide; PD-L1 exons 4 and 5; Set C
uucggccuugggguagcccuca

SEQ ID NO: 22554 - RNA, 25 nt, Artificial Sequence
  Synthetic Oligonucleotide; PD-L1 exons 4 and 5; Set C
acuucggccuugggguagcccucag

SEQ ID NO: 22555 - RNA, 23 nt, Artificial Sequence
  Synthetic Oligonucleotide; PD-L1 exons 4 and 5; Set C
cuucggccuugggguagcccuca

SEQ ID NO: 22556 - RNA, 26 nt, Artificial Sequence
  Synthetic Oligonucleotide; PD-L1 exons 4 and 5; Set C
gacuucggccuugggguagcccucag

SEQ ID NO: 22557 - RNA, 24 nt, Artificial Sequence
  Synthetic Oligonucleotide; PD-L1 exons 4 and 5; Set C
acuucggccuugggguagcccuca

(The sequence listing continues in the following parts.)

The invention claimed is:

1. An antisense oligonucleotide which modulates one or more of: T-cell ability to kill or exert a cytotoxic, anti-tumour or antiviral effect, T-cell ability to produce an anti-viral cytokine, T-cell expansion,
   wherein the antisense oligonucleotide modulates expression of an immune-related or immunomodulatory gene expressed by the T-cell by altering isoform expression of PD-1,
   wherein the antisense oligonucleotide is capable of inducing exon skipping by annealing to the pre-mRNA of the immune-related or immunomodulatory gene,
   and wherein the antisense oligonucleotide has either a maximum length of 30 nucleotides and comprises the sequence of SEQ ID NO: 6508 or consists of the sequence of SEQ ID NO: 69648.

2. The antisense oligonucleotide according to claim 1, wherein specific hybridization of the oligonucleotide to a target region of a PD-1 RNA in exon 2 switches membrane-bound PD-1 expression to soluble isoform PD-1 expression.

3. The antisense oligonucleotide according to claim 1, wherein the antisense oligonucleotide comprises a modified polynucleotide backbone.

4. The antisense oligonucleotide according to claim 3, wherein the modified polynucleotide backbone comprises at least one modified internucleotide linkage.

5. The antisense oligonucleotide according to claim 1, wherein the antisense oligonucleotide comprises a backbone which is selected from the group comprising of ribonucleic acid, deoxyribonucleic acid, DNA phosphorothioate, RNA phosphorothioate, 2'-O-methyl-oligoribonucleotide and 2'-O-methyl-oligodeoxyribonucleotide, 2'-O-hydrocarbyl ribonucleic acid, 2'-O-hydrocarbyl DNA, 2'-O-hydrocarbyl RNA phosphorothioate, 2'-O-hydrocarbyl DNA phosphorothioate, 2'-F-phosphorothioate, 2'-F-phosphodiester, 2'-methoxyethyl phosphorothioate, 2-methoxyethyl phosphodiester, deoxy methylene (methylimino) (deoxy MMI), 2'-O-hydrocarby MMI, deoxy-methylphos-phonate, 2'-O-hydrocarbyl methylphosphonate, morpholino, 4'-thio DNA, 4'-thio RNA, peptide nucleic acid, 3'-amidate, deoxy 3'-amidate, 2'-O-hydrocarbyl 3'-amidate, locked nucleic acid, cyclohexane nucleic acid, tricycle-DNA, 2'fluoro-arabino nucleic acid, N3'-P5' phosphoroamidate, carbamate linked, phosphotriester linked, a nylon backbone modification and mixtures of the aforementioned backbones.

6. The antisense oligonucleotide according to claim 1, wherein the oligonucleotide is chemically linked to one or more conjugates that enhance the activity, cellular distribution, or cellular uptake of the antisense oligonucleotide.

7. A method of treating a disease in a patient, the method comprising administering an antisense oligonucleotide according to claim 1, wherein the disease is cancer and/or a viral infection, or an autoimmune disease.

8. The method according to claim 7, wherein the antisense oligonucleotide has been transfected in a T cell, and the method comprising administering the transfected T cell to the patient.

9. An isolated T-cell transformed or transfected with an antisense oligonucleotide according to claim 1.

10. The antisense oligonucleotide according to claim 1, wherein the antisense oligonucleotide has a backbone comprising ribonucleic acid (RNA) or chemically modified RNA.

11. The antisense oligonucleotide according to claim 3, wherein the modified polynucleotide backbone comprises a modified sugar moiety.

12. The antisense oligonucleotide according to claim 11, wherein the modified moiety selected from the group consisting of phosphorodiamidate morpholino oligomer (PMO), peptide-conjugated phosphorodiamidate morpholino oligomer (PPMO), and non-peptide dendrimeric octaguanidine moiety-tagged morpholino oligomer.

13. The antisense oligonucleotide according to claim 4, wherein the modified internucleotide linkage comprises a modified phosphate.

14. The antisense oligonucleotide according to claim 13, wherein the modified phosphate is selected from the group comprising of a non-bridging oxygen atom substituting a sulfur atom, a phosphonate, a phosphorothioate, a phosphodiester, a phosphoromorpholidate, a phosphoropiperazidate and a phosphoroamidate.

15. The method according to claim 7, wherein the disease is cancer, and the patient is administered a further anti-cancer agent or treatment.

16. The method according to claim 8, wherein the antisense oligonucleotide is transfected or introduced to the T cell by any one selected from the group comprising: sonophoresis, electric pulsing, electroporation, osmotic shock, calcium phosphate precipitation, and DEAE dextran transfection, lipid mediated delivery, and passive delivery.

17. An antisense oligonucleotide having a maximum length of 30 nucleotides and comprising the sequence of SEQ ID NO: 6508.

18. An antisense oligonucleotide consisting of the sequence of SEQ ID NO: 69648, wherein the antisense oligonucleotide is a chemically modified RNA comprising at least one 2'-O-methoxyethyl modification.

19. The antisense oligonucleotide according to claim 17, wherein the antisense oligonucleotide is a chemically modified RNA comprising at least one 2'-O-methoxyethyl modification.

20. The antisense oligonucleotide according to claim 18, wherein the antisense oligonucleotide is a chemically modified RNA comprising a backbone comprising 2'-methoxyethyl phosphorothioate.

21. The antisense oligonucleotide according to claim 19, wherein the antisense oligonucleotide is a chemically modified RNA comprising a backbone comprising 2'-methoxyethyl phosphorothioate.

22. The method according to claim 7, wherein a pharmaceutical composition comprising the antisense oligonucleotide and a pharmaceutically acceptable carrier is administered, and wherein the carrier is selected from the group consisting of a nanoparticle, a liposome, a pH-sensitive liposome, an antibody conjugated liposome, a viral vector, a cationic lipid, a polymer, a UsnRNA, a U7 snRNA, and a cell penetrating peptide.

23. The method according to claim 22, wherein the administration is oral, or rectal, or transmucosal, or intestinal, or intramuscular, or subcutaneous, or intramedullary, or intrathecal, or direct intraventricular, or intravenous, or intravitreal, or intraperitoneal, or intranasal, or intraocular.

24. The method according to claim 7, wherein the disease is a cancer selected from the group consisting of hepatitis B virus induced hepatocellular carcinoma and Epstein-Barr virus induced Non-Hodgkin Lymphoma.

* * * * *